United States Patent 9,976,180 (METHODS FOR DETECTING A GENETIC VARIATION IN SUBJECTS WITH PARKINSONISM) - sequence listing, part 41

SEQ ID NO: 527 - DNA, 639023 bp, Homo sapiens
agtactgaaattaagcagcatccaacacaggcctactcttacgacatgtgactttactgttttccgtttttgttgaaagagtcattaacagttaggagttgatggcagtttcaataacaggtcattgccgagaaaaggtaagttttaactttatattgtacatgaaatttaaacttgaacatgttcggcagagtttcctacattttggtgtgaacatataaacatttctacaaaatatgacgcttttacctgtgattaaaacattggctggtttcctttgatgtagaaaagaatgttcttttcatatttgcagctgtcaaattccaatgtcttttactaaaatgttataataataagatgatttgctaagattttgtactaaaatgttaaagacagaataagttataaagttttagtttgaagtgcatttaaaaataactactagaaataatgtgagactttgcacctttaaccaactgttttataaaaatatgtattgttcaacatccagataaggaaagagaaaagggtataacaatgagaaatagcttgaatttcagtgtgaaagatactcactttaaagcattgtattaatgttagcactaaaaacccttaaaaaggttactatgtagctaattaaaaagcaaggagcttttaaaatgtaaaggaatactgtctatcatgacacttgaaattttttttctaaatttcatttaagatatagggtgaaatgagtgtaagtttctaattcataagcaaacttttatatttaaaaaagaagtcacagctgatttcattgaaggttactctgagaggagaggcaaattagaggtatacttttgttatttatgtaattatataattttccttctttgaaatattccaaaataataaaccttagaaatgaaaaggatttgttagtcctaaactgacatgtaattttcttttatattgacttcttgcttttacagaatgtctttgtgtgctgtaacatatgtgcagaaaacatcaaaatattgctaatctcagagacaaatacctaaaataaatctgactgtagatttttgaaagaattttaataacagcccaagatatgatccattcttccctaatattatttttattgtgctgctggatgggagaagtgatggcccccacaacacctattttttgtgttattaaaaaatggttacagggttgataagtggcaacaattttcttttcttttattgtcttctattgaaagacacacataaatgttttttgacatggtcaatttagtaggaaattattaggcatagtagtacactccattttaagacctcttcaattgtcaatactgaagctagctacttgttgactattaaaatgatcacagaaaaatagagattaggacttggtgttcaatacattttttattgttagcatgtaagaagaccctggtaatatatatttgctttgatattgtgattagattttcaatttgttgcatttcctcacaatggaaagcattatttaaatctgtcttcaatatcgtggttctgaacctctgcatctatagaagctgtataattctgataattttggttgatatgttattactttctttcattttattataaaagaatatcaaatgaataaacacatgcaatacttacaccttagcaagaatgaatatgcagataaacatctggcattgaggaaaagtccatgaaaattttttaaattgtttaatgcttttaaaaaagaaattcactgtaaaaatgagtgtttcttgcagaaactgttaaattaaaatacacatattttatggaatatgtgtaaaattaagaatgaattgaagagagcttgatatgaatttagaaagatcaatgagtaaagatgataggtaaattaaaataccttcagaattgtttgtaaagagcagtaaggtacaaaccaaattttaagacagttaattgcaaataagttactatagaattctattactttatatgttttaagtggatgagtcagaaacaagttttgatgaaatgaaaataatacggaagattttatttggaaagtcatattaaagctaatttgctcaaagaatgtcgtgcttttccacttagggccagcattcagtaagattcagaaaggagaaactctttccttgatattcctcctgttgctcctttttattattctcttctggagcggcctgctctgctcctaatttagagtcccatagacttggtacctagaaagatagacccttccattcactggctccttccattcaactgaacttttaaaatgtactcatcccattttccagcacttagggaatctaataaaaataatccacgcttataggagaaggctacagagctttgacttcctagccaggcctccctttctccccccagtggaattttaatatgtttcctcagcagacagggcccaaaggattagctaaatgttggatctcaagtgaggagactgatgccatggtaaatggttgggggaagactttagagggagagtgttttgttaaccattggtcctgcctgtggcatttaaacacagaatttctggaagtgtctcatatgaaggatccatcccagtgatgtatccatttctttaagatagtcctgaagaaataaacacctttcttgcagcaggtaaaaaaaaaaaaatattgcactacattttcaggcaattttgatattcccatacacttagaaattatttaacataattagtttttaatagatgtattttaaaagtcattgaacactctgaatttaattctttggatactaaaagcatattttttacactgtacaataaatgctacataattagactttaaaatgcccttgtaagtattctaaatttgagcttagagtgtgcaaaacttctttgttggcaaacgatagaaaatgagttcaaactagcctaggcaaaagagatattcttttatgtgtgaaaagtctaaggatagcaaagtcaggaatggctggatccaggagctcacacaggattatcaggagtaggtctcatttttttcattcctcagctcttcttttcactatgctgtaagcagtctctagtggaagctctcacgaaattgtcaagctcctactgagttgatcctttcagcaaactgtggggaaagaatgcttttccccagtcaccacagcaaagtgtcagatttagatctgatgggactgaattggatcacatgaccatagctgaacaattactgaacttgggtgcagacagcatgcgtgaccatgcctagctcacaggcccactcctgcactgggggcagctacagctgcagcacttgggctctctgctaaaaagaggggtctcctgatgtagaaattaaaatgctttccccagaagaaaggacaaaagcctcaaaattctactacggagtcacgtatggtcacattttaaacagtcattatttcccaacttcttcaaattccataattgtacaaaaatacagttttaattgaaaggcggatctgattgaaacatgagtttgaattaaactaaattttaaaatatttttcaacagctactgtatgtttgacaactcctcacaacatttgccttctaaaagcttataatccagagtgactattattttaataattatgatgcaaatacaatttgtcaagtaccataagaagatacagagaatgctctattagagttcagaaattcatccagcatttttgcattcctgttatttgccgagccataaactagagaattttgtaagtgttgtatcatctgatcacatactttcagggagttctggacagttttggaggaaagttttgtggtagttttcagggaaatctagcactgggaagatgagaaacattgcaagggacaggaaggaaatatgtcaaggcacaaaaacacggcgtgtcagagaattccaaagtagtgtgaattctccagttttgttagacagaagtatagtaataagaggtaggccagaaagatagtgtgagatcataaatagagtagacctggatataagtaacagcagggtttttgagcaggggagatacgtaattggatgtccacacttttacatcttgatgggttgtctgtctagggtcaggatgtatttgtttcttccatttatctcactgtgaagtgacattttctttgcagaagagtttgaagtcagtggagatatttctgtaaggacaggcactgacttacctgttcaggtgcctgaggttcttattcaagttatggttataacaatcttttttttcatttgatgaaggccttttgtttgttttgtttgcttttaatttaagaatagatgatatagtgagatggttcaaaatcaatataaaaccaaaacacaatgtttttagataagctatttcttatatttttatttctatctatcccatttatccccatcttaatccaacgtaaccacttttcatgtttaatatatatatttatacttcacagtttatgtaaaaaccatatatatatgcacatctatgtgtgtatgtatataacataactgcacgcacctctccactttgctttttttcttttagaaatatagattagagatattttataacaaaactaaggaactaattctcttttttacagctgtatactattccactatatggaaatatcatacttaatttaaccagcctcctgtaaaaagagtgatggatgttttcaagtttttctaattcaatgaatgtccatgtaattgtttctatttgaaaatctatctatctatctatctatctatctatctatctatctatctatctacctatctatctatcatctatctatctatcatctatctatctacctatctatctatcacacatttccagaaataacatttatgagacaaaggataaaataattttgatagttgttgccaaactatccttcatgttatttgtaactttttgaacttccaccagcacttaatgagaatgcttgcagaagcttcattgctttttcaagggattgtgttgccaagctttgcaggttttgccagtctctaacaactgcatctcaacacagttttattgatatttctgctattatggttaaaattgatcttctttttaaaagattaaaggtcgatttgctttccttgtaagaaaatgtattctttctcagctgtataactaaagaccaaaacattagtgactttagtgacactcaagccttggagtgagatgtcaaaggaagcaaagaactagagatagcatatatgaaatgctgtattccttttcttttttttttttttttttttgagacggagtctcactctgtcacccaagctggagtgcagtggtgcaatctcggctcactgcaagctcggcctcccgggttcatgccagtctcctgcctcagcctcctgagtagctgggactacaggtgcctgccaccaagcccagctaatttttttttgtatttttagtagagtcggggtttcacggtgttagccaggatggtgtcgatctcctgacctcgtgatctgcccaccttgacctcccaaagtgctgggattacaggcgtgagagcgcgcccagcctaaatgctgtattccttttctaaagcttgaaatagacagtagcttaaaagggggataaaatatgaatgttcaagtgaaggaggagaaaaggaatgaaaataaaggaacccaacaaggtctcagaggagactaagacagatgggtataatcactggctcaagtagatgaattaaccttaaacagaagagagagcactttaatgagcgtgaatgcagatgaattggatataagtaagattcagtgaggagaggaatttgagggaatacatgcttcatagtttctatctttgcctaaatggtgggaaagttcatctgatgaaagcattttctgcatgtcaaaaactagacagaatatcttattttaaaacttatccttgtcagtaacacacaatacaattgtggattttgcaacttattttttatcttttgctggttattagtccaattccattcaactccataaataattttgaactctaagtatactatgttgtcctaaggattgctggagatacaaagaaatagatatgctacttagccaatgaaaactgtttagtaggtaagaggtacacaaagataagtatctaaatatcaattatacatataagtccagtgccatagaaatattatagaatataccattgacagaatcccaaaggtcttcattttgccaaatctaatagccatttatgtatctttatattattcactgtctgagctgcatttgatgctatcgaaccctccttccctcttgaaactctcttttcatttgacttctggaatacttttttcttccagttttcctccaaactacctgaatgctctttctgtatcctttgctaacactttctcatcatctagctctctaaatgttggaatgtcctgagatcagtctttggatttctacttgtcttctaggtttattcctttgcggttttatttagtttcatgaccttaaatgttatctatatactaattatatttcaagaccaaatcttttctcttagcagtaaaactataaatccaattgcccattcatcatctccacttgagtgtctcatagagacatcaaagtgagtatacagtactcaaagcaaatctcctaattactgcccacctgtcccccaacccagcctgcttctttcctttttgcctccaccttagttaatgacaccatattaatctctcttttcaggacaagagtctaagaattatccttgattctactctttccctactacttcctacccaaagtttcatctagtttatcagcaataagtagagcctgtaaaatataaacttacttttcattatactgttcacgtgacttttctcaataatggcccttaaggtgttatatcttttttttttcagtctaatacttcttttattttttatttttttggttgtcaatacaatgacttttctaaaaaaatcttgccaagtgaatacagcacaacatgacacttggatgaacatcaaactttagataaaacacacacaccaatttactctctgctttcaagttagaataacaagaagcatatgaaacaatgttgatttgtacatgtttgaattaattcaagaaggttgaagaggtggcaatgtttacaaccttttagtcagactttttgttgggcccccggctccaggtgactcctgtgctgtaatttgttattaagtatactttgagggcatgaaaaccgttaagtctcccaatccttaaaaatattactgaagaaaaagatatggaaagagaaaatgtaataaataaaaactccttttatattacattttgtttacaatttgtcttctttcaaattgttgctattatgtacttgaatccttttttgaggttctattgatatacttttatacttataagtgatgattggaaatcttaggctcttattgaataactttgtatttcacgggaatgaattagatattaagcaagaggtataggtacatcagaatatcttgaattcaatcacttctttccacttccactgctgttattgcagaattctcctgactctcctccctgcttctatcttccccacaatagtcattgtccaaggagtagacagagtggccattttaagagttcaaccatgcaaactcttttaatataatattccaaatgactattatacttcaaattagattcaatctcctttcatgatttgcaaggacctcgttatctcattactctgcttttgttttccttcatattagtttggctatggaatttattatttatttttcagtgtttagtggctattttcaccttagaatgtgtggtccatgggagtattgacctcgcctgtctttttactgctaaatacctagaacctagaacaaatggtaggtgtatgataatatcaataaatatttgtttagtgaaaggataaatgccataaagattgactttgggctgtagaatcaaggaagacaatctggagatgtgtgaattttcctggtctaaaatatagggtaatttaggagaagagaagctagaaatatatttcaaataaaagacactatatgtactatatatatggtacagttttagtaagttggcagtgatgaaaggttgggtttgaattctgtatccattatatgcttctgaaaaatggaacaaataacccaccagctgaaaacatattgccataaactgatgagaaagagcaactacctctaagtatttaaattttaagcaattttactaaaaccatggtattaaaattgactaattttatgttcactttaaatccatttcctaaaagagtcaaaacagaacatctctttaaaagagctatggaaggtagaatgctcaggaaattggatgctgagtcaagggaaacttccgtttctgttcatttatctttctgctttagttaatttcatgttagaattttaaagactagaaactgagcaatggaacccaaattcagctctctgctaaatgcactggggaaatcaagtaatctgagcttctgtataatatcacctattcatactttgatggttctcctaaagtagaacattaaaggaaaaaatgtatggtgattacctcagtggtgtctcaagcactgtggtaagtactatagttgttaccaaaactagacaatattaacttattctcaagatgtttacagttgcttgagaaattcatcaatataaattattagagtgagattcttaataattatcatcatagctatgacttactctgtgtagattatgggacaagaattttgcatgcataattgcatttggtatccacaaaaatcatgtaaaggaatttgtatccccattttaaagataaggaagctaaggttaagagattaaatatgcaaatttacaaagcttctcggtaggctgggtcatgagttgtacatagatctgggtaatgcaaagtccatgttattttcagtatgccatgcgataattttgaagcctgttaagtgttagcagttaagcaatgctgaactttattcatgaggccctagagtctaaaaggctctaaaagaatcctactttgtttgatgtctaaagcaatgccatctgtaggaaacctgttgtttcttctctgcaaatattgcctatgcagaagtgttgtaaaacttgtgaggaagaaaacgttcttttgccttggtttttgccatactgcaggtgtctttcctctttctctttttctggtctcctctggattctatgtctccccctggctcttaattctcaaaaattccttcttagatccacctatccaatacggtagcaactagcacaagtgactattgagcacttgaagaagggctagtatgaattaagtgtaaaataaacaccagattttgaagacatagtacaaataacgaaaatgtaaaataattaatattttggcatttaatcatgctccattgattatatttcgaagtattgggttaaataaaattattaaaattaatttcacttatctcatttaacttttccaatgtggctacaggaaatttttaaactacatgtgtgtggctcatattatatttctaatggatgccacggctctaaaccatcttctttttggtctctcttttgacgttcttataatttcaatttcattcctcaaatacggtccttaaatttctatctttagccttggtgtctctgtcaaaattgttccttatttctaattgtcacttgatacttcctctatgatatcccatcagcaggttaaactgattatgtcccacattaaatccatggcctctcccaagggttatttttgccttccttccaatttcgattacatctctactcctgaagtcatattattaagggacatgatatcatccatatcatgtattccataccacttattccatacatccaatcaattgccatactcaagcagcatttattcctttctttccgtttgcacgtatcatcatggtcactattggtcatctattgagtcttgtctagattatggcaaaagagtctcaggcttttatattgctatttctcttgcctctttattttgcttcttataaatgtattttaaggctttagggtgatagttgggtttgagttaactaatgcaagtaataatgtctatcatctatttatattctatttagaattttaaaagtcgttttgcatatgttattttacttggtaattctagaaagccagtgacaaagtgggagcttttagtagacttcgtagaaaaaggcagtgaagcatggagaaattgaattgcgggaggacacagaagggctaggacacatttcaggtataaccattaaaacatactttttctcaaattttagtacggaacttttttctttcttacagagatagtagtggtattaaaagcacaagctgggaagtcagaaaaaataaaactcaactctgggccctaccacttgctagatcctgtatgatattttgggcaagttacttaatctttctgagtctgcattggctcatctgtaaaatggtgagtttcctcccaaggaaaaaatataaaatgatgtatgtaaagatgtttaccctgcatgaggcacatagtaaatcactttaaaaaggttaaacgcggtggtaagagtagcagtagtaattgttttatcaggtcttgaatcaaagagtgacttttttttcttcactatgatgtaaaaatcatgctatgataattttggtttatttcaattctaagtattatgataaaattatgaaactcatcaaaagcaatttcttgctattagtttcattttctcaatacagctgtgtgggggagtatagtatagctgtgtgggcaaagggaagaagagataactcttttcttgtttgtttaccaatttttagttgatatggtagttttccttcaagcagctcaagatgtaccctcaccaaaaataccctttaattatgaagaattaatatttatcacataaaacaattcaaaaacaggtaggcagccactgactcttatgcctgaaattaaaatgaagcaaagaaaaacagcaaacacgaggagagaaaagaaagtagaattctcttcatgcacttttattttaaatctaaatttttgcatggagtggtaaggtagtaaggtagatagtccacaagacagatctactagggtcctagaaaaataattctgagaagggaacatataaaaggaaactaggaagtcctgagagtatagattgctaacccagtaaagaagtcttttgtctttttttttcttcctttcttttgtttaattttcctttgaggaaaccaactcaggattctatatatgtaggttgaatgaatatcccaactcagtcctaattttgaaagcaattggtgttagcgcatccacttaatgagaacaaggtgcagcagaggggaacccacgtgctgacaaaatgctgggaagacaaccagctatggtgctgtccacagaaagcttgctgtatcctatggccagctggcattgagctttaggtttgaagtctggcattagcaaaggggattagcaagtgggcagtaggttcagggtgggaaaccagcttgacaaaaaacctggagaccagtcagcatggcagatgtgtagagcatacacaccctggagcagggatgggggaaggtgaaatgcagtgatctgacttctcctgaccatgatgagctgtatggtgcatacatttggcagctttagatgtggagaggtatgcaggaaacacaggaatccaacaacacttgggatttggagtcacagtcattctaatcttggtggcaaacttgaacatgctggaaatgctcatggcctgggggagttcaagacaggggatttcagacagtgctgaatgaatataccaatttcagtactaattctgaaaccagttggtattagggcattgaattaatgagagcaaggcatgggaccaagtgtctataatgtcctaagtacaatacagagcaacaacactgacaaatacagtgtctgactttaaggagcccacagtcaatttgggcagaagagacacacagctcaaatagagaacagaaaccaatataaggcaggatataattatctgccaaaatataatagaaacagtagaggaggcagagaaaagagagggaggaaaaggggaacttgcttagcaagagcaaagagcacagcacaatatcctactcgttgtaactaagatcatgttgagaaaattgtaagaataaatgaagtaatgtgaatgtctgacgatcctctttctaaagcagtagtacaaatgcaaatgcaaatgcagtctcctggttctgctcttcatttgcgatcttaccagcttagatttaaaaataatgaaatactgaaaataatattgacttaataggcagcacaatcaccattcaacccatacatcagaggagcaatgttcctaggggtgattgacactacgagccacagtcgggaatgcctgcaggccagttgggatatctatacaagataagtgggtaggagaggacctgtagacaagagaacgtctatatgatgccttgtctataggatgtagaagctgtccacccgcagctgtctcttaccatacacacctggatcagtttgccacattttatgaattttcaagagaagacatatagacatacttttctgtttttttttaaaagtaacaaccctcatttttcaattggaaattgattcaaaacattccaaaacattgttcaggcccaacaacatatgtctgtgggttgaatttggttggcagtctgccgattttccacctcttcttgaatttatagctgctcctaaaaaagcaggagcagagggtaatgattagagagaactggagtcctccaaataacttctgtatatgcaataaatcccaataaatgtttagagactgactggagcattagattattctgtgaaaaaagcatccatttatgtatagcttcttcatttaggtccttgttgtgtctgtctagcttgcatgactgggctcattttcctaaattgaaagaacaaactttcttctgctgccaaccctccccaaagcatttttttaaaaaaaatcattaaaagatgtctctaaaagtttaacttgactaagtcataacaaatacatttgtctttgcatcaactgttatttttgaatcgcatgatgtaggtagggtatggatcagaatgtgtggaagtactgttgtaagggagatgaaagagaggtttgcataccttgtgttgtgatagtaacagtggcaaccatttaaatacacatacatgtgtgcatgctcacacacacacaaaaacacacacaagaaccccaccagtaagtgcacaagatggggaaatgtagctggggcttggttgcataacccatttcatcacgttttctcctttaatagattagattctctgtctcagacgtagttataacaaaggatataagtaaataaaacaagacagagaagaaaaatgttcaatgatttttaaattaaatggataattctcccaactatttaatactctaaatatttatgcattttttactttaatgtgtccaagcaaaaatcctatatttcactttgtgaagcacctaaatttagacagaaatttggctacactaattcaaattacagtagcactcaattaactggaacctattagttatatcacatatgtaaccatctcctcctctgcctctcaccttgaggggagaagcctgggaactatactttgaggaagaaaaagcaaactaaacttgtttaagtggagtatctagtcccccagatagctcctatattaagattcctgaaaaggcagttgaatcacttcaagagactaaaggcatcaagagaaccttcagttattcatcctagaaagaagaggatacattttaaggtgtacatatacaatatacaattaacatagtatattgtatctcttatcttcaaagaaaaggattgaaaaactcagtaaaaaatttcagtttaagtaatgtgaactggcaaatattttttcactattttgatcatctgggcttcttgaaaggaagcctgaggatacataattttgtggatttttttttctcacaccaaacttcctttggtctttatcaaggagagctattttctttcttttttttttttttgtccctcagacaattacttgaaccacctcagggctaaatcatccaccgctggaacaagaaatagaaaaccatcaagacactgggaccaacttcacagtaataagagtacatgctaagccattctatccagaacctactgcaaaagcaatggaactgaaattggatgggcattcccatacacttttttttttttaactttaagttcagggatatatgtgaagatttgttacctagataaacttgtgtcatgggggtttgttgtacagattatttaatcgcccaggtattaagcctagtacccattagttatttttccttatcctctccctcttcccaccctccaaactccagtaggccccaatatgtattgttctcctctatgtgtccatgacttctcatcatttagctcccacttataagtgagaacatgcagtatttggttttctgttcctgtgttagtttgctaaagataatggcctccagttccatccatgaacctgcaaaggacatgatctcattcttgttatgactgtatagtattccatagtgtatatgtaccacattttcttatccagtctattgttgatgggcatttagattaactctatgtctttgatactgtgaatagttgcctcaatgaatatacacatgcataaagggatgatttatattcctttgggtatatacctagtaatgggattgctgggtcaaatggtatttctgtccttagttctttgagaaatctccatactgtcttttacaatggttaaactaatttgtactcccaccaacagtgtacaagcattccttttatgaactattttttaagtgttgaaattgatgttattttactcacacttaccaagttcatgatataaataagcaaagaaaaagtaaaaagcactcttgcactcaaagttgtgtatagacccagattgcctaggagctctttggggatttcttttatgcaaaagaatttattttccagcaatatttatgactggatgttggtctggttgacaaagtaccatattttaattagtcttaagtagaatatttacagcatcattttcatgcacctatgtgtctatttatctatttacttacctgcttagctacctactcatttatctctcactattttcaactattgcccatacccctacccctcaccagcatattctaaagtgaactttcattcccaggaaaattaattagagcagtaatatgaacaaaatgaagatagcagcaatgggctgtaaaataagaagacaccatagtaacaagtaactatttcacaataatgcgcgtataaaattaaagaataacttacataaacctttataaaaataactttttacaaaagggtgcagctgaatcccttaggggttatgaccaaatatgcaatttctcagcctctccctcattctccttaaatgggaatatctgtggaaggttcagctaagtctgcatatttaataagctccacacattgaccattgagaattactactttatagctctctttctctttactaccagaagcatgtgcacatctggaactggttatttctgacccttactctcaggtgaaacattaacttaatacagacaatctttaattctagtggaatggggttttgtggattcaacaataaattataatgagtgatctcatcttttggtctgggcttgtgatgtacaaatcaagtgcattcccaccttatttacaagtcccagcacttcagtgggtcacctcttcctcactggacatttgctttctccttgaccgcaacttcctttgctggtaacctggtcattcattgcctcactctcttgctagggttgaggttctacctttctattgccaatctcctttgtggataattgagctagacctgaacaaatagccggaattgagaactgtgccacctagcaaaaaacctcctagttgataacaatctgcaaatctgaacttctcagtattccccaccctgtcagattatcaatgactgtttctgctcacttgttgtataactcttcctattcaacttgtatccccagttgccaatatttacctagattgtgaccacagatctatgtaattgcttgacactgtcagcatctttcaaactgaacctttcgtcaccacgtgtggctaggagagctctccagaaactggtcacttcagatgaaaagccagttcccggttctttcaggagagataacaggtccttccaatttatatatgtataggggtgtgtgtgtgtgtgtgtgtgtgtgtgtgtgtgtgtgtgtataatatatatataatatatatgtaactttatttccatatggaatatatatatatctcacaccaaacacaaacattatttccagatgaatcatagttctaaaaataaataaagttgaaacaactcatttagaggaaatcatgggaatagtctttgttgccttgaaattaagcaagggtctcttaagagggcaataaaagcactaatcgtaaaaggatataaataataagttaaacaatattaaaattaaggacctcttcattaaaacatgccattaagagagtgaaaaagcaacccacaagtgggaaatgataactattgcaacatatatattaaaaatagacttgtggttataatacataaataactcctataaatcagtaagaaaaagacaaacaatctgatcttaaaaacaagcaaaagtattgcacaggcacttcacaaaagaatattgcatagcaatcatctttacaaataaaagtttgagtgaaataagcccatcaagaaaaaatagaccctttaggttttcattgatataaagttcagaaataggcaaaacttagaagacagaagaatgattagctttagtggggtgaggtgggtagtgagtggaacagagctgtgcggggattctggagtgctgataatattgtgtttcttggtttggctgtaattacaagaatgtgttcagtttgtgacagttcattgaactttatatgcaaacataggcatgcacacacacacacatacacacaagctatttaaaatgtattttactcataaataattgagcaagagagaactgatttttaaatgcattaaaggagatactctgaaaacttttattttaatgatatagttattgtccttcacaacaatagactatgacattagtgtcccatcattagacatgcccttttggcactgaaattcaatctaataaattcagagtttggagatgagcattagggaaagactaatagatacaacagcaaatttgctaaataaaacaaatgtcaaccatatctgactgttgtcaattactgattactgttaattactgtcaagtactaattatgcaatatgcaacttccacatatttgaaccctgggcaggccaagatagtgatagcctggcataactgcaaccaatgggtgattagatttaatctgcctgataaaaagactttgcgactgggtcaagcactttaagaaggaaagacagtagaacaagaaatcccaggaaactgagacaatcgcaggttaaaatttcctttttgcacttgatactctcccaacaaagattagagaagtagcctgtcccagtgagggtctgagactccatttgtttccccagtgttttctaacgctgtggctgctgagcaacttgttctagagctgatgttttctctttaagtgacatttcatcatcaatgccctaagatagtcaccctgttttcccttaattgatagttgtacgcaagaggcggaaaatcgctcagcatttcttgctagattaggtcaaaactgacagaggaaacagagagaagattgcattacttatgccccttatggctctcatctgtatctaagaagattgccattttataaaatttcttatgctccctaaatgtaattacaatggcgcaggcattttcttcctatttgcttttcaattttttactacctgcctgatcatcagagggaaattcagaagcagttccactaatcttaactttattttccttatgtctctttaattagatgcaattgcaccctaggaaccttttcttcaaatgctttatttagttattccttttaagtctttacctttcttttcatttgattgttgaccagaagcattgaacatgtacctagatgttcagagtgaagtacctaaaattctggaatattttttccgtatcacagggtgcccttttcataagattaatgtttacaaatagatactgtaatatttattctgttttaaagttaattaagaagcatcccacgagcatgttatatatttattttgtggcctcaggggtcaaggattcttacttgtggatttcttttcatcaagtatcttagaaaggggttataccttaaacaaaatcatcaatttccccaggatctataagacaaaatcccaattctttaataaaaataaccaggttctcctaaggcagccttaatcaaccatagctttcccacttagccaccaacactgtatcatcttgtgtggatgttcactcccctttccttaaatcttgtgatctcagcctgcactgctcttgatatcccctctctgcctttcagagtcctgtttatcatacagcatccaggcctcacatcacctccaccctaaaatcatctccagtcccattctccactgcactctaatcagacttcatggtaggcaagcctgcttgtgcttaactccactgcagggtgcttaataactttgcagaacctgtgggatgtggcaaagtctatgtctcagagtagaggctcaataaatatttgaagtgtaaaatgagctgctttgctcccaacaggatggagtttgaaaggttaagagctaagaaagatcatggttgcctaccacacacttattctacttttaaaaaatattttacttgacattttcaccatttaagatggccatgtgcagtgataataactgtattacaatttaccatgctgcagacttgtcagactttgtcagcaaatgcagcaaatactccagattccctgctataagttaaataaatgcaaaaacttattatcacatttcctatatataacacctgcccaaagacaatgttacccaatggggtggctatggtcacattcctttactgtgatcttcctttctcattatatttgacatttttgaaactgagttttattgcactctctcagcttacagagtggtcggggaaattagacttaatagagatgtaaaagccacagggagaaaacaaaaggaaagtgaaatggaaggaaactgaaattaaaatgctattttggtaaatggctgctgtggtggagacaacaaacaattgcaatgcgagttaattactgacctgtcaggaaagtgtgacgcgaaggttgtggcacacattactggagctaccaggaccacaactcatttccacaggggaacagacttgttctaccacagatcaacataagatctttccaggggatagaaatgaatttctcggagaaatactatttatctgtggagttgtcatgagctcttagcagacctggagaaacagctcctctaatacatgtagagcagggaatggggttgtgtcaccagagaaagtttgtgcatgtttaggcagaggggaccttcgctcctcgtggtggaccttcgctcctcgtggtggatgtgctaaatatacagctcccttgccatggagtgaaaactcaggctaacactcatgaaatgggaattccctgggtgtatggccatttcttgcctctgagattttactcacaaaactctcagtggcaacctatgtcttccagaagcatccttcttttagggaaaaatatcaagtacctatccaaatctgaaactcaaggaagactattctcaaagcaaaaatccctgaaaattctaagattgtgataaatttgatctttttttaatgagaagaagatacagggcttttgggaaatagaaatatgatatttttaaccctaaaatattatatgaatctccaagcatactttaatattagcctcagaacacagaagaaacattgttttctttctgcctctaacttataataaaatatccatagtttatttactctaagaaatattagcaaaggtgagttacacatttttaaagtaagaaaattggtcaaagacattttcttctttgccaggctacatacactggcataaactaggttccatatttgtttttcatttatacattcaacaaacatttaagtctctattgttttgtcaggaagcagaggaacatttataaatgattaaacagaaagacttgcatgatacatacctaacgtggctacactatgatcattttatctgccagattttctttacatttcttgttaccttttctttccatacacaatgtccacttgatttgtgggtctatggcgaaatcaaggatgctggggggtgtgggccctgagtgccatcctagagttattctgaacagaatgtgacaccaggggatggtgttcagtatacccaagcctacattttctctactcagcagcataaagattatatcatagtgcctatccagtttttcccagctcaaaaattacttaatatatttttacttttaatgctgttgatgtgaaagagatgtcaaaaatacacattctaactcaaaagggcaggctgctgagctttagtgtagttaacagaatgcaacaaataattgggagagcagctatgaaatttatgattagatgaaatatcatgttcactcctatttgcagtatgagtaggaaaatcaagcccagaagcccaggacaccatcgaaccacgtagtttgagcagagccaaagttcgtgttgctcttatgaagtgcattctcattactgcttcctgtttttaaacaggattgaaaggagaactagtgcaatatcacaaggtattcttgctcttctgttggtacacgtaaaatcaggaagtctagagaatagtgaagccagtcttaagtgatttacatttcaatttctaactcagggatatttatttggagagtttagtaaaatcaatggatatctcaaacacatgcaaaatgagccagttcttcaatattttcattagtcattcaccagtgctctgtatgcctcctgtaagaacataaaaacacaaggcatcaaagttttctctaacaaaatttaatagtaacaataatgatgatgacatgagtgggtaacgtgttctaggaagaacaaggggaatactgaagaggcacatagatcaagcaaaacctaaacttaatatgatttgaagttaataagcctgatattactaaattacatagaaataagcataagcaaatattattgattttacaatctaccaaatctagaaaattgaaggtcagtgaggaatgaaaacatgggtggaacaacagaatataatttaagattcctgtgaatatttttggaataataatgcagaaagactcacaaaactggagttcctcgttctctttgagagaacaccctgaaattaatacagatattcctggaagaacaaccactcctaggttctggaagccaagtcaagttggactctggggtatgagggtttcttttgagtcgatgttgagcaggctttgcaatggagtttcttccctagaaccttatttcataaaggctaaaaaataagaccaccatggaagggatattgcatcatacagctctaggaggcaccattttccagaatgcaatgttaatgtcccatccccagtcacaaatcctaccacctctgaatttatgtaagggcataaatagagtggactgatcaatgctcttctactctaagatagttctttcatgtagccagaagagtttccagtttgagattcagttaaatgcttccttgagagttaagggaaagtctgactgatataacattgtgttagctagtctaatcatacccctcccatatacatctaagtgattcagaggtaagaaagaatggatgatggaaatttttataaattttgacactgtagttagattaagcctaagtgaatgctgcagtgggtgctctggcagctgaaatatgaaaaggattatagggtgtctactagagaaaaaactgttgggatgtaggcagggggaaactggggagttgaaagggaataaagaaagggctctaagtgggaccccaaaacaacttgcaaaatatggcctagaaacagccctgtctaattggaatgagaggttcctaacgggatgaatcagaggaaatcgtctctgaacccacaggtacagcagtcacaggtcccacagccactggcacagctgtcatcatcctgttagatttccatcctcaactgtcctccttctgtccggcagcagggctctgcttccctctcaattcatctccattctcaattcatccacaaaaaaacattgtgtgttatgtacatccaggacaacacacattctcttcctcagagtgtctagaataccagcccctctggtactggttgggttagaagggatgggactctcagtcaatcattcagccagatgaaagataagcgagatgatcagatatccccacagagaggtcaaatgctaccttctctatgaaatccattgtttctttctttcttcgaacttccctggtactttatgtcccttcatgacatatgtcaatacctaccttataatatcccaggtatctgcacacctttgcattgccaaatcctttgccagaaatgtccaacctgcactgacttagctctgatgtaatctgatcttctcttgcagacttcctctctctccacctcccacttccacctgagtttaatgccattgctcctctccccacctgggcactgccctattctcagttaattattgattgtttctctattgccctcaccaaactctggggcacttgataaagattatctctagtctctaaaatggtgcctgccacttaggagaatctcagtaaaggtcgaaggggtatatgtatgttttctgttgatagaaatctttaagacgaggttttgtgtcatttttctctatcttcccagagcaatatagtggtctgcaaaattagaaatccccaaatatttaacaatagaagaacaattatgaaatagcatcaagtcaatgaccttgcagagcaaagtacgtgggaagcagaataaagagaacaaacttagtggagggggtgtcaacaaaatgtaacaacagggtgagatggaaaaggaagtgagggctggaggagagacagtgagcaaattgagagaaataacattaacattgtggtagagagagagatccgcctgatggaaagatctaagaaagcaaaatcttgaaagtattttctgcagcttgtccccatgaaaacagaggtggggaagccagataaaaggctttgtaatgaatccagccttttgacagtagcatatcactaggcaaattatggtttgattgtgaaatcaatataggaatgcaaattttgatttgacactgaaatttgtccagcttctgaggaagcaacatgtcctataaatggtgtacggttgggctatgtaaacaccgtggctagatgctcttggccagaagagagtggcttcagcctgagtgatttcatccaccaatattacaaacacactgtccttagagtttgaatctattgaataatgtgggaaatcaacccttgaaggcactcagaggagaaaatatttttctagaaaaatatatgattttcttcttaatacatacttcaaatttttatttcatacttattgaaaaaaactcttgcattctcaattagataattttgaataatacattactcatgtaagcatataaaaaggaaaataagagcaaaataaattggctaagcaattgctaaaacaacttttctataaacatcttcgtgatttattactgaagaatcataaagtgcaagtgtttaaagtatacaatttgttcatttttaacatgtgtaaatgcctatgaaaccaacaccacaatcaaggtaacagacatacccatcattgccaaaactttgctcaatgtgatccatacttgcctctatcctttccctaaggaattactgatcagctttctgttagcataccttagttggcatttttgagaatattatataaatgaaattatataataaatcttcttcttcttcttcttcttcttcttcttcttcttcttcttcttcttcttcttcttcttcttcttcctcctcctcctcctcctcctcctcctcttcctcctcctcctcctcctcctcctcctattcctcttctttttttttcggtttctttcactcagcggaatagatttgcaattcatctatgtggttttatgcatcaatagtctgttcctttttatggtttattgttttcattgcataaattaaaatgtgtctatctgttcacctgttgatagacatatgggtcttcttttgggaataaaatacctgctcctccacctctttctgcctgcctgttttactggaaaaattatgagtctctctgatcctcatttttttcttataaaaatatgggtttaatggctattttataggagttttttgagaatcaaccattgagcacattgcttagcacatagtagatactaagtattagcttcttttctaatttgtcatttaattgccttactggtatttattgtaaagtaacaattttcctcctatcaaaatatttccttttctgttcgtcttagtgtctgcctgcttggccattagaatgaatgattctagcctcattgtccaacaaacattggggtggctatacacttgcctccttaaaacatgattcttcttttggattatattcgctcccataactgactagtcacagttttgttcactgtacacagtgctcggagcccgctataggatgtctattaggttagacttggagacaagaatcagacaagaagagggctgtttccagaaaatgagaagatgtgtttgtattgcaaccattctgtttgtaatgaggtgctgtgttcacttgaggaacttttggggagggacatttgaagaggattatggatgaggggctcagctaaagctctaccagtccaccctctggtgctgccacagtttagttctctttgttttcttcctccaaattctattttttctcattgctgctcctttaaagtgtgtccatactaaattttcttgcctaaatcagactccttctattaaaataaatggtgctgatttttttcttcatattctttataaatacgatgtccaactaagctagcaaatctagttcagttggcagatggcagtggatgaaggaattttaatttccccctgtgagtattgtgagtgggggtaggggctctggggtctgttttgctctgacaccaattttactcacttaaatttgtctttattcatagagatttttgttcaccaagaatgggtgctgatggtagcatgtaggggtaaagtgggtaatagaccagtgaagttgtggattaaaaagcatatatcctcaagacagttggtgggcaacaccatttctatataaggaaaactgtatctcattactgttaggagtttgttaatggaattaagaaacacagtctatcgttgtgctacctataaacttctgaagtcctctgttatgtatagtgctatccacatgtaaaggtcccaactgacaaaataacttacaaaggaactacttttttcttcactagtcagagaggtgaagactcttgtttatcaacttttaatatcctaatgattactagggacactccatcaagagttttcatggaaaattgtatgtttagaataacataatacattttatattttatcaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctgtaagtcaaataccccaaatatcccaagttccttgtcatacagaattttgtaaaaggaaaaaaaaaagctaattagtcttgttttatttgttttcctaatgtgcatgagaaaactgtttttgtaatgcattttatcttgcatacttacagtcatgataatatccccagttgcaagagaagagctgggcttaatccagagtgataaagtggatttggagctagactgaagagcacctttgactcattttaagggcctctactatcatgcttcagtgtcataaaaataatgaggttatgctagcatgtggtgtttgtacttccaaatacagtacatcactttgaaaagccagaggctaaaattagctaagaatgaattgagaaaaaaaaaaatctcaaaaaaaaaaatgtgaaaatctcttccttaaaatctcccaataatatacgatactggaaattatgatttgatttggagtgggcttaaaggattgaaatgctgtggctatttaaggtttggagaggaagccattttgtctcgataatgtgtcattaggaagatttgaaataaaatagttagagatgaactctactgccaattgtgtcgctggccctgcacgcatcctgagccactaaacccactgattgcgatgagtctcctctggttaattttcttccataatggtggtaacttgcagctgaggccataggatgttacaaaattatttatgcaatgttagccactcttttggaccccagatctattttgtttctcacagtgagagcaagagggaggagaaataggttagctggggacaggctgagttccagtcaccctgcagaaacatgtgagctattaattgagtgttctgttaatatcataggggcctatgaaatattcagcttcctaactgagttattaaatgagataaacttgctgagtagcatgttaccaattgtatttattccccatttttcactcaaaaaattaacccacagcaatctcaggaacatgagaaatatgtgattttaatcattctttcctcaggtgttgtagacaaatttagcatgaggaagccagtgattatatttggagagtgagaactacatccttagataaagtaactaatgagatatgcatttttctttatttactttctcatttaaaagtattgtctcctgggaggtacaacactgccagcctgactttgcttttaaaccagctaaaatgttcatcaactatgaacttgagacagtggttagagtaaattattggaatctctataatgtattatcagtaagaactgtacctttgaaaaagtttaaaagttaagtatatttaatgatgcctaacatattttattggctgtgtttaacaaaaggcactatgccgcagttgtttttgacaagcatgaaaacatcacagcatgagactgcaaaaggaattatggagagaaattacaagtgatccatctctcaatgaattatccacctcaatagcctgcagaactcagctaccaattaacacctactttattacatgttgggatgtacttaataactttcatgtgtttatgcactattaccttgactgatgcctcttgtacaattaggcataattggcatatcaatatgcaaaagttaaaaggattaaccctcttaaaactaatgagcatttctgtatccagctgctaaatgagacaaaattagcatttttcacttttgggcaggattttatcatgcagtttctcattgttgatattaccttgttacataactttagtttggggggttgtatgctggactgctagagaataagagttttccaaagttaaattagctataattatcccagcttttgtttccgcattcttagcctgggcaatatgtattcctcgataaggaacaaaaataaaagttacttttggttatgtgtgctcagtgcataattatataaaaggggtattttagtgaggatgtgtcatttcaccgagaaaacttggctcagagatactgtattgaaagcttgccatggcactaattttctttctgtctcagttcttttcatctcttttttccatgcacaattttctgactagatactgacagaatgtaaagtattttggcatatttattcaaacaagcctgttaaagttatctgctcaagctaaactaagaacttgatttttcagaagttgggtggtggggtgaggtcaagggggagattttgaatttagaggtgggaagagatgggtactaaaaatgtgggcacatattcaaatgcagtagggtttgttgtaacagaggcacatacatgtagtctgtacagaaaaaaatcaaaagtatttagagatcatacatatgtcatgcatcctacttaatatatatggcatatgcatactacttgttcactagtataacaattatgcaaatccagtatgacttactggactatataataacacaaggatctgatattacattcatcatgacttaattcattacaaaaatgataaaatattctagagtcaaaccaattctgtaattttctcacaaattcataaattcctctcgtaaattttgttcaattaaaatgtttttaatatgactcttaacttagaacacaatacaaaattctcctgtatatgtcgtaaaagctttgattcttagttatcttaaatgaggaatgctatgaaatgccaatataaacatttatccaaccctcagctatgcaaacgtaggtgaatttacttgctaagttagaaattttgataacctaaatgttgcaggaaagcatctcagtaaaacagatatgaatcctccattagtattttattggtgatgtgcatcgttttctttagacatcaaataatcattctaaaatttggttaataaaatcaatgccttttcaaaattcaaagaagttactttttgacgtgggaaatgttggagaggtgggcagtttcgagagggggaagtggtttgcaagaaaatcgcccatctgtaagagagatctggagagctccctttggtggggaaagaacagtctttggtctcagtgatttgttgtcccgtcctgagcaccagagtgagacctcttaaaggtagacagcttatttaccagaatgtgctaaacagaaaatcagacagctgagggccaatagatgggggcaagtgaactgtgcctgtttaagggctaaaaagaccaatgtgcattgcagcaaatagctattgcaaaaggtttaatgtggctttgatgttatttataagagagatgctcctgcctaatacacagtttagaatagatattaatgaggagtttaaatagcccgaatcaggaaactgcagacatatgatttgcaggcaagagtagtttcggcatttaatgctggtgtcttaagcaacaacgtgtatgaatattcaccgtttccatcttgtaaacgccacagaacggcattacttcattcatggccatcatgaacaggaaaatattttttattggtgttcagataaagacttaggtggagccatttttaaacattaacatacaagattccttttacttccattaacagattgtttgttcagtttttaaatatattatcagaaaaaagaggaaacaattttcttttgtttcttacttctgtgattataggatacttgccaaagttgtggctagccaaaaaggcagacataaaaattgctactaaaaatataaaccttctgtttagtagagtttttaagaaatattatgagattgtagggcttgtccatgtttacttcaaatcaagcttatagttaggtttgaggctttgtttgtataaattgtcctgaagtggatcctgatatttaattaaaatgacactaaatcacattgaattgataagacttggcatctcaaacaaaggtaattgcccgtattggttttgtgcaaaaatagcgctgcttggaaaatgtgcagccaacacagactgtcaactccatttatagatcaatatgtgaaaaccattgatcaggcaggcatgtgtaacagtaacactttgcatttatttgttgtttttataccacattaaggcttacaggattataggattcctaaatattttgacttcctcataaatatatgatctgttgcatgttaattaaatgagagtctgcagccatttctaaaattgtttttagtttgatgatttccttttattgctgtggatcgtatgatctgaaaatggattagtttccttctgcataaagattattaaagcttattttaatgtgtcctatttagtgtaagatgtgtctgtatttttgctttgaaaaacatagatacagacaattattttctcgtagcgagtggctgatcttttttcattaactgggcattctcagcgctcagggtagaattatttcctgacatattttgcacaccctgtagataacgggtcttcttgacttccctgatagaatttgttttctttcttttccttttatctagctctgtagtacaggcatctgaccaaacattatgtagaaaataaactgatcatctcaattaaattctagacacacacaaatataatttaaattctatttttctgattcaagaacaagccttatgaactgttcttatacactgcattcttcagttaaatctctcttatctcatcaatgtaaggacagtgttttgttcctaatctttattggactattgtggatgacatttgtaagccattttggtttataaggaaaagctggaggacagtggagtgagactctccaaagatccaggcctctgatatgactacacaataatgtgtcttccactgcaattttctttaccactgggagggcaattttgttgagattttttaatattttctatatacattaggagtgctgctttcaagacagtgctttctatacaatattaaaataataaaagaaacaagattttaaaaacagcaacaaacaaataagcatgaaattcgaaggtttcctaaggtattttgcagacatgctgtagaacagatgaaaaagtttgttagctagaattttgacttttacacaatatgcccctgggagaagaagattcaaaaaccactggagatttctttccttgtccatgccaccctttgccatctcatgctgtgaaaatctttaactctatttaccaagcacaaattggacttgccaaaaggttcagaaagtttatgacgacagtgaagagtccatacttcaaagaaagagctagggctctcacaaccacatatgtggctgcaccgtttccatcttaacctgagcatagctaaatttgtttataatctcctactgatagaacatggtgctgaatgtacatgagatacatttttttaaaagttagtcctctgattactaatttgaatccaaaactctaaccttgttagcatctggacttatttccataataacaaccccttcagaacctacaaagtaatgaataattgacaacaaatgaaatgttttgatagttgtcggcacaaagcatgtttaatgttttgtgttgcttcctagctaattatgtagatgacacatttgtcagaccttgactgccattagaaacgtgtttccagaggggagaaaaacaggctattcatagagtaattagctagaatgctcaatgacctgtgagagattcaaatcgctgccagttcagacattgttttgttacagagcagaggggtaattaaaattccaaattacagtcctatgatggagcatttgtttgttgacagtatactcttactctagtttgttaatttttttttaaattgcttctaatccattttatagctttaggagttccgtctttgaatttgctgacaactaatattatggtaaattgtacttcagctgagtactgcgtgcctcacaatttcaagggaccacaaggttggtgggataaaatagctccttctcaagactgacagatcaggtgctgtcagcgagaatgcctctaacatggaacatcttgtcaaatactgcttccaattctatatgagggggaaatgaactagtggaaaatacaaaggtagagaggaaagcaacaatgaacaactagaacggagcaagaagctgttctcccaataagaaatgattgattaagtgttctgttaccgagtaggagagaagagtgagagctgaggatgatttgggaaatggtgttgagattgtggtgctgagttcaaggcagaagatgcggccgtctgtaggagggctcacctagatcacccaaaggatggcatgtttcacagtaacacctttcatctcaggtcaataacaaaccatggaatgacagatatcattcatgagatgtttcaaggaaatattgggatagtttacaaatctagagggctaaaatagtctaaaaaattcagttccagtggaacatgtatttaggttgctgaaagtgagaatatagttttattaaaaagatctgacagaagtcacacggtgtttgatgcaggcgaactgacagaggcatccagtgagcgctgattatcccgaagtcactgtcagctaggattgattttcactttctccgtttatgtaacggttcctgtaatacagctgaccccgaatcacgttaccttgtcatttctctgcatggatcaagaagagatgagctgaaaatagctagacactgaccttgaacttaccagaaaagtgagaagtgacagtggggtttttctgtagttcatgtacagagacgaaggcacactgttcctctgtcgagttcactgcagcagcacaagggggcagagcagtactagagattacaggtaacacagcttctgcaacagcatggaaagactctgaaatacggagttagagccagaggtctcatttttacatcttagtttagacataaaggagaattactgatgaatcaaaatctcaggtcccctgatgttcataatcagtaatctaaaagtgtaccttctaattaaaaaaggttacctaatacgctgtgtgccagcaactatgcttttccactaaatttttgcagcatctcttatttaattcttataatactcttcactcttaaaataactttggaaccatagtcaatattattaagagaggtttaatttatggcaaactcccaaggtgatatgtgtcactttacatacaattgtatcagcagatgggaatattctttacatatttaccagatgttaacacccaaaaattaaaactggagagtgtttaatggcagtgtgcactcacgaacaggtaaaaggcaagctagaaaatggtgtttaccatttaatttacatttatttatgcctgtatgtcttcccattttaatatctgcctcaattttcaaaaatgtattttaatagatcatcattataaccttgattaacctaaaacacagtatgtcaaatattatcctttgcttgctagcacttagttaagctaaatcattgctgtactgatgctgaatgtttctgataaatggcactttaaaatcttggcaagtgaagcagagaactgaagcaggttgagaaacagaacagcaaacactgactcaattatcccccaggttgtaagtgccttatgtaatggcacggtagcatctttgcttgtgtgatggcacaataacatttttgcaggcctccataataactagactcttccttgtatacagtagattctatgtatgtgtacaggtagtatatgtatatatacacacacatttctttatttatatagatatatagaatatatacatatctatatacagatatatagaaatatatggagagatgtatttgtatataatttatatttggacctatttttatgttccaggagaaaataataacatatatatttacaagctgaaatatcaagattgcctcaaggttcttcttctgtaaatataactcaggacaagctgacaataagatcagagaaacaagtagacttccaatatgtttcaaggacagaataaataagagatcattctattgccaagaatgtggcagaaaatattcagaatatctgtgtcatcacagaaatctatagtacctagtttttgccctttggcagaagaaaagcacaagtcctctgacttagaaagatttgctatttggaggaggcgatataagtgggggcggcggtgtgtttatagctataaaatttgtgtgtctaaaaatgacaccttcgaaggcaagcctgaggaacagatgcattccttgagaatcacacaattactttgcctttctgctcctcagagagtgcaggagacctcttgcatggcctctcctaggtggaaggaaacccatccctaaacggttgattagcctctgcttcggaggtcaaggcagacataaaggtgttgtctgctaatacacttccccagagttttattttttgtttcattctttttctttccactgccttcagtgtgcaaggcttttaataagggacttcagtccctgatgtgttcagattcggtttattgttaccatctgtttaattatcctctcaggtttgtgttaggaagcattaaagtattttatccagcctttgaatccccatgttcctaaagagatgtgggtaaagtacgtgtcagttttcaaagagcatattaaaaactgataagcagaaccatctccaaacaataacatgtaaggcaaatacattttttttacattaatgcatgttacaactaattagcaaatgtacagcaatgtggcaatctcacggaaatgatgccatcttctctatatgaaatctcatatgcttctcctttgaggtgatggatttttatgattcctattcacttccaatgcactgacaataggtttattgggggaagagatatggaatttgatttgcaataggacatatagttgtcatatgtcaagcagatttatggatgtgctgaagttaaagataaatcacatacccagagaaaaaggacagaatgtttggggaaaaatgaaaaaacccaggggaaattcagttacttgatttttttctcctcttcctcttgaatttcctcctcattattattattagatttcatgtcatcattattattactacattgcatgcttttttttttctggagaaaaagcagcatgttgcttccagtaagcactatagtcactgttatatctggtgcagttttccatgtgcaaaaaccattgataacaaaaattacatgggctgacacagacgtgttatcagtttatgtccaaattattttatatatcactattttagtgaaatttttggaaattataaaacaaaattaagtataaatgtgtaagtatcaaaatgttttagatgtcagaaaccctgaaaatcaaacggaaataaatcatgcttttacttcctaaatcaaggaagccaaatgattaatcattattcttttttatgtatcccttacgaggtgatttcaataaactttttttctgagattccaagatgttattagatttaaaatgtatttgaaagtgttgagaaatggtagttttgttttgtgtaagtacctttccacagtaccataaacataaatgaccaaagtactgatctctttttattcctttgtgaagaaaccagtgctgttcttgccttatgctcttacattatctctgtgaaggaagaatagtgatgacaccaactttcctccactacttttggacactaaacctgctttctttcccacagggtaaaataaagctgctgtcttcatatttccaatgagaagggacatgtgtctccttgcattgaattgtcttagatcatatcatgtagcacaaagtgacccaatataggaagacaggaaaacaaagtgacagttttgtttgctctaatgtaaacgccaacatcaaaacatggggcaaatcctagaggcccactgccagaacacacaaattaaatagcaagagctgatattctgtacttaaaaaaatgtattcaagggatattctgtaatcagcagtgaaaggttaatgaacaaataagcttagctcaggttagacaaactgagtgtaactaccactgtttttaaagccatgagaaagtgaatctggctgatacttgataatacatcacacactgtggtcttacctattgattacaggctgacaatgggtaacctttcatggcaacttcctcttttaccatgaattattgacagtattaatgccaataacacatcatcaaataggaaagaaatttacattcctggatgtactatccttaacctccatgcctttaacgtcaagaaagaaaagaaaagaagaaagaaagaaagagagaaagaaagaaagaaagaaagaaagaaagaaagaaagaaagaaggaaggaaggaaaaaaagaaagaaaacaaaggaagaaaaagaaagaaagaaagaaagaaaaaaaatatcttctttcttgtcttgaaaatgctaatgaattacctttgacttttagacaggttattcatgtgacatcccgattattctcatccacaacacaatctgggtaacacagccctacatttaagggaatcttgctgttgttattttcaccctagtgtcctctaatagtttatagatcctaggaaattttactctagtggtgtgtcctaaggtctctgcattaataattcctgctcgttgagtggtcaccatctcaatcctgcccctgtgtgtgtccctctaagagtccccaaagtgggaaataggagaacacgtttcatctattcatttcatctatttatttatttatttgtacatttttattggcactaacagtatgtcagagactcctttgaaggctggggacataaaccaaaaagtttctctgtcctctaggaggttacattcaagtgaggtagaatctttacctggaatagcccagactctgctgttagctacctagacatcctcattgccactgccaccaccacctcttcaaactagtattagtgtcaagtacgttgcattttaccacaaatactttacactatgcttaaaaatggcctgtaaaaaagagacgttcacctcctgtaggatgaatttctgtgtgttgtatatctcaaatgacaagctttgattttttaaaacttcaaattataagaattccacctgattttaacctactttaaactcccttgcgcactttgacctatttcctatgtcttgtgtttggtgtacccaagctattgaagtactttctttggtaacaagtcaagctgctagtattcttatctggttagatttataatgcctcttttattcatcattctttctttttccttcttccttagtcttttttgaatttatgataaacttttcactgatgttgaaataataatttttatgaatacgaatgaaagtgttaatatatttgatgtctataactatttttgtttcaacacgaaaactgaacacagacataatttaaacttctacagagcattcaaaattttcaagttcttgacttaaaaattttactttgatctttgctactagggtctgactgagcattgtccttcaagtagccataatttatggggttgattgtggtttgtacatgatctaattataacttgccaaagcagtttttatcattagtgttattcttatctattctttattcttatcatgccattgtagcctttaaagtacttgctggccattttactaacgtgcaccccatcaaagcaaaggtaattacattaaccaggagacaaaataggctctactgagacctcacaattccttatttttcttacatatggataatgggacagcagtcttgctatgagaatggcccaggaaacccagattggattcagtatgcatttaagaccatggtttctcactttttgactgttaacctgagcttgccaccactcatgctgccctttctaactctgagccccctatctcccatctgactgctttgatgaaaccttgttccccaaggtcaccaacatgtacctagaaccctggttgctttttttcacctatgcttcagaggcctgtttcagacttttcctcatcaaaaacaatgacaacttcatgtttagtattcacactctagggtgaaaatgatgggtctaaacaggggttaccatcaagtggtggctccacccaggcaatatgaccagaggtactttttatttggttggaatggtgtttttaatagtttgaatttgaaagcctttcattagagttgtggtgttttcctgcaggttgcattacctgcttggccctaaggacatttgacttggtattcttaaagctgttctattgactggctgttcacagatgaggacataatgtggtaagtcagaaaataacaactgttggtcataaatttgaaaacttagaagttgacagccataaagcataaacttagaagtgtagtctttatcacatttcactggtagtgaaagtagcttatattacatagctaaacaggaattttgttattcagattttctcatttggacttaatttcaattatttatgtatttattattttagagacaggttctggctgtgttgcttgggctggagggtagtggtgcagtggcatgtttgtagctcactgcagccttgaactcctgggtgcaagtgcaagcaatcctcctgtttcagcctccccagtagctaggactacaggtgcacaccatcaatcctggctgtttttcaagtttttttgtagaaacggggtcttgctgtgttgctcagggtagtctagaactcccagcctcaagcaatcctcccaccttggccttccaaagtgctgggattacaggcctcagccaccatgactggtcctaatttcaattttagtctcttaaattattataaattaagaaacatcttgctgcctttcaagtaacactaaaaagtaaccatggttttctgtggaaaaggtgttctcttgtcatcaagttttaaatactctgtttattctgggttatctaagatttaactttaatcattctgaaaacttgaagagacgctactttgtatttaagtgaagccgtgcacttgtaaatcttatcataaagaatcacacaaggcccttacaatattatacaaaatttaaatcaacttcgatttaactagtcatctaattatcatcatttactttacattctcactaattaatttggagacttttaaactttgttagaatttttatttccttttccattgacatgtaacatccattaagaaatgaaacaacataaaatgaactctacaaacagtctccactcacttcttcatagccaaaatgtcttttttgggagcatctctgctttaccaaatagaagccttaatggatagagaagcaggttcacatgaggaagataatgctacatggccaagggcctctttagaatttctcgacttgcaactggcatgttgaattccacctaaagatgtattttattttgcctagacagtgctttctcctctttgctttctaattgagctgacatattgacattctgagatttcacatgaaaatttgtatttgtgacatgtctcaaaaaatcagaaattctggcatctggggctggttccccaagaagcaggcaataactagctgaagctaagtatctcttgcctcctctagatggggcaaattctccctagttcaaaacagtccagccaggcccccttcatggggtgtttttacctatctggcatttgagttggtgatgctggctttagcatatctattccaactttatttgtatgtcccctgaggaccataagaaactgagttgtcatgcagataactgcaaaactcctgtctcctttcagtataacttttccgagttgcctcctaggtaggaagaagcttttgaaataggagaaaatagttatttcatgtattcaggtggttatttgcataaatgaaactttggaacacattatcctttgctgattcccaaagacactaatgcccctgggacacacccagggcactgatttgaattgccaatgacaaatcaaagtgtcagtcatgggtagatatggaaagcatttgtgggccctccaggttcaatcagaactgtcagtggccctccaggttcaatcagaactgaagtgggccctccaggttcaatcagaactatcagtggccagtgtcgtagaggtagtaatgcttttgtttgttagttatgagcatgatacaggttcaataatctgaccagtaacattgcactctagccaggattagaaatatttttaggaagtcaaagccagatgtaaattatcccctcaagtaaatcttcatgatgcagattctataaaaattgtagaaaattgctattatcattatgccacctgtttgtataaagtccttttgtcaggcctggctctgtaccttcgagctgctctgtgtgcctcactctgccatttgaccatcacttttcagcaaatgagcttccaacacccacctacattctgaaccattatattttaaaccaccctgaactcttattcaacctgttcttgattgattgcagcttctgattcttagggaaaatcacctctgcgttttattattcttcctgtaacaatgtctgctgacttccatcctcagctacaattcacagtgagctcttacattacaataatacaaatgtttaccatgtggggacatctatatgtactcggcattatgctaagtgctataacttgatgagagactactttgtatttaagtgaagcagtgcacctgtaaagaagatttggttaatcccacaccactgccaccaacaaatacatgattggactgagatgtgactttaaagatacctgataccaaccaaaactcaagctttcgacatgctggggcacactctgtgttactgaccctaagccctgaaactctccctactgcatgcatttgtggatacattctgccatgttcaatgtggctaagagaatgagtgggaatcagatgtgtattctccgttatgcctattaaaattctattcaacttcagagagccaactaaaactcaaccccctgcctagttttctctgactgacctttctctcatctgaactcctataataattattcctttgattgattctgtaattgttcaccttgcacaactttagtgcatttctttctgctttattttaaaaacttatttatcctcattattattagtcagcattttatgtgttcatattatagatcccctgttacaatgaagactccgtgaagtcagacactttctctaacctcaacagaaccttgatgaaaataagcatttaatttttttcaacctaaggtactttaaaaggtttagaatattaggtggctagtaacatctaataatattctaatttctggagaaaacattcctgaagacacagagagggcaaaaacacaagaatagcaacaacaaaaaaatagaatttagagatacctcatagtcataaagctaaaggagctgaattaaagaagaaaaataatagttcagctatgcttcacctcatgaacatggagtgacctcaggatatcactattgtattcattgaggctgaaattggcagcttatcttttctactgcctgccttgtggttcagagtttatgatgtgcaaacccaccaaatactaggcaagcatccctgtgctacacaggtgttgttttctaaaatagccagaattctgttgctcttcgtctttgctcctctttctatatccatttagagactggaagtcacaggaaacaacacggcaggaagagtgggggactggcagtaaaataaggcatcctggagagtatagtaaccacaattatattgctaaagatggagctggagttacagaaagcaccagtagaaaggcaggctggggatttaattttttatgtatactaactacacccttacatcgacaaccaggctgggaaagttggagatgattccacctgtgtctagcaaaactatgctagtagtcttgttgatgaaaaatttgataaagaataatgcttatcaaactgcctcaagctgtacctaaccctaagaaaggaatccgtccacccctatgaataatgaattcagtccaggaatggtcacatgaccttctgtaaccattaaaggttccatttggctctatgtagcagaaaagtggacatagtgatttaaataaataaatctgtagtgggtttttttctctttttctttttaaatgtttgtataacaataattcagagcagttgctgtgcttggctaaacacattatcaaagacacaggtttatcatttttctccactcaccatctttagaatgtagttttttttttcctattgcctctcttctcatggccagcagatggctgctttatccttagcatttcagctacattccaggcaggaaagaagacaagcattaagggaagaaggcatgtgcaagatgaacctgctctcttttaaatagcttccatggaaagcccattcagcaatctctacttacatctcgttgttcaaaagggtatcaaatgttcacgtttagcttcaaggaagactgggagatgtgatttttaatcaggacacttcgctgctgcaaacaaaataacactggatagagattaaggctaatataagatcagagtgaattaagagtgaggtgagagtagggacactcctcagatcacacagggctttgcagtcgactacaaggagtttagattttattatttgatgcacaatcagaggccacgaaaggattttaagcacataagtctctctgttgggtaaagcataggttaggagaggaagagagaaaatggggacactattaaggagcctgtccatcctattctctattcaataaatcgtggtggcttgtgctagattggttgagtgggtatagatggaacaaaacaattaaaggacattgtcaatatagaactgaaaagagttgcagaggggttcgatgtaggtagaaagaaagtaggagtcttctgagagtcaagatggagaaactgggtggatgatagtgccaatcactgagacaggaagaaccaaatatcacagggatctggtgaggtgagatgtcaagtgggtcatattcggttgtgagaagcttgagatttcagtgcacaccgaagtgaaagtgtcatagggacaatcaattacgtgagtttggagctcagagaatagatatgccttggagatataattttgatgtcaacaaccaacagatggtatttaatgctacagaaatagccaagatcccattgagacaaagcgtagaaatataagagggctcgaacctttaaggagcctacaaagaagttaaaagactgattggaaaagggggagtgaaccagacgatgtcagttgacatccatgaatttcaataaagaaggggtgcccaagaagactcaaataaaaaatatatatacatacacacaaacacttaggtaactatggattcagtttctttgaagacaaaaatacttcaaaggaattgaaaatgagtcaaaactagtagatgtaaatattggtatatatgacctaaaaatattttaaaaaacccgagatgtttgtttcatgtacaagtattttggatataatttataatcatatacaaatatgcacagttatacaagtagtatttataattatatatttaaatgtatgttttgataaaaactaagcaattttagagattgttatatattgtaaatgttttttcgtctcctataaaagaaaaactgaaaatttattttgtacttttaactttcccataaacatatcaatcctggttcaagggagggaatatctcattgcaacatcagaaaggataggaaaatgtctggaaaatgataactggcttcaacatgcaaaataaatgttcaaagatagaatcaaagggcaaacatcaaggtaaatataaagaagctacacacagataataaagataatccacaaaacttaaaaaaaacctctaattttatctggagtaaattgagtggatattttgaactttatttttcatttacagtttgccccaggataaaatgataagctctattaatcagaaaaggttaatggcatattatatctttggtagattgataacagtctctggaccaagttgtttgtaacttctgttcaagagtacaatagtacctcagcagcaaatcacatgaaaatgtcaaccgtatgttagattttacccacttaaagaaaaaaatcccacaagaaacgttataggataatggaatgtgcaaaattaatcgcttttcaaggggtcgttccgagttttattctccttggttgaattccctccccaatttgcccctcagatatgcattctcttattgaacgatgtgattgtggcgactgtactggtgcccactttgagtcaacgtcgcatttatcaaacagttccctctcacccaaatattcccagtgtagtcactgctagcaatcctcctttatttgtactctccgtttgtacctggtggattatatattatattaattcataataccagctctgccaggctccctacagttacaattattaaagctgtaactgaaacgttatctctcatattgatcttcaaccagaagttcttgtcccgaagcttttgtttcacattaagacactaatgatcaccttcaccaaatgagcagcttaatagtcacaaaaagctaaatgaaaagactttgatcaccacctttgagagcactgtgttccaacatctctcccatccataattggcaaacactaactgagcttttaattttttttaaaaaaagaaacatacaaaatactctaaagaaacttattttttcagaaaaattttctccttttttgttgtgtttgccaagtatgcttagccctacctattctatttgttttccaggtcatataaagcatctgtgtgcctataggttatttctttatatgtgatttttaacaatttattcattttcttttcataagaactgagatgagttatgaattcagttgaagtgatagaaattatgcagcacttttgagtgcctatttgatttacttgttaaaagaattggtacagattaatcagtatggtctcccccatatctggagggacaatggagctactcaatggttctttcatattcacatttcctcctggaaaaagtagaataatgactctataatgaagtctttatacaaacacaatgtatcccgaaaaaatattaacaatatttttgtaattgatcaaatgggaagaaaattctctttgggtattaattagacatatcaacgttattcactccactgctaaaaaagtaacaacactacagagactttttatatccaagttttaaatcaactttatattgtagactattaattttcccaatgaacctgcagatgcataatctgaaagtggacactctgtagtggtggactatgcatacatagaaagaaaaccacagagggttaaaaaatagcaagcctgagtttttatgggtcattagctctttaatgcacctcaagggctcctaaaccaatgaactgagagtcttgggaagactctagcctgacccgagtgaaagaaatgaggaagagcacaagtattagcagtgctcgatgctattaaaatattaaccaaagactaatttgaaaatgtattaaccacatagtaagttaaggcccatcacagatcaaatgctaagttttgggacaggaagaaattggcgtaagtaactggcaaatattcagggtggaaagattggaagggagaaaagctatcatggaaaatgacctgatagccttttgaggccttgtggttgtcagagatccctgtgataatgatctgcatccattggtgcttcttccctgaggaggcaaatgcctgaaaaacagaagctccaatatttctatgggtgtggagcaggtatccgcatagcacagtgaagaaaagtagtggggatactcaccactctcattctcagccacagatcttggggtgactaacgctctctgaagtcatcttcagaagccactataactcttttaaagttgcttccttgaacttagaaatgggtgcaatattttgggggaggcctctctaactgctgcaaaccaccaatatctctaaggctattaatgatgatcatcttgaaaacccaacctagtagcagatgtggtttcaatggaaaaagaaagagtcaaatccatgtcagagaatcagaagagacagtggatgttgtctatttgagtaatataaaaaataaagtgatataattgaatagtataatatacataatacttgaaagaaattagtatgttatacattgaaaataaaatacgtatgtctgtctagagactatttttttaaagacggacagatttcaagggaatcattccacggttatgcttgaacacaaatgagttactatatcttcaaagattccttcagatcaacaattggtcatgtgaggaagagagatgacttaattcccttaagcaaaatacttcaggaggcttttgtcacatggttctaaggatttacaaaaattatttaatattgatggaaaatattaaatgagcaattatataagaaaacttttatattattcacctatatcaatgaaacattttactcagttttagttgcagttttcaaaaacaattgagaaaagtatttaataagaaaataaatctaactactttgttaatttaggttatttgcatcatgttattaaaaaagtggaattgatattcatatgcagaagacatgctatgaataaattaataattatatatcctaaataagcttgagttttgggcagctagttaaattattacatgatagcagaggatgtatcttctttcttttgtcttctctgtcatttaatattaagtagtaaaaaaaaactagtaaataagactaagaataatcatgtactgctcaggtcttttttggttgtaaacgtagaaaccccatttgaactagtttagaaaagaaaaaagagtatttgcttttataacacatattcatgatctactgataaaccatccccaactgtgtatttaacttacaaatctgcagtttgggcaggattcacaaggcaaggctcatctcattggctggggcagctccacttaggcctgaaagatttactttgaagacagttctctcacatgattgaaagctaatgctattgtttcctgaaagctcagctggggccgagggttgcagattggagggggctctctttccttccacatgggcctttccatggcctccttcagcttccttatggcatagggactacgttccaggagccagtgttccaagaggaccagaaagaagttgtataaccctttatgtacaagttttggaagtcttaaggagtcactttcttggcagttacagccctgccatatctaagggaaaggaacatagattctcacagtgaggagtattgtgaatgacttggaaaataaaatatgcgacataactgaaatttagatatgctcttttctctatctgtgcacctttgcctctcttttatatgctgtcttctttttcctctgttaagacagtctttctccattaagtgggtaagatgagagccggctgttcacatgcttagagtactctgtcgtagaattaaaaggaattcttctccatcagcttgagggggaataagggcttaaaaggcaaagttagaatttggacagtactcgtcagaaacataattaggaaaaatagtccccactctcaccaagtatgggttacattcaggtcagacaacataaagaacatccactaaaagttttgacaacagaaaagggtcttttgcattttgctgcctacctttcactttcgattgcatactcatttgtttattcactcaagtatctgtacttacactctctgacagggagtgttctacatcagtgattctcaaagggtgatctagggatcccttggggttcctcatcctttcagggggtccaagaggtcaaatctattttcataataattctaacatatgatttgcttttttcactctgatttttataagggtgtacagtgaagccttccagagcctacatgacatgtatcacaatagtgaagagatttcctgctgtcttctcttaagccagacattaaagacatttgcaaaaacacaaaccattgcctctcttgtcactgaatttttctttattttagaaaatagttattttattaaaaatatgctatttgtgttaataagcaatgcatttatttactgtatctacttaatatgtgttattaaaattactcaaatttagtttctaacaagctaaatgttgatagttgtaacccacattaacaaggtctttaaggaattaaaaaaatttttaagaatataatgtcctgtgaaaaatgtttgagaacctgtgtgtaacttgaaatgtgatatccaacaaagcaaacgaagcctctgctttctgagtacagaagagatgccagcctacttcaaggaggattacaagatttattatgccgcaccataattatctatcaatggtcaaggtcctccacaaaactctaagtttctagagggcagagactatatattattttcagaaaaaacttcaaaaattatagttattttttcaatgagaaatacaaaagtattcaattttaggcattcatgaactccattgaaggatgaaatttttcttattaatttacttctaaggtggcaataaaaattgagaagttatcagttttaaagaactcattaaaatctaaggcttatcagaaattgatattggctaaatagtatctaaagtgacatataaatgttcatgatgtctgtattgaagaattcacgctaaataaaatggtattatgttaagtgcattttactgatttggggttgttataaacctacaaacaaaatgttggctatttttcttcttttaatttttaaattttttattactattattttttgtagagatgtgtctcgctgtgttgccctggctggtctcaaacacctggcctcaagcaatcctcccgcctcagcctcccatagcactgggattataggcataagccactgcgtcaggcccatttttctgatcttgtgttaattttcctgctactgagcatacatagtacatgcttcatacattttgagtttgattgttttagattagatgcagattgtaatatagaaatgcaatatagaattgcttgagcaccgcttttcatcgccagtctggaatcaccaatttattttctttggctatgattttggagtctttagaaagcaacactaaaatcctagaggtaaagccttaggctcatttagaatgagaaatgctcatttgctgccatgctaaggtgcatgcaattatccagggtacctggcaattaacacccttctctagtgcagtgattacctaatttggctaagaatcattagagggctttttaaaaatacagattcctgcacctaacctagaccttacaaatcagaatccagcttctactatttactgagtgtcaaatgtttgatatctcaaagctaaacaaacaaacaaaatctaggaagagtccctatatttgcctgtctctgttttgaaactcagcctatgaaacaaagagcactatatcatagaagtcatcttgcattcaaaagctacaaatatccaccttatatcctgcctataagtctccaacttcctcttatgtcttaagaaaagtctagacatagctcaactgtgtctaagcaaatctgtgcaagcaaacttcagatatattgcaggtttggttccagactaccaaaataaacaaatattgcaataaagcaagtcatacaaaaattttgatttcacagagcaaataaaagttatgtttatactattctatagtctattaagagagcaatatcattttgtataaaaaacaatatgagccaagcgtgatggctcatgtctgtaatcccaacactttgggagactgaagcaggaggatcacttgagccttgggattcaagaccaaccttgcccatgcagtgagaccctgtctctacaaaaaattaaaaacaaaattaatcgggcgtgcttttccatgcctgtagtcccacctacttgggaggctgaggtgggaagattgcttgagccctgaaggtggaggttgcagtaagccatgattgcaccactgcgctccagcctgggagataaagtgagacattgtctcaaaaaaaaaaaatgcataccttaatttaaagaaatattattgctaaaaaatgctaacaatcatctgagccttcaaagagtcatatcctttttgctggtggaaggtcttgccttgatgttgatggctgctgactgatcagggtggtgatttctgaagggcaaagtggctgtggcaatgttttgaaataagtccacagtgaagtttaccacattggttgcctctttcttttgtgaaagatttctctgtagcatgtgttgctgtttgacagcattttacctacagtagaatttctttcaaaattggaggcaatcctttcaaactctgctgctgttttataaactgagtttatggaatattccaaattttgtcgttccagcgacattcacggcctcttcactggggtacattccatctcaagtacattctttgctcatctgtaagaagcaccttctcattaaaattttatcatgagattgcagcaatttagttacatcctcaggctccacttcttattctagttgtcctgttatttttaccacatctacagttacattctgcattgaagtcctgaacccctcaaagtcattcataaggattggaatacacttctttcaaactcacattaatgttgatattttgaccttctctcatgaatcatgaatgttcttagtgacatctagaatggtaaatcctttttagaaggttttcaaattacttcgtccagatccatcagcggaatcactgcctatgcagctatagtcttattaaatatatttcttttttttattatttttttgagacggagtctcactctgttgcccaggctggatggagtacagtggcgtgatctcggctaactgcaagctctgcctcccgggttcactgcattgtcctgcctcagcctcccgagtagctgggactacaggcgcccaccaacacgccaggctaattttttgtatttttagtagagacggggtttcaccgtgttagccagaatggtctcgatctcctgacctcgtgatccgtcgcctcggcctcccaaagtgctgggattacaggtgtgagccactgtacccggccttaaatatatttcttaaataacaaaactctaaagccaaatttactacttgatccatgagctgcagaatggatgttagcaagcatgagaacaacattattgtccttgtacatctccatcagagctcttgagtgactagctgcattgtcaatgaatagtaatattttgaaaggaatctttttttttgagcagtaggtctcaacaatgggcttaaaatattcagttaagtcatgctgtaaactgatgtgctgtcatccaggctttgttgttccatttataaaatacaggcaaagtatatttagtatcatttttaagggccctaatatttttggaagggcaaatgagcactggcttcaacttaaagacactgataactagagaatcagcctgtcctttgaagctttgaaaccaggcattgacttttcctcttgagctatggaaatcctagatgacatatttcatataaaggtatttcatctacattgaaaatgtgttgtttagtgtagctagcttcatcaataattttagctggatcttctagataacttgctgcagcttctacaacagcactttcagcttcaccttgtacttttatgttatggagatgacatctgtccttaaacctcatgaactaacctctgctgccttcagacttttcttctgcagtttttccacctctctcagccttcaaggaattgaagagggttagggccttgccctcaattaggtgttagctcttaagggaaagttgtggctgctttgatcttctatccagaccactcaaactttcttcatagcaacaagaagtttgttttactttcttatcattcctgtgttcactgtaggggcacttttaatttccttcaataacttttcctttgcattcacaacttgactggcacataaagcctagatttcagcttaacttggtttttgacatgctttcctcactaaacttaataatttctagcttttgattttttttttttttgagacagaatctccctctgttgccctggctgggtgcagtggtgtgatcttggctcactgaaacccctgcctcccgggttcaagtgattctccagcctcagtctcctgtctcagatactcccagatacagagtatctgggattacaggtactcagcaccatgcccacctaatttttgtattttagtagcaatggggttttgccatgttggccaggctggtctcaaactcctgaccttgggtgatctgcccacctcggtctcccaaattgctggaattaagtgagagatatgcaactcttcttttcacttaagcacttacaggccattgtagggttattcattggcctaattttaatactgtggtatctcagagaatagggaggcagaggagagggaaagagacaggggaactgccagttggtggggcagtcagaacacacacaatgaagcttaataaggtgaagcacaataaaatgaagtatgtctgtacttatattttccttctccacaaaacatttccctaaggggtgtgcatgtgtgaaagatgggtggtggggaggaaaagaggagagagaatattgagttattgcaggatcaactttgctccatgaactttgtaggggcttttacttacttacccttgctgccgttcaccagcaaatctcagtttctagaaggttgagaattaatacagttttgaggactggccctagtaaggcaaatgtttgagggtgaaagaaactcagagacatttgaggcaatcacgtgcaacagctggactaggtgcctggcagtagaaagctcacaaggacttaggtgagatggcgttatgtaataagagatctgactgtatgtaacagggcacctactaagtagcagggatactaacaacataacctaccaggaaagagaatgagcaggacctcaggggagaaagcccttcaagcagcagagtggttcagggtaaatattcctcatcactggaaggatcaggagaccaaaggccagctgccaggaatagaagattaaacttaacagattaagccagtactagaagcaggtaaaggagagagggaagggctacaagaatgcttacattagacctagcacttcggcctaactggcagcaaagattcaaagtgggatactcactgactttgagacttgagaggctcactgaatatgtattctctcaagatagtagaagagaagggcctgactgtattctggcttctgttaactggttctgtagctaaactaagcctgttagaagagctggtcttcagataagcaacagtaggagaaagtcagcttggctgtgaggtgttgtcaggtattgtaatttattcataacaaatacactgatttttcatgaccaatgactaattagcatcagcctaaagaggtctgtattgttgaaattatagagacttaaggtgtctttcagatgtaagccatgttttttctgggtagtgggaacaacaatcaatcaggaaagtgaaaacagcatcagtgggcaccatcagaggctacaattttttttgtactgattcaaacatatcttttaaaaatgattaagtatataaaagtatctaaaaaggataagataagaaatacgagctcacaaagggggaataaaagtgtagaacagccgaaagggtccctcagtttcaggccgagtgtgagaataggacactctaaaacactttaaaaatctctaaatacccagagatttctttgttttggattgtatttttcttttcttttttttttttttaaagctaaagatgaaatgctgtcatattacaattttgtttactggaagcaaaattgaccaaaagaaactgtccttaaactgaagtttaaagttggaacctcatgaaaagacagtctttataaatgatcaagttggcatgtcagggtaaaagacaggaatgtaagattaggcaaaccagaattttctctgctgtgattgcccttgctcttgagagctcgttctttctctttgactattagcccatggcagttgactcaactagggaggtcagcttctcagccgcccaagtcccaggaagaaaagacagaaacacgtaacctgaaatgacacagccgctgatgcagcttgttgctctgcttgcttatattttgaagtatatcatgtaagctgaattgcaaagaatagcattcgacagggtgaagggttgcatacactgaagaaaaggcaagattcttggtgaggcaaaagtctgaaggacaagtgcctttagcatcaactgaaagtcttactgtataatatgacctcaacaaaattggacagtgctgcatagtcaagaaagggatagcaaactgaaagaactgatttagtggtattgccatctagctagcttacttaggaattatttctgatgactttaatttcaataaggcaggactaattcctttatccacatttccatctatatctttgttggatgtttggggatggaagagtccaatagtaaaagggaagtagattcttatgtggcctcaaggaaacattgtgtattagtatgggactggataactagttatctaatatctagttactttatatatttgagcataaatttaacaattaatgatactgatttaagagactgattttgtcaatcaaatgacattttggaggtaggtaaaaaaaaaaactaaaaataatcccgcctagctaatacagtccttttcttgctgttgttgttgttttaagacaagttcttattctgttgcccagactggagtacagtggcgtgtttatagctcaccacagccttgaactcctgggctcaaacactcctcttgccttgaggtaggcaggactacaggtacaccacgatgcccagcttttttttcttttttctttttttttttgtagagacaaagtctcactatgtggctcagactggtctcacacatctgacctcaatcaatcttccctcgttggtttcccaaagtgttgggaatacaggctcagccaacacagtatttaacacagtattttgcctacagaaattactcaagaaatactcgtttaaactgtagctcaatttcctcattttccaaatgaatgtaataatttcctctatataatatagtgctctgctttcacaaaatgagtttaatatatgtaaaacaattttgaaaaatgaaatgaaacatttttattaatacgttccgattgagtttaatatttatcccatgcctgctatgtaccaagtgctctgctcatctgtttactagaatggtgtggatatggtctctacttaaaagaaaaataatctttttctctttaatttacttcgtccctattgaagttttcattgtcccattgatttaaactattgacacatagattgaagcttgtatactttgaacttatcttgtatttttctttgcttcaaacttttggttctctgattggtttttaatctctgattgtgctgggaccaggtcataatcacatggaagtttccttcaaactgcagtctcctctaagattctgcaatatcccctaggagtgctaccccaatcctataattactgcaatatgagtggctgtcatttccagatgtgtttccttcaggtgtgtttgagggtggtcaaaataatagagatcctcattcccgatagatccttgtttcatggttagaatgcacttcaccttcatcatgtactatggtatcaatcattaactgctatcataggaaatctatttattctttgccagcaccattagaaagacttcataaaccaggtaaaagtgctttctcttaagcagaaattttaaatgatgttttgtagcataaagtgacaatatatatatttaaaaattttctaacccccaaattcattagtttcaccaagtgcttccagcctccatcttagtccttttcttctttaactttagaccccaaattaacttctccagagctccctacaacgtatcttgtttcttgagggggaaaaataaacccccaccaaattcctgtaaaggatacttaataaatagtcattacattccttcaataactttaccattaagcttctgttgagtttgtggctaacatttcaaaaataatctcaactttttcttcttattgctgctgagttgggtgtgtctttcattgtggctagatgagggacataaaattagtggtaaagccacaaataaccagagaaatttgataatatgaaataggaatacaatcatattttctttgtttatgaataaaatttaggaatctctatttaaataatctcgacttatgaagagcaaaaatgtttgccttttgcactatgaaaattttactttaaaggttattctgttaaagttttctgttttaaagtttagctatacagtttttgttttaagagtttataattcttgttcttggggggaaaagagttagtattacaaaattcgtttatattaaacatgtcctttttgcatgtgaccaaaatcattggttcctaggtatgttttgcacctgttcatgtcctgtgattttagttctccattcctcatctttgaattgccactgatttcaaatccctgtctccaaaacaatataatgaccattctctgttagtctatcttcaaaacattcccacttggtcctatattttatcagccttcacatttccctgaaaatatcccctaaatgaaccacagaggattctgtgctaaatgcccaggaccacaatttgggaatcattactctatgtgactgatttctcccgaaacaaacactttgatcatttaaaaatgatggctcttgctgagagtactaatgagcaaattcgtgctttgtggtttatacacaatggaggattaaaaatgggttcagaattggactccctctttagtcttccaaggggaacattagtgagagagttatttttaaaaaattaatcctattttggcagcttcccttgatttgaatatgaaatggtgttaagtaggtgaccagtgaaatgactttctcttttctttgtagatgtctgtaaacagtggaaatacgaaaatgtttctgtggactttctagatccaaggatctagtggcccctcacccgctaataacagccaagagattattttgcagctcctttcacttagtgtctagaaagataaacatagagttagataatagcatgaatttttttttctgatatggtgcgaaagcaaatgtaagcatttcactagttgactatttcttggggaagactcatttgtctgtgtaaaatgccttcaaagaccaagaggaagccaaggccacagggaattagagaagggctagagtccccacattcctttgccttctcctttaaccccgactatgtttacagcccttagaaagtgcattagggagtgagtcttcaatctgaagccttaagagcagaagggtatggcctctactttaaaaaggtattgtttggataaagaatgcaggggttccttcgatgataatactagctaacatcattgagcacttatttcacactgcccttgaagtcacttcagaagtattaatccatttgatcactccacaactctaggaaataggagctattattgcctccatcttgtagatgaggagactgagacacagagacgttaaacgaattgccctaagccacaaagatgagaggtgcatgcagtctttgaatctactagttgctaccattgtaattttgcgaaaattattctctgctgaatcatacttataattctttttgtattccacttatattgaaggatctgataaggaagtgggacttttcatgatgtaaattgatgggtgagagctctcatttatccaattaggtgggagaatagcctggtccctttctctttctttcaaccttttgaagaaaaagtttctttttaaaatgatacattacattgtaatcaatatttatgtttattaaagttatacatgaagttaagactttagtctagaaaacttttgattcaacatagcatttctctgacttctctacctgtctattcatcagttccccttcctagaggcaactgccttcaacagctttgtttttttgttgtttcttttttgtattaaccttcttttctttttaaatattacgcatatactgttttccctgatttatctgttctaggcattatgcactttccgttactatagtttaatatctcatttacacctcacagcttcttcccttccctctattgtttcatcatagtttttcacaatttttagttcaattactaattgacattattattttctaaatttttccaactatgtcaataattatataaacataaatttctttgtattcaattttcttggatggagtaaatgattgcctaaattttaattttacttatattttatcataactatagctatttttccaaaaatatcaacaaaattgccaaatatctatcttttggccaaacactgaattattaaataatgtagtgcctccttttaaaaaatttcctcccattgttctccatctgcttgcttaacacatcttgaactaaaggctctattggcctaacacgcagtgcagaacatgtaacttcttgttgccatgttcctatgttcctgtgttcctgtgccttattattttgtcattattattattattattattattattattattattattatttgtctcccaagctagagtgcaatggtatgatctcagctcactgcaacctctgcctcccaggttcaagctattctcttgcctcagcctcctgagtagctgggattacaggtgtgtgccaccatgcccggctaattatttttttgtatctttagtagagatggggtttcatcatattggccagactggtctcgaacccctgaccttgtgatccacctgcctcggcctcccaaagtgctgggattacaggcatgagccaccgtgccggcccctatgccttatttctaacgatttttttttttcccttggtcaaatccttcattttgcctaaacacttcccctagttgcttccaaacaagaatatagtggaaataaacacatttagtccttccatatcaggaaatgtctttacttaatgctatcatttgattgataatttaacagattatttaattataggtggacaatattttctcctcaaattttgaaagcattcttctagcctccagtcagttttagaagagtccagtacgattctgattaccaactttttgttgtaagtgattgttcccccttcctctctcttccacatacactatttttggaagattttacaatcttttcttagccccagtgttctgtaactatatggtccttcttgttcatttattgtacagggcacttggtaagctctttcagtcagaggctcatatcgtaaaatttggagacattctcttgtacttcatgttaaattctttttccagctattaaaaaaaaattgttcttttggatttttctattaggtagatgttgaacttcctactttattctctgatcttttctttctttcttttttttttttttgggagacagtctcattcctcattgcaacctcccctctcaggttcaagcgactctcatgcctcagcctcccaaatagctgggattacaggcatgggccaacacacctggctaatttttgtatttttagttaggatggggtttcaccatgttggccaggctggtatcgaactcctgacctcaagtgatccacccacctcagcctcccaaagtgctgggattacaggcgtgagccaccgcacccggacttgatcttttctttctactcgtgtgttcgcttttcctgatatttttgggttagctattttttcctccagaaatttacttgatttaaaaaatatatttatatttttactttcctaatgccactctcatttattatttctgtttttatgaatcttatatattttcttattttaattacagtgctaatagtttttgttcgcttgtttccatctgtttcttgtattatttctgcttactttgggtttctttctgtttgcttattttgatattcttatttcatttcacaattttttctaaagattgtaagcttcatgagaacagagagtgttttatttagcacttgaaacagtatattgcacatattattcaatgttattattcatacaataaatatttccttaattattagttgtaagttagtaagtagttaatttatagtaactcatatctgcctattcacatttttaaaagaggcatttaaaatgctgattaaaatttccttgtgtttggagcaggggcactggacttcttgactgacagtcttctctaaatcaatcacattatgaagctgacttttcattgcggatatccaaattttagtgtctgcaggacctgggagccattcacttctgctagagaagactcctccaattttctggatgaagggatatatttttgcctctgacatatctgggaggttgactgaggatggggactaaaagtcttgttgctaatgaggtagattttaatcccctagtttgcagtctcacactcacctcttccctctgcaatgccaagtgaccttgagtctagactctagaagcttccttgtttaattttgtctcatgaaggtctgggagccgtcagctgactatttgcaatgggtgagtaagcctgggagtctagcctttctgaatgatggctgttgcaggcagtcttgaccatatcttcatggtaccaggcactaccaagtgatcagcctcttggatattctgtagcgaaaggcaaatttgttaacttctttgtaattaataccttcatccccacaactgcaccccgggagtgcaggggtgcaatctcggctcactgcaacctccgcctcccgggttcaagcgattctcctgcctcagcctcctgagtagctgagactacaggcgtgcgtcaccatgcccagctgatttttgtatttttagcagagacagggtttcaccatgttggccaggatggtctccatcttttgacctcatgatccgcccgcctgggcctcccaaagtgctgggattacaggcgtgagccaccgcacccggcccacctatctatattattatttcttctccaagaaacatttccaatcaaaaggtcaggtttttttctttagaaaaggaacataaaccccaagtattatatatgctacgcaggtcgaggaactagtatccaaagtatgatcagttatttcaattaaagactcattgtcgggggtcattttgaaaattctatcttatttcagtaagagtagatgtcaaagctcctaagagaaattatggaagtccacctggaaaaggcttgcaactgacttggttcgtattttaaaaagaatgatgtatatgtttctaacaaggtatcttagggtaaagctattgaagtttgtggtgaattcaaataaataataggtcacatgtataaagaggtacaatataaaggttgaaaggccaattccaatatagtgttatacactatgctaagtattgcagatttaaagatgaataaaacatgccccttgccctcaagagtcccttgataggacatctgcttttcttcattttcaagaaattagttgtatgtgattcttactgttataatcttgggatgtgacaagttgtgagagaaatgatttatcagggaactttgatagctaaatcataccacagcaatcagattaatgagttttggatcaatctagtcattcttttttctattttcaccagaaactcctaactcccaatttagcttcaaataatattttttcaactataccgatttacctcttctttgactagttctcttttagaatacatctaagtaagtggtactaacctggaggtaaatgaaggacccatcttttataaaaatgtgctgccttgaagaatttttttgacagaaaaaaatggcagactttctcttataaaccgtatgttcttacatttctgatatctggaatcaacagcttgccagaaacatttccaatcaaaagccagactaacccataaaggtgtccaaagaagtctgttctgattactgaagatgttgaactagtcttgacttcaaacagtagatatttctacactttagtggtatatgacagctctattcattccacaatgtcaaattctttggttttggccattgggtatttatgcacttctggctagggaagcagagaagcctaatttgattctggagccaaaagtttttaggccctgttcctttggaacttggactggagaatgttggcactgtataaagactaggacagatcaagtagtcacacataactaactgactcaacagagcatattcagagagaaagatcatgcctacacatggataaccattctccaaggcagactaacaacaccctgaattcaatcacccctaaataaacacacaaggaaagcacagctttaacataccttccggcacagctctccaatgctgcctgattggttttagtgccataggccaggctgcagatgcagccattactgttgttcttacttatgtctgtctgctgtctgctaacaagcattcatatgctttggatcattaaagtcacaacctcctatgccaatctattcctctccacgggtttgctgtagatttgaaagagagatgctatttctgtttctttttctttccattaagacctccagtcagggttatttctgaggtctgaatatcctagcttgtacccttgccctcattgaacatataaattgtgttccattaagtttgttctttttgcctgatttatttcccttgctgttgtatgtgcctttttaatgcaaggcaaatgatttgtgctggaactgcaacagacaaaagtgctgtaacttaagctgcttcctgatgccactgctatctatgagaggtctgctgtacttacacccatggtaaatatcttctgacagactccaggtggtcaggattttcacaatccaacccatttcagtgttagcacttgtcatgtggggctctgtgaattcttccctttcatcttactgttggtggcaggttggatacatttggacatacctgtacaaggccacatgtgtccacagttataatcgaaggtggagaaacacaagtttctctttcagggaagcacagaggacagatattgtacaaagaaaaaaagaaaaaaaattgtcacttgtagtattatgcaggctgcccatctaaacccatcattgcctggcacctacacactaagggcaagaatccagccaacttgtgagtgggcaccatgccatttgagcagatgggcatggaagtcggcagccagtagaccatgtatgtgcatcaacggtgggtgttgagggcacgattcccagaggagaatgtcctaacagctgtctggcctgagccaacatacttacgaccaaggaaaagtgccatccttcaatcctgctgagttggattaaccttcagaactaaatctgctttttcggcagcagaaggtgagtttagggtctctgaaaatctcaaagaataagtgaagaaaggaaactgggaggatacaattattctctattgactaaagatactgaggacattcaatatgcttattttaaatctttgactgagaacctgttaattcttgaaagaatgttataattgttcaaagcttggcttcccacaaagctgttaaaagtgacctttaaacataggcagaccattttcagtgagttaacacttttccacctttgcattaagaaatagtgatatatgaagaaaggtgtcagtagactactgacagctgactgtgggtagatatctttgtcaaacttgacatatcatggattaaattagatctatcatggatcagagctttcacaaaagagaatttcttcttcagtgatggaacatacacttgaagaagtaagaagtaaacttcctatttcaacgaaagcctttctgggcaatgaaagaaacatttttatttgagactgaaaataaagcctgattctaatttgttaagaatttccagacagttaaacatcattaaattagatagaaattgtttctgccaaacatagccaaatggtgatttgacaatgatttgttttacttggttaggaataggtagataattttaacattcagatccttaattattttctatgttgctttcttatgaggtatttgtgtggtagttcttgctattgttttctgttgtcttaaatctttttattttaaatataacatatgactttagttgtggataaaatatcagtttggttcaagattatccacctacgttttcttaatctactccctaaactatttcattttgtttatatcaagagagtaagtgcttatattattgggagtgaaagagattaataagttattttatctgctaatggtaggaactatagctttggctttgatgaattatataatgtcttagatctaataccattagtaacattatgagtagaataaaatgtttatatgtctattttggccctgagtttctcattatatcaatttagaaattcatggctaaaaaatacgtgattctacagagaaaaaccaagaaaattatattacttaggcatctctgagtttcttggctctggtggttcttatcttaaaagccgatttgaaggctaaaaattgtggtatgtccaggttccatgtgaatgacccctctctgtctgagaaaacagagagaaacgatctagcgaaaatatacaaaaaacataggggaaagctaaagggaatggtattcagcaataagcaagaaaatgtgtgtattatctataactaatttttatttaaatagtaaggtcatgacgcagtttgattttctttgtggaacacatgtgtttgggactaaataaagcagagaaagaatattaaggagttagaatcattttagcaaacgcttccctttggctatctgggatataggaaaatgtggttgaagctgagttaaagtcagctagacttgtgccaggagcgagaggctggtgggcactgcaggtgatgcagatgtttataaaaaaaaatccacacttttttaaaaatctgataaacttttatttgtcctcaagaaggtttttgaatcatttcctttcattttgtgccagggataaaaaagaaaataagagtgtcagatttctgactgacaataataaacaatcaaaagaggcttagggaagagcccccctcccaaaaaaaaaagagagaatatttgcttctgaatgtccactatggcaattgaatgatattgtgggcagatggaggaaagtggaattgtgaaacaatttacttatcatacactaataaggaacaaaacagaaaaattgcatctttctttcgtttatgacattggctcccactaggattatgaaaagatgcatttaggtagtgttagaataattgtgggacatggataaattttacatgtgtccacaaatagttaaaattagaagattaactgtaaagaaaaaaaaagcttcactaactttccttaattcctgattgtaatagctttaagaaatagaatttggcaaaacaaatgaagatttgaatgtaagaattgggatacaccaaaaaaacttttaagagactgtagagataaaaactaaacttaaccacagatttattgctgcttttcatccaagtatccagggacgttgctaatgggaggtacgcctcagaaacgtacatgtctgtgaaaatgttggaacaaactaatgcttttcttcaagtgattttatttcaattctaagccacaagatataaactttcatcaaaaatgggaatctatttaaaagcagagctatgaggaatgtttcatgtttatgtataactttcatagtagaccctcctacacacggaaaataatatgcccaaattctgttatttttacagtatgtaatatatcacatactaatcccacccatcagtttcatatcctttaaatagataaaaatgaaaaagggatggaagaaaaaatgaagacactttgaaaaactgactttttaattcctctttttggagaaaaagatatctgaaaaacttaattatgatccatatcctaataagaacaaagaggaatttgaaggaaaatacgcattatatattcagaatactatcttttttcatttcgctttgcacaattagaaagctaagtacctggggaggggaagaacagaagtagaaagggagagagtggtgggtggtgataaataaggaaaaacacagattttcagtaatactaggttcaaaataatccaagtcagaagaattttatatttcaagttttttcaatggtagttacaaatcattcctatttgcaggacgtgataattcaataggaaatagtgccattgaaaacaagattgcccacacgcagtaaaaagataaggttggactctttttttctccccaaaagaagggttaccatcagttcaaatatttatcaggaaaactcagttgcttaatatgcagaatattgtaataaaaataatttaagacataattatgccaccttgaatgaaactcttaataaacagatcagagaaacagaattgtcagggccccttttctttttctaaaatattgcaagtaaattaagagtaggaattcacaaaatttttcaagtgggaattttagcatgatattgaaaccaacattccatcatttataaatataagaactagcaaaataaatgaggctgtgaacatttaattatgcaatagacatatatacatgttctattctgtttagaggggggacctatatactatataaaaacatttggaaacaaaataaaagagacatgcataaacataatacattaaagcttctcagaagctttacagaaatgcttctgtttttaagagaaaataatttattgaaataaagttgtatcaagctactgctaatattattcttctattcaagttttcaaaattcaataattaatgaacaattctagcaaaagcaaaaaggattgaagatcaaatgttggaaccctcctttgtcagcattctgaaacttaatctaagcaacttgaagaataaaatgtagggtttttatatcagatacattttaaaagttctgagattgttgaggaagaatttaaactactgtttaaaatgaaattctctctgcaatactggtagtagagattttataacacaaacaaacaagtatattttgatcacttactattagaaattactgacatatggatgtactaaatgtgaaatgttttctgggtataaataaatggttcataaggacatctaatgttttaagctggaatatttgtcaagagcatgtcccataataatttgtaaaattgtcagataataataataagctattaatcgatatctatataagtactataacattttctgttatttatactatggcttaggagagacttttttcccttcaaacttacttgataagattttggttgacccaagttttctttataattattatttcaattaagtatattatgtaaaaacaacctgaaatattctaatttttgctgatatccatgcaaaacaattaagccattttggatccagaatttcctaagtcataagtctcagtcaacataatctgatttggagtgatcacatatttctttgtctaatgctttactgagaacaacattaaagcaaaagacaggtgatgaaagctctcttttttcaacatcttcataacctggttgaaaatgatagattggctagtttattgatttaggaatgatcagcaatattacttcccctaaaggagtattaagatgattcacaacaaatttgaacctgatttctagcatcctgtataaatgtgtacaaattcataagtctgactctaaattctaccttagaaatatctttttatgcacgtggaggctctcaactttgtagttccccaagaatgtagtgactgcctacacacacacacacacacacacacacatacacttatattgctggagaaacaataaagtgtcatagttgagcttattcctagatctaggttaaaatactacctatgcctttcattagctatggattttcaaagttacttaaactgtgtttacacttcgatacttataaaaatggttaatattattaaccttttaaggtttgggtgagaattaaacatgctaataaatgaaaaacatagagaaccatgcctggcagataataagtactcaatatatgttagcatacaatattatctttgtataaatttctcaatttgcattcttatttgtaccatggactcaatgggcccctttaagggtgaaataagtatgtgcccagtttctattttgagtcttcttatttagatttgtttcccaaacttcaatcattcacttgctatgtttgtgagttttttccatatttcataccataaattacttatttaattatattatttaaacttaaatagctttattttaaaataaaatatattcataccactagtaaatggttttggtgtgatacatttttctatgaaaccttaggattttataaatcattacaatgaaaacactcatcagctaaaataatctcttatgctcctaataatatgtacaccacacatttccaaacactgctttaaataaaagctttctataggtgattggaaaggaatattaagaggcaagtgggtctgtatgcccataagaatttagtagtggtcagatgaaagagggcatggagctagccatagaagaaatggtgcaactgacatagttaaaggccaagtgcccactcatcaatattgtggagacatttacttgctacttctctaacacttaagacttgagtttctttactttccaggagaattacttttgtcctaagaatgggaatctagttgggttttaaggaaatagaacaggaaaactccttccatcttggaactcttccactcttgaaagttaaatataagacgtatgtatgaaattttcagtggagagtataaatcttagtataatgagtagtaattaagagtagtacattctaaatgtatagcaagataaaataaatttctgtttttaaagaggtttagataccaaatgcatatattctttcactcctgagaagaagctgaagtatcagtggataattaataagtgtgaattttgggtttctacgatcactcccattaactaagtattctgccctcagtttcctcatgcatagacctttcatttagacgttaattgagcatcaactatgggtaacatatttaaggtaatgctagcagctgtaaaatcctctaaaatagatgatggttccaaaaaatagaagcttatttctcacttatgtaacagttagatggaagttttcttcaggaactccctctgcaacttttctcttaagtataaaattattccacaataaaaatttagcaaagaaaacaaagtgagctttactggcctatgtatggtttccccacatggtgattcagcgcccaaactccttccatcttgcaacttcatccctccgtagggccttgttcattgttttcccagccagggtgtaaggaaagagaggacatggaggggaaacactccctggttaatagccttagccagggagtggctggcattgtttctgctcacatcccttgatctgaactagtcacatggccactcctaactgcaaggtaggctgagaaatgtagcatctagaaaagaggatacaattttggtgaacggccatacccttcaccatatagccgtttacaccatccatccacctccccaatggacacagcctaaagttccatccagttacagcatcaagctcaaatttcagaatctctggtgataaacagctctctccataaagctcaggttttacgggaggggtggggagacagcccaggtaagtgatttagagcttgagatataagctctgtcccactttccctaccacgtccaatggacaacaatggagcaagaacttggtacctgggaaaaacaaacaaaaacctttctcatttgtcaaaggaaaaataggtaaacagccaacagtcactggaccaaaacaataattgaatcctgctggccagtctctgtgagacaacttccctcaaagtcaagacagtccccggctctcctttctgaaattccccatggccactgttctccagggtttctggccctgctttctggagtctgttccttctcaattatcttccataggacacctgtgaagcgaacattggggaaaattatctccttggatttttactttcttcataacccagttttcctagagcaaatgtggggttccaggttgtatagagtcgtggaattttttaggccaggattctgattttttttttttttggtagaacaattctctcaaaatcttcacagacattgatctaattccttcagtcagttgtatgtgccagtaaccagaaccaaaaacaataaagtcctttcctagacatagtactcaggtctgctttatttctttaatttcttacacttatctctctttctctctctttctctctctctctcatcctcctcatgccccttcttccctccttctttctctccaagtaaatatgaaacaatattaatgggagtttctgtttaaattacaaaacagtgtaagattttattataaattctctttctctttatgttttattgtagaatctgtctattatgcttcttcaggaaaaagaacattaagatttattttaatttgttctaaaagtacataagaaagtgtgatttttgagtatttaagcacatctggttactaatagaagacaagagacttaatagaatgttgatcctgtaaaagctgagctcacatcatcaacaaaaaaaaatttcaatatgaaatattttgtcctagtaacaaatcaccttgaaacatagaggtgtgaaacaatgtttttgtcatgcttagagtatgtccaaaaatttagatgaagcacaacaggaatagcttgtttctaccccacgatatatttgagttctcttctgggacgtttgaagtttaggggaaactcaatggccaaaaggcaatcatcgggagttctttttttttaatttttatttttttttagagtggggtctcactctgttgcccaggctggagtgcagttgtgtgatcatagcttactgcagcctcaaaatcctggctcaagtgattctcccacttgagcctctggggtagctggggactgactgactataggtgtgtgccaccatgcctagctaattaaaaaaaaattttttttgtagagttggagtctcactatgttgcccaggctagggctctttttaaatttaatgttccatttttaattattaggggtacataatgggcatatatatgtacggggtagtgtgatgttttaacacacgtctacaatgtataataatcaaatcagggtaattggggtattcactaacccgagcatttatcatttcttatttcacgtgttctcactcatttgggggcgctgtaaaacaattgatctcatagagatagggaatagaatgatgattaccagagcctgggaaggatagaggacttctttatactcacaagcttggtggttgatgctggctgtctgctggaacctcagcctttctatcaatcggaaacctataaggctttccttgtgcttactctgtgggtgtgatttgggtttcctccaacatattttccaagagtgaaggttctcagaggacacaggagaatgtatgacatttttgtgttccaatctttgaagtcatagagtggaacttctgctgtacttttttattgaagcaggcataaggtctgcccaggttcacatgagagaacacagacttcaacatttgaagaaaggggtgtcaaggttacatggtaagaagagaattgggtttgagatatgcttgcagccagccatctttgagtacgtattttatttaaattagtcaatgtccaaaacatttacttctcattttatatctacttaattcacatgcttgaataacactgaattggttattttatgtgtattcttactaaactctatcaagaaaaattatgtaataatatccaatgtcaatatatttgcagatatccagacacagaaggaatcattcacagcatatcttgaaagatgtcattcctccattggaacaactggtgagtgtttaagtcattatattcttcatctactgatacaaaataaattgccacaaaactcagcaacttagaacagcttaagttattatctcatttttctgtgggtcaggaatcagggcaccacttagtagagggatctagcttggagtctctcaaaacgttgcaacaaaagcatcagccagaattgggatctcatttgaaggcttgactggggaaggtctgctttcaagctcacttatgtggttgttggctgggttcagttcttccaggaatgttggccaaaggctgcccttatttccttgccacaaagatttctccaaaataacagcttgctttttcaaagcatccaagatgagaaggcaagagggagagtttgctagcaagatggaagtcaaaaatctcttgtaacctaattgtaaaagcaatacgccatcagctttgccacattcttttggttaaaattaagtcattaagtctagttcacacaaggggagaggattacataaggatgtgaataataggaaccagagactacagagggcttattgtaaatgttgatagttttttttgttattgttgttgttgtcttcaaaaaaaaattaatcgactcaacatccgtaagaatggcacttttttccatgtttttgtgtattgttatatcctagtgacaaaaagagtacctgaaatattgtaaataacatgaatgaataaagtattatatatatcttaaaaacacgtaagaccaacctttctgatatgttctgatacttctttcttttaatgacctcttttttgataaatacaatgtgcttttcctctatgctcattcaacttgtctttcctgctatatttcatattggtcaatatgcttccagtcttattggcttacaggatattgcactatgattactgcattcctgtctatctctagctatttcatccctgttatctttgggatgtcccatccttagcaccaacaataatttctttttttgcttcagtgttcctgttttctattgcttttcatgttccagatcccacatccccactccagctatttctccttactctgctttactttaggataagaatttctccaaataattgtctacctttgctgtttccaatttctgccctccctttgtctcttgaactaactctgtttaggcttttatctcaatcattcacctcttatccaggtcactgattgcctccatgttgttaaatccatcagtaacttctcagttgtctcttcagtaggtctatctgagcatttaacccaattgatagctctcttcttgaatcaattgcctagtgggtacaatgctcactgtttgggtagtgggtacactagaagcccaacaaccaccagtatgcagtatatccatgtaacaaataagcacatatatcccctgaatctaaattttttattaaaaagaaacattttcctcacatgactaccagtaaccactttctcatggctctccaattagctggagagccacctcttttcaaccccctttactggtccctcttcattttggagctcagtttttattttttattttttctgtctgtaggaatttcctagggcatctcattcagtgttgtagctttagaccatgtaacactagccagttctaaatttctatttccagcatggaccacagctttgaacttcagtactataaattctggcatttttacacacagttctaatatacatcctaaacttagcatatctgaaactgatcccgatttttgcccaaacccgttctccatttcacaagtcttctccatttcacaagatggagaagcacctccaggtgcttcagtcaaaacactaaaagtcatcttcccttgtttcagtcgtaacataaatgaacaccaaagaacccagtttgctctgtcttcaaaatatacccagaatcagttcatttctcaccaccattactatcatctgtcacccagtttattgaaatagtctccctgtttacccactttcgctttctactgtttattttcaacacaacagtgggagtgatcctgttaaaatgtaaattagattttgtttcttatcttagtcagtctgttactacaacagataccacaaacaaggcggcttttaaacaacagaaatttatttctcataggtctagaggctggaagtccaagatcagcattccattctggtcaggatctggtgagggccctcttctgggttgcaaacagctgacttctccttgtatcctcacacggcaaaaagagggcaagagaactggggtcccttttaaaaaggcattaatcctattcatgagagctccacctttatgacctaattacctcctagtaacattacattggagtttaggatttcaacatatgagttttaaggggaaacaaacattcggtccatctcacatcactccttgactcaaaatcctccctggcttttagtctaccccaggtaaatgctaagaaacatccaatggttcactaggccctagaagactcatcgacttccccagtctcacctctccctttcttctcctgtctccttctgctccaatgaagctgatacctcttcctctgcccggccatcccacctgcttttgcctctatctcttacaaaataatatatttggtgcccagaaatttggatatctcatatgttcctctgctttacatctctgctctaatatcacctttttaaataggtcttccctaatctctcttaaaaaaaaaatgaaacaaaaacaaacaaacaaaacccatagtggccaggtgtggtggctcatgcctgtaatctcagcactttgggaggctgaggagggggctcactttaggttgggagttcaagaccagcctggccaacatggtaaaaccccatctttactaaaaattagtaaatttttaaaattttaaaattacaaaattagccacgtgtggtggcactcatctgtagtcccagctacttgttaggctgaggcaggagaatcacttgaacatttggggtggaggttgcagtgagccaagattgtgcagagagagataaaaaaaaaaaaaaaaagaaacagaaaggaacctacaaatgaacaaacaagaaaccacaccatttccatgtacacttctgttaccttaatttactctatagaccttaccaccagatggcatactacagcatttatttttgttaagtttgtcactccattagaattttagttctatgagggcaaggacactgtctcctgtgttcattacttcattcccatgactacaataattgctggaacatgttagggactcagtaaatatttgttgaatgaaggcataatgaaaatttaatggcttttgttttcacttccaagcttgtgatacacaggtctatgcttgtaacctttctctcctgtgaattagtcatttgttctaggatgtcatctctatcatcacagaaatgaaatccctcaagttgaacccttcatcagtgccttctcaaactgattccctctttccattgagcccatctctattagtagcaaacatatatctaggatgagaacacattttctttatattctttattttctccctggccctttggataagtcatcattttctgatgaaacgtctcaatggttgtggtgcccatatgcttctccttgtgcacccccaaaccctcacccaagccttgaaatgcttctgaccttatcataccctatcatcccccccactgatcctaggcagcaattccagaacagccttctttcaatagtactttcattatttcattttcaaattttctacagcatcatggtccccaatttacgttatttattatcctctctcaaacacataccctcaagccaggagtagtaacatgattaagacatggctcttaccctgaaggagcttggatttcctgtagcaattacagtcctttcatcccagcacatgttcatgtgttgttttgtgttgctcactcttatttcataggtaatagacttgttccatggctggattgtaaatgtcttgaagttagaggccatgacttgtattttctttattatatcgtacttctacttagattgcttttggcactagtacttgttcaggaaagacatgcttgtgaattgatgtaataagaaattaaaagtttattaaaacaatgttgctagttgcagacattaataaatatatgcctaacatttgtagtgaaagccaatttttcaatataattagatatactaatatattgttttcaaaattaattacgtggatctcaacttagcattttctctaggaaggatttctctaattccttaaatttgaattagatagcccttctttgatctgtctctcaatagcagctgggtcttgactctattccagccccatcacactaaaattgcctatttcctttattgctcttactgagctataagctatttgaagggaggactatgtcttatttattgttttactattaaaacttcgtataaaggctggcacactgtagttctccaataaataggaaaataaatgctttatttgtttggttttattttaaataaatttggattacacagaaaataaagtacaaaaataattatgaagagctggattattttgtaaaaataacacataaaaagtttgctctgaagtagtcgatgaaacatggcaaaagttaggctgaaaatggagctcagtaaatgtctgtgtttgtgtgtgtgtctgtatgtttatacataaaatatatatgcacatatattttaacagtgcctaaaggtgccccaaagttttttacataaaaaattataatatatataaaatccaaattatagttatttaaaaaattaatttttatataatttttaattgtgtattttctatgccactatatcaagcataagctaatatcagaagaaccattagaatattcagaaatagttttcaaaatttacctgcctactcttaaggctatttgttgatttacttgcatatagtagggtttctctgcagcctcagttctaaataaatgaaactcactttgaatatcactaattatagataatatagtaatagataatagatctatttgcccaatactctattttagccccaatgaccttggaaaagtaacatcgagaagtcctgctaaacagaagcaaaaacaataatttttaagttttttaccttgcaatttatctcttttttgctgcatacccgaatatttttctgttttctctttttccttccttctctccctctcccattgacacacacacacacataaacacacacacacacacacacacacacacagtgccatgagttctaaaaacttttggaactaccaatcagcttacttcctagtcttgacttgggttttcctggatcatctctctgaacgcttatcttgctgtgtcttgtgaacatggataacattcaacttttatccatcaatctctacttgaattgaatttcttacttactgttattttaaaggcagaaacattatcttcatcccaaattcttatttatgaattatctatattgatgaacaatgccccaataatcacccattcccccagacagaaaatctgattgattatagaccattcattatcgttcacattgacacttgaattatttttcagaacctatgaagttttctttacatctgattaatctaatgctgtgttctttttaccaggactcacatactctttctgcactctggtatgttccctactttcatctctccaactctcctcacctccaccatgccttagggtggcttccagagtcatccaggagtcctggcagtagtttccttggctgtacctaccaggatgagctatcatatatgaaataatatacaggaaaatacttctgagaattaatgacattctttcctttggagttattatccatcatctctactgtatggatcttcaggcttatttatttctaaaatgttgggatatataaatctcaattcctttatatctcatattgagataactctactgaacattctccaggaaacacgagagacattggcttttggccaaatttatcaaagtgtcctattaggtccaccatgttgtaggacaattattcactttataaaatgaaatctgccattttggatgctctcatagaggctaacaccctttgggaatcatgctccctctcttaatgttccttttaagaaaatagattgtaaacagcatggttaaacagaacaaagcatttatttcttttgaatattggccaaaatacattcctaatctgaatctaaaatttcagagtggaaactacccagttcactgacagatgatgttatttatgccacatgtatgtaaatccatagggtttcggtagaagagacggaaatcatttcctgagaatcggtgtggttgcttagaaagtgctataatatcacaacagttttgtacatgaatcatcaaatatatcaatatgcatttgtttcctgatcttgtatattctatattataactgttcatgagacctaattattttcagggtactttttcttttccccttaaagaaacattcaagaaaaagaaccctgtttataacatgttaaatctttatcttgtttatttttatcaacagagtgtaagacatgtctatggaaaaccctgcaggagtcaaaagcctgtggcaggtttttacagaatcatctgctacctcctgagctaggaggattttgaggacagagctcaggaagttgctatggcttgggggcaaagcaggcttttgcagataaaccttaagtcacagattctaccttttagagccagatatcattttgtggattaattaatagtagtgagggctttgagcatgaaagacattgtgagaatacagtgttttcttgttttaaaacgaaggacatagactttgggggaatagttctattgatcaagctgggctttccttaaactgctgaaaaactctaaaagctctttagtctttcaaaattctacctgggtaagacaaaattaggttttctgaaatatccttccagatcttcaggctgttaataataagttatgtaacaataataagttatataatttaataatgctaatagaaaccatctctaagttttcattatttcatgtgcccttccttttctcaagtaagagcatgtatattaattcaagtatttgttgaggccatcactgtgctaggcttggaatatgtgataatatgctaactggccatgtccctttctagagaagcgttcagtctagggatgaacagaagtgttaaataaaggaaggcataattctataagtccaaattacaaaatgtgctatgataaaaaaaaaacaagtttctgtgagaacctacactggattaagtagtcacacatggattctttgaaatggccagttaacttgagattttgcaagattgatggagtttgccaagcaaagaactggaagaagaatgttgaagcagaaagaaacaagtgcaagggtcgccaggtcagaacaaagttgttacatctgaaaaactgcaaaaattccacagcagccagaatattatgaacaagggaaaagagtcacgggttttgaggagagagaggcagtgcccagattgcaaagggccttgaagtgatggtaagaagttcagaagccattgaaacacagaaacaaatgacaatacctctcccatccagctccacatttgaaatccatttaactctagagtagagaaaaagaacacacagaacagcaacaataaaggctattaatattgagcaatcctttcttccccactgcctagactgaaattaagttataacgcagaaattgaattacactaataagttgcccagacagtaaccaggaaggccattctcattgaagtccagtgacaggcaaagaacgaggaacatatttacatcaaagacacaaataaatagaattcagggaagaagagaaagcaatggtgggtggaagttgggtggtgcatgagggagggagaggtgagctatagtaaaagcctccagaagactgaagaaatttcttgagatacaaaaagggtgccttcctcagcctgtttcccaaacagaacctggattccttggtggtgaccaaatgaacacaccggttgccagatgaaaggttcagaaaaaaagtcgtatgggggttcttaaacatcaaataataacattttcaaaatgacattttgatgagttaggggtgaataaatcagagacatacagataaaatttcccttgaaatacacagaggtttaacatgatggggaaaagcacttggcaaaacataatatgtgctttgccaaacctaatatttgaaaaatggtttaagacattcagcataaccccaaagctggacatgttgtcttatcctaagtgagagaaagtaagggagggaggctacccatgaaaacattgctcaacaaacttattaaagaatataaataagttgaaatgagtaaaccatgcctaaatctgaaatcaaatttcatgctgaaatcaaacacgcttatcaaggacctctttgagaattcttggtgacctctttctatcaccacttatgtatgacccagaaccattctttgcttttcttctactcttcttcacatgcaatcattgcatccaactttagatatttggtttaccacttcttaaaaatgtgcacacacagtaaatgatgtatttacatcagacaaaaacatcatactgaatctatgtctaaaggcataatatttcattcttgagctatatttaaggcagttctaaaattaagacttttaaaaatgtttaaaaactattagtactttatatgatgtacagataagctggagttttaaggtattttttctgtttttgattctgttcttaatggattatgtccacagtgagttcgccggtaatgagcaaatcaaatatagcatgaatagcagagacagtatgggaataagtgaatattgagaagaaaatgtaagcaatgagttccaaagagaaagagtgcaacctaaaaacaaaggcaaaataaataaataaataaaagcaatagaaaaaagaaagacagataaggtagatatttctatgaatagtggagaagtaaaaaatggcgggcgtgggtggggggcgggaatttaagaaggaaagtgaagcatcatttgggggtaaaataatgtaaccaaatgtgtcctcattctgtgctctttaatagaaatcattgaaacagacaagattaacagcaaagtactatgatctattaaaagttcagagaaagtatagcagctgcctcgttattaaataggaaaataattaaatgctaaatctgcttgataattatagtggcccagggttgtagttatagagagatgatgcagagttcttttagagagaggtcagtcagtcacacagaaggtttcatagggtgatgctactttaaagggatcatctcagtttagagctggggcctgtctcagcattgtggatccagaaaactcatatttatcatcattattagtgtttactgagatgaagatcccttgagtctatctcacagtacataatagggaatattctgatactatttaagtcacccgctttctacatcaaagaacctaggaagctgaactaggattcagatggctgccaatgagcacattatcagaacaaaggggaagagaacaataacttaaatacatcagcagagaaaacgttatgaggcataaggaccatgtggttctggtgttaaaagccaaacccttctcatcaaaatctggtaaaagttgcagattaagtttatttccatttataaacagaaagggttattttaacagaaccctttggtggaatggtgtagatgaaaatctattatttgcaattgtatctgagaacaacatgaagccttctcataaaaaaaaatgcagtgtgtgtatgtacagttaacacactagtctttctgccatgattgttaccattaatcaaaggttgtcttctgctcccctgtcttgtctgtcgcctccaacgtaggttgataaacaggtgctatctgggtatcccactgccattcattcttctcatctgtatctcagcatggctgtgtctgccgagcacttcctcagtgcttgcagactggctggcatccagtatgaacaaattgctgatctttccagccatttaatgttaaatagggcttctaaggaacattggacaaatagctcaagaagccagatttagcatctaaagattggttgacatttcttaagtatacttagttcagggactgctacttctttaaagaacttcaatttggcctagaatttggcaagtagtatcctaaacttagacctagagctgtaagtaattttgtaaattactggagacaagaccatctgagctctagatgactagcacgctcaactggaatttatagatcattgtcccttcaaaccatgggattaacattgagtaggaataattattagagaaactaataaggtaccatatataaacccacatgcaaaatgcatagcaatcttttgcttgccctaatacttctttcggcacactatgaggctcccagaataactgattcctggtgtctgaaacatggtgacgtatttcaaactatcatgacaaagaatagtaaagtaattaatcctacctcgtggaaacttcacttgccagcatgagaccctttacaatgcagtgctttcagtgcagaaagcataattggaattttctacccaggctaaaagatggcctgagtctgtgagatgacttaagcagggcatggtatcccgtccccccagaaaaggagcaggaatatcttgaatatgaactcccaggagtttaagcctcaagaggattacaattgtcctattaatctttccagttctgttgtaagcagagaagctggcatttagaggaaagaagtgttattaattaaaaatgtgttgaaaagaatgaataagtgtacatcaagtattaaaaagacaatgaaagggccgggtgcggtggctcatgcctgtaatcccagcactttgggaggccgaggtgggtggatcacctgaggtcgagagttcaagaccagcctgaccaacatggagaaacactgtctctattaaaaatacaaaattagctggtcatggtggcacatgcctgtaatcccagctactcgggaggctgaggcaggagaatcactttaacccaggaagcagagattgcggtgagccgagattgcgccattgcactccagcccacgcaacaaaagcaaaactccgtctcaaaaataaaataaaataaagaagatgaaggaaaataaacacctgatctcagaagtgagaatgtgtgcacagtggtaggacatagatatactacgtgtagaaatctgcatgtaaacatttaacaaatatgcatggtggtagcaagtgtagtaggtaatagaacatagcagaagcgttattagcttcttctaatgacctggaaggcagcctgactttggaaaatgatataagagaagataactaacttgctattcagtccgtcctcatttttcctgggacctctgtatgatcattcctgaaaagtctattgcattgatccaagaccatggaactggctcagccactgatgacaatgatgtcacatttattgagtcttaacttgagaaatccagcccttggcatcaatctcaagtattctgggaaaagtcctgcagtgtctggggaaatgttacttatgtattcaaagaaagagaattctatgatgtacaccttaaacctgtttatgttgatttctccctataagagtattagctttttcctttcacatttcctatctcttttagaaaaattttcatcaataatttatctttgtgggtagcaaatgtctaccgagggatcttttgtgaatttttggaaaaaacaattggggctatatttttagcagagaacgcatgcatcaatttttatgatgggttgataggtttttgtagtttttttggtagataaatccaggttttgggtaactgttaatcagaagaaaacttaaataaaacaataaattttttctacggttacacaacaaaatttctcagtatacattcctaaagaaaggaacctcctttgtggtggtaattgctattgaaaacatctttcttccaaacatttgtggataccagtgatacacagagttaaacactaaatttattatatgggttttacgaggtagaaaaataaaattcctggcaccaagaaaaagggacagtatacatagaataaaatgtggaaaaagcaaatgaatagatgtatccaaatacaaaacaaaaaggcaccagtgaataccatggttctcaaaattatccaagaaatcttccttagatgctgtagagttgtggagaacatggtgaagtaaaagaaactttctggatatggagataagtaaaaaacactttgctatcattttcataagtcatcattattattatctctatcattatttatttagtcaaaaatgtattcatcaaatgcattttaaaactaagtcccgtgctatgtattaggaataaaacaaggcagaaaaactctcacctatatcagagcagacatttaaccagtgagattttagttatttggaacaactcctttacctctaaatatctcttcctttcacttgtagtattgaagataaatttcttggcttgcccagtttactataaatatttaaataaacatttaaatagccattcatttacttatttgttcaaacagttttattattttgactattggcactaccaaaatattccagaagctaggaatccaggtgtgaaaggtacagttttttgcctttgatggactcatagcacattatttgcctgcaggcacagataaataaaatgacatttacaacatgatctgatatgtgctgtcacagtgacaatggcaaactgaaaatggagattcaggatggtgcacctaaaagagatggcagagaaatcatggaaagaccctctaataaaaagacgtgcacattaaaatttggttttcttcttattttttgagatggggttcttgctattctgcccaggctggtgtcaaactcctaggaccaacagattctcccaccccaacctcccacacagctgtgattatagacacttgccacctcactgggttttactaatttaattttgaagtagattaaatatacttaagacttttgtgagatgaagacatggtcatggtggactatttcagctagggggataacatgggatggcactgagggagtgtggtcctctgatactaggcagctcagggagaagggtgtgggcaattcactaagagtgaaagatgaaggctaacgacttgggatggggcatgtgaggcagacacaggagggtagaaataggatgctaagaaattaaaacacctagtacagactttgcagggagtcaacccatcacaatttgcattgtgcatttattttgccaaaacctccgcaaacacttctgcggagttataatgacttgttgaatttcctttaagaaacttgcagctctattagaaatgaaagccaatacagtatatgcaaataggaaaaggaagcaatcctacatcatggaagaagataatgagatactgctactacagggtatcttggcaattgaccaaaatatatgaaatgttgctattttaaatgcccttccatgattcaactagctcagttacctggtcccattgaagtcttcctttatcccggcttcggaaggtacatggggaggcttgaaaagaagaacttttctaaggatacttggtaaaataaaggaaggcattcaatttgtctttcttttaccatttgcaatcaattttttaaacaagtgacttcaacgcccagaaagaaaagtcaataaaggtgtatcactatctaacaaatcattcacattcctcttcatagtctgtcttttagatatttaacagcttgtaatgactatgattttgcaggcacttcccataagctatatatgcattattaataaagttctatgactgaaaacttccgtcactgcaatgactcttgaaaagcataggtttattcaaatcaacaatgcatagtagtttgtcacggttttaacatatgcattcttcttgcagatggttgaaaaagaaggttatctgcaaaaagctaaaattgcagatggaggaaagaaactaaggtaataaaattctttaattcacttttatataactatgctggttcttcatatgctaaacttgtgccactgttattgtttgggatgcaagtccctatggtaccagactagaacagtctcctctgctactgctatgatcaacattatttttaatggaactacagtttttaaagaaaggcactacattctatattgtcgaacagaacacataaatgagatgctttttgtcctccttggacttgaactcataaaacactgaaaataaataagacaatggattgtgatttctgtgattgaaagattagagaatgaatgcattcatctgcaatacagaaaagtctctatacaataccttgtgagaataatttcttgaaggatggaagatttgaaccacttttgtagctcaaaatagaaattgataaaataaaagtaacatcatattcagaggtgagagaaatttgaaaagggaataagaaccttcagagaacaataacaacaaaaatcttgaagaaaaaaagtaaggttgataggacggtaaagaaagatgataattgtgtggtatataccgtatgtttagaaataatcacctccattttagaatttttgctatttctcgtattggttctgttacatatttagctttgtgctgggtgatatgcaagttaccaaatttgtagaaaatgctcaagttgagagacaaggcatttactcttaaatgtattactaacaattaaaattaataggataaatgtactaattagctacacaatgggacacatgttagttgtataatacaattcattactagaatgacactctgggtcaacaccagagaataaagtctgcttttgtttgatggttataatgaattaatatatttatttaaacaaagtaaaatttggaggggggtggagaaatcatccacaatttcactacttaaaatagctatttcagttgtaaataacaagctctattttctctccatattgtgtcttattctgggatagtgaacaaggccttaaatctttgcctggactgtttttctggagtggccctgcagccaccttcccttgaagagttcaggagagagatgcacaggagacaagatcaaatgcaaggttgctttaagagatgtggctagtcccttccccagtggtgaattgggcttagagaattgggttctgaaggaacaacaggaggaagtctttgagtagcccagcccgagtgctctcctttcccctaaaccttatcatgaccttatcaactcaggaaggagtgtggagggtacaatgatgcctctccccaagatgagtaagtcatgaccctttcttccctcagcagccatgtggaataaagagtttcttcaaaattatctaagttagccagttcagccctccactagagctgagtaggagaatagaggtgacagcattggtcagttccaccctccagcctcatgcaaggaagtaggggagatcctaaatgaaataatttcaagaaagcagaaggaggttctactgtgtggttttgtaaagtatccttgtccataacccctctgtaaaccaaccttataacatacagaaggcagtgtcaagaggaagcagagaagaacaggtcccttcccccagccaactcacatgaatatgtttttaggtagttttattcaatttgtatactattgtgtttttgttttatttgctgttactttcctgttttccgtgttacagttaaattaatataaacatttgtttgtactctgttttattatttcactttgcataccattatgcattctttcagccttttccacttaaagttatatgttttagttttccttttttttttttttttttttttgttgctgctgttgttgttaccccaggtgcacagaattgagctgattatatccttcggtttgtggccttgtgctattatcattctgggcaagagccctagctggttttattttattatcagtctccaatccttgcttcaatcccttgtagaccttcattttaatgtatttaatgtgtgtttatcaaactcattctccatatatatctatatttagctgtatatgtggcattcaaaaaagaatgtatagttgtgtatgtgtgaatgtgttctatatagcataaacatttttgtatcataaaccttattatgtttcttactactttcattcaatgttagctcttgggcagctttctatggtgctatagagacatgcgtctcttaatgatgggcatatgtcctgagagatgcatccttaggtgatttaatcatcatgtgagcatcatagagtatacttacacaagcctagatggtatgtgatatagcctattgctcctaggctacaaacatttacagtatgttgctgtgctgaatactgtaggtgattgtaacataatggtatttgtgtatctaaacatacctgaacatggaaacgataatgcattgcgctatgatgttatgaagactaccatgtcgctaggcaataggaatttttcagcttcattacagtctcataggactactatctatatgtcgtccattgtggattaaaacgtttttatgcagtgcatgaacgtctttaaatctagttcatttcttccaattgctggccactttgccatcgtttatgtgtagtcatgtgccacatggtggcattttgatcagtgatggacagcatatacagctgtggtcccataagattataaaactgatgcctactgtaccttttctatggttagatgtgtttagatatacaaatacttaccactgtgttacaattgcctacagtattcagtacagtaacatgctgtacaggtttgtagcctaggagcaataggctatgccatatagcctagcgtgtggtaggctttaccatgtagatttgtataagtacactctgtgatgtttgcacagtgacacaatcacctaacgacacacttctcagaatatatcctcatcattaagtgaagcatgactgtatatgaattgttacttatccagtctcccagctgtggacatctaagttgcctctaactcctttcattccaaacaacatttcaataaatcgcacatatatgtttcctttgaacctgttaggaattttctcaggggaatatttccaggagtacaggattgctcagtggtaagtcacatacatttgtaaatctactgactactgttgtcacactttctcctgaatgagtgcaccaattcacaccagttcaatgtgcaatacagaagggattctactttccacagttttatcagcacgtagcatcatccaatctaattatccatagaacattaccttaatgttgcttttatttgtgtttcactgataagtattgaagctgaggatcactttatctgtttagagacattcagattctgcattctgagtctattcataaactttgactattttctattgagtttcctgcttttttattcaataatttgaggaaactcataatatatttgggataataatgctttgtcaattttacatgttgtacatatcccctccaagtttatggggcttgttttgtttttattgtaaatacaaattgaacattgtatatgtaatcaccatgtttaagaacatgataatcccattatgttgataggctataatatgccaaatcatccctacctctttttttacttgatttttaagttgagtctggttttatatttatattaaattatttgtattagaagttatcattgcaatatttctcctgttgcttgtcaatttttcttttatatttttgtctgttttttgagacaggatctcactctgtcacccaggctggagtgcagtgatgccagcctcctccacccccatccatccacccaccttatgcggggataaatgagtagctgggaccacaggtacacaccaccaggcccagctattattttgtatttttagtagagacctgggtctcgccatgttgctcagaatggtttggaacccctgggctcaagagatccactcaccttggcctcacaacgtattgggattacaggcgtgagcaatagcacccagccttcttttatattttctaaagacaaatgctaagcctgcattacttgatcaaatcacacgaccattttaaatgaatcttagtatgcactgccatattgcttacccaaggagtgtatatgcttttatcactagcaacaaaaatggtcagtttagtcataaccttgaaaaattatgtagtttttatcccattgatagtttagtaactaataaataatataacatactataatttatgcttcttatataaaatttgatagccttcatttcatttatcaaggacctttgtatcttttataaattttaatgaattaataagcaatattaatagatgcttactctgtcaagcacttggctgaattctttatcagtaatacttaaatgatactacaatatagactctattattgcttcctattgtataaatggagaaactcagtcaacagtattaacctcttatttctcccaaatcttattttatatatagttagtatcacagaatttagccctgacctctgcttgaaacacgtttgctttatctctcttgctttaagctatttgagactagtgagcaaaaatggtcctcttatttcatgccatcaacagtaccaggtacttcaattgtcacttaataagtattattttattaatttctatcaagttttctacttataaatccataatagatcatcataccttgtattgtcttcttattttccttctttctcttcttttttatgtgtctttatttgtctctttaatgtattttctctttctctcaaagaaaatttaacttatctctgaatataagcaggagatggtaaaaggaaagataaattattggctatatttgacattcataagaggccatacctttagccttattttgaaatgaggttatacacatttccccaacaatacactgacaggcttgaaaacagaatacattcagcattcactttaatttttaattgtgaacactgaaactatgccttagcttatctgatgaaccataggaatttcttcatttggggaattccgtccccaaacctgtaagtaaccctggcttctctgaaactctatgacaccttagtaaaaagttattttcaatgcttacatttacaaaatacacctgacagtatgtttatgaagtctcagcaccacaaactttcttctccctcggcatctaggtcttcccgtcatcagctcctgtgtggctctgcgtatcttaccacaatatagagtcacattcttctctccttagatggacatagaaagatatacttgggggtgaaaatatggccagaagatggctacgaaaagaaatgcagaaaaaagattgtgcagtggttacgtctactagtgcctgctttcatcctagggcccatagctactaggccttcggttgggtttttgtttgtttgttttaacagttgttattcagaatggactttctttggaatgtgagactaaggtgtgcgcctaacgtcatcatattttttctttagtagtttctgctcagtatcgcaataaattcttccaggctgaatctttcttcattttcttgcaatactgacagagatgggtatttttacacctcagtgtctttttgacccaccttttagcagtcataaattacaagatgcttagaatatgagacagaagaagtaagttcctagaccaaccagtttgagaatgagtctgtacgtttaacagtgtctgagtgattttgcggtaaatcaatcagggacattagaataaattactttcactcccatcactggtgtggaatcaagtcaaatccagcatgaccaagttaggtaacaaaggcagatggaccaaataagagaacctgaaatttgtcaaggaacctcacatatattttcttctgactttttggtttgccactctgtcattacctaaagaaggcaaaagaaaggtaagcgtaggatataaagcttttggtgtttagagcaaatgaatgtgttaaacccggagtttaagctaacagattcttataacggtaatgaatattttaagagccatttttcatcaagcattttccagataagctgttacaatcaaagttgctgttattatgtgctgccatccggtgtccattttgtagaatgccaagctgatggctttgttgagtttttgtttttgtttttgttttgggggtgttttgttgttgttgttgttgtttgggctttgattttgtttttgtacttctatttgtctgctagttttttttgcatttttccaacttcacaattcaggatttgctttagggaagttttatgaagtgtttcacttggataaaatgtcccaccaattgcataaatggtacataaatgccctcatagaaatttagttctccctacttcccaattgtagttagcaccccttttccccttagatgtaatttgttttgtatgtcaaaagataagataaatacctgcatttctttttttgttttgttctgttttgagactgagtctcgctctgtcacccaggctggagtgcagtggcgcgaacttggctcactgcagcctctgcctctctagttcaattgattctcctgcctcagcctcccaagtagctgggattacagacacccaccaccatgcccatctaattttctgtttttagtatactgggtttcgccatgttgaccaagttggtctcaaactcctgacctcaagtgatcaacctgcctcagcctcccaaagtgctgggattataggtgtgagccaccgcacctggcccaacacttggcatttcttgccctaggatttgtctcctgcatggaatcactaggatcaaacccttacctgattgttacctgtaaattcctgtggaaactgatggctgtctcccttactcttggcactttggactgtcttactaaagttagatatttcctgaactgtgtgtcttagttacccctttagtctatccaacaccttaatttttgtctctctgtggaaaaaatagaaaactattctctcaaagttatgatgaaatgtggaggcactgattggtcagtgggtgaatttgcctgctgaccatcatgataggggtggaagacagggataaagggctcgcagttcagcattgcaggatggcccaggtcaggctaagacatggctttgctccaaagagaaagagattctagtacttccctgacaagtgttccttatctccccctcttagctcctctcatgaggctctcaactggcatgctcagagtgactacagagagagctgcatgccacctgctgagagaccatggagacactggagtgagcaggggcctgaatcccatctctatggcttgttttcccttggttaggatgcaaccttactgggcttcagttttctcttctgtaatatgggagtatcctaggctcattcagaagacttggtttccatgtttattgtccatcttcttgtagttagaagtacagtttttgaggaatgtcttattttccatctcttttcagcccttagaattgtgtttggcacgtggtaaatgtttaatggagacatgtgaccagcttagtaattaaatcacatagtgcatataaaatgccaggtggcatacctggaacagagcagaagccagtgcaagctcagcgtgggaagccctctggagaaagctcaggtattggacactagaagcataaattaggaaaaaatatcctatatcagaagtgttcgatagttaagaaaaaataatgctaagaataccttaataactactaggaaactaaggaacagagaaaggaaaagaaatttttcagtccttgttaatgacgaacagcaaacataaagcagaaaaaatctcgattttttctgaaatttgaaaggccatatactcttttactcaaaaaatctttaataatcacctactaaatgtcaaacagtatgcccagtactggaaatgctcttaagaggagagaggtggtttctatttctttgtgggagcttggggcatagagggacttcctagtgcaaaaactgtgtttatcctagaaaatagtctatttgcaaagtttcctcagaaactgctggacacacctatcctggctaaggcttttaagcttgtatgagttgcccacttcctgaaatgtcacctaatatattgaataagggtcatatatagtgatttggttgcgtatagaaaatatcaaatccttaagtcaaggtaaaaccttgccaagtgatcctttgcacactccagagctgacaatgccttacgagagagtcactatgttaaagtaattgggtgagaaagctattcccctgatatgctaagaactatgggcaacacaatgggtcagacatggcagccataaaaaaaggatgagttcatgtcctttgcagggacatggatgaagctggataccatcattctcagcaacctaacccaaggacagaaaaccaaacaccgcatgttctcactcataagtgggagttgaacagtatataaaaaagaaattattctttggccattgttgtaaagtcataatgtagttagggctggcttcaccggtgtgcgtccagggccccatgctcagaaggactctgcccttgatttaatgctagattgttactgtcttaaaatacttcataatttttggacacggaatggtgcatttttattccgcactgggctttgcaaattctgtacccaattctgtttttcactggcagataggtgtaaactcatgtctttcagttattcaaaaaaatatgtattgaggccctaaaaagtaaattaaaaaaatttggatttaaaaaaaaacagcggccgggcgcggtggctcactcctgtaatcccagcactttgggaggccgaggcaggcggatcacgaagtcaggagatcgagaccatcctggctaacacggtgaaaccccatctctattaaaagtacaaaaaattagccgggcgtgttggtgggcgcctgtagtcccagctactggggaggctgaggcaggagaatggcatgaacccaggaggcggagatttcagtgagcggagattgcgccactgcactccagtccagcctgggcgacagagcgagactccgtctcaaaaaacaaaacaaaacaaaacaaaacaaaacaaaaaccagacagcataaagtaacgaacagattataggttttggagctagagaaactgggtttaactttaaatctaagtgtaaggccttaagttaccctttgagcctcatttttcatattagtaaatagagatgttagtactttcatcatttttgtgtatgaagctaagcataaactagatgatcaggtttacgctaggtattctaaataatttatgctaattattattttaaaagaatcatgggaaaaaatcgagatgaaagaggacatctaaaaggttgtcagcagcattattattcttcgttttgaaatgaaattcttttcaagcaataacactgagcccatggaaaagctttcacttttattcagagaagatagacagtgtttatagtttataaattcaaaacaaagtagcaccgtacataaggcgtcagagcaagtcatgttgctaaggttttgagacctgcagttcttaccctcttcagttttttcatccaattcacctaacaggcacacagttcacagcagttcaaagtccttataaagaacaatgagataattgcgtttcatgcaacttcagctctaaccagttccatttccaagtttaaggatggggagagtttttgccagcaagttctataaatgatcaacatctgaaacagatccaaatcagagccatttatccaggacttactatagataggatgcaaataaggtatagtgtctccttgtgagaatatgaaatgtatagtgggaaatataataggtaggttaaatatggattcttcgtgtgtgagggtgttctgtactccctgaccacgtatggtcaaaataagggtggtgttaaaagatgcccagactagacttctaataatctttctctttttcctgtttggagtaatctattattatgacctgaatgaagagaaggctattgctgcttcaattcactctgctgctgctggtacctaaaaggcaaaatgggcactagggcagaaggaaacgtctgtgtggttttctttctgggttttgttttttcatcttttcattatttaattgaaaaattgatactcttcatttaaagacaagtgggtccaagaacacagtgtttgtatttggatgttgaaaaatacacattgtgcttcttgtgtgtctgcttattctgttcttttttaacacaatggtgtatcattaagaaagctccaggcatataagagcaacctaattctttttgtaaatattaaccttactgaatcaaagctgtcctttcaatcaagctcttagtttctaaaagacaagtggaaataaattacgcaaagatcttcaatagtcatttaaaaagtattttggtgtggttttctattgacctgaataaagtctttccataaacttaaaaaaaaatcacttttgtgaaatgaattcaactgttttgaagtgaatgttaagctgaagcaaactgcagcaatatgctctaatgggtagaaacttatgtatattaatctccttaatatctttactatctacaaaagagtgccttcatgacatgaacatatatatattctaactatagaagcaatatgtgttcaatgcagaaaacttggtaaacaccaagaaatacaaaggagactcaaaagccgcgattttaccacttgatttaactactgtcatatcaagactttttttccaggccaaagttcagtcattgactcaatacatatgtattttgcgtctattctgtccaaggcaccatgctaagcattgtggatacctttgtaaagatgaactgatttctaccatctcgaggctcatttcttaatggaggatagaggtgaaatttatgaaaaatatttttaaatttatcataagtgttatgagaggaagtcatggaaggcacatatgacaaagcaatgttttgacttctaattaatggaattaataatcagaaggagtgtatgggtgaagaaagtcctaggtaaatagcacagcacggttataaactacgtgtattatggtctgcattaaaaccttcgcacatcagtattcttctacagcatagggttcattattccattatatggacctattatatgcaatttatttaacctatcttttttatattttatgtatggaattaacaagtaatgatgcaattaatttctatgcatacagactcggcaatttgtgagactatttctctagaataaatttaaattcgtagggaatggacatttttagccaaaagatatacacatttttagggatttttaaaaagcacattttcaaattgcactccagaaaggaagcaacagtctgcattcccaccaatagtgtatgagagaatctatttcctacactgtgattatccctagatgttatcagatgttagttcttttattccttgacaatttgatgtacaaagagggaaaaagcatgtcactatttttatttgcatttctttgatttctagtaagattcaacattatgaaaatattttgaattaagcaatgacacatgaggctggttagtttttaagactgaaatacactaaaccaatgaagagaagaaacaatgaaggaaggaataggttctgattcctatttttactttgctatttttggtttgctgtaaaaacataaactttttatgggaaggatgcacatggatacacaaaaaatggatttttggtagttgaaaaagatattaggaggatctataaattaagaaattcttactataaatgctgtacttttaaataattccagaatgtctttattattacccaaattccataccacttatagattttaataaagaggagacttttagcaagactgttaaaaataaagatggtctctactcattccaaatgttgctcatactgtatctataaatgatttcttcaactgataatgctttctttcccttttatttttttgtcctaaggaaaaactggtctacttcctggattgttctttctagtcgaagaattgaattttacaaagaatccaagcaacaggctctgtccaatatggtaagtaattctctgtttctattgttaaatatcttttcagaaatattgtagaattaaaagtttggttttatcagaaatcacactaaaacctccaagctaccaacatctgaaaacagatggagaaaatgactcaataaacttttaatcagatgaagggaaaatagaacttagtgtctgttttattaagtggtgcatttggagaataatcacaaaatgagatgtatggtgagcagctatgtagtaatgcgaaggtaacactttaaattaaggtgccatttataaatgccttattcttatttatgaaatgatcactaaatgcagctacttgctcaaataatgtattataaagtatgttataaaatgcattagtaataaatgcttaacggatgatactatgggaagctgttttaaagaatattataagacgtaaatcatattaaaccatgtatgtgcatctttaatacatgaatttaagttggtatctagcatgctataaagtgcttcagacattaataaataataataaactgtttataaatggcaccttaatatagggtattaccaatgaggaaacactctaaattagccaagtgattttttatcttcgtctaactgtgacgttcactatatccagctaacctttttgaatatttctatgactccatctaatggagctaatacaatttctgtatcctgtagttattacaaagtgaaatttgtagggtttcttccttgtacctggaggagggcctcacatatacctacaaagatttgacagtgataataagtaagagcaattcggagccagttactggggcaattcaagctcaaaaccttgctgcccaaacacaagagctaccacaagatgtaggagacagtgggcaggcaacatatctgacagcctcctgattaggaaggactccgggcaggaactaacctgccacagcccatcggcctgatggatgataaggaaaggggtcgcctggcaggagttacccacaatgaactaatttgtatttgacaggtaataaaacgatgggaagttctttgctctccagccactagttgtgtttgctatgtaatcctctttaaatagaaaatagaaaatcatttgctaggagatttttcttaaaagaagattttagtaagaacaaaaggtagcatttgacttgcttctgataaccgcagtagcctttatccccaagtggcttgctgattttggagtctcagtgctgtccgatctgtaaactaattatgaataaattaaaaatatatctcagtcctttgtatttttaatttaaactgcctcagaaatttgttttagggttttattttgtttttatttttggatacagtaaggttgagataatctttttaaggaaaataaagtacccctaagggccaggcacaaaacaactaccatccacttgcaggtcctttgtcttccctttgaatgagctctaagggggaagtcaggaggggaggaaagtcgctggccttgctgagtttggctgctgaaaagatgatcttcccctgctgagtgagaagaattccattgggaggagagtttatgcgaatgtgtgggataatgggagagataagattccatattttaaagcatttggtttatttttattttattattttaatctctttataccatgagatataattatcagctgttaaattttatacaggtgaaagaaaactccctttttgattgcaggcaaatcttgcaagttagctcactaattgcatgcctctcgttcaaccttcagaactgttgtaagttgacaatagacttgacttgtagaagaaatttgttaacattttcctaggagtccttatttattacttctggccccatttttaatgctcttatggtttctaccaggcactcattgtcttcaaagtcaattcatggcaggaactaactgtgttttgtggtaatgggtaagagaattacagatttatgtttgtgctgcatgaattgacttgctagtcaacttcttggatccatttctaacccagtattaaaggcctagtgggatagcccacgtttaccagttccagtcttagagaaacgatacaacgattgccaggccttgattaaagatgctgtggttttattttgaaagagatttatgctcaagtttctgaatttctcttgcacccccttagaatttttctggtgttgctcattgtgcttctggaaaaaagtctgccctttcctcctaggggtcaagacaagctgcctgagtgagtgcagaatgtgatttaaaagaataaatggtattttagtccttatacaaatgatctttaagtgttaatgcagcagtgagacaaggcaacaaaaccagccagagcagttttgaagttggactctaggggatgtaattcctttttttttttttttttttaccactcattagctgataacattactcacttctttgagcttcagaatccttacctgtgaaatgggcatagtgatacctgccaacagaattagtaaggaatgaaattaattggtaaaaacaaatacataatgaacaaaaaattattgtgctttattatatcatatgctattaaatacagaaatataacatattctatagtacacaatagagagtataattatattattacattagttttgtacttgacctgattcagacatttatagaagagagaatatactaattaattcaagaaactccatcatgcatgacctccaaaagaatgtatccagaagtagcataaaatgctgtctcagagcaatgactaatactgaaaataaagccagccatccatttagggctctagatgttaacctcttgaatgtccatacaaagtttcccggtgcccccatcttcttcctttggctcttacccttactgttttcacatttaatacagcatgttacaaagtattctgcctgaccccacattctgtgtttggttactttcctttctcactgaagttcttccagttcatatctgtcttactcagttaggactgctacatcaaagtaccaatggctgggtggcttaaaccacacacatttatttctcctggttttggaggctgggaagtccacgatcgaggcacaggtgaatctggtgtctgctgaggtcctgcttcctcatttgcatctgtcctgtcttctcactgtatcctcacatggcagagggcagaaagtgagagagcagacgttcgtgtcttttcacataaggccactaatcccattcatgagggctccacctttatgatctaattacctcccaaaggccctacctcctaatggcatcacactggggtttaaggtttcaacataggaattttagagtaacacaaacattcaatccttaaaaatatccaagtcacatttttatcaaaagcagccttactgtgcaaataagcacagaatcactttgcttattttcatagagattcataggtacctcagtgagttagtaaaggagaaggaagaatgacctattctgttcttgttttatgaaaaggacattaaatcgtaactgaccacctactatcatcagcattttataacagaaaggacattataaaatacccaatccaaaaaatagaaaggataaaattatcagaataaaagacaccctttaccaaaaagaaaactgtcccccttatttgcctaacatactctctcttttgctcatcaagacaggtggatcgggactggctggtcctccagtgaggaggaaaaccactcgtgtccctagatccagatttcctgaattatgaaggaaaggatggtgttcatattctcatatttttaatgtatttttatttataactcacttaaaatattataaaataatacagaaaccattttaagtaaaatgtataaaacatctatgtgtatttttaataggtatcaatcaatcacctgcataagcactacccaggatgagttatagaccctgccagcccttcagaagccccaacccctatcagttgtccctttgtcatcatagcctcttcccttctctggagttagccaagaacctgcgttttagtcattatttcattgcctttcattattttcaaacctatagctatataccttaaaaatataatttaggtgttttttaattcatataaatggaatcctagtgtatgtttcttttgtttcttgcttctttcactaagtatttcttgctttttctgtcctttaatattttatcattccatttttttcttttctctactagtttgggaggatacactttgtttctgctctgttagtatagttagcctagggttacagcattagtacttatcaacaaataaagctagtgtgagaccctttaccttctactaagatgttaccttggaatatttttaatcaatttatccctttctcaatgtatatgttattaccatctggtgttttaatttttttaatatcaccagacattattattctcttttatggagtcaatgtttgtttacatttgcctaatatttgccacattctttgctatttatttctccatgaaccttggacttgctttctaggatcactttttcttctgcttgaaatatattctgagaaattcctgtgctaagggtcttgcagggacaatctatctcatagtctgcttacttgaaaaaaatctctatttctccctcatcctagaaatatatattctctttgaatatagaatttttagttggtagtcattttcagtcagcatgtcaaaaatatcattacactgtcttctgttatccattcttaaaatcaaatcacctgttaatataactgatcttttctgattgctcataatatttttctcattacctttgtttttctacagtttcatcatgatgcatacagatgtcagtttctttttatttttcctgcctggattgttatgcttcttaaaattattgattgctgtcattaatatatttcaaaaaatttccaatagctatcttttttttttttttttttgagatgaagtctcactctgtcacctaggctagagtgcagtggcatgatcttggctcactacaacctctgcctcccaagttcaagaattctcagcctcagcctccagagtagctgggattacagacacgcaccaccaagcccggctaattttggtatatttagtagagatagggtttcactatgttggccaagccggtcttgaattcctgacctcaagtgctctgcctgcctcaccctcccaaagtgctgggattacaggtgtcagccaccgcaccaggcccaatggctatcttttcaaatgtagccctttttacattccctctctcatttccttctaaaccttcagttaaacccatgttaaatttctcactgtattctctaaatgctttacactctcatttttcttatatttttgtctttctgagctgcattgcaaataatttctctttaggtatcttccagttcttctttctccttaatttcaattattgtaatttttatttctagaagtttgtttcttttaaaaatgtactatgtatattgttagagttaattttttcctgcaggcattttttaagactctattttattttgttataactaggaggcatagttgttttataatctgtattttgtgattctaatatctaaatttgtgtcagtatgtttctgctggttcttatgttgctttgttttcttgtgtgtctggttatctttgactgtgtgctaatcattgttattgaaatattatcatgggaggcactctgaggcctaggataaatgtgtcctactccagagtattttagatttttctcaggaggtttgggacattcccagagactgactatctcaatctaaattaacagtataaaactctccaattatgtctacataataggagggccgtagctatcctgccacttctcagggacaagattgtgcttcagtttttcttattttcttattttacattgctcatctaccaaaacagtcttctttatatttccttcggtttggagaaaggccacaagtttaatatcggttctcccttattctttataacactttggccaggaccttgctccattattctgggtttgattgaccaaagctcaaatgtgtagtataaacaaatgacctcaggaaaaatgcagttgtgttactttgatattcagcttccctcactgaattcatattcccacccctaaaaaatatttacagtggcagtcccactgtcttttcagactttcaattcttttaaggggtaattttaaaaagaaatattttatccagcatttttattgttttcagtgggagaattgatccaaaaacatagcttctcattgcaatctacctcacttcaagttaagtatgcatttggttaatcaagtttgtgctatttatataaatcttggtgggaaaagacttcataagaatatgtattgaaattctacaatgaacagcttgctcgttagggctacatataaggcatagagatataatcaagatatagtctttgccttataaaatctctgccaaaaaatagggtgagatgaaataagaaacatagtagagttgtttttttttttttttccactgagattttgaagaaggcgagctcacatctgtgaaagatttgaattgggccttgtaggaccgttataatttgaatatgtggagatttgtagggagggagtgcaggggcataaaaaacatgaacaatggcataaaactgagaatggacagagcctgtgcacaacaaggagaaatgaatttttgttttggtttgaagataggataagagaaaaggattgagaagagtttcatggcctgagatttgctgagtgacaaatttttaataagtagtgttagcgttctccaggtgtcttcattctggaataatctgtcatggctattgttttaacaaacatatactgaacagcagtactagtcagtggtatgtgtcttaaaagagccaggcctattgtagggccaaagcaagagaggatgctccttcttcgaggctcttcatctcatttactgcagaagtgaaaactttttcctcaaaagcacccacactagtgtttgtttcatctggtgctaaagaagtactagagaatcaggagttgtctgtttgatttatcttctcaggccttgactcacactccttgtatttttcaggtacactttcctattttagtatcagtgaagtatttcaattgactctagcacttcatttgcagcttgactcctaagtacctgctgtactttgtgattttagagcttctgcttgatgtgttcaggaggcacctgaccatgttcatgggatttggcaaatctccatttttggttaaacaaaacccatttgatggattgcatcatagagaagaagctctgcaatttagaacatccattcatttattctctcaacagttaacaactcctaccaggtgtcatataatttttttctttttgttttgttttgtttttacattaggggcaacagaaatattcaaatgaatagtatatgatccctgctcttaaagtactcacaatatggtaaaagagacataattttgtataggtttattataataaaaccatgactaaagtgttaaaaaatattagacaacatgccatggaaccatagatttagctataggtagtctttttccagagaaactattgttgcaagtcatgttcagcttaggtatctctccttttgttcaaatattactgtttgatattattatatcaaatattattgagcatctcttatgtttaagtcactacgataggtgttctgaaagataaaaaatgaaccagactgaaacaaatagaaagtatggccttagattgagtatagtgaagaaatggatgttggtagttgtcctaaaatggcatgaacagagacatggcgtcgttttatgataactcaagagaagagtgtgattgcttccatttggacaggatttgaaatatattcatggaggaagtgacatttgagcacatttctgaaggatgtataggattttgatgtaaaagggggcaaaagatattttatgtactaataagagagtaattaatagtgaactatggaaaattctttttttgttgtttattttacagatgtatattgatctcttgccttcttccatgcactgtgtactagtcactgttcttgaaatgtttgaatgggggttccctgaggcctggagtgaatatttcctagtccagagtattttgtgtttcttctctaagttgcctgggagtgaggaacagctttagactaagttgcggaacagcattgtggaacagcaaacagtgtaatttggttagaaagtcagtgtggaaccggtttaggaaagactttgaacaggattgggagaagagatcatttcattctgtaggtaatgtggggtttttgtaaccaatatgaaatattctcaaattaagagagactcagagttttcagagacatgtttagggaactgatatatatatcagttgtctataaaattaagtctctcttaattttgtgtatatataacttaaaaacacatgcaggacttggtaaattatccgagagacatgttctaaaaatttatgcaaatagatgtgagcaataaggcctgagctcttacgacagagaaaattgtaaaacggctgtgtgtcatcattttggctcaatgcatttagtaaatcacaggacatcttttcactgacaaaatattttgatattctcatatgtctctgacctccaacagtatggccatttctaaagacgttctagtgcaaagagaacaagcagagctatccatctaaggagagcgaaaaacatgctgtcccaagaactaggtgtgtcaccatctcagtgagcacccgttgcaaacctactggtgcttccatctgactccagaacatctgtttagtgtcacaccctacttaaacaaatgcattgtgtgaagtctttccaccaacaatcagacgctgtggaactcattgtcaccaattgggtggatgagagccaccgtttctattatattcatcacacactgctcagaaaatttagtgtcacttttgatataaattcaaaaacattgtaaacattttagggaatattttccccctaaaatggtgtggttctaaagccagtatattcagtagaaagcctatatgttggttgtgtaagggacttttttgttactcttatgttttttattttacattgtactaatatgtatttttaatcagagccaacaactggcaatttttactttttaaaaattatatttttgggttttacatttaagtctttaatccatcttgagttaatttttgtatatggtgtaaggaaggggtccagtttcaattttctgcatatggttacccagttccccacatttattaaataaactataaaaactctagaatgaaatctaggcaataccattcaggacataggcacagacaaagattttatgatgaaaatgccaaaagcaattgtaataaaagcaaatggtgacaaatggggtctaattaaactaaagagcttccgcacagcaaaagtaactatcatcagagtgaacagacaactttcagaatgggagacaatttttgcaatctattcagctgacaaaattctaatatccagagtctataaggaacttaaacaaatgtacaagaaaaaacaaacaactccattaaaaagtaggcaaaggacatgaacagatacttctcaaaagaggacatatatgcagccaaaaaacatgaaaaaaagcccaacatcattgatcattagataaatgtaaatcaaaaccacaatgagataccatctcacaccagtcagaatggcaattattaaaaagccaaaaaacaacaggtgctggtgaggttgcagagaaaaaggaacacttttacactgttgatgggagtgtaaattagtctgatcattgtggaagacactgtggtgattcctcaaagacctagagtcagaaatattatttgacccagcaatcccattactgagtacatacccaaaggaatatcaatcattctattataaagacacatgcacgtgtatgttcattgcagcactgtttacgatagcaaagacatggaatcaacctaaatgcctgtcaatgatagactggataaagaaaatgtggtacatatagaccatggaatactgtgcagctataaaaaggaatgagatcatgacctttgcagggacatggatggagtggaaatcattatccttagcaaactaacacagggacagaaaaacacacttataagtgggagctgaataatgagaacacatggatagagtgtggggaacaacaaatactggggcctgttggaggtgggtggtggggagagggacagcatcaggaagaatagctaatagatgctgggcttaatacattggtgatgggatgatctgtgcagcaaaccaccatggcacacatttaactatgtaacaaacctgcacatcctgcacatgtaccctgaacctaaaaatggaagaaaaaaaatgtatttttaaaaagtacagtgtgatcttttgatgcatgtatacattgtggaatgattaaatcaagctattaacacttccattacctaattttttgtgtgcaatgaaaacatttaaaatataatcagtgatttttaagtatataggatgttattaattatagttaccatgctgtacaatggatctctagaatttattattcttgtctaatagaattttgtactctttgagcaacatctccccatacccttcccccaaacccccagaccctggtaagtactattctactctctgcttctatgagtttgacgttataaaaattttacttttaataacagaaaactcttccaaggcatttaatgaactattaacttttccaaaccactcattcagccataaccttgaaagcaaaaatgggcaacataaaaggcctcattaaaataatttgttttcagcctggcccacatatcgagaccctgtctctacaaaagtttttttttaaaagattagttgggtgcagtggcccatgcctagaatcccagtactttgggagcccaaggcaggtggatcacctgaggtcaggagtttgagactagcctgtccaacatggagaaaccccatctctactaaaaatacaaaaattagttgggtgtggtggtgcccacctgcaacctgagctacttaggaggctgaggcacaaaaattgcttgaacccaggaggtggtggttgcagtgagccgagatcccatcactgccctccaccctgggtgatagagtgagactctgtctcaaaaaaaaaaaaaaaaaaaaaaaaaaaaaaaccacacatgcacacatggtggtcatgcacctgtaagtccagctacgtaggaggtcgaagcaggaggatcacttgaacccaggtgtttgaggccgcagtgagctatgattaagtcactgcactacaggctaggcaatagaatgagactctgtctctaaaaaaataaaacaaaataaaataaaataaaataaataataatttacttttaaaaaatattgtttactttcaatatgagtaatgaacacacacattaattaaataatgcaatatatctaatgctcattcactgtagtatgactttaacaacaaaatgaacttatttatggaaggaaaatgatgtgatttagcaaaaagatgaaaatagtttcaatcagaaagctattcatgaattattgagtattccgtgcaaaatgaatatggaatgattttatctttgtagagtgagtattgagcccttattcagacccctgcttaagaagatcatgaaaaaatggaggggcaaacaaaagatctatcagccttagactaatgaaggcattttaaaatctctgtttaatcatttaattctcataatagtagtactcttgccacatcagcatggttatcattgatgcagtatgttagtatagctgtagattgcaccatcatatggcctcatcaaacatttaatgattaggaaaaacaagttacagttcaaaatctggaggataatgggtagagatggaaatacagagaagaaaaaaaggaaattaaagttcagtgttttattaatgtaaactttggaaggaaaaaatcaagtgatcgatattgctataaatgaagccatgttctctggttatatttttttctagctttggccattaactataataaattctgtaacttacataatttttaataaccacagaaatccatgaaattgacaggattctttacaaatggatcagagcttactgtccctcaataaacctcaccttaggctctctcagaaaactgttttaattatgaagcttgtctctctgtggtttatcattttggccaatgaaatgcatctgttttggagcttgcatttctctaagataaaatgagcttttaccccacagtgtattttttaatttatagagtatatgtatagtctttcttaaaaattcactactaaattgaaatgctctgagaagcagtatcacattaggtagaaacaggggctttcaagtcagatcacctgggttaggaatcctaggttcatattttacttgctgctctagtttattttcaaatattaatgataaatttattttcacatatttattggctatctcaactgcaatatgacattaacaagggtgactatctcgtagaactatatgtgagaaaattgatgcaatgtgcctcacacagagcaaacataataaatcttaattgtatttatcgttgtcgttattactacatgaagcaatagagtatagtggttaggagtagtggcagatgagggaagggtaaagggagaatgtgggaaagatctgcatgtgcctagaagtcttttcgctcacattccagtggtaagtataaataattggccacattctgatgcaaatggggctgggaataaagtcttcagctggcaagctgcttcccaatgacaacacaaggcacttgaagagggagcacaacacacattttggtggagaacgattcacctctgccacagcgagagcagcatcagtggtctcaatcctggttttctggaatacaaagcctgaattaagagcctgactttatctgggaggtacaaatccaggacaagagagtgaagtgaaaaggaagtcaggccagaagtgatgggcagtggtacagggatgttaccatgttggctccccactacaatgagcttcaaagagacggagagaaaagggtctgcaagtacgctggtgaaagcttaaagcaatctgtgggaggaagggagcagaagaaggaaaaggaatttatctcccatatttcttcccatttcctgcacttttcccatttcctgcacttttgattaaagttcaccacccagagtcttcacttgcctgcttcagtcggacctgcctcagccatgggaggctactcagaaagccaggtcccactcctgcaaagtggcatttcatctaaagtaggaagtggtggaaggagccaaaggcccttctatagtctggcagcctagggggaaagtctggtattccaagaaggtggctggtcattctcaagaggtggactgcattgcccaggcagggctggtcatctgcagggacagctgaggttgactgagtggatgacagtctaagaggaaactctgaggaggcacctgagacatcaaaagtgtacccaagctattcaccttgcagaaataaattgcctttttaatgtaaatgtaagactatatcagttgagaaatataatcattatatttattccagcaagattttgattcagaaacaaatacaataggtgctcatttcttgaaaagtgtagaatactttctcctcaaaaacaaacaaaaagcacataacattctagtgcccacaatcactaacaaaggtttatttttctgaaaatgtggtttgatttggtcatgtaatatactgagaaatttcactgtagaaacaatttctgttattattaacatcatttatattcatatacataaaacccacatcttataatcaaagtatcctcttttatgttgacaggggccatactttagacattaataagatcaggtatccattcagccctctttcctaaatcattttgcccaaatgagaatatataaatgagttttatcctcctccatgaacgattttccagaatcaaaaccagttatgtgataaaacttaattcctctaaacagattttgtgtttcgagtttcaaaatgataaggacaatctgagtctatattctggaatagcaattaatccaaaataaaaaatggcgctaataacctatttcataaaatccgagctttgtctctctttttgaaccacatctagtaataagggtaagaggctgtgcggccaaatgatttgtggcctgcgtatatgcccaatcttcatcatggaagctatcatcaagctaaagagcatctggcctttgatattttcttaatatacattaaaagactatggaccccaaatatcccataaagaaaaatgggaaacttaatcccacaggtttaatctaagtcagagaaaaaagtattacagagaaaatactcttagctattattgggaaatggtgaagatagacgaagagaataataaaaatcagaagtgcaagagacctagggtcaatttttaatgacttcacattcctctaaaaaagaggcttttatgttttattgtccaaaagcagtaactcttaaataattctatttaagtattttaaaaatcagtcatttctattttaagtttaccccagaagaaatatggtgtgtacattcttagatttaaattcatatttagtcattttttaaaaagtgtatttttataatgatgtagaatatgatccattggcatcatgctgttcattagcagactttttcttgtgttttatagctgtagaatcggaaatatgttttctattaaaggattctttaatttcaggcttcttgaataaaatcttgattgtcttccgaataaattctacaacttttctgaactacttattccaataagtagtttaaatgtttaacatttaaacactgagaatttcttctaataatctcgattccctaaaactgctcttcaggcataggtctttctgctgtagctttgtgaaaatgaactacttattaggaccatttttacacaatcctccagctacttattctagttttctctttttaaagcgaatatatttattattacttaagaactttgtttttttatctgtcatacttttgaattcaccccaaatctctattagctttgattataccatatgatcagttcttacttaaagttggtataaaatggaaatattattccatatgtacttctcactttgtgaactgtcattctgagatgtattatttatttttatttgttaatgcattggaatcaatccagatatttttcattgtcattctctatccagttcctcaattatttcaatagttcacaaataactgttgaacacttatttggggccactttgctagattctggaaaaataaagaaccataagtcaaacccattctcttactggatagctaggggaaaaaaaacacaccaaaaaggagtagcaatgtgtgactaacaagagttgtaacacagtatgtttcaaagtaggggaaatggtggaaggagtgagtgactacctgcagagggaaaattctccccatggatatttttatttttttaagttgtgtcttgaaaatgagcaagattacggcagatggtaggcaagcagggtagattgaagagagagataaatgtatttcagatgaaaagaatgaatgcatactcaaatcccaaatgtctggcgttgtgaaaacacattgcattttggaaactgccacggatgtagcgtagctggtgtgaagaatgggagaacgcatagaaccgagagggatggttggaggaggacagaaaggagctcgtataccttaccaagggatttggacactatcccgtagataaattttccataataaacaatgtgaggtttgtgtctcacattgaacgaaaaaaggtcaaaatacagagaatgaattgcaagggtttttgactggccacagaggcaagaggtagaagaattcttgtgagagaaaataagaactctactgaggttaaggtcatgagatggagaaaaaggaactaattccagaattcgagactttgtgccttttgattatggatggtgaaagaaaggagggagttaagaaactttcaggtgaagtgagtgaagggattattaagcaagacaagcaatagagaaaaggaggcaggtaggagaagaagataatgatttcactgaggtgactgtgctacactctcatggtaatgtagaaaatataattctgacacatcagagggagctggaggccagaggcacccattgaggggtcaacatatggcaggtaatgggacaagactaggggcaagaccaaaacccataggaatcacatgagtgaggagaaatgatgagggcctagaacgctaaacctggggttactaacatttagaaagtgggaagaggaagaggactcagtggaagaaactgaaagggaagagtataaaaggtgaaatgcttccatggccaagaaacaagagggctctaaggagaagggccaacagaatctaacagtgcagagttcaagtcagatgcagatggggaacaaggcatcagattgtttttgttgaccttaatggttaagacattttagaaaagtcaaagaaggaagtaaatatcagactgcagtgttgaagaagagaatggagtctgagcaaacagagaacatgaattgaggagaaggacaaatctggcaataacggaaaggaaataagtgagattgagaaaaagtgagggtgtggagttgatgcttgcttttcttcttcttcttttttttttttaaacgggtaatgaacatggttagaggctgaaggacacaatctatttgagggggagaaagtagaacgaaatgtgaaattcttattcttggacaactcaggaaatgagggacaagactggatgaaattaggaactagagataaataagccttgggcagaaggagtatctcttcctctgaggcaaagcaggacatgccttgtgagtcctttttgtgctttatggtactgacaggtcaggtaattttgacactcacagaggccactgtcctgccaaggcatgggagtttattagacagatgggccagtcacagccccagaattttggggctggaagacaaagtgggaaatgacacaggaaaaaaatggaaaatgtgaattattattcttggacctgaaaaagccatttttaggtgaactagtaggaggaaaaaatgagtgtggaggggaggccatggattccattgtgatcaagaactttaaacttggaatccgataaaagtaaattcgtatcagctcaggcactttctaagtacatgaccttatgtcaagcacttggccgctctctgcttgggtttcttcatgtataagttgaaagcaatggtaatattttcaaaagattgttgtaagaagtaaatgagaaatcaatattaagctttcagagtgcaatagaggaagctatcattaaactttatattcatttgtttatttggattacacagactaagtatgaaagtgggaagagttgtgactgttccagcacaagggctgtgatctccatgaagtcagaacaaaccatttcgtggggtggactcataagggttgaagctttcagagagcagtggcaagaggaagaagagaaagtgactaggaacacatacaaagtatcttaagcagagtcaaaggcccagctgaagaaggtagacattatttgtaatattgctaccctaagtagtcaaaagttatttctccagtattcggggatatgaggaatattatggaggggcaagcagatgagagcgatatccttggaggagagggcaggtggagggggtggttgaagtgactgtggaatcaggaatataggacctgaaaggaagtgaagccaggaaggaattcagagactgggagattgcacaaaggtcaatgattttaatagcatcagaaacacacggataagaaaatctccagaaatggaatctgtcagatgagcagcagaatgaaaatcactgaagtggagacaaggtgaaggagtgagattgtaaggagtgcaagagacgggcaaggtcctggagaggatggccacagacagggtttggattgtgataaacccgtgccaggtactgtggaatttgccttaggaggctgtagggtaaacacacctgatagcaatagcttaacaatctctttggaatgaccctctatggcagacacacctgaatgtgtgtttcaagctagggaatccaggaacagctaacctggagattcgttccttgtccgtgaggaacacctgagccctcatccagtctcgtggatcacaggctgcacaggggaatgaggctttgagttttgggttggatgaaggttgccaggtggaggtccttaaggggagggctttaagtgaaaatgctatataaactgcatgctggtagcaagaggttgtggttttcctgcccagccctccgccactgggctgtggagcccgctgctgctggtgcattcttgtacgtgaggtgtttctcctgtccagcctggcaccactggcctctttccccggtatgtaaacccttaaaatcccatatcttgtttgctggctctgggtctcgtctttggcctcttgaacctcagccctattgggttaataaggattcagcacaacagatgctgatgagaacattttgagattgacaaagctagatgatgagaaaactgtaaaagcttagactgttttacccacaggtttcctttagctctatagcatatggagtttgtaggtaattatacagaaatctaaagctaatatgagatttttcaaggaagagtcagtatctcccttatccctggagttcagggagcccagcacagtgggtaacacattgacacatagtaggtgtgcaataaatgttaattgagtgactttgtgtaatctcacatttaatccaaatatgagtcctttgaactgtttctcacttttccaaatcacaaagactgcttaaccatttaaaaaaaatacaaatcttaattgctataaaattgggaattttaagacactaaagtcttccttccaaagcacaaaagctagttgcattttggtatttttccttcattcatgaattcagcaaatattcattgaacaacaactatgtgccaggcactgttccatacattgggaaaaacagtagaggaaaaggcaaacaaggccctagctcagggagcttaattctagtgggggaaacacagacagtcagcatataaaaatatatatgttaatttcagttaggaggagggctgcagtgaaattaaaacaagtagtgggatggagagtaaccaggagtactggagtacagctcttttatataaaagacagtcaaagaagacctctgacaaggtgacatttaactgggaactgaaggataagaaggagccagccgtgtgaagattgggaggtattccaggtaaacaggtggtgtaaaggacctacggcaagatcacgtttaacagagaaggacaaaaacaagatgaatatgtctattctggagtctagtgagaaagccatagcttttcccaaattcttacatgtttttagcatatgatcacagtgtctattcaatttttaagggctgcatcatggttaagaacagtctctgcagtgacactgcttggatctaaatcctggcccctccttttctagctgggtaaccttgaggaaatttacctaactattctggcaggttttcttacctacaacttagtgatgataatacctacctcatacagttgtgaatgtaagatttcacagaatcatttggttaatatttattgcacacttattttgtgtccatgtgttagccacagtgctgggccctagaactccagaggcaaggaaaatacggaatcttcctcattttagccttagacttctgtataattgcccacaaactctctatgatacagaggttatacactaaacgaattatcaataattgttgtacgtaggtaagtacctggaacataaaaagtgcttcttaaaataattatacctttttaaccccctgacttgactgtatgggaaaaataagccattttgttacgtactcttaatgattattttcgttggttctgagtatcccctaatgtaattaaatctataagaagcatgttgttgttaatttttctacatcataaatcacttgacaaagactatcattatcatgctttgaaatctaaaatagtgatcacctgggtggcagagcgtgggtgaaacaataaaaacttttcactgatcaaaatctctttaaggagcatggctcattttgatgggtttctcctgaggttactaaataacaacaacaaaaaaggtagatatgctatcaaattctatcctgccggctgggtttatcctgtaggaaagttatacaatgtttcaaaaaaaaattcagttgccagaaaaaagtctcataatttaccataaaaaaacaaatttctggcttctgaaaaagcctatttatgttgaacttatagaattggatataatggctaagaggcaacaaacatggacagaatatgtttttaaaacatatttaccattctttcataatttcatgttttatcctaatgttcataatgttaaaaacattggctaaaaatataataagcttcatatactaaaattctgaagtattttatggacaatgacttgagaaaagtatggaatctacagagaaacctagaaaatttatctgtggagaaacttcttgaaaaaatagtaaagaaattctcaactggtaaactttttaaaaaataattggcggtatggaggtatgccaatgtaaagttgtataagtatgattaacttgaatcaagtgaaaatatgaaaagacaaatgtgggtgatattcctattgattattgtgaattattgaaataaaaaacatcttttaagtaatacccacattgtaattgtgtaataggaagcacacattttaatccttttggtctaagttaaatttaccaaatgaaattatatttgtgtgtatagtcttaaagtctgaaaagtgaatttctaaaaggcatagttgacacttaataaatatgtattgaatttgctaacatgtgaaacacaaacctgaaaggggaattggagattaatccacctgctcaattttctagatgatgtagtcagattctaagcaactctactatagtcgcaaaactaaaactctgtaacagttttttgcattgcactatgatttatcaattttttcttttactgttaggtctaaaagtaatataacttaacatgcttttatgttactttagacattgaagagcaatattccatattactaaatagcagattttaaaactttcattattcttaaattactaaagaataccatctcaaaatatcagtattctagatattaatttttcctatggtttatagttaattaaataattttaaaaataagtctgtaattttagacattgaaaaaaattaggtcccaaatgaaaattcctacaaattaggtttcccctggggaaaacaaaaaaggcattatatcataaatatgtatagctgctaactcaataaactcctatttctctgacatctatctacagtgttgcatcctcttattcttacttcatttttgtgattacagaaaactgggcacaaaccagaaagtgtggatttgtgtggagcacacattgaatgggccaaggaaaaatcgagcagaaagaatgtctttcaggtaagaatgttacatatattcaatttattcctattctctctaaatctgagctctcttgggtaactaaaataagactaccttcttgtgatgtgctcatgtacatgaactcgttgtctgaaggtcatgaaaggcgactcctcttcccagttgaatctttggttttgttgctttttttctggcgactggttgctatctaaacacaaaatgtatgttgcacgttgattaatataaacacacaaaagtcattgaagtttgcagtatatgcgatagatgtctggagttcaaacatgggatgtttgacttaagtagatttgatctagaattttcagatgcacacaaactaagactcaccaagtataagctatttacattcattgacactcttgccttctagtcattaattacatttaccagtataacttacaagaatggagagggctgaacagctataaaaaatagattctttcatattgcttactttagttttttgaaaaaaaaagttgattaataattgcaatcatattcgattgaatggcaagaaccagatgaaatccttgagagagataaaattggaaaatgtaatttcacacgttaccaaaatcacctaattgcgtgatttatctggtaattaataatttgagatcttggagtttgatttttgttctattttatatgaaatttaattttatatttccaaagtaaccagtaattagatatattttagaatttatataatttagtagaagagagatagagtataataattattttttaaattaaatgtcttctgagagcatgttggcccttgaataaaagtcaattcttctactcttaaatgctttgctgaaattaatattgggtcctatggaagcataggtaggtgacattttctaccgacactctcactgaggggaagaagctggtttccagttcggtttgtattttccagatgctattcaggtatatccaaataatttgggtccataaaatattttaacacattctagaataaattacttttctggttctagttttattttgcttaggtatagagattttttatcaaacaagaaagtgagagaatatatgcaattattatttgtcaattaaaaataaaatttaaaaaggaaggaaggaaataaaagggagagagaaaagatagaagaaaaccaaacacgcttgtcctgaaatcaatgctctaaagctgaaagtgactaaaatgtggctttacagaatcaagaaggagaaataaactttctttcaaagggaggaactatagatcagtgacttcccctttcccccaatttcttactcttattattctaccataaataacagtttagaggttataattctagccttatgacaacttagatgatcaacataagaagctctgaagtagaccgggaaagctcagtggtagagccttattatgtactgtgaatttagcatcctaatcaccaaaattgtaaaagatgttgaaatttgtcatagacattattcttggacaatagcaattctttggagatgggctaagccagcctttttcagtttcttctgttaatcttatgaagagttaaattagttcacaaatgaggatgacagtcagctatatttgatgcatacagggctgaaaatattgatgaaaaaattatgtatatttttatataactatgaacattatatgcacagatagacatttcagccacctatattgacagtgtgtatcatcccaatcttttcaggatatgactaatcacctcctgttgcaattttctatttgatttttatatttttgaatgtagatccttccaaagatattaaaaactattctcacttttggtagctttctgaaggtgaaaattttgccagctagttttgtttgtaatgtaattgaacagttcatggggcctcagtcttcttacagacgctttatttttttttagtcttgtacttttagagaaacaagaggtgatcataaggatattgtgaataacaaaccaaaagaaaagattcaagtttcatgttctgtttcattctttttgagtgaatcccttggtttccttgtcgtgctgaaatcttttcatcacctaaatgcatgagttttggtaaaactgactaatacatatccatagatacagactatgagagtaagccttttgagaggaacaatataaatagcttctatagttctgttaacaaaaaagcgtcgggaaggatttgccagagagctaaatctagatgacttgcatcaatatttgattagatacattagctggtcgaactctcaaatgatcagaataaacatgattatgtcttaaaaacatggtattaaggcattgttggacgttggagtgtatgtgtgcaatggtttcattacctgcagaataatgaagtgtttcttcctgactgaaaaagaccatcatagcttcagctgatgtgctacattggaaatagctttagaattccaagtttgaattaggcttggtgttcaatctcagtctatgaattatagattacagatagcaaatgactattgagatttttggttcaaggaaaatcaaagaagagcaaaattagaaatattttaaaatttgaaatctgtctttaaaaagtttgatggattagcaattgtatgccatgtaattacaatgtctgcagagaagttgaacttaaaatgaataggaaaacaaacaaaaaattgtatgtgcctgagaaatgttgcaagtctcagaagcacacatttgtgacaaccaaaaatggacagatttcatttatttcatttgttcatatatgctgtttggatgtttgagttgttttctctttgtactgaaatccaaattttccttcctagttgaaatcctatcaaactgttgacatggactgaatcttatttgattgctatgtggaaacataacaatgacaacattaattattaagttttggtattcaacaactttcagtaaatcagaatgatacttgctaagtttaagaatatctgcatattttataacagcacactctttggcctaattggtacttcttaacaataaataataaaagaattctataataaagtatgtattagatgttataatttatattaaaatatatacatgaatatacatgtataaaatatatatacttatatacataaaatatatatgcaaatatacatatgtatatatactctacctgtgtgtatacacacctaatagcttgaccttaggaaatagagtaagcacttccacacacaaacacagaaagatagtacacatttataaaagatcatacaaattctaagttaaagtggtaaatgtccattgctgctaacttttgtttaattctgcatttatgttcattgtcaaggactgtcacaagtttgatgtagttcgagaaacctttagcaactcagctataacgagctgggtacgcgttttcttagttaacagcaacactaggtcttcatcagggatagagtgaataaaaagatttatgttcaaaccacatgttttaaacattcctgctaagtgctagtttgctctttggtgtttagcctgaaatttaaagcactaaggattaaaaggattacaacataatcttaaataatcctaaatgtcatttacagagagatagttgtaataactaaataaaaccatgtgaaaggatggcagcattgtcaggcagcctccctcacacaagcggggctactgtcaccttctgtttcctggctgggcatgttaggcagttacagtctttcaataagaagttcaactgagaaaatggctgcaaaataatttagaacaagtttgtttaaaaaaaaaaaaaactcttatatcttgtttctaagttgaaggaaatttttcagttaggttttgtcttttcctttgaacacaaacctttctgagttaaatattttggaaagcctagggaaaggaagttcgtgacatggctatcaaatagacaactgatgtatctctaaaaaattccccaatgtccaaggagatacccccttattaaatatgtgagagtctcagagcactataattatttccgtgtcattaaatttagtacttaaatatcctttacttaaatattctgtcatgcaaattagtcttgtctccccaaagaaaatacatagaaactatatcccatactgtcttctacttattaagccagaagactgaacactttttagctgaataattgttactgctaagggtacagttgcattcctttaataaaacaaaacaaattcactcctattaaaaaaaaaaaagttatttgtatccacaatataggccctgtactccaaaatttccagggtgtaaaataggaagtaaagatgaagaagataactgtttcctgggtctttttcattacaggttataagacagcattatttatttaagataattaaatcatttttactctaaaaatttaccttttcttagagccagacagtgactggcctcagttttcctgagcttcctttaaaataaagtttttaaaaacatacattgggctcttctatagatttcatgctttcagtaggatatttctgccaattaataaatcatggctgattaggaatatgtcaattacctgtttgctgcttgaaaggcagaaaaaattaaatgactaaagaagaggaaagtctgttatcctccccccgccaccaccaatttgtaacctcaacaaatatcatggtcacatttcctggatttgagattatttttcaagattctttttcaatatattaaaaaatagatctcgggggacagattctgtccctaaaagtaaacctcggaatagatttattatttatattacttctctgactttggatggagtcttctgactacaatgtatattaaacttttttatgtaatattctccatggatatgcattacatttaaacataatttgatctttctgatctgaatatgtcttatcttaaaatgtttaagtactacttaagtttattaatgtgaagataatttaataacatcttaaaaaaacataattttaagccaaaaggaaaactactggtattgtgcttttatccatttccttgtgttacaagtggtggtttaaaataaatccgagcttttaccaattttctttcatttttcagtgcttgtagttagactaaatgcaaaaggatgattcttcacattcatacatgcattagatttccagtaaagctggtttcactttagagaattaaagtatcttaaaagacacggcattaaaaatagaccagagtaagagaaacattcacgtctaacacagttgttttttgccctacagcttgtccccaatcatttcatctacctattagatattcatccaacattcaggaggtgcagtggagagaacacatgggtctggggatgtgtgttccaatttgggctatgtcagttgtaactttatgcagaactcacagcaggatcctcctccaactttgtcacaccaaggaaataagagatgacagtcctcacctcacctgcccatctgtgttaatactaaaatgaagcaatcctgtatgtttgtttgagagcaactacaaagaagtgattttaatacaaatacagcagactttcattattcatctactaaccacatcatctcacaatgttttgagggaaattccagatatgaattttagaagaatagggttgagagaggtaaatatctgtgaaatgtaactcaaaatttctgctctacttctggtctttctgttgccttctgaacttaatagactgatatttaatacacaacatgaaaatctttttattgtgtgactaagaatatagatccttaatcttatttttaatgtgctattcttagtggcattaatgtaatatccaattaattaatcaatgacatattcaaattaatacttaaaagcatatcaccttgaaagccctaccaagctgttaatagaaacttgcaaaaggtaacatagaaacaagtgtagcaactatgccccaagtgaaagagggacaatagtgacacttattactcccctactgaggtatcagtacaatactgtttttctgattgaagggaaagagatatgattatttgtatgatgtttagcttcacttttgttgatgcggtcacacagattttgcacagagggaggcataaaattttataattagagatttgatttaagaatatgaatgtcaggggtatataaagattgagtgcaaatgatagaatctggggacaggaaataaaattgattgtaagaatctagatgagatcaagagagcatgttagctttgactgatgaaaggagaaacagaaacaagaagatggatggaaagtacattctgcaaatgaagaacatgcctattggttcagataatgtgacttgggaaccactgtctttttgcacgtttaattttctaagaaataataaaacttttttaaaaaatatattctagacatctagaattaagatttataaactaagtgtatcgttagggaaaacaacacgaactttatgttgcctgggtgatcccgtgaaactcactagtcaaagccttagacatcaaggatgtatgctcatttgcacaccttcattgtttcattactagagggcataatgctgccttactagattcattctttttgaactatcaaagcagcatgcaaccggatgacagtaaagattgaaaatagtagtattagtacattttggtccccaattagtgaagggaaccaaaattttgtaattccaaaataacataaaacaaaagaaaaaagtcaacttggcttcttctgtttctaacatttcagcagaagaatggatgcacgtcatctaatgaacttagacaactggatagctcacttcacattgccttctggaatagctggctatgtgagctcaaagatatgagttgtgcagttggaataaattctgggttttagtctgacaccaggctaaatgcaccatgctgttcttcatttaccgacatcatattgtgaatcccttcctctcatggaacatattctgtttcttgatgatttggtagagctagtgtggtagtctctatgccatccatgggctcctgtggcttgcaacgcactttctctgttttcccataagcagaatgagactaactgagccacatggagatcaaacctgagacttgacacgatgcactccaacctgggcaaaagaaaccactgccactggggaattttatggagtaaggtagaatcaacaagtgtatggtttttctacttgttattttaatctcatttataaagtatagaaaatatattgatgctagcaagacaatattcaagccaagggatcctttttcatatctgtttcaatatcttttatttttaaagagagcagccatgtgtatttcatgctgtgtatgatttttaatagcaaacagacctattccagaaaaaggaacaatttaatccctaaagctggtacataatagatggggccagtaaatggtatcacattttacagcttgtccataaggatgacacaggatgaaataaaattgagtgcttttggatagcataggatcactggctgataaatagatgacgctattcagtttttagaaacataaggtaatgaagctggatctgaaagcaagagaaaaaatacatatatatatatatgtattcagtgtttatatgccacaagccactgagcaggaggaaaatctgggcagcggtgagcaaagctgaaacctcagagcaatgtttaaagcaatataagaaaataacaaagcaagcatccataaacaaaggcttgaaatgcacagaaaaataagttcaagatgaaaggaaaatgcccacacttatgcataactggaaaggccacttatggcatctatgcatagagtctctcaatgtaagagttaaacatactactaaacatttagcagaaaaaaaattcaaaaggatataaaacactgcagggcagttaaggattcttggtatttgaagaggggaggaggctgctcttttatcttaacaaaacaggatgttgagaggtggcctaagtgaaacaatgaaatgaaatggttgatgttggggagaaatcaggaaggaagctgtttgaactcttttcagataacactgatgggtatgagatggcttaaccaagggagaggtgttcacatggagggtttagatgcatttctttttagtagagagctattagattcttgacctcagcctcatcaatttacctaacattgcatttccggcactgggagaaattctaacagtctcactttctgggtgaacaagtgtaaactaaaaaaattacagtggcaaaattaacaaattgctgaagcaccttgaaaacggaaataccaataatgaggattcctttcccaagtaacttagaaagaccttgattgtggtctttttttttttcttgaagttgaattttaagcaatgcttcattttcaaaattcccatgcccttgatcaagtaaaaggcaagcttctgatatttgagatctgcgatagatttgaaatcaattcatggaaagggaggttacgaacatactcttttgatgtgtaggatgtactgataggggtggcagaaaattatgtgaaacccttctcttttgacagctatactggaacatttacaaccacagatgttatttgtccatcagaaaagaaaatatttgtttcaagcttcaggcattttctactacagtatcaatatgaaattcaacctcaatttaatgtttaatgcatatgaaaataaatatttggagggggcaaatactagaaaacaattgaaccccacaaaatgtaactagcaatatggaaaaaaatgctggcttcattacgagcaaatttgtccttttactaaagtaaggattgttctattattaacataggaaatcttagatggactgcaaagaatgctgcattattcataaaagcattgctgccatctggtggctacttggcatttcaacactggcttctctgattcggtttgactgggtgctctcgggaggtatttaaagaagagctttaagtggtaaaatataaatgtggacatcctctggccctacatgtcattcatctgatggcagtcctttctccctgtcttgtcgtggaatggaggattcagggagaggaaatgagatacttggatatcttttgtcctgaatgtgaaagtgtattttacatggcttatctaaagaagttactcttggctgttgttgactgatgaattttatcgacattcatttctgttggcaaataaataagtatatacccaaatattaagaaggtttattgaatctaaagatatgctattttgcttaaataagaatatacatgagatgctttaatccctcatttggatctaagcatgaatttttttaagttatcagtcactgaatttgactttagaaataatataatttagaatgtcaaaaaagaaaatgtacagaggttcataaatttcttcccatttattcaattgttatattaaaatgggaggattgttaatgactcagaaactcgtaatccttcttcatgaattttcaagttaaatgacaaatattattcagttcacatcgcactttttgttgaaaataaaatagttaaaatttaagaaattttgatgattctcaagcatcagtgtattaactcattcttaacaagaaccaattagaattaggatatctctgtaattttagtacggttttaagtttccaataatcgtagaaagtctccttggtatgtaatgaaaaccttgaccctttaaatggctatttatatagatcacaagtctttgaagattataggagataatgagttaaaattgccccaggaggaaagctgaagttttcttctgaattctcagggatgatatttaatagttaatattcagtttctagtgaatatttccctgtatcattaaactgccttctgatttagtaaaagtcagataacaaagaaccattacactaaatctggagaattatatactgaattaatattatcctttacaagaaaatgtggaaatgcctatattgaaagtaagacttttgggttttatttttaaatttgtgggtaagattttcaatctgtgaatacatacttgatattccctttgttactagctatttctaccactaaaaataattccttcttcaaaatatgtaatttggcttatggaagaatgttgctcatcttctctaggaagatggctcgattccccatccttcctctgttctccattctactcacatttaggaaggatatgaacaacaacaacaataaaaccttgcaaagaaagtaaaatcgataatgattatatccctgtctctttcatctgtaagtataaaatttcaactaaattattctcctaatagacttggatacaaccctgtggtggtttctaatggctccataatagagatagtaaaccttgtagctatggtcaggatgccctaggttttagtcataagttgctaatgtttgtttcaataacatttgctctttggcagcttttacagctacttaacactaaattcccatttagtcaggaggatcattcatatactgtaatgaatgatgtcaccttaaatcctttactatgtaattgctggatgttacattttatagtggggcatttgatggtgtatttgtttatgctaaattttatgacagtgacagctgtatcttggaggaatgaccttttttttttttttttttttttttttgagacggagtctcactctgtcacccaggcttgagtggagtacagtggcaccgtgttggttcactgcaacctccgtctcctgagttcaagcaattctcctgcctcagtctcctgagtagctggtattacaggaacccaccaccacacccggctaattttttttttttttaatatttttagtagagacggggtttcaccatgttggccaagctggtctcgaactcctgatctcaggtgattaccagccttggcctcccatagtgctgggattacaggcctaagccacggtgcctggccgacccttttcgttcataggaatctagtttcaaatctttttaagcaaatagtttcatcatatttgccttctggcttaggctaggttcccctgaaagaaaaatttgagactaggaattgtgtgcaagcagtttatttgattgaagaaagcagaaattaagaactagcaagagtgaaacagaaggaagaaaagccaatgcagaacccattattgagttggtcatagggtagctaggacaacttgccagaattttccacccaaggatagacaagatgaagcatttgttcattagctcctgagcctttggtttctggttgcctctgggtggggataatgtctttagatcttgagtttcaggctgttcatgggtgggcgtgtcaagaaggctctttcaggtttcctaccctgtagaaccaggaaatatccacagcagatagtaaaagatgtgtaacgcgtgctgaggcaagatgcagtcagtacaaaggagttgaagtccacacagaactgttgcaccagctgcagctgtagtgacacccacacagctaagaggatgtgaagcagggcacaggaagcatctgatgcaatttaccgcttgcaatattcaaatttacttatctcatgttaaatctaatctgttgccatgtcttcaaaatgatggctggcctcaatctctacaaaagagctaataaaaatgtttttgtttaaaaaataaaaataaaaaagctccactcctccactgcaactgtgtatgaggccatatttgatatttatcatctaccaccttcactcattctagattttcctcatcctcagccaggaggagtttagtcggttttgtttgtctgaaggagtcaatcggacctttgtatatgcggggtctgaacctttgattttttttttttttttttttttttactttgtcacgccctgttcactgtagttgacagttcactgctctcatcaggcctagatgtaccacaagacatctcactgaatcatctgacttccagattcattcttcctcctgctgctgtgcatatgcaaccttactttctcattataattagggtcagctatccccatgaatatagtagctattttagttgccctcttgtacacatcatgagtatccatagttaccatgcagtggtcacagctttgagttcatgatacttactaatccctgttagaagcagaactctcccgtatcccaagaataagaatatctaattcagcagagccaaagttgcaaaacccagaagcatacatgctgcagataggttactacgggggctactcttactcctaccttttggtccttagacccacatattccacctactggagacaccatgtcatgtaacatcatgtatcaatggtgtgccatgcattgattcagtgaatatactgcaacttggaatattgaacccccaaaaaacaggatcctgtctccaaactactacctaagcagacactttaagaggccacttcattattagatcaggttgatttcttccaagtgatgtgacatttagtaagaacggcagatcttaagatcacgtgcctggtgtttcatttccctcatttccttgatttcaggcaagatcatgaatcaccccacattgctaattcagcattcttaaagatctggaatggtagggcaggcagagacaccataatcagagaaagcaaacccatagaatgaatcactgttcccccaaggatggaaggggtctgatgttgtcagtttgctgtcaaacacctggtttgtcctgaaggggtcagtatctgcctctgctgctggaagatcatgtaatcagtggtaggtagccttggggagaaaaagccatgatgttgagtgtgtgcagcatctccatctctgccacatggccactccactcatgggcctattgtgcatgttgtaagtgactaaagagaggctaaagaacttcaactgaccagtcatctggtacattggcttaccctctggtagatgtagacaaggatctgcatgctctggatacattcttatgaatcttctaacatttcccaggcttcttgtttctaatctttcagactgtctccttccaggcctctaaagagcaggaaaagtcaccttccattgcctggaaatcagtctatattctaacctcaggctaccctcctctcaagatggctgcttgcctctctgtcctgtgggaggatttctcttcaccacagtcctataagatgactgggtgggtctacggtgaagctgcagtcttttttttttttttttttttttttttttttttttttgtgctcaccaacatactgagctaacccatccatgaatcaggcttgaggttttttttcatcattcatcagctggcttcaagcatctccatgaagccctaggggtgaactcagggagaggcaccagtgttaacagtgacaagaaaaatgggaatttgagccatctgttcatggaactttcttaatccctctagacctgtttaggccaaattctgaatatagcatttcaatccatggattgttgtccactctatgattcagtgaattcaaaaatacccaggtcatcatgagaagctgaagccatagagttgtctgatgtcatataattagatattccttctctattctgacccagcaataggccagaagctacttttcaaatgggaaggatatttttgctgtggaaggtaaggccttcctccagaaccttaaagactttcattgtgaggctgttagtataacctaccacacactccacagtaatattatatttcactttctcactaaattttctgaatcatattcccaagagtcaaggagctcacatgacagcctggacctgctgcaggcattggtagttatgaatagccaccctggtatatgaatgacattcagaaatactcctattgtccaatctactaacttatctagtaatgacagtcccgggcttgtggtcatatcaccctatgagaatatctgagtgaggcccagattcctgattgtctgcaaacagtggcagttttaaaccactaaatattgggccggtttgttacagagcaatagctaattgatacaagtaatatgtctacaaatacagtagtttgatttttacaagaaatggtgacatatttgaaagtcaagttcaaccggtattaacggaccttggaaaaaagataatgagaccacagttcttggtgtcagcttctaataattaattaccaagcactagctccatagaggcttgtagagaacatgcaggtggtgccatttcatctggtcatgtagcttttctgttactcagattgtttacagaaatagctgcctaacaaagttaacttctaggaaggatgccaggttacacggaatcataccagagtcttagaatcacattgggctttcacccaaagtttttgcaacattaggtggaggcaatataatttggcttgaaaagttacaagggaaaaaaatgtcagaaaatgctcatggaacagggtgttcagagtcttcaagataggatctttcttggcctcctgaaaatcagagaaaattgtatatctgtgatttttttttttttttaatagaacgacccaacagaatccagggttgtcacagatcattattaggccaacaactgtagaagttctaaccccaaaattgagctgtaagacataggagcagatagagctacagttggaaaatctaaacatagtctaaaagttttggcgcttcaagagcttctgggggaaagaaaagaaatttgatttctgtgttgctgatggaaaagctcaaaaattacctgagaaaattgtatttgacatatttttattgcaaatggtattttgctatttgtttctaaaagttgaaaatgaccttgcacgttaaaaatcatcagtttagaaaaaatatgaagtctgtttgcatttggaattaagtattccaataatttcttaaatttaaaaactacacatagaaagtgttattattattttggagagttttcgtaggatattccaggccaatgatacttatctgggtaaggtgaacatgcaattcttagacttgcctttgttaacttttagtttttttccttcccaaaatatataaacaaaaaggtttaacttatttctttctgaatttttctgacataaataaacccaagataagcatagtgtattcatgttaaagcttcataacgctaagtctgttctgtcttggactgaaaatttatttgaattccttcaattaaattaaaatttaaagtttcaataaaatatattatttctaaatctattttaggttaacttcaggaatagaaactgatgaaaaacagggggtaaaattattcagttacatcaaactctaggtgttaagtgattttttttcagagttattttcgaaactgtgtgttcagttattactttttcatagtactgagtagagctccagaaacttggaagagtcagttttcaaaaatatctaatttatggttaggaaactgaataacagtcaactatttcccattgtttcccactaagtcctttgttccacagttactttaaataaattttctcacttcatataaaatgcccttttgataatactgtcaatttatcttctaaagtcaagcaaaattaattttttcaatataatacaaatcaaactatggtgaaaatttcagtgataggagaaggtagctgaaatatatttcaagtacaagctctaagcaagtaactaagacttggattatgtagagtgcttactttctattggtgaatactactttgctgggccccaaaacagggcagactaaaggtggttggtagttgccattgtatgaaggtagattgcttttacaaaagatacaatttggaaatgatatgtatctatgatatgtttcttattttgttcacttagcatatttaagtttacttattaaaaatgaaacatttctgagataattttctattttaatgactccaatctgatttagagacagagagatagagttctccttaaattattttgcatagggtttccattgtatggacaaaattcttatgctttttttcataaactttgctcaggattcactcatgtttctaaataaataaaagataaataaaaataagttaatgaagaaaatactaacaggacaatacaaaggaccaagtatcattggagttttggtttatcatagttccatgtatggcccctgtatcagccaaaataggctaaactatgctttgagaacaaatttctgttgttcagttccatactgtcttcagtctgagatccaggttgatggaatagtctctttctggaagggtgtgacaagcaacatgtttgcctttaaagctcttacctgaaagtggcatatgtcacgtctgtcttcatttcatgggactaaggaagtcacagagccaacaaagcacaaatgcataatccctccatatgtacagtgacgacaggaagaaacactagttggcatggtaaagaattgtagaccctaccacagtccctacacaactaaatattcagatcacctgctcaatctaaataaaggtttgccatagttgttgttgctgttgtttaaatgaggcaaactttgataaagccattccagagataaaagcacatttaacataatttattgagtacttgtaattgatggtaacataatgactgatttaaaagaaccattcagctcctttgataaacactgttaagtgtcaagttattcaacaacatatgtcaacctgcatgccgattcatatctatttttaaaatttggaagtgttgggaatatgggaaatttgcatcaataattatttaagtccaaggcagatgcataaattataggagctgaaggtcaaagaattcagggtgaaataagtattttctgaaggtgacaaaaatgaggtaagggttgaaaagtatttgctttcagtaattgaaatatgtaaatgggtttagtcctttttccaatagtaaatgaatgtatgttatacatcatcaaatgaattggtattctattcacagatatttgtataccatttttaaagatataaagtgcatacatatcctacataaatgtttttggcatgttgggaaatgctctgctgagaagatatgctgttgagtatctttgttattggaataattgttttttggtatacaaatatttagcacaaaaaatattttctctagctagttttatgaaatatatccatgtgggcatgtatactaaagtgataatattagaatggatcacagatagaatgatggccattaatgtaaattgctcaatagaaagaaaaccccacattttgcttgggaaaaaaccatctgtattttcagaatgaggcataaacctcatttttaatgctctagatttgttacaacaagtaaaaactactctaattttagcaaaagtaccaactagagtcagtgaaaaatgattgcaattcaactctatgtatgtaactatcatggcaaactaattttatagagtgtagttttttttttttttccactttgaagagattggtgttaaatcctatttttctaatgtagagcatattggtttaaaacaacaaacaaaaaggccctcaaacaacagtcccagtaaaccaagttgcaattagctgccactcctgggaaatattctaggatatgtggctggcacttgaaaaatttacaccttctgaggaaaagcagaaaaattctgtcaaacaattaaactgattggaattcccaagaatataaaaaaccaaaatgagtcttatgttagaaaagaatgggaaatagttctatatatggctgcaaattggagcagaacaagtaaaagattttttgcaccttgtataaatcattttttttctttagaacaaataggaaagtcaaggaaaaactcattgtactagtttatttttaaaaattacacgttagagtttgaaaatgtaattagttaaattacctcaaaatagcaataggacagagagttgttagtaatatttttggataaatgtatgagatggttgttagatctatgtatgaatatacattggacaaccaagttggttaaaagtaaaaatccgtatattactgttaaagaatgtagaaaatatcaagatgagaaatattcaaattaagagtaagatagaagaagaaattggcacttctaagattcaattaggataaactcttataactttgattaaaagaaaactatgcagtacaatggaaagggaaagaccctattgtatctgcctttcctaagtaaatatattccaaagtgttataaaaatttagacatcttagattctcaaggaaataaaatgttttcttgtttaaaacgctgtgtgtttggcagatatcttgaagaaagagaaaagactatggtttgcatgtttcctatgccaaatatttctatgctaacatcttcaaatatgggttcattacgttcaaattccctaatttatatagaaattaaaagcttattaaagtaatgcttctcaaacttttccattaataagtctctaaagagagaataaagtactttgaaagtctggagagcggtcagagataaagatatagatttagggattttcagaatttagatgatatttaacacatgaggttgaatttttgccattaaagctgtaatttttgtcacatataaaagaaatgagtcttacggaagtcatgatccttacaatcaacttgctcttcagttcctaaatttcactatcatagtgatttgattgtattttttataacagtactccttttcagctgatggcagagactcttgatctctgaattaatatagcctcaatgagtcatccttcattagtaagatgaagaatgaattctcttttacccaattaggctctgagcattttccatgaagatgaagcacaaaataatcctgaattttaaatctctgagttggttatgcatatacaccttccaattggaaaaagtgtttcaaatcacttcctataagttataaatgtgttagtttttttttaagtcaagctacttttaaaatatttatttttactatttctttgattatactgagaaaatcaagaggaaaattatttaaaataaatcattctcagggatatactggccacaggtttatgataccaatcttgcaatcatgcctattaattgataagtgtacacatcccattacatgcaagtatcagtacctttttttacagaagttttccaaaatgaggtacatatgttttgttgagggtttataagaaaaatatttctccattaaatattaatctgtgttacttttttttgttttttaaaaacagagtctcgctcttgtcgcccgggctggtgtgcaggtgtgtgatctcggctcactgcaacctccacctctcgggttcaagcgattctcctgcctcagcctcctgagtaactgggactacaggcacgcacccccacgcctggctaattttgtatttttagtagagatggggtttgccacgttggccaggctggtctctaactcctgaccttaggtgatccacctgcctctgcctcccacatattcttaaccaactacatattttttatgaaacttcatttgattttaactttgcttaaaatgttaccacacagtagtcttcaaccttgtagacatttctgttttgctttgaatatgatcttcttggtatttacaatttaaaataaaattcttacccatcctgatcggtagcttttcacttgtattgcctatttttgaaagaacttcaatattttttagcatttagctatttgacccattggtgatatttaatatgttcataatttattttgctgtgtagtatgaagtaactcaagtactctgcacattcaatatcatttggtaattaatgaattgctcttctaatgtttcgtgatgcttatttgtaattacatactactttcctgtttaaataaatgtatctcagagacattttatttctttggtattgacatagtattactgttttagttattttaaacatataatttattataactactagaaaatcaagtctcctggtcaactttttcttttcaaaatatctcaatattgctatagcattctcagactgttagtatggtatggaaacaacctgattttggcttttgtaagtaacctctttggcactcgtgtttatatcttcattcagaaaatgttagaaaaacatatttatcagtcatattcaaaatattttaatgtatattcaaaaacatttgaggtcaagttatttgtgttaatgttcatatcactgatcaagttatgtttttcaatcttcacaaattcacactttctgtccaatagctcctctccatttttcatgtgtaccatttctatctcaaaatttccatctgtctttcttctgtattagaaattgaagtttctcctttccattgtcagcacaattttatgcactattaattatgctcttttctttctttaataaagattttaattctgctactgtatgtagatttctcctgcattgattctttacctttcttcagccatatgtgcattccatttggtattaaccctttaaaaaagcaaatcttccatttctggcagtataaattacaagttttctgttactgagaggtcaacaccaggtacattcctaaagtttctatttcttgtaataaatctaccttcccccttaacccagataaacattttctccgtatcttttaaggatttcttctcttctaacttgtggacaccttttctaggacccaggttgatatatggttgttgtttggttttgtttgtttgtttgcttgttgagacggagtctcgctctgtcgcccaggcttgagtgcagtggcgcgatctcgtctcactgcaagctccgcttcccgggttcacaccattctcctgcctcagcctccggagtagctgggaccacaggtgcctgccacctcgcccggctaatttttttgtaactttagtagagacggggttccaccatgttagtcgggatagtctcgcgctcctgacctcgtgatccgcccgccttggcctcccaaagcgctgggattacaggcatgagccaccgtgcccggccgtttcttacaggtttttatactttcaaatctacttgagttctaacaaactcattcactctcatcttgaaggaaaatcgatgtgtcaaatatcgttttccatgttctgctcattaaaaggagatggatttatttcaagaattaaattgaaatgtattttaattttaaacagtttgtggaatttcaaacagtttgtagttctttttttacttggatgcgggcatgaatctataattccctagaagaatgaactatgccttgtgttcttttaaatcgccggtcattgttgattttacacatcaagtgaaatctatcctcttctcatgctgcttccttagaagctgatggtggtggcaggtgaagaagatgggataaaaaggaatgtgaatggtcctggtggccccagaaaacaggtcacacatggtaggctgatgattgtgaggctttgctgtgagcagggcaggccagaacatattagggaggagagctaacaagggctttcttaacatccatactctttctgctttttctgcttaacatccatactttttcttcattgaaaagttctagaaatgggccaggcacagtggctcactcctgtaatcccagcactttgggaggctgaggtggatagatcatttgaggtcaggagttcgagaccagctagccaacacagttgaaaccccatctctactaaaaagaaaaagaaaaaaacaagaaaaaagaagaaattgccaggtatagtggtgggcgcctgtaatcccaggtattcgggaggctgaggcaggagaattgcttgatcccaggagacagagattgcagtgagccgaaattgcgccactgcactccagcctggcaacagaatgagactgcgtcgcaaaaaaaataaaaaaattctagaaatgcattagctgctcatctcaatccaggtgatctaaagtatttagagagtattatgttctctctctttgagagaactgccaatcgatattcttgattttcagtactactaaggcctgacctcttttgttttcatgtggttttcagtagaaaaatattaatcaaataggtacttgaccaccaggtcgatccagaatcttgctttttaattggatgtgttttaaatttaaatttaactctatatgatggaatttttttttatttttggcattgtcatctccaagtttgacaatggaaaagtactgatgtcaatatagactatttttattttatgttttcaagtactttcttgatatgtttgccagtttataatttcattgttcttgtgtcttttcaataaattgttttaagattagattagtttaaataaattatttatacttctctatatacatcattattctattgctatttgtgaacactatattattttaaaacatttctgcttaaaatattgctacactaatatcctcattttcaaattgttgacatccaaaagtgaaagaaattgggtgggaatactttcatttaacaaattagttaaaaaaaaattcaacaagctctaataggaactaatacatatttttgaattatttgatgatgattggtaataattacagatacttctcaacttatgatgggctgacttcatgataaaccctttgtaagttgaaaatatcttaagttaaaggtgcacttaataccccaatgaacctattgtaaagtcaaaaaaaatggtaataccatcataaattggagaatatctgtactaaatggttttatagtataaaatgttcaacctaactctagttaataagtatatgaacaggccacttactagttggatgaaatatattacaaataaaaaatcataatgcatgtccttatgccatatgttgcatgacattttaaaaaatattaaatacgtcagtgtgggctaatattttatttgtacaattttttaattttataaatctcttctgctaatcttactttgtaaattaatttttaacctattttaaatgctagtcatttccaaaaatttcatttccatattttattcctataaaacttcatccagttagtaattttctatttattgctaatttatttcctgatgaatacaaagattattgaacatagtctggctcatggagttcaaatcttttttaatgaataaatatattttgtattttttttctggaattctaacaactcttctgttatattatgactgggaaaatatctgaatttgatacatgaactttccagaaaagtatggctttctgcatttggtggccatccattttattgtaatcactacttatcctttaaaatttttaagtaaaatgtcctgtgaatcttgttacctttgtcagttagatggcctcattaagtactctgttgtataaacataaatatattagataacaactttgcagcttcgaggaaaagtggcaaatgtctctctactccttgttatctgggccttagtgacttatctaagtcctggctgtctttaaagttcagaattttaggagtacaaagctgtctttaataactagtttgtttccacagagaaaaaaaaaatccaaagctcttcattaattttcattgttacattagaactagcttttctctggtcttctcatctgtacttcattaagtcacattctgtggtataatgttgcaagtttggaaatgcagaaacagttcaagaaattgattctatttgttctttctgttcaatagacctttgatctgaaatgttcaatggtgcctggctgttccacacaagccacttttaaaccattgttcacattgtaatagccttgttatcaggttgtatgaattaattccatcacattaggagaaggaagttagacttccacagcacaatctaataactgtctcatgttaccatacaattgattgggtcacaagacaacacatcgtgtttataattgaactgttttgtaaggtggtcttggtcttaatttcagaatttcataacgacattaataggttttgatttccccaggacaccttgcccaacagtctttgagaacctaacaatgtataactgaaaatgtcacaatgaagcaggccaccactcttggtaaaattcccgaatcaaactcttctgtgcaatgatgtaaccacctacaaacaaaaccagcactttgggaggccgaggtgggtggatcatttgaggtcaggagtttcagaccagcctggacaacatggtgaaaccccatctctactaaaaattaaaaaaaaaaaaaattagctggatgtgtcccagatacttaggaagttgaggcaggagaatcactttcacttgaacctggtaggcagaggttgcagtgagccaagatggcaccactgcactccagcccggacaacagagactccatctcaaagaaaacaaaacaaaaaagcagaaaccacccacaaactaaaaaggcaattatcttgatggggcaggaggagttaggagaaatatggaagttctctagtcagccgctgtcaaaccttggcagagagtagctactaagttgtctgtggagagatcccagagatcccacaggcttgccacaccatcacggaactattgatagcaaaaaatggaaattaactagtaagggaatggaataacgtgttacgttgctgtctctatcacatattactgagcttggtggtggtgagttgcagttagacaatttgcaaacagtaattttgaaacagttcaaatagacacattaacaaattaactatttgatgagctgaattcattcctccacctggttaagttcgtatatgtgagattattctcattacttacttgaaaagatccagtgagcaatttttccttaaggcaagcttcctgctctttaggttaccaaccccagagggatgatcaagtgagttcccagattcttttatgtaaggtaacttccagggctattaacctatgataatgtagttccctggacccggtagtcctctgatacgctggtttgcttgtgtctgtactcttttggtgatatgtgactgctttgaaacaatggataagccctttaacaccactgttcatttgttcatttgtttgacttcccaatgctgagccatttccctcctggtgtgccctcactttgcctctcttccaagaccctggctatctgaacaggtagggcttgtaagtcttaagctattaggtacctttgggcagctttgttagacaactttcaagtgacaagacaaatccataaacccatcctttacaacaagttctttcatgaactcttccttgacttccatagcgagaatcgttcttcccacctctactcttctgtagtgcatacaaccttaaagagactggtgtgaaaattaaacataacttagacagaatggctcccacatcaagtgttcagtaagcatgaataatgtttatgaagaccatttattcagcccaccatttctaatcttatcattaccctttaccaaacactctagtgaaatctcagcactctgttagatctttcacgtgtatcatttctactctttgcagccgacttaccaaatgtatagcttggtctgttttcttgtttaaatgaaagaatttacagagggattagttactttcccctatttcataaagctcttatggcaaaatcagggtttaaacacagaggtgggttgcctgtagtgcctgcattgctaatgtttatttaatattacttctggatgacagttttgctgtctttgtgcattattagaattattaatcccatttgttagacattttttgttaactggcatttttatgcatattttcatatgcctacatattccttctctcattacattttgcatctttgtaaagcaggggccacaactactttttaaaatcttctggccaggtgtggcagctcacatctgtagttttagctacttgggaggctgaggcaggaaggatgacatgagcccaagagttcaaggctacagtgagcagcagtggcaccaccacactccagccttggtgacagagtaagattttgtctcttaaaaaacaaaacaaaaaaactttagtgcctaccatagtttcttgcatggtgatgcttaatagtatgtttattctttgtttggtttaattttgtaccttgctgaaacattggcttagctttaggcacacaatagaaatgagcaaaaacttcagagtgatttagaaattgcatcgttggagacttccccaccacaccatcttatcatctttctatgcactgaggcctcatatttcacagtgttctttgtagttgtcttgtttctgttgctgtgattgtcatttgtgttttgatcctggatttactgaaatgcttccttacaccctcctgaactttctttgcttttccccctctagtatgcccaggcaacctaagcgtggaaatgaattcattcttagccattctcttttcaaacaacaagaaataaagtcgtttatttttcatttgttgcacactcctcagtaagaaaaaatgggcagtttcattacgtatcatttgtttcttatttctttagtgtaactggcagacatgacttgtttgcttttggaaaaaggaatatgagaaggacagattcagggactcatatcaggatccagaatgtccccccaggccttagaattatatatgtgcttgacacatagatgaaatgtctgcctgggtatttggacagatagaacttttacttttacatcttaaggtaatagccatctttgggcatctttctcagaaaaccttcaagcagaagccaatgagacaaatccagagactgtactgccctgctttgtttactaaatgcacctatttatagacaaaacttgaagttggtgataatacctacatggtgcaatggggtcacaacacccattttaatcagctggataatctttagattgattagtttctaagcctgaggtaaaatgggccatgattccttcttcaaattctctgtctctgcatcctcctcttgctgtcccattctcaccagcttctgtaggggccttttcctgcccagttctctccatatggtttatttagagaaaagtacagagaatatttttatactctgtgaggaaatttatagatatagactatgcatctccagcatcttacaaagcttgggttcattatctgaatatttttacattggttgatagtggcaggtctgagactctagcagaagtaattctgaaaacaattccctccaggttgtatttgttacatttatattttttaaaatcccatatttatatactaaacaatacagacattttatcctatgtagaaagaaaatgccaagataaaaacagtgccagggttggttaattcaatagctcagtgacatcattgacaacacagttgttccttcttcctgtcctgtcatcccgtgtcaccttctctcactcacggctgcatgttgcctattgccggtccagaatgttcgtgaagacctgacagagttaagcagattgaaggattctttcttatacctcttgaagatcaaaaaatgcttctcccagatggtctgcagcaggcactcttgtgtcttgctggactagaactgatcacatgcccaccccacaatctaaccctataacctgcgagaggaatggaggtaccatagttgacgaggaaggaggactgacatttccccaacttaaggctctactagtaaagaagaaaatggcttttgagtaggtaactgagaatgcctgctaaatttggccccttttttagacactgaccttgggcattatctattgtcattcacatttcttaccccaagtatctaattatctagtccaaatgcagggtttttttccattccctaatgtagagttccatagtgcctcaaatatttctattctggtacaatgcatatacaactacttaaataatactaaattgactactacagcaatttaaaaatacaagaaatcttcttatttatagtttaataaaaataacttctggcctcttgagcccagaaggcactgtgaaattcatagtcacattttgagatacagatattttgttctttgtacctagctacgctgaagagtttctttctttctttttttttttttttggccaggctacatgtaagatggattaaaagaaggcagatttattatacattgtaggtgctgtttttactcaaatagcagagaatttagaggccacttatttaagtacaaatgctgcctcctacctaagtcacttaatcaggacactttaatttctaccactgctaaattcagctaataatacctgccccctatctacctctctgggaagctgggaggattaattagataaagtcttaaagctcctcagagagaagtggtatatgtaaaagatgttattatttctagggaagaatgaagcggtatctcttttatggactgtccacacttctagaattttttcctcttattcagctcaagtgccaattttgtggattttaattcatcatgtgagacccttctcattctcaagtagttgtacttagagaaaagattttcaagtattgcgtctgatgatgggaagtacattcctgagtttcactgaatatttcagagcactatcctgcaaactggtatatatgctggaatctggttgcaatatttgtaaaaacaagccatgactgcattgcagaatgtgacccgggcctatttttgagatcctttccaatccccatgatctaagtcaggtcactttggacatagaagacaaattgatagtaaaatcttgaatctctcataaatcttgttaaatagtttatatttaaatattcttttgagctatacatttttatatttagattacagaattctatccttcaagaattctcagttttggttatatagttaagtgtacacaattttcccaacctatgatccactttacagagctttgagtatgcttgccttttacattgctttattggacattgaacactttcattaactattacattgatggtttcctgtttagaaattgagttagcacatccctgtgtgttttggtaactgcagctgctacttgatgttaacaagtctgcattctggtcagtggtgcagcagctcattacagatagagatgggcttattttctcacagtagtttgagaagccagtgagtcactggatccactggagatcttgggagagcttgggaagtggctgttgctgggaacagccaggttgacttcccccaaacactttagagaagattttgaccaccttcaatcattcacactttctagaaatgaattcaacctataattcttcacaagtcaaaatgacagattctttcaaagcaaaagcatagctatatgatttactggaatcaggttttcatatttataggctttcttttaaaaagataaaatttcttgtttttcttccagttctaaaggaaaagatgagaaatgagtgtcaaatttgactcagtgactaataccaaactcactcaatctgccaggcatcaggaactgggcaactcaataggagcaagaaaggatgtagggagcacagtgtcattaggggaaaagcctttaccttgccggaggatagagtgaagaagaaaatcaagggtcaggtcatttctaggtctatttatcacatgaagaaacaataaagagaggttaatagtgcacttaagacttgcactaccaaccacttacctaagtcaggtattgggccctgacccttctcatcataaactcctctgctcttggcagaagctagaaatgagggtgagtgaacacgggcctagcatgagagaaggcagaaatggtttttccccgtatggtgacaacatggcttttcctagtgttaccagcttcattcatcaaaatgtattatctgtctatggtgccttcttgtgaagcattcacagccaagaggagtgctgacattagcttaaaaagctaagttttaaggctttgatgaaggattcactgagtggttttgagaaaggagaatcatggctttgaaattcaaacacatccttaactaccaccctcattccaccaattaaataaagtgaaatgatgaataacagacaatttataagaaagtatctatagttttagatacaaagagatgacaaatgcaaaaagaacacccctatattttgctagaagaaaaaacatttagatacagattttttagaaagtagtacagctaattagcagtagagccatgttttacttactacatgctagacactaagaacttatgcttaatccttaaaacatcactaagacagttacacccattttacaaatcaagaaaagtaacaaagattccagtcacttttccaaggtcatataattagtaagtggtaaaagacaggcccagagctagggcgatctatttatagatggcttcatgttgactactctgctacacatgtaatgaagacaatttaaaatgtggaaaataataaatgctaattccagattttcaaaatacatcaaatatatacataggaaggacagtaatcacaagacaccattaggctactttaatataaaaagaccaagagcttggatgaagtcttttatacagaaagtgctaaggagcatagcaagatgagttttatattaggatataatataataggataagatatgacttattgttaggatgtttttgcaattaagatttgcttaaaaatagaaacatgcttcatgaggtcctgcaacagttcaggtaggaagcaacagctaaatacaagagatacttcaaatgactcttccataggtaacgtggactcccgggaaacgggcctaagaacccaatctctcagatgttataatgaagctgcaggtcctctttacattggccaactgttaatgatgatgtttcattatggtaatacaatggccagtcattaccctcacactttattaaaatgtacatgtgttgcagatacctcatcttcattagcaatgatagactccgaatattctactttccattttaaagaatcctactattgagataaagagaagaaaaacatttctcactttattccttttttatgctttttgattgctgaattatgtgaaagtgttacctagccaaaaatatttttaaagtcttctatgaatccagtattcataagcttatgtaactcttccttcactctcagactaaatgaacttgttatagatggaattgaataaagttaccatctacagtactcataagttttttcttttagtagttttcagttttagtaacttcttggagttatcactttaaaattgtgtttctaatcctcctatacttgtaaataaatttgtaaatatcagaatcatattgtttatgatatatgtaaagttttatttccccctaaaagtctatagactttaatctgccctcgtatggaagtttctctattactttaataataattttaataatgttataattacagaagcaccaaaaataaggcatgcatccatctctcattgtataacatcattattggtgtattagtttgtttgcatactgctgataaagacatacccaagactgggtagtttataaggaaaaagaggtttaatagacttacagttccacacggctggggaggcctcacaatcatggcagaaagcaaagaggagcaagtcacatcttacatgggtggtggcaggcaaagagggagaacttgtgtcagggaactcctctttataaaaccatcaggtctcatgagacatgcgcagaacagcacaagaaagacctgcccccatgattcaattacctctcactgtttccccaccaacaacatgtgggaattgtgggagctacaattcaaaatgagatttgggtggggacacagccaaaccatatcaggtaaatattaattgctccatcttaaacgtgagaaaactgggattcagagaggttaaataacttgccggatttcacacagctgataaattacagagccaaaatttggacccagatctgttttcacaacttgtactcttctcacactggcatgctatttagaaggttagcccttttctggttaggcttcctcctctactttacaaatcattaagtgctgcctcctgttggtctcccttggcgttacgctgtagccagcccttcaatacaatcagtgaaaacaatccttgttgggagtagatcatttcggagtattgattctaaatttgtcattgttttccgtgaaagctaagcatagagtataaattgccactcaccacataaagttgatgactttctatgcccaaatgatttgacaatttgtgatttttccccaggagtttttttgctaacatttttcaaggcaaaatattcaatccctgtccaaaatgatcaaattttgccctgcagcaaacttgtaaatttttgccaggacccgtgaaacttcacaaggcaagagatcaataatgtcacactgttcccttctcaccgctttcctcaatgtacacactatctagtttgaaactgccaacatgagaaagtaaaaaatttaagggacaagtaaggaactctctcctcatcttttaaaaatataggtgatatctttaaagtagagatgatctgtctgtgctcaaaaatttgaagtaagacaaaaatttagttttggatatttaaattaattttacaaaatagcaacatgcatgactctactcttgtattatcctgttgtgtatgttcacatacccaaaaatatttttggtgttctgcctattgtgtctgatgctgtcagcctttgttgcaaatcaggacttaggcaaagagcccagatgggctttgcactgctgtcatgccaaggcactaagacattttacttccacctgtaataatattaaggctttacttcttcaacattaatttgatgcatacctttcttttttcccccacattaaaaaacgtcaataagtgtgagccaatgtttcagtagatttcatcactctttctcttcaaactttgtctttctatccaggtctgtcttgtctgcctgaattgtaactgtgaatattttcccatgttcacctattgggctttcattcttcttgatatctaattcctccttcagataactcatccattttcatggcttcagctatgcctttacttgaatgatttccaaaattctatcgccaatcctttcccctcatctaagcaccagtcatttattttcaactcttcactggacatttctactttgatgatttgcccccttttcaaaataaacaagctgaattctccacccctcgatcgcctcccactcctgatttcgtttttgttttcaagaatagaaacctgtttccgaatatttatttggaaataaatattatccatacttgaaactttgggccaaggcacaagaatggcaatgcaaagacgtacaaaaaactggagttaacatacagaagtgcagtgagccaggctcagctgtatggacttggggccttggccctgttttactcagcgccacctaatggtcaccatttagaaaggcaggcctacttttgccagatgcaattttgcaaaggaaaatgtaaatgtcaattttatagtgaaatttatcaatatgtttaaacgttgtcactgttaaacaaaatgcagcactctggaagcaatatgaagtttatatatgagtatgtttattccaagagctgccaatttgtgaccactacgaaatcagctgagctaaaagacaattggaaaatatataaataaataaaaagtaactggcagctcctcttggttatgataatgatgctagagctaacacagataacccaaaagaatggagccgttccagtgcgtcacaagactttaggacacttacatagtgttctgaaaaataggctaaactaatttcatcagtgagataaccaacattgagctaaacccacaaacctgaaattaaacatcacacattgtaaatcagtgaagcaaaaatcaaacatccagaaactacaaaaagtaatcctgtctcttttaaaataagcctcaggttattcttctttccttaaaggtgctctgaggcatgaaaagtaaattttcagcctaagagtggtagatttcaatgaatatacaatatggttcccatgtctcaaattcttactttgttctgtttttttgaaagacaatgtacatttgggttttacataacatataagcctttggaaataaatattacagacttctaatgttagacttgtggaaattgagccaaagacatacaccagtcaaagacatatattgatgacataaagcaatctttgtgacaagatcgcttaagatttcaaaaagacatatgcagatgaaattaagcacatataaatttatccaatggttacttaaaaaataaaaataaaaattagattaactgccttcacacttgggatttttacttgtaaacccaatactaattgagaaaattaagaaactatggaaacttaactaattcaatattttttttcaatatactggcaagggtatttttataaacataaaggaaatgcaaaatataaatatactaaaacattaagatatataaacactcaaactatcattacaaaatctatgtgaaatataaatcaggcaattgacagtaaataatatgaaacttgtactttgtttgctttagaaatattattttattttccaatatctttacctcggtcaggtggccaaactgtctgattagaaatatcttagcataaagatgaaaaatgcattctatgaactactatagcataaaggcttttgaatttcttctgagttgccattgatctgcacgcattcatttctgaattagaaaacagctaatattttgtgaaaagaggatacatatttctttaaattgagaaactaaatttcatgttaatatagtatcagtttattgtacttcagattttagcacaagcatttcagaacactgaaaaactatatttagagtgagatctacatattccatacagatggaatcagtccatgaatatatattggtatcattcttgccagtcctaataaaactctgtctttagtgtgtttgaacaaggcttaagttatacatgaaaactgaaacatcaaaccattatataccatttaagtgtagataaaataattttacatccgtacaatatttttaaatgttgactttagcaaaaacttaaaaattctctgaaatttgaaatgaaaattcatgatgcacaaaattatgaaagaagaaaatgtctactccaaatatcccataacttttttgaacaaactctgttgtgatttaatctttttcatttacattttctgtctgtatttgagtttacaaagtgctttcaaatgcaatacaacatttaacctgcactatggccttttgtgaaaagtggtgttattgtacttttaatgatgagaagagtctcctggaggtgaatgaccaacttcatcatcacacaaccagaaataaatggtaggactgaagcttgaagctctggttctctgaatgccagccagagtgttatttctaacagaccacagtgtgctatgctggtttctgatcagatccgtttttcctctatccattttacacacataaaatacatgagaacaaggtaaatggaacaattctaagttttttagtttttctttgtaatttgactctcttgaaatcccagctttgtctaagcatagcataactcgaatatgaaatcatattcatgtttgtgtgcatctgcatgtgagtgtgctcacccatatgtatacatgtaatgaattcctatacaattaaatgcactgcttccttttattttcttcagaaaaattgccatggttctaagaagaaaatagagaaaaagagaatctcagtaactatacaggaatcaaaggatttagtaaaatggaaatgcatcggcaggaaatcataaatttgttatttttttaaaatacagtcatgtgccaataggattacattctaaggaatgcataattaggcaatttcttcattgtgtgaacatcatagagtggaattacacaaacatagatggtatagtctaccacatacctaggtgatatgatggaacctattgtttctaaaccacgaacttatacggcatgttacggcattgatcttatgggatcacccttagtatatggactgttgttggccaaaacattgttatgtggcacatggctatatatagccaggtgggtagagcccatctggactgtaaatacataattcttaggagtctaaagttctagaggtgaaatggtttgacctgagtttttgagagtggaatactcaattgaacaaatgtataattctgtttctgtttcttggcgtaaacttattccatatatattcatatagcttatttttgtctaatgctgatataaaatttgactaataacaaaataaattatattagtccttagaagggaagtctgcttttgactttaatgaaatgtgccccaaaacacattggaagagattagacttaatctaattatctgttctcgtactacttaggacaagcgctttcttcctttctcaaaatccatcttgtcttctgctcggtttcactgtaaacttgaaatcactttatgacatcagcctgtcaccctgaaaataacagatatcccagatgtgtcattgaaagttcacttccaaaacaaagaggaagatagaatgggctctcgggggcctctgatcttgtttaaagaaatgtctgagtcccagcgcggtacctcacgcctgtaatcccagcactttgggaggccgaggcaggtggattacctgaggtcaggagtttgaggccagcctgaccatcatggtgaaaccccaactctactaaaaatacaaaaattagctgggcatagtggtgcacacctgtaatagctactcgggagggtgaggcaggagaattgcttgcacccaggaggtggaggttgcagtaagctgagatcgcgccattgcactccagcctgggggacaatagcaagactctgtcccaaaaaaagaaaaagaaaaaaagaaatgtctgagacttctgctctgtgggtctctccaggggaggtgaatgcccagacatatctcacccctgcaggctatgcctttcaggtgaaggatgctgaatgttccattcagactgactttctgatcttccaaactttaagaggttgtatcggagtcatactttgaaaagttatctcctcaagttcctggtattccctgatggttcagaactcatacaccttggcacatgtagttatgaaagctctttgcatttgatgagaagcacgaagaagcaggaccagtgcaagcccatatgggaaaaagtgccatgtgattcaatagtatataaatcggcctcccatggtgacagaaggtgtcattcaaggccataggccacagggagagtgtcactcatatgtatgcacactcagttcagtcctgtgcacatcctacacttccgaatgcatactgaccattttccccttggagtcacgtacacaacatgcagaatggttatgtaggagaaatccatggcaacagcacatagcttgtagattgtatttggaaaaaaaaattaccttttctaaagttttaaattttaaaacatgtaattcttgagatttacttgattcaaacttgaaaaaaaatagtgttgcacaatttttttgagcactagcttatcttaaggctttctgaataacctaagggctattcagtcttccttttagaaacctccgagttatttttctgtgctgtgtacattttcatccacaagaaaaatattttcttctcattcccttagattcctcgggacactttttttttttttgtctgcagacaccttaaaggactgtttaagaccctatccactctatctattcttagcttcacctgaagggcaaaatccctaagatcttgacacacatactgataaatacatggaattattaaaggtgccatctcagcagaagaggattgctgctgcctttgttctcgggggaatacatatttcacccagtagcaagacacccaactgctgctacaatcagaaatctctgaaatgcctttaagctaatcatctttgaacataagcctttgttgttgaatcagggaccttctagatgcaaggcacagaaacctttttttattattttgttttttctccaccttgcacaaaacagcatcaagcctgtcaccaccgacagtaaggttcagtgatctgtcaacattcacccctgatgaagacagtgagagaaatccatagctctggagagttcaggagagaaccaaacagtgtgtttgcaaaagagcatttttatatgttttcttgtgacagcactagtttaacagaaaatagttggagtgtgccaaaaagggggaaaaatgaaagacagtagtagtaagttaggctagcatgacatgatggatctgggctatgacaaaccaaattggaacaaagcttccctggggaccaactataccaggtttgctgaattgtatttcttgatttcttactgtgcaacagtgcttttactgttagattgactaggcttcagaatatttttaaaattgtacaaatcaaaatccatgtagcttaaaaatgaaggatgtaaaaggtttaggagtttgatgtattgaaaggcattctgtattccctcatgtgagtattaagtatacactttgtctgttcgatgaatttcaaatctttgtggaaggcagtagacacgatagcagtttacagggtggaaaaccctggttggaaagcagggcacaggctggagagattcaaagcttcttcctgcttatcccacccagatgtgcccaggaattgcaatatgcagcatctgtagggtctcacttgttctgagatgtttatataaaggacaagtaaagaaaccttaaatctggtgccctcttaacaaaggtgtgatgcattattcttattacttgtcctttcaattcttacctagtggctttcacatagtctaaggtaaggccagaagaaaaataaccaaaaaaagaggaagaagaattatttcaaagctgctaaattttactggttttcatataccacgtgaaacctaacaactagacaatctgattctttacaatagtcattcataataaactttgaataaatatctaaatgaaaggactttcttaaatacccaggcaagtttaggtactcaagctgcaaaggcataaacaattgagtccctatctttaaggagtttacaagcaatttgaataattaatgaaactgtcagagtgtaatgtgataactaccaagcaacagccaagctcaaagcagatagcaaactatctagtgggcttgatcaacacagctccatgactttcccaatagctatttacgatcaggagaagggtagagtaaagggatgctgaaagtgaggtggttggggttcagtaaaatagaagatctaagtattgaggaaggagagctaaataagacattagttcagaacacattaaagtaggaaacacaggctaaagcgcttacggctggtaatgtaagggaataaagtggtggtgtttaagggttaaggaaaataggaaatgatggcaacaagcccaaactcgagtttgtcccatccaaaaaaagaaaaaaaaaaagggcagcggctattcaactatagcccattgatgcatgccagaatgtggagcaatattgccaaatcttctggtcttccaagagaaaccagaaatctggattttcatataacatatatttaaatttagaaaacttttttttaacattacacatgacgtggcattatgtgaacccaatcaaatgcacctgagaattgttttagcccatgcactttcaagttgcaaccgtttttttgacatactcagatagtgtgtaataatggatacacaatgtaggaggaggaacagggagcctgaactgtttggggtaatcatcagattcaaatactttttaacagtaaatggctggaatgggttaggctgaggatacaaaagagatttagaaatgagggaaacacagattactcacttctcaagtagagtatgatagccggcagcaggtaacgaggtagaaaagaacagagccagctaagtgtgggtatggtcaagaaataagagatttgtcagaaaggacttaaaagacagaagagaaggaagaagacagggtgttatgaagtggccagtgagatcatcagtgagaggatacacagtactgttctgtggcctgaaagtggcattgagctgatcacaacagaatgccctaagtatagatttttaagagaattattgagagcaacagactgtttcaaacagatttgactttgaaagtccaggtgatttaaccctggtttgataatttctatcagaaatacagcaaataaattggttaactgaattcaatgcacttgcaaaatgtactaaagacagtttgaatggtattcgattaagtattttggggggtacttggggatgacaatgaatatgatgatacattagacactacctgtcccaaggtgtttacaatctgtatggaaaagcagcagacatgtacatgcaaacacagtttctctccctccctccctccctcctcactcactcactcacagacacactcaggcacatacatttgtgtgtgttctaatgcttgctaagtgttatgccataaaagcaaagcatatatgattgttcaaaatcaaatgttatagttttttctctaattctaaagtacttcagtgtattaccaggtgggttctcttcagagaaccccaacagcaggccaggaggcagtgtgctggtagatgccaggcaatccagacaggatcccattatcttcctctcttgccacttttgttaaaacctggtaagactagcactcagcaaacgttcagtgagttacatgttttaatttgaatgggctgatttgaattcaaactgatgaggtttgaaccttgcccctctatatctacccattttatcattgcccaccttctcttcaccaaggctagagctgagactagcgctgaaaagaaaattcttggtaaagaattccggaatcttttaagagttgtacccagacactggagaaatttaatcaaaaactcagttacatagaaacagcatatttaaaatgtttagaataaaagtattttagaaactgggaagttttaagacacttttgaaaagccataactacctctaacgcgatggctatttcacagtggtgctattagacagctacagccaagtgccccaaattaatattaataacaatgagtataaataatagtgggcttttctgtatataagcacatcctattcttattttaaaatacagtagcttgagttttgcaatgactattaaatttcatcagccattttggggtgacagttagcttccagccaataacagaatattataaaaggagaaagttaagatcaatcttaaatgtaatagtttttatataagtgttgctgcttttttttagttaattatttacaaatgtattttctcaatatataatgcaggaagatgccaatattactcaattattttgatccatttataccttgaactaaggaaataattggtatgccacccctaatattcatttactgaaagatttgtatcctctttggtttggttttatttatgtgtaaatatgcatagttcaaaacttgttagtagcaacactaataatgtcatttatatacttcaccttgtccatttaaaatggattgttctatttatagagtaacagcctgtaaaattaaattaaatttttaatagaaaagacagtccttttaaaaattattataatagaaaggttgatttttttcataaatcacttccaaagtaatttttaagaaaatcttattttagttccaaaactttaaaatagtcttattgatttttaaaaataattattcatgtaaaataatttatggcagagttttctgtacttgaaaataattcttataataggaattttacaagaccatttattttagcagtgctaggaaacacaactataatttagaagctattgttgattgtttctagaaatatatatcgacctcattagttttaagtgataacattactaagccaaagttccaatccaacagtaccagaattactgattgtaatcagttttcttcgaacttttcctttagcacttagatttcacttagcttatcatacataaatataaatgtaaatttaaattatcttagaattctcattattaaacagtatagaattaatacccatggaagctccagtgtctaaagtcttttgttacagtccctttggtatgcatttggggtctggttgtattgataccaccctcttggacactttattattaatcaagaagacacccaatggtctcgagaatcttcaccacccaataagcattcactgagtcatttattcatcgagtaatgctctagaggagaggaagtcatcatcctcatcactagcaactgacatttattaggtcctcatacatgccaggtgtgtttctacactcttaacatgtgttaacatatttagtcctcacaacaaagtgttcctgaaaatgattttgtgaagtttgttagctggatttacaactgttaaatatttagacacatggtctgcacatctccatttatattcttgtcttgagacccactgattgttaaaggctatcccaaaacatatccatttcgcacagtttagagtgtgattttatttatttcggcagaggatagattaaactgactttggtgtcttaaaccacatcaatgtgtcaaagatgtcaggctttgttaatgatgcacaatttactaagcacctgatgaaaagcagagactaaaagtttcttaggtaagggtcttcaggctgggtgttctgggaggaaggaaacggaaagtaatattaatatatatgttttgcaactattaagtgtcaaaaggataatgtgatcatgggatattcatattcaaatccaagtttaggtatcatttgctgacaaatgtttaacacaaaaactcaaaggtaaaatctctacttttttgcctattcagtttgaaagttctatagttaaggcagagacaacagcaaaatcaaggataaatatttgaattactctaagtccatttgacaaaaataaagttctggaaatgtaactcaatggtaaattagtcttagtcaatttctttacttaaaactcttctggtatttgtcataatgataaatgatcatctcctctaagcccttcctttccccataactgaattcctactcaataagcaccttaaagattctaagacagtctctgttgttattcttacatactctggaacccacagcacttaaatttatgaatggtttgaaccaccaacctattatgcaagcgtaacctaatgttctttgaatataagcactaggtaaacaagaaaatattgccacatgcatttacttagtgcttctgacattttgacatttaatggattgataattaactttttcaagactggtagacttctctccaaacatactagttaggataatactagctgctgtaacaaagcccaaaatagataatggtttaaacaaaatagaattttattttgcactcatgtgaagttcagcatggacattgttgattggcaggctgctttcctgcagccattaaaccaggaaccctgactcttcccatgtgatggacccagtgtcttcaacatgtggcttctaagaccactgtttctctacatcaagccagtggaaaaggaatgaagaggaggagggtcctacttagactggaagtgacacacatcacttctgcttatttcttactaggaagtgtagcctttgggggacagccactttccagcatcatctgccaaaggcactccaaaatgcaaaaatgtcagtgattagtccaaagaagtgactggaggattcaggttctctaacatccagccaatggctcttgttactagatcactgttttccagccagtgggactctttctgcaaacaggtgacctctacttggagagaaaccagaagaaaatttaattgaattctaagctaatgagaagaaatgtaatcataacaaaataatagccagtgtttattgagcattcgatatgtcttgggcattcttctaagcactttatatatgttagtttggttaatactcagggtgatgctaaaggaaattatttttagtagccccattttacagttggggaaactgaggcatggggctgtgaatatatttcccaaagccatatggtaagcatccaatgaaatctggattcaaatctaggtagtctgattccatcagattattttatcttccatcaaagatagaaaaatgccatttgaaaacaaaggggaaaatggagagaaaaggtttcttcctgaaagaaactttctctaattaggcatggcttaagttacacagtttgtaattctgtacaactcactctcaccctgtagacttgaaagcccctgttcttttccctatgattacttaccttgtccaagtcatgtgggctcagaagagggaaaaacttaaaacatggtctctcatctcaaggaagttagattctgttgaggagaagagaccctaaaatggtaggaaagaacagtcaagattaaaggacaaataaaaggcagacaataggatttcagaaaaggctgtaatcaccacacataaattaccaagaaaggtttcatcaaggatgttcttctttagctggtccttaataaatgggtaggatttcatgaatagagaggtactgagaatgtcaggggagaaggaagctgagaacaaagtttcgggtagataaagacacggtgtttgtagcagccggtctgtaataacaagcaattttaggaattagtgagagttacatctttatccatttttactttagaacttatttttttgcatatatttttaattctatgtaaccatctggtaatgcctggcactctatgatttgttgcagtagtagtgtttatctaaggaactacgtatgtaggcacaggaaaatgaatactgagttctgggaacaaaggctggggagggatttccaaacaaatgtcaccttctactcatttcaacaagtgtaagagttaagaaatgtgcctcgctgtcaccacatttctgggcctctacggcttgttacagagaacctaaccaagacctcggtattctggctgtcctgtctaactacatttagagtaactgaccatccttacatacctatatcacttcccatccctgctctctcatgcagagaatatttcatccctccctcaaatcaagggatgagcccctggaggacagcgagtgagttctgaattctctgaggagccacctctgactacgactgtccctctctgtcaatcacagagcacttcgagtgacatcatggctgtttgcagtattatgctgttgctgtaggcagcatgaaattgacaaggaatggcacagagaagagctgaaagggcacttctgcttttgtgatgcatctgacacctgtagttacaagaaagaaaacagctttcataagcatattgctaggtgatgtagaaggtgaatgagaatttagaagtagtttttcaatgtaatagcacaatagaatctaaactgcttctgtgcacttgcaccctaagaatatcttcctaagtggaagccatccggtaaggtagtttctcagaaacctttgggtaaaaagttaggcttcagtgaaaacccaatctagatctcagaacgttttggtctatgagatgggggtcttaccagctctgattttaataaaatataccttttttagaaactcgatcttcacatttttttaaacttttactttaggtattagggtacatgtgaaggtttgctgcataggtaaacgtgtgtcatgggggtttgttgtacttactatttcatcgcctgtgtattaagcccagtacccaatagttattcttcctgatcttctcccctctcccctcaagtagatcccagtgtctgctgtttccttctttgtgttcgtaagttcttatcatttagctcccacttgtgagaaaatgcagtatttggatttctgttcctgagttagtttgctaaggataatagccaaatatacctttttttccttaggttatatgcttatttgtatttcttctacctgagaaatcatattatagattgtaaagctagtgtccaaagtgaagcagaaagaaaaaaggtaccccagtatcttcctgagggggagcctttcctatgactgaactaacaaattgacctaaatttgttattattactgtaatagtaagagcaactctgacaattaagccttagcaagagaggggatttaagcccaaataaagtcagttgttttgataactgaagtagttttaacactaagtggacaggttacaaaattgggaagcaattgattgtactatgctgagagatcacaagtttgcacaccatccataatgcattcaacttgagcaatgtactgagtctgcagtactctgtgtgtgaacatggttgactctgcaccttcctgtagcagcccacagtgcaaatgtcatcttgataactctctgctgggtggctccttagaccctgtcatcctgatcttttgcctgttgtctggtcatggtttcttccttgttctcctttaccccctttgtgtggaaaaacattttagtctttagcagcaaatcaaagccattttcaggtgacactggtgatcttctctcttacaggtatatccttctgtttcaggtttgttatgatgaatgtaaggagcacagtgaggaaagctattgccagtcttactcacaagcactataggaaaattaaaaggaaaagtcttcctgtaactatttgtatgtctctcaaaccatggaaactaagaagagctacaattattgaaataaagtgctatattccaggctaggccaaatattcagcagagagcctgaatatttcatgtatatgcagtcaggaaataatacagaaaaaagaaacccaccacaaaacagtataattgaggactattactaggccacatgttttgaacacagtatctcatttaatcttagtgacaaatgttctgtgtgatcttctacctttagctcggcccattcctctacattcctatgtcattttgtagacttatcattttaattgttaaattatactgccctgggttcatagatatcattctctccagtgggaacctcttactcatctttttattccctggcatctatttatctatcaattgccaaaacaaatagataactagagttgatttgttccctatcacttctcttcgggctctaaatcacatcaagttctcagatatctcatccacgtatgtattgctatagagatattagtacttcaatccacactatgaattcccatgtggaaaaaatggtaaaaaaggtaatgttaggattacacctcaaattgatgtaatccctagttagcatctcgtaatactgaaactctttattatcctcttagtacaccatggtattgacagcactttgttttaccttatcattataacatcatctgtaagaatttctacttgtatcattaaaagatgattatgacagcttcgctaagcctcattcatgtgaatggaaaattagtgccataaagaaaattcctaataattattttctaggacgtgttggtacttttcaaacttaaactcattaaatcgatttgaatctcatttgagcaaatccacacaaactgagtgtcttattaatgtcagtctcatactacttttaggaaaagatttaatcagaaaatatgttaataaaatccacatgcatggttttaatctcctcacatatatggcaatagtgtctatggatctcaatatttgggaagtgattatcacaataatttacatattataaattatcaaagtaaattgaatttaataattaaattatcaaagtaattcaaataataagagcagacactgtgctagttgttttacacttattatcttatttaacatgagaatttttgtccccactttacagatatcataattgtgaaggtcagagaaaagtgacttgctcagggtcacgtaatgcatgtgtagcaaaaagctttttgggacatacttctgatagactctaaaatccttatttttttaactttgctacaatgtcatattgattcatgtttccagcactgggtccttcctttcattgtttcttcaagagcaagagtatgtgtctgatataaaaagcaagtactgagttttcttaagttctagttcaaggtctaaaaaataatgaaggattaaactttttttattcaacttatccattatgaaacatacttgaacaaatacacactgcagtaattaaaatcagcatgcaaaatgctttatgtaagtctagagagacagagtcaaacctcaccactctgaaaatttgtttgggttctattttcccagtgagtcagattttcctttttaagcatcaagagatagtagccaacattttggatggaaatcctctaaatatttaccacactttctcataccttgtctgtatctaatttaatataatgctttattgatgacatctcattataaacatatattacattatgtaatgttacagagtggccctcaataatcgttgagatatgagagattattgaatcctacactgaattttccccttattatatgaagtttcaccttctagtcttacccttatctgccacttttttctacgctttgtgcttctttccatggtactctctctccttttcctgtttggctacaagttgagaaaactactttcttaaaattgtgtctaaaataaacactcacagtccttaatgaggatctaaagagttcttctgtaggcaaaatacaagtgttttccatgaatgtgtaagtcataagtggtgaaaatttaaattgttttaccatgaattaagacaggccaagtagtttgtttacctgggaaatattcatggaatattttggaaacaaccatgttggaaagggcatttgagtaatattaaagaggaagggttgtcatctttcaggcagatatcaaccaacaaagtcttcatttttctccctcctatatcaacaaaaatctataatacacttgtaaatgaggcagcaagatacttacctcatgtgattttgtttaataacatttgataaatgaaatatctgggattataaaaggaaaattgaaatgtgtatagacaaactataaaacctattcaaaggggcataaagtctgggaacgtcctacaggagtgtgattaacctgatacctatgtagaagggaccaggtctgttggtaccagtgtggcacatggaaatacatcattcaatttggtcaacagatttggcacattcaaagattaaaatgaagctgaacaggatgagacctcaggatcaggtgtggccttggtgaggaagaattaattgctaatactatatataatcataattttttcatatatgaaaacttagtaaactgtatatacttttacatatggtttcaagttatctctaagcatccatttggttgtccatataggatcctcagtgtatgagttggtgtatccctaactaatacaacagatgagccagaaatgtagaattgcttaactgaaacaaacattcagacctggaactctacattcctgtaagcactgggggttcttggttaggcagctctcccctatgcagtgattcagggaccctggtaccttgcattctgtggctatgcttcctcctgaggcctcatcctttctgtccaaagagagaacatagacaagacacacagctacttaccagtcttgtcccataaatagcacacatctcatccccttacattccaatgattagaacataaacatgtggttactccaaatgcaaggcaggctgggaaatggagtccaattgtgtacaagttagaaaagaggaatttggcactcttgggtgtgttacatattaaattactacaggacctgtctctcagagggaactaccaaaccaacaagtttggtagcaactgcaccattgtatggatggaataactatattaatgaataccttaatgtgtatgcaatgtctgactacacttttttttctataagtcaaaccctcagcatgaactctaagacaatgcccttagtttttttaccatcatctttgccctttcctggtgactgtattttggctaaatactaaataagtgaacatgacaagaggcaaatatgaatgagatgttcctgaagtgttatatctaatacccaaacaccaagaatatatatttgagttgaaacttaatatttgcattccttttcactatttacttgttaaatcttagattattaaaggagagctgttcaatgtctctacactaataatgttttgaagataataaacaaagcccatttgtttattacacttcaggaacatctcatcagtatttgcctcttgtcatattcacccatttagaatttagccaaaaaatattcagctttgtcaatttatcattttcttaaaggtgacaaaagcactaataaagaaggcaacagtcaatatgtgataaactttagctatgtgtataaaaattgtctccacaagtcactatgattacttgatagatggtcaagatacacatattgccaccattgtctctttaaaatatcttcatagagtttatgatgtaggatatttttaagcgtgaaactttcattatgaaatttgcttaatgctaatatagcaccatttctgggttgcaaagagtttaatatttcagtgaatgtgtggattaaatatgtatacaaaatttgtatataacacatctttccatatgtgtatatatgtgtataatacatctgtccatatgtatgtataatacatacatggacggatgtatctatatacatccgtctagatatatatgtatatacatatatatggagacaacatatatatggggacaacatatatatggagacacatatatatggagacagatgatagagacatagagatagaatcaatgctctttaaggattttaaacaatgaatatgatcccactaggttaatctaatcaagcaacaaccaaggtaattttataaaaaaagttaagaacttctctgtttctaaaataggacagtgttttgttttagactttgatatttgctataagcatgtccttgaatgagtttttaatttcgttaacctcaatttgttcacctgccaaatagacgtaacctcttttacataggcatgttgaaatgatcacgtaagatatgaatatcagatgtctatagattgcattcttggtgttccatatccatcaatttcttcctctttccttctgtgtgattctacatttaaaatatcaccccctccacaatcagtaccaccattcttgtccctataagactgttaaagaggacttttaattcaactgacagattttactttctccccaagttaattttttgtttaaactttcacataaaaaactatagcaaggtataaataatacttcttgctctgactaaaaataattctgacactttatatcctttttgaaaatttcagtccaatgtggtgtgaaattctgggctgaaaaatctgcatttctggtgaaaatacttatttaacttagtggcacagatatatggaaggtgcagaagtaattctattttatgaattttatgacaaaagttgtctaaaagcagaaggagatcaagcattctccagtttgtagatgactctaaattctcccaggtagtgaactatccacccccgcccattagaaagctaaactaatatattttatatgcatatctattcccttcatgtgaattcaggaggaatagtcctgcctcacaaaatgatccctttatcaaagagaaaagactcaattgaataaatcatgagcttgaccagaagtaaactcttgtaatctaaccctgattggtgaggataaacaaaagggcttatatctttgaagataaatataataattctgctcctctgtaaataagtataaaattacaaggtatatatgcacattcacaggctactagaatcactttctaatccctggcttgtccatttaactttttaaagcagattgggctgaaagtatgaattaaagacttaaatgtaagacctaaacccataaaaaccctagaagaaaacctaggcaataccattcaggatgtaggcatgggcaaagacttcatgactaaaacaccaaaaacaatggcaacaaaagccaaaattgacaaatgggatctaattaaactaaagagcttcagtagggcaaaggaaattatcatccaagtgaacaggcaacctagagaatgggagaaaaattttgctatgtatccatctgacaaaggattaatatccagaatctacaaggaacttaaatttacaagaaaaaaccaaccccatcaaaaagtgggcgaaggatatgaatggacacttctcaaaataagacatttatgtggccaaaaaatatatgaaactggccagccatatgtagaaagctgaaactggatcccttccttacaccttatataaaaattaattcaagatggattaaagacttaaatgttagacctaaaaccataaaaactctagaagaaaagctaggcaatacattcaggacataggcatgggcaaggacttcatgtctaaaacactaaaagcaatggcaacaaaagccaaaattgacaaatgagatctaattaaagagcttctgcacagcaaaagaaactaccatcagagtgaacaggaaacctacagaatgggagaaaatgtttgcaatctactcatctgacaaagggctaatatccagaatctacaaagaactcaaacaaatttacaagaaaaaaccccatcaaaaagtgggcaaaggatatgaacagacacttctcaaaagaagacatttatgcagccaacagacacatgaaaaaatgctcatcatcactggccatcagagaaatgcaaatcaacaccataatgagataccaactcacaccagttagaatggtgatcattaaaaagtcaggaaacaacaggtgctggagaggatgtggagaactagaaacacttttacactgttggtgggactgtaaactagttcaaccattgtgcaagacagtgtggcgattcctcaaggatctacaactagaaatagcatttgacccagccatctcattactggatatatacttaaaggattataaatcatgctgctataaagacacatgcacacgtatgtttattgtggcattattcacaatagaaaagacttggaaccaacccaaatgtccatcaatgatagactggattaagaaaatgtggcacatatacaccatggaatactatgcagccataaaaaaggatgagttcatgtcctctgtagggacatggatgaagctggaaaccatcattctcagcaaactattgcaaggacaaaaaaccaaacaccgcatattctcacacataggtgggaattgaacaatgagaacacagggacacaggaaggggaacatcacacaccagggcctgttgtggggtgggggaagaggggagggatagcattaggagatatacctaatgtaaatgatgagttaatgggtgcagcacaccaacatgccacatgtatacatatggaacaaacctgcatgttgtgcacatgtaccctacaacttaaagtatataataaaaaagtgaacttagagttttgcattcatctttagccatttgattgtaaatatatttattcacaagtgattaaaatgaatatcacttatttaaaaataaaaatacattaaatatatttaaaaagctcatcactggtcattagagaaatgcaaatgaaaaccacaatgagacaccatctcatgccagttagaatggtgatcattaaaaagtcaggaaatgacagatgctggagagggtatggagaaataggaatgcttttatactgttggtgggagtgtaaattagttcaaccattgtgggagacagtgtggcaattcctcaaggatttagaaccagaaataccattggacctagcaatcccattactaggtatatacccaaaggattataaatcattctactataaagacacatgcacacatatgtctattgtggcactgctcacgatagcaaagacttggaacccaacccaaatgccatcaatgatagactgcataaagaaaatgtggcatatatacaccattggaatactatgcagccttaggaaaggatgagttcatgtccttttcagggacatggatgaagctggaaaccatcattctcagcaaactaacacaggaagagaaaacaaaacactgcaagttctaataagtgggagttgaacaatgagaacacatggacacggggaggggaacatcacacactggggcctgtcagggggtcgggggctgggggagggatagcattaggagaaatacctaatgtagatgacgagttgatgggtgcagcaaaccaccatggcacgtgtgtagctatgtaacaaacctgcacgttctgcacatgtatcccagaacctataataataaaaaaagtatgaccggtcttaaagcaatactcatctagttttatgggtgcttcatcagacttgtaatataagttttgtttgaaccaaataaaattactaattttgtagtttaaaatggtcaaatattggctctctaaacctttacaaaacatagcacttccaaaataaaaattaaatataatagtggtaaaattataaaacccaaataatatagatatatcaaacttgagatacaatcaatcttcttattgcagcgtttaactgtcaatgaactctttggaaaaaataaatctctaaagtgaagcaagtagcatgtcggtgctttaggaaaactggttcttctatacaaatggaattttagcaactgttgtaaacaaattaagggtaatttaaaatatataaataaaatttagtgccaagagcatgccaatcaaataaaactagttaatactatattctttaagatattcgccaaataagtgcactgtgtatcttacaaacaaatcactttactataaaaatagtttgtgagaggtacttacgttgaatttttaacaaaggttgttttttaattttggaaaaaatatttttcaaacacctgttttcccactactttattaaaatcttttggaacaatctcagtaatattactgggcaaattgtgaatttcttatataaggatatggcacatctcttcaaatgaaaatactgcgtgacagaaaaatgccttaatatatttaccaaaaatgtgagaaagacatagaaagtcgttctgagacttatggacagagatcaaagaaaacagtggttactacagtgttcggatttgtagagatagggggagacgactgcctgcttagaggagagtaaacactgtagtgtgttcaaatcataagacttggaattggctaaatctgtgtttgaacattggctctgtcatttactagctaatgacaggcacatgtaacccacacatatcgattatatcttctgataaatagggctaataatcatatataataatagacctcaggtgcttatggagatcaaaatagatgatatatgcaaattgccttgcacagtgcctggcaaacaaacaaaaatattaatccttcttagaattacttaggagaggatctataaaacaagtataactagtctgaagaccattagggttgtccttggataagacagacctaagtcctctgaatccagacctccatttaattcacccacctcttcagtagcggaaggattttgttttcctcagtgggagcagcccttggatagtctttttcctctcactttttccatccctttcccccaaatcccaccaactttctgaccccttagaattagttttctattgctacatcacaaatcacaaacttgacagcttaaaacaacacacatttataattttacagtgtccatgggtcaggattctggacacagccttgctgggttctctgctcagggtctcacgaagttgctatgaagtcgtcagtggggctgtgatctcctctgaggctcagggtcctcgtccaaactcactggtgttgggagaattaagttacctgtggttgtagactgaggtcccaagtcccatacactttatgacatagctgattgttttcttcaaggccagcaggagaatattgcttctattttgagccctttttctggggaagggcttgatcatcttttaaagagtgctcttgatgagctcagccctcccagaagaagcagccttctgattaactcaaagtcaatggctttgggaccatggttacatcttcaaaatcccctcaccaaaccacaggagtgatatccctcatattcacaggtcctgtctgtagtgaaaagagaggattatattgggcatttatgccaaggggttataattttggataccatattagaattttgctttccacacctccaaactatttcaactaaataaagggcatttcatttggcaatatggataagttttaaatgctaaggctcaataaaggtagtaacatgatatcaacatgcaactgaggtatcatcagttaatacattctgatcattctgatcaaaaccttctgtcccatattacaaattgaataatgagggaaagaggttgatctggaggtaactggttaatattttcagtgtgaaaagagagagaaaagagaaactttgcccctcattcaaacgaaaaaaaatttcaaatacctactgtttggagtcttatccagtttaccttccaatgacttaggactgagagagctgaacattagggggtctcaatcaagcagctggtaaaataaattacataatttgaaatattttcttttttctacgatataattcttatgactccatctccaaaagaaaaaaagttccatttaaatgaggcatcactgcatttattcatggattcttatatttgttgaaaagccttagttttagtctttcatgaacaagaaactagatacagcacacagttttatacctttcttgatgaaaagaatataattcacaacctctttcctcaaacatttaagcaaaatttaagaagagataatatgcaaacttttaactgtgagcaattttttgaaaaatccttcagatggtaagctatgctgttaggtctttggtatagctgtgaggtagaggagaatggagagagaaacagaatgggaatgaaattaatcattacttaattgattcaataaaaatagaataccataaatagacttaaatcatatctaagtaaatttctgtcttagagtttcatctcatactctattaaacattttcaacttttcttatgcattaagagaaccataaggggaaataagcaagcactttgtagccagaaagaaccaccatgggattcttgaggtcgcactagctcactggataatattaggcaagtgactgaccctgtccaagattctattctttaaaatcaagggtaattgtacccagtttgcaggattgagttgataagaaacacacacacacacacacacacacacacactacacaatacactacacagtgcctagcacatgaaagagctatggtaactattgtaattatgagtctttatattgccaatggcatgtatagattgttttaagcaagaatatgatagaacaagcatccctggtaacctgtcatgaaatgctggggaatgtgataactgtaaaatcattgagtaagtcaacggagaagtgcacgttagttatttggtttaaagaccattataatgttattattacatgacacaagtaagactacctgggaaaacagaagctgattctacttaaatactttatttacactttcccatagcctaagaaaagatagtaaatcaggaaaaaagggcaaacagatatattaaacataagggctagtatttgtgctgctaatgaaatttgtatttggtattgaccttcctggcagccaaaaaaaaaaaaaaaaaaaaaggaagaaaataatatattttaagaaaagaaaagtttttatggagtttattctgataatattatctcatattgttctttgtgtgttagtgcattgctaaaggtattttcatttttgtagtctatcaaggactgttaatagaaaaattagagcgtaataaaagatgacacactgaaggagatttgttcagctaatgaggcctattcttgtggaatcaaccttttcccttcatgctatacctctatttttaaaatttagcaacaaagagcctagtcaaagcaatttggaactttggccaatacatcagaaaatacacacataataaaaatcaacattatacagataccatttgcagctgttggctctgctgagagcagaggttcccatgtacaaaagatttgcctaaaatctcagagtcaagaaaattcagttcaaatccatctacaccaaagtgagtgtaggctgatcactacacttacttggatagttatttaacaacctttaaatgaagaaatggtactatactgatgtcaatgcccacaacagggcctagtacatcggatacactccacaaatatgttttaagaatgaatactattcctctgtgatggtggaaccagtttggtggctaaggagggttagttgatacaaatacttgatatttatcaattagaaaaggggaggtggtaacaataaaatccctaggtatgtatcagggtttctcaacctaggcacgcttaatattttgtatcagataactctttgttgtgggggctgtcctgtgcattgtagaatattcagcagcatcactggcttctgccaactagatgttagtggaatctcaagttgtaacaaccaaaaatatctccaaacatttagaccccatttgagaaacacagacatatatgaacttgtgtgtgtgtgtgtgtgtgtgtgtgtgtatacacacatgatgatgatagataatagctttgttgcatattatttgcttttattgtactttgaatatgcgagatcaattattttcaattattaattttatgttctttcaaggcataatagataattaacacaattagcccaatggtcacttattttgaaaatagcatgaatatggtctaaaagaattgagcgttttccaaaatcacagctaatgtacttcattgcattgcttatggttcttgataaaatcacgcaaacataagcagtctgatgttatttttttgtttacagtattactgtgttgttttggttaacagaatgaaaaacagcactgtaatactacaagtaaaaatgttttattcttagtttgtttcatcaataaaagctgacatttttgcaagaaagatgttatactattgaaattaacttttagtcaattgtaaatgattgtattatatcggtatgttatcatgaagattagaaatcatttcctacagaatcatgtttttgcttcctcagcactgtttcaattgaaaggaatttgaatgaagtgcatctcattactaacataaagtagatggagcttgaataatttttatatttattttccatggatcgctattacatttcttatctatccaaattttataaaataaattgttttaatccattctttggagaggagcaatgaatttatttttgcaaaagctatgcatctgagtatattgtaatatgcataaagctctgttaacacagttatttatataaaaagtgtagctgccttaccttttatttaatttacatactttatttactttctgacaggttcttctctttgcatttttatttgcaaaccaaaaatgtcttttcagataagtcaactaaaactttgatgtactgtataatctaaaactctataaaatgttttatgtattgtataggtttatatgaatttttagactgaggatatagaattttggaactatttcattaatgattcctatatggtaacaccatacttcttaaatatgatgatagagaattgtcttttgtctgagatcatgtttaggaaaacctacagaacttaagcccagtctgtttcaaatagaaaaacatatctctggctatttttaagggttgttattttttctcaaaatatgaacttcacataatatgaacatcttaatccttagagaatttggtacatttactgtaaccttatacaaaagattcatatttttctactcaaatgttggaaacaataaaagttgcccttgtatgtttcataaactgtaacaggaatcacccaccagtaaagtaataagcacacggtgtatcaattcaaagacgtccagttttagaaatataaacttaatcctcttcccctcccttttttttttttgtatttagcttttgtaagcatggtttgtatttgcataacccaccattcatattcttgtgagttcatgatataaataatttgaaaaatttcattcagttccccaaattattctagtcattatggatgattcatgagaggattaatctcttggatgtgacataaaactagagaggaaagacactacctatcatatcatttgcagttaagaacatgctgcatatctttaagctttacttaaagtgcttatagtaattgggtgtgcatgccttagctccgttaaaacccaaacagcaatatgggagagtgtggtttgttttttaaatgtgcaaggaaggaaaattagtgaaatctgtttaagtcacaaaactgcctcattcaggacccaattcagcagcatggaaaaagtaactcaagttaactgtactcttagcatatgtctaagctcacaaatttcaattcacttcaaatttctttcttctcccatggatctgcctgcaaagaaaagagatacaaagatggcaaaccggttcaacagttcattagccctagattctcttagggttttcagaataaaaacgtgtccatttgcagaccaaattcctttatgtgttggaatggcaatgcgcctcaagaactgtttacgttgcattgtgggccttccttttttttccctcttcaccctctactcctgccactgccatacatgattacacacatgcatatggagttaagggtataatgtattttgattttatccatgcaagtaaaatttggtggaggaaacaaaactaagctaatgaacaaaagatttcagaattatacagagattgtggtttagtgacctaaattgcaccataatcctttaaaggattacagtatttggataggaaaaaagatttatctttctataatggcatctctgtataagaggatattattggatatgagctgcatggtagcagcagatatttttctccacgtctttcggcaattcagaatagttctctgatccatctgagaagtagcactgaagaattagtcctcatttataatcaaacattcttgaataacattttcttccaatttttgttttaaaggtctaacatttgatcgtatgttttctttagttaactttctatattatatggcaatctctgcagttatttttttcaaagataaaaagaaaaaaaaagcatgttcaaaaatgtagaagttatttttgcagtaacgtatgtcatgatttttaaacattcaggcctttaaactttttttatagtgtatgttcttgccaatcccagcacagttctacaaagtaaaatatttggcagtgaattcatattaacagatggaacaagaaattaacacgtttttgcttcgctaattcacagttcttttaatacgctaattctaaatcacctgttctgactttgacaggctacagacacctgtttggggtaatattccacagctaattattacatgagaaattcagtttccaacaaaagagtttctgtgtgaaattgccattgtagttaacaaattaatatcaactatatacaaatacatttctgatgtcttaatttaaatacagctaatatactactcatctataactaaagaatggtatataaaaactaagactgccctcttagtgtttgaattctgtctgtcacactttacaccatggttgcactgatcaagtcagaatgttcttcccagtagcagtaatttactgtaatactgtattttaaatggcaggaaaagagtatagaattttcaagtggctggaaaaattcctaactgtatgttaaaaatgactcaggagagttaaaaaagaaaaatactgacaagatgagagagaaaaaaagaaaaacttagcttgggtagcataatatggaagacagaacaataaataaacaggaagtccactgcactaccgagtttttgaagtatgacggacttacatgaagtcccatgaagactgttgatttgtttgctaagagaaaagcaagtaaacgatgccagatattttatggatagaaaattaaatacccgcttcttataactcaacagagttataacttaatagagaaactacttctattttccactaaaacctgattttctttatcttctatattgttcttagttattctgacatggtcatttcccctgtgtcacctcagacaacttcctttaacactaactcctttccctgcctccaatttcccccataaaaaccatgctacgggaaagtgtggaggcaaggagtgtgtgtatgggagggtaggttggtggaacaagaagcaaaaatcagaaacgtaaggtttttagatgtttgtaacataacgacagatgctgaggtagagtctatctttaggtttgccaaaggttccattttgtgtgtctgttttttgattctctctaattgctgttcagctttgtatgtggctttgctaatgtgtcttctgtagccacattgtcgtttctttaattaaccttgatatcctagtacccagatagcagagttcatcaagcaggcacttggaacttttaacattcatgctgttgtactttgatttttaagagttattgtacaaagtatatttttaaaatgcatttttattctgcgagacttaaggtggatgaggagagggctttttttttttcttgttttgttttttgtttttacatttagcctccagcctccttgtaattttattgtttttctcccaaatgctactctagaaagcacatggtctttctctcaaaccatgctttatgacattgctatttgcagaaatttaactggcagcccaccccaggaagataaaatcctgtttcatccaagtttggttccctcctacacccacacctgaaactatatttctgccagagcctacattctgctaaggaagaaaccaatcttttataatacttcaacatacgtgaattttattttatttttaattaaaaaattacatttctcatccaaaaatgctagatgacatttaaagctagaaaagtgtttccaaataactcacctttacaattaactcttatcaggaccagatagttatttcactgtaccagggcaagcacatggctgggatgaggctgggcagtgaaaggcctccatgatgattgtcactcgatctcttggcaacgtgcagaagcacattatcccacaggatttgctcagggctcaaagtttgtaagagagttactggtacataattggaatgagaccagttttattttcagttaataagatgctcaaagataaatgaaacttcctggttttcaagggagaaaaaaaaagactcttaggaagcttatacatctcttaagtttttcctgaaaacatttttagacatacatttgctacctctaaaacaacttgaatgaattagatctagatgataatggaaaatatttaaggtttaatactgaaaggataatgaccttgcaaaagtgtgtttggcaattatattcaatgtgaaattcttaagaaaattgctcaagataatgaatgacatcacaacgcaatttcactcatctgtcctcagttaaaacactttgacaaatcaattcattaataagtaaatctaatatccctgtactgtcctaccttaaatatactcattatatataatgcaagacaaaattatgtaattttgctatggactaatatatatgtacgtatctttatttttatgtatgtatgtgggtatccacacatacatacatatgaatacattttagggagcctatttaatccttcaaggaggtttgcagattacaatgagttcttgcagcaacaattatatttcacttaatacttttctaagcaagtagaattttaacatatcagcctttcataaaacagatttatgtaactagcagatgctattaattgataatcaccatttatagccttatacatattttaaaatagttccctatacatataacattacggtactatatttagggttttatttatagaatatattttagaaggaattaggtagctttcatttaaaaaatttaattttcttaatttatcctaggccaattctattaatttgtcatcttagaatcatgatattattataataacaatagcttactttgatatacatgtggctcccaagcacagctaaacataagaattgctgggataatttttgaaaaatacagataccagaatactaactgtattgccaaggagtgggacacagctgtctgtattttataaaaactccccaggtgctcctgtgcaggatgggagaaaatgctatcattgcatagtttctactagccagaaataacagttacagaataatactaataactattacaggaacaataccaccaataaggacaccactaaaatctactctctccaacattttttaacctaaaaaatgacaagtcgtgttatatattcctgaatcaccttaatcctttaagaaataaatatatattaaatatttatttaggcctggagcagtggctcgggcctgtaatcccagcactttgggaggcagaggcgggtggatcacctgaagtcaggagttcaagatcagcctggccaacacggtgaaactgcgtctgtactaaaaatacaaaaaattagctgggcgtggtggtgcgtgcctgtattcccagctgctcagagggctgaggcaggagaattgcttgaacctgggaggtggaggttccagctagccaagatggcaccattgcactccatcctgggagacaagagcgaaactctgtctcaaaaataaaaataaaaataaataaatatttatttgtaaggatcaaatattttttaattcaaattgttccagacggggcattatttaagaaaatcagactttcctcctagtttaggtaggaaatcaccaaccaaccaatcaatcatcatcaaaccttcctgcaaaaatgccattctcaaacaagcagtattgacaactgctgagatttgttagaaatgcagaatttcaggccaccctggacctactgaatcaaaatctgtattctgccaagattttcaggcagtttgaatgcacaataaaatttgagaagaactccccagcacttgtgtgtgcccacatccaagctaggtgctagagtacccagaagcaatataggtgtgcagagatttatctttgcctggcagaatctcgctatttgtaatatatacatatatattaaaatatatataacatatattaaaatatatgttatatattttaaaacatatattaaaatatatatgttatatatattttaatatatataacattatagactttggaggctttcatttgaatttgcatttgagtcaaagtcctaattctggctactgtctctgatccatcatgagattctctgatcaattctgtctccaaatatgtaatctcactataagtatcaaacaatctaatgcctcaaccttcaaaatgtagctagaatctcaccattatttccagcctagattacaataaatcacttcctaactcagtccctgcttctatattcactcctcttatagtatattttccaaaagtagtcaagctcagtgacttcaaaagactttaggcttattgttcccattcaaaattgaacttacgtagttatagtttatgtactttaggtgtctgctcaaatggtagtgcctcaaataaacttttcctgattattgcatttaaactaaacttcctgtctatccctctctctctctctccaactttaccctgcattttcctttagggtcctgtggtcctcatcactctttgtaagcaattgtgtcatattattaaatagttgactgcctgtcttcacttggaaatataagatccagaaaatagacactttgtctttcttgtcccccagtgcctataagagtaccagataaaaacaggaagcaaataaataatttatgagtgaatgtttaatcaaattagtgagctaggatattcagtgcatgtgtggttattcattgagtgtgaagtgtattcattgaacacctaatatatgtcactatggcagactaaaaaatggcacataaaatatatgcttttgagaaataaatacatgaataaacaataggcatatattgcacaaaataaattctttgggagttgaaggatgatttcagtggcatgaagtagaagaaagaagacttgttttgagaagtaggtgatatagtgatgacattatcacaagggcaaatagcaagctttagggctgaaatatctagagtattatgcgtgaaacagcatacctgtggaattgacagttcattagaaagacatctagtgactagcttttggtggctttacctccaaaactgaggaatttgtactgtattctgtagataatattttcgagaagatagttatgtgttcataaccgtggtttggggggattcatgtaaaggcaacatacaggatggactggattaagaggctgcaaagacagataactggttaggagattgctcatccgaagcggaaagaatagcctgggtgaaagtgtagtattaggaatttaaagtattaagtgaattaataacattaagtttcagaaaagcagatagcatattacttgcatagggtttttgttttgttttgttttttgctatcaacaccttcatcactattatggcacataaaactacccataaaattttatccttttttttttctttgatagagtctctgttacccaggctgaagtgcagcggtgtgatctcagctcaatgcaacctccgcctcccgggttcaagcaattctcttgccccagcctctcgagtagctgggactacaggcacgtggcaccacacctggctaatatttttgtattttttttttttagtagagacagggtttcaccatgttagccaggatggtctcgatctcctgaccttgtgatctgcccacctcgatctcccaaagagctgggtttataggtgtgagccaccatgcccgtcccataaaactttcacacagtcagaacgataagggtactaatataagctgtgtagataacaatccttccagtgattatggatattatcatttcctgttgatttaaggctcaaatgatttagcatagcagtcttggcaattatgaatctaaaaacgggagtttattatcttagaaaaagccatcacttcacttccagattaagggccttttttttttttttttttttttttttcgaacagtcaatacaagagacaagaatcttttcctatattcaaaagcaactttcgtttattgggtggtaaactgcttacaggcacaagtcttttaatcttcattgcttcctatttctgagcaacagttttcttaacccaacatgagaatattaaaatcgacctggtaggatcatgatgagggttaaatgacataatctaagttaagtctcagtctctatgcctgagtagaaagtcaataaatacatgttgccttctctttcccccagcacctagaaaagtatcttgacaacattaatgctcaataactgcttgccaaataaatgaatgttgttgagtttgcactaactaaataatgactttttaaaccattgaccaataagcattcaaatgatcaggttccgaaaactcccgcgcaaatatcttatagcaatgaacctcaactgcagtcctgaaattttttcttaatctcttctagcccacaaatttctcttcctatagatttgtgtagttacctacttttccccttaatattcattttagccatctgtctcctatctcctagaccacaatttgttgattacttgccaggatatatattttcaatgctcttagattgatagctccatttctttttctatcccttccactcccctcttgtgcatggcaaaagattttctttattggttcccgccttttttttttttttaatatggtgtctcactctgttgcccaggctggagtgcaatggtgcaatctcagttcactgcagcctcagcctcgcaggttcatgcaattctcccacctcagcctcccgagtagctgggattacaggcgcgcatcaccatgcctggctaattgtatttttgatagagatgaggtttcaccatgttagccaggctggtctcgaactcctgacctcaggtgattcacccgcttcggcctgccaaagtgctgggattacaggcatgagccaccgcacctggccaggtcccacttttatttaatgctgttaatttctattttaaataacataatatgttcccatattctgtgctccccaacccctgtattctctcttctatttattcttctttcctacttattttatgaaactcttttctgatctgcactataaaaatattttcatctctttgcccattttgtctgttgcccaaagtattatcttcctaattggattagaaaactcatctttatagggccttttatgtgttctgtgcacttatggttttctgtaaacaaaaataataaataacaggtggagagctaaatatataactcactaggaatggagcatttcaaagaagaggaaaaggctatgtcagaaacattctacatagagtacaccaagatcggtaaaaatgtaaatggtcttcaactgttacatttaatagactaagtcatgctgtttattaatcataaaaagtaaacatttctacttatctacattttttcagaaaggtattgtaataaatattattgtaagtgtgtgtgtctgtgttgtaccaccaaacatgaaacgtctcctctgtcctcatctctacccagttcttggtaggtagagagacagatggactcaatgaaagataattaaaactatggggaacttgctaatataaactacatgacctgattaggattctttagctgcatcaattctgtcttcccatattttaagtcctaccagacaaaggaggggccaggacagtggtgggctggagctggctgcagagctgattgtgcacatctcttctgaactccacattccatgacataatgtcagccctaaaatggccgcaatgggaatattcacagtagggaaattgataaatgccacaaatcaggacttccccaccccccccccccccagagatcctatgataaacatttatttgcacagcattcacccagggcccagaaatttggggcaaacatatgctgcaagtcacttgactataattgagagaaagcagtaagaagaccctagaatctaactgggctaagcaaagcgggacgctacaatctaactgggctaagcaaagggggaattcagggatgaatcaacaagatgctgctccgggagaaaagatcatagcaaagagttaaaaatgagactagacagggaagcttgggaaaattctcccagcaaaaatagggtaactgcatgttctttgtattggatagttgcgtcccctggtgggttagagagggaggttaatggattgggtttttaaagccctaaagtgaacaggatgaggttttaaataaaaagtgactttttaagattcatattgctgcagagctttgcgtgctctgcagcaatgtgactctatcaggtaacaacagatgtacctggtgagactagatttctgtacttaggtacagctgttcctagctgtaacaccaccttgcagccagcaccaggcttttgcccggggcctaacagcctccacttcctatggggggattcacagccacggcccttggatagtcatgggtacccctggatgcctggatgcctaccctggctctcagggcccactaccattttcctggtatcctgagcattttcacaggggaagagcacagtttcagaatgaagatcgtgtgaatgtggaaaagaggaaaaaggcctcagagaactagaacaagcacactcaagtgtatacaaaacatataaacacatggtaactgccccagtccaatgttaggtcatggaaagtataggaccttttatattgcaagtgacaaaagctcaactcaaacttgtggaagcataaaagggaataaactgacttaagtccctttgctctcctcttgtccactggttttatttataaacagttttgctctcatagtcggttcacacaaatgtgctcctccttagcactcaggcaatcagctaataggagagagtgcttacttctggtaacttccgggggaaagtcctaagagggctgttcactggccttgccgtggtcacctgcccttccctgaaccaataactatgagcagagaaataaaattttcttctggactgagatcctctgccagacatggagaagggcctgggccccataatctgagagtacttcctccaaggaaggagtgcaagttagctagagagagacatctattacaattctttagttttgtttttgagacaaggtcttgctctgtcacccactttggagtgtaatggcactgtcacagctctctgcaccctcaatcttctgggctcaagccacctcccacctcagcctcagaagtagctgggaccaccgggtacacaccctgctacatttttgtggagacaggtctctatgttgcccatgctggtcttgaagccttggcctcaagcaatcctcctgccttggccacaattatcttcctaatggagtcgtaggggacttgctgataacctccgtaagtagatacaagctctaataataatcactctatctagatgattacttcttttcttgctaattttcatctttcctggattctatgccttttaaaatttctctctcctgcacatacccagtgttctttatttctactgtttttggaacagttccaatgaggccgctcaaccactccctgccacgcccaactgcagatctgtatcagagttgagcactctcagtggctggactcctaagcagtttgtttctgtcaggctgactgatggcacttaggagatactatgttgatttgccaagaaaatccgtgatctaagtagaaggggctgctttcttagcataaataagctaatacatttactatttaaggtgttacttttattcataattaaaaagtttaatcagagagtgggctaccttctcggtaactctctagagcccaccgtaagtagcttgtgaaatgaatggcacagaaataatagaacaatgatagttaatctaaaatgccatgatggatttcctactaaatgtagaaatacaataatgtaataacaacaaaagggatattcttaataatagcaagtaaccacaaaattaaacattttcctttagttagaattttgaggcttaaataagttttgaagttttccattttaaactgttgcctgatgggaaaaaccaaaagtcagcattaccgtggatagaatgacctcaggatctagcctaattattgctgttactgaattgtttgtttacttcccgtctgagttgcatgatgcttcgatgtggtactggattagagaaggaggaggaattcatgagtgaaatgtttgtcctgataactgggagaatggctaaggtgaaggtttaatgttgtaagtaagcaacactattccatttgcaatgatatgaacttaattccttatcttttaatgtttgtacttttaattatcaaccaactggttgtctgtcttagactaatgaaaattaggtgactttggaaataaagtttggtgctgaatagttaaaagcttgtatccatctgtccctcccttgaccaaagcttccagtttgcctaggactctcttgggttgatgtatgtttttcagtgtactttttactttgtgcctccttgcataaattgtttttatttagaaaatgtagataagctacgtttatgttatgtgtgagagtgtttcacagattgagaaggaacacgtacaggtttgttacatgggtatattatgtaatgctgagatttgggcttctagtgaacccatcacacaaatagtgaacatgctttttgttttgaaacagtggattgctcaccaaaatcagtggaaatgggtaatgaatgaggtcataaaagtagctttcttcaggaatctttaggatctgatgaagctggatatgtgcattgcccaaagatggcttaagaagtctatgaatgtgggaattgacttggacttgatgatcacctttacttagcacacaaaactataaacacttcggacagggatgaaacgtctgaaagtgtgaggaaatttacttcaacattgaaaaatcagtcttacctcaaaaatgattcagtggcccattctgttttattatattttctaattaaaaagaaatctaggctgggtgtggtggttcacgcctgtaatcccagcactgtgggaggctgaggcgggtggatcatgaggtcaggagatccgagaccacggtgaaaccctgtctctactaaaaatacaaaaaaaatcagccgggcgttgtggcggacacctgtagtctcagctactcctactcgggaggctgaggccagagaatggtgtgaacccgggaagcggagcttgcagagtgagccgagatcgcaccactgcactccagcctgggtgacagagcaagactccgtctcaaaaaaaaaaaaaaaaaaaaaaaaaaaaacacctaaataggcagacaacgggccatgtatcagtgaatttcaaacattaggatttccttaaaatgctttataattagctttggaaaaactatctgaagagatgtaagcatgaagaagttgaggccatgtgctatcccatctcatggatctgggcttcaaatgtcaactctactacttactagttttagttcagtctatggtattttggtttaaaattgcattataaatgcacccacatacataggaacatacccacacacaaaactacaaggagaacaaagattcgtatgtaatcatttctttccttagttataacatccactaaggttaatattttttttacattttgtttttctaacattttcttcctgttccttagaattatagcatattctatgtggactggaaaaatagtcaatggttttcttttggtgtttgcgttcttaattcctgaggtgaattacatgctaaaaatgacttgtatgtctgtttggtgggctgccaccaacatagaaagtctgacatattttccgtggaagaaatacttattagtttgtaacctaatatttatttgcaccgtattttagtgaggaaatgaaggcagagtagaaatgaatttgttcaaatttaagcattcactagtactttcatttctgtacttgaacgtacagggttagctgggaaaaatctgtacattggttttcaagccataatcttacgttcagattttgtatgctggtccgttgtgtaaatatgaatttttaagcaatttagcatttcatcaaagtaacacggcacttgattttcattcatccatatgaaaacaattaggaaaaaatgccacttatcttaaatagtatttgtcagattttcttcatcaaacttggtaaatacagatctcttgacattttgatgaattttcatcactctgtggtaaacctaagtgactaggctgtggcccgtgaacagcttttgtttctatgcgacattaaaatgtattttttaaaaaacatgattataatgaatattcaaaattagattcattctctagcatgtgcacaataggtcacaagtcatggctggagaagaacacttactagtcaatctcaaggttttattatttcttatgaatcacaatttttttcagagatataactatcaaagaggaaagccagctaaacatacaccattttgagtttgcctagacaactctgaaaattcatttcatatgtagttaacttaaaagttactgtatttccctagctgtgtattgtcttgactcaaaatttcttggaccgtatgttcaagacagcttgaaacagacattataaatgaagaataatcagttaccatagttcagagcatttcttcaaatactcttcaatttctggttccagcaaaattttatttacttaaatataaatcctcttttttaatactctagagcctcctcctcaacaaaacacctcattttagtacaattgtttttatatcctgtcacaggatgatgatgataaatggaaaatgattaagtatattgtttgtcagatttcttctttcacaattcaataaatattcccagagtcctccctagtcaccttccttgcaatgattatcaaacggaaaatatttgaaattcaaggaggaaacctcgtttttattttggttgttctccttttccaaaaaaatacaaaacatgaattaaaacttttgggagcttacaaaccaagttaattacttagagacattaagtcctttatttggggaccttgagctgttgtatacttcagaaaaaatcactctaagcctctctttccatggaatgtacatttgtaatgaacagtgcttctatgttggttatactttcattatttaaatacttgatttccatctataatgcacttattcaatgaaagtttattacatctactatttattatatgccagaaataatcaccaggaagaatgatgacaagtaaaaaaggaaacaaaagtaaatcctttccctaaatattgcccacactgatcttcatggtccccgaaaattccacactattttgcactttgtggtggtaaattatagggtctcagttgaaaggctaattttattatttgctgtatttgtctatttctaaacttccttgtttcagattgatcctaaaattgcttacatgtttattatatcaaatacaataaggcaatagattagagatacttaaccaaacagaaaaacgtcactggggaacttatgctatgagtgacctacatttttatggtactttattattttcaaagcccttttctcatttaatatgttgttatatattctttccagtaatcctgtgagtaaacaacaacatttgatttactattatctgagcaacacttatgaagtagttgcttttactccttttgttctaagtgacaaaatggaagttcagagagttcaaataacttaccaaaagtcacactgctacttactgacagagctggaattcaaactcatgtctgcctggctctacacagcactattgagaaagaatgataaacggctttatcagctaaagtccttgttcattcactgagtcttttgtatcttttaggaaccagcctaaatctcttctttaatagtgacttctccaacaattaactcatttcaagtgaccaattttctgagttactgtacatgccactcattttgacatttaattacacactattttccaatattatttctgagtgtatgcattcctgacttttctaccctgtgatatttaaatgaaagcaacactccttcatgctacaaagtctcaataaactaggtattgatgggtcttatctcaaaataagagctatttatgacaagcccacagccaatatcatactgaatgggcaaaagctggaagcattccctttgaaaactggcacaagacaaggatgccctctctccaccactcctattcaacatagtgctggaagttctgggccagggtaatcaggcaagagaaagaaagaaaggaaattcaaataggaagaaaggaagtcagattgtctctgtttgcagatgacatgattgtatatttagaaaaccccatcatctcaaccaaaaatctccttaagctgataagcaacttgagcaaagtctcaggatacaaagtcagtgtgcaaagatcacaagcattctcatacaccaataatagagagctaaatcatgagtgaactcccattcacaattgctacaaagataataaaatacctagtaggaataccacttacaatggatatgaaggagctcttcaaggagaactataaaccactgtgaggacacaaacaaatggaaaaacattccatgctcatggataggaagaatcaatatcgtgaaaattgctgtacggcccaaagtaatttatggattcaatgctattcctatcaagctaccattgactttcatcacagaattagaaaaaactactttaaatttcatatggaaccaaaaaagagcctgtatagccaagacaatcctaagtaaaaagaataaagccggaggcatcacactacctgacttcaaactatactacaaggctacagttaacaaaacagcttggtactggtaccaaaacagatacatagaccaatggaacataacagaggaccccttccctacaccttatacaaaaattactcaagatggattaaagacttaacataagacctaaaaccataaaaaccctagaagaaaacctaggcaataccatgcaggacataggcatgggcaaagacttcatgactaaaacaccaaaagcaatggcaacaaaagccaaaattcacaaatgtgatctaattaaagagcttctgcatggcaaaagaaactatcgtcagagtgaagaggcaaactacagaatgggagacaagttttgcaatctatccatctgacaaagggctaatacccagaatctacaaagaacttaaacaaatttacaagacaaaaaaaaaaaatccaaaaagtgagcaaaggatgtgaacagacacttctcaaaagaagacatttatgtggccaaaaaacatatgaaaaactcataatcactggtcattagagaaatgcaaatcaaaaccacaatgagataccatctcacaccagttagaatagcagtcattaagtcaggaaacaacagatgctggagaggatgtggagaaaaaggaacacttttacactattggtgggagtgtaaactagttcaaccattgtggaagacagtgtgaagattcctcaaggatctagaaccagaaataccatttgacctagcaatcccattactgagtatatacccaattaattataaatcattctataaagacacatgcacatgtatgtttatcgcagcactgttcatgatagcaaagacttggaaccaacccaaatgtccattaatgatagactggataaagaaaatgtggcacatatacaccatggaatactatgccaccataaaaaaggagttcatgtcctctgcagggacatggatgaagctggaaaccatcattctcagcaaactaacacaggaagagaaaaaccaaacactgcatgttctcataagtgggacttgaacaatgagaacacatggacacagggaggggaacatcacacaccagagcctgtcagggggtaggggagtaggggagggatagcattaggagaaatacctaatgtatgtgacgagttgatgggtgcagcaaaccaccatggcacatgtgtagctatataacaaacctgcacattctgcacgtgtatcccagaacttaaagtataataaaaaaataggatgaataaaaactactacttcatagcacaaccagctgactatagtcaacaataatttattgtacattttaaaatcactaaaatagtataattggaatatttgtaacacaaagaaatgataaatgcttgaggtaaaggatactgtgtttaccctgatgtgattgttatgcattacatgcctgtatcaaaatatctcatgtatcccataaatatacacacctactgtggtacccacaaaaattaagttttttaaaaagtgacaaaatgaaagcaacttgtacatttatattctctaatgttctccttgatttctcaatgatacaaccttgccctcacaagtgttaaagcagtaactttactatgctcaagtaaggtgtggcaggtgaattctaacagtgcctccatgatctctgttccctggtcttatgtctgtgactaggttacattatacggcaaagatgatggatttggttacattttatggcaatggtgaatgaattttgaaaatgcagttaaggtcccaaagcagctgaatttactcaaaaaggagatgatcctgagtgggcctcatttcatcatgtaagttctttgaaagcgagtctagatgtgagagacaatcttctactggcctcaaatcagaaaacagccacattatgttctgagtatggagaggggtggcctctgggaggtgagggcctcagcctcaaaaccacaggaggtgaattctgccaagaagcatatgagcttgaaagaggaccccaaagcctcagaagatacagtaaccccatctgacaccttggttacaacctgtgagatctcaaagagaggacccagctcatctgtgcacagacttctaacccatggaaactgtgaaataagaaatactgtgttttgagctgttaaattggtggcaatttgttacacagccacagacaactagtacgtaaagttatatccaatgcactataaaacttgtcaatttatgtagaaattatatacacatacacatgtaatttatacatatttgcacatacacacccccctccgtagttcagcagtagcatcactaacttagagttttaattgcaaaactttcattgaagctgtggagccactctacaaaagttatgagagaacatatttttaagaaaattgcccccctgccctccaacccccatcactacaaaaaaaaaaaaaaattagccaagcatggtggcacacagctgtagtcccagctactcaggagcctgaagcaggagaatcgcttgagcccaggaggcagaggttgcagtgagcctagattgcaccactacactccagcagcctgggtgacagagcaaggctctgtctcaaaaaaaaaaaaaaaaaaaaaaaaaaaaaaaaaaaaaccaaaaacaaaaaactaaactaatgattaataatttcagggggaaaattggcattaacttcaatgtttagtgtttatttgtcaaaagcaagacagaagagtttaagtgaaaattggcctaagggatctgtaaaatataaataatatggtgtaatgttaatatttcaacattctgcctaaaaaattttgtagatataacttttaactatcctaacattttcccatcaaattttaatatacaaaacaaacttgcataatagaaacaaatttctcaagtggcactgtataagacaaatacataaaatacccatagtaatttgtgttaagtttataagatttcataagtagccatgtatgattcctaagtccctgtcactttacagatgaataaaatctatatttttcagtctcttgagaacattgtataaaggcaaagaaacctagtgaatcaggccttcagagttttgaagtagcacatacacaatattgctacatggtttatgcaatttcaacatattacccaaatggaattatgatttctaattcagtttgtccttaaggtttcatttctccatcagtgatatattggaaaactcctctaggcaataaatatacacaggatgagttgtaattttccatttctaaagtaatatgtttggtaactgtcaatgtccccagatcaatgtggatgtccatagggaaagtacttatttgcacattaaacataaataacctacattatatgcatgctctttagatttccttatgaaggatgttgaagtaaatattactgaaccattgtcgctttctctctaaagatcatttctttggtttgagttgtaagctgatggtcctcgttgggcccttcatttaatatggacctttgagttgatcataaatcatttatttcagcttcaaaaggacagaagtcatacctgcagcaagaggtggctaggaagatcagatgtgaatgaaggagtttcccaactatgagcccacacataaaccagagttgtcttttactttattataatacataacaaacatatatttttccccctgggaactacattttagcaatatatttttcattattttctattcttctggacattatacactgattgcctttaagatcccttttgtgaagctttccttgctccgatcgctcttcttcccatcccaactttttataaaaaaaagcatgccatctttaggtcaatagtgtaccatagacctatataactttatgctggtacttaactatacatatttgtttatttctgtctcctttactagactgtccacttttcagagcaggaacagtgtctggtacatgatttgttttgttaaaatccagcagagcacataatgagtaactatcattcaataaagtgattttgatgttatcctttgaaaagaaatctatgaatgcatgagtgaataatgaaaattttagcagtcagattttagcagcaaggattatatagacacatctgctttcatatatctctttccaaaagaaatattgttatgaaaacaacaaagtgctcttaagaggtacatgagaaaaaaattgaaacatgtagctactttagaaaggctaagattttcttctgaggtaaagagaaatggctggatattttagcagtagaggtagggttaatatcatttcttaagcctgacctcaggtttaacttgtgattctaatgttaatcattattacatcttataagacgtaagcttcacacctcataaatttagtcagcttgtttctactatccagagccatgttaaagaactgttttacaaagcatacatttctagagttctttctgtgccttttttcaaattgtttcttgtccttctagctaattttcatgtggtacctgccacaaaaccctagaaaataataatgcagatgtttgagtcataagtggtccatctctctttcggtcaacctattacgtaaataaaattgtacccttcctttcacctatttgtacaataattagatcatggtatcaattcaaacaaagaaattgatgtcctgggaactggttatacaaatacattatttcttctctttgaaatgagtagaaggaaagggaactaataataaaatatcacattattgcctacccactaaaggcagcctgaaattttacaaaacagtcttcctggggtcgtctcgatggtgagatataactgcctttcataatactagaagtacagacatcctcatatttttaaaaaatgcttaataagatcttcatctgttgtatttttcagttgagatcttttatgctttatattgtatctaataggcctattcacaaatgaagagtatatgagggaaaagatgaatatcacttcataacaagacattgaaataaactatcctaaattatgaaagcttcccaatgcatgtggcttttttcttcacggcttttctattcaaatatcaaagtgcttcaagtggctttgatgacatacttatgaattcatgaaagtgtttttcataatctgctcacctttggtgcttagaggttacgccgattgcttttatttgcttggctggaaaagaagagctctgagtgggatgcagatacataacacttcaaaacagttccttacattgtcttagctacttttcagaaacttgctggaactctctacccaaacttcaggcaatgataagaataagtgtcaaatattattagttctggagtataactactaatttttgtttcaactgcatagtacgtataaaaaccttggaatatttccagttatcttcactgtcatttagtccttaaaacccagaacagacatttaaaatgaaaaaaaaaaaaaaaagctaccattatattgaggctgcagatgcaagttggcatcgtcagaagatgaatgcttgtagccttcactggcaacctgaccagacatattctatataattaaataacgagcagtttaaaaaataaaattacaacatcttgggcaatcctttgtgaataatggagtaagcaggagagagagaaaaattccaaatgtgattagcagttgctcttcatgagaaattttctccacctctaatatgacttttctgaaaggctttaatgaatactttcctcagttagactgttgttttaaatatcactgtggactctttgcagtgttattaccatatgaagatgacacgtcggtgaactttatcaaatgccatgcagctcttggcatgccatgtctatgtaactcattcgagcccttcttgtccgagttgcagtactcttttgcataaatgttaaggttaccacaattccaaaaagaaacgaattttcagagacctgctttatgaagaaaacggcttttggagaaagcaggaaatactagtacatcaaacaaagtgaaagacaaagtagtttaacttgttggtttgtttgctgaaactcaaaagtaaatatactgtagctcaaagtgttccatttttatctgcctcctgcagtaatggctgtgttacttcggggcttctacttcaataattgatcagggtttgtatagcaccggctaagagcaaaaataagagtgttgctttgaacaaactgctgcaatgttatagcattaggcacagaaacaagattcgggaaatatagatatagaagaaacaggaaaaagatggatacattgggtggtaaacattgcttcaggctagaaagtaatgagaatttttccgtggagagttttgacctgctattcaaaaattgtttcttgtcttaataaaatcctaaaagtgtaatttacttgcaagagggaaagaacaaaggcaccaaaattcttttgataacaacacttgttaaggttgataagttgggtttcaaatgtgtgaagaaaaatgtgtgacaatttgttttaaggtgacaccctaagtgttcagatacttccatcttacactacttatcaagcaggatcctagttgaagcttccccttgtacatttgcagtatagaccatactgaaatggtaggaactgaattaatctagaaaatatagttatatttattagaaaaccaacaatcacagatctctctaatttttcttaagctggtaaaaataagagtacttttttttgtttggttctaatttgttttgcagtctaaataagaagcaccaatacttatagaaaataccttttttctcaacatggagtgttcaaaaagagaatagctatgatataccttatttttttctagacttaatcttacatgactcacaaaggtatccattgttagatgccaactgttgcacacacatatgtgtccatttttttctattttaaagttaaatttcatctaaatttcagattcatgccattaaaatactataacctgctgctgcggtgtgccaatggtgataagatgtaaagcatgattgcaaaactttaataatagtgtgggaggaaactgcagtgaaaaataatcaatgtgatttttttcctgttatgtagcatattccaaagaggttgtttattttatgcctaatcaccataaagaagaaaatcaagcactcaaatatttcatactaaagaataagcaaagaagcatctaaaatatttgttcatatttatatatgcccttcaaaataaaattggtaactaaatgtatcccaaataactgcttcaacagccaggcgtggtggctcatgcctgtgacccagcactatgggaggccaaggtggttggatcatctgaggtcgggagttcgagatcaaataattgcttcagatctcgactttgctatgcacatactactgtaagtaaaaggcaaacactgggatgagaatgtggtgaccaagactagctttttccatagtgagtttttataatgtcatcaaactcacgatcaaaggaatttgggaaatgttgagcataacaaagataaatagatgtcttgactggagaatttctcagggcatttaatatgttaaggacctggaattcagtgttcccaaacatatctgatcatggacacttttattgagaatcccaagggaccagtgagtcctggaacatactttgagaaatactgatcttgacctatagccagcaccaactctgattagctgtgcagtgagaaaatcactttcctccttcaactttctaaattaaaaatgtccttataattcccagtatatttcacaataatggaaaatcctcttaaattattatagtgatacaatactgttttaagtaaaaatgtgaaaaccgttttagatgctgagtcagagcggctgattagactaatcagctaaagggtgtctgtgggtagtagtcccccttcttgcatagttttgtttgggattctgcaaatttctgtatggcacacgctttggggaatttcataaggaggtgaaattataaatattaaatgtttaaatgccaaggaaatgttaaaacttattggaactcttctattcattcagtatatacttatgccaagcaataacccaggaaggaagggcatgaagctgaatctgtgtttagggatataactacctaggcagaaaagacagacaaaaaagcaagtctctcagtgttttaagctgtcagatgaaaccgtagagtcccataggtgcatgtggtaggagtctgagtaaattacccagactgggaaaagccaatgttcacatttgaggtggttcatgaaggacttgaagggattattcaggcagaggaaatgcactccaagaagacaggcacaggtgtggagaaaatcatggtatgtttcatgattccaatagaaagctccaggggagaggaaggaagctggaatagtaaatgaaaatgatgatagtttttatttattattattattttgtagtttattttttttgagacacggttctcaccatgtcacccaggctagactgcagtggtgtgatcaatgctcacggcagcctcgacctcccaggctcaagcgatcctcctgcctcagtatcccaagtagctgagactacaggagcacagcagcacaccgccacacctggctaatttttgtattttttgtagagacaagatttcgccatgttgcccagcctccagcttgtaaatgttatgccacaaacttggatgtttttccctgggcaatagaggaaaccactgaagggcatacctctataaggggagaggcagatgagtgatagagaaacagccagagatgaatactgaaatctgtgttttctgatgtgcttgaatgtataagaacatgaccagtttagaaatagtttggggagttgaaaaattatgtcaactagcaaaattgacggagggcagttcatcctcactatgacattgaaagacaaaataattattagatggttttattctaataactgattttcaaattatttttagccttggaatcctttgcccatggattctgcagtttaaaaaaaagtgcagtgataaagcaggcatggctgtgtttaattggtgatgatgtgggtatgaaaggccccagggaactaccctgtagttctctttccacttagctcccttctttcccaggcccaggtatgccctaggagaggaggcagagtatgaaaatcattcttaatagtgagaagtcatatatttagtcagacatgctaactggactattttgtgtttgaagaagactttctgctttctttttgaattattgtcacatttcagttttatttatttactctataatatttattgagagcatgctttgtgccaggccctaggctggagactgggaaaacagtggtgatcatggataagattcctatcaccaaggagtttacaggctgtaaggaagagggccctagataggtatgaagctgccaatgtgcagtgtttcaggaggtggaagggggtgggagagaaacctccaagacatgcaggtaatctggtcaaggaggacagagggagggagttttcggtgaggtggaaagggcagaaggtggagcttggataggtggggaggtaaggggttgaaagtgaactccagactgagtgaagagagtgtgcaaaagtgctgtgaagatggtccatttgaggacttcccaacttgctggtctagctggagagaaagagcagaagaaggtagcagaagataggaggctagggaggtgggaggaaggggccagattgcagttttgatggctgagttaaagatttcatatttatttgaagttcaatgggaagccatgaaatgactcaaggcagtgcagcatgatgttgtttttttggcatgtggtattgtttctataggctgtatatgacaaatatgtcaaattttgcattacgttctggattcagggattttgcctacctaggtttctgcattacattcaggaaagagctacttaaatggaaacatataaagtcattactctgaaggtctctctactgttaccaattttgatatgaaattagctgtacaataccttcttttcagggatttttaggaatttaacaccttctggagttctcttttaggttttcgtacttttgggatcacagtatttattttcagaataactccaggtcaactaaattcagcaatgactggcaaaatatcaaacataaaaaaaaagtggaaggtgtgctgcttattcgatagcaaaatcctaccaaaacactggaaggtagaatgccattggcctatgataattaaattgaaggggagaacacagcattaaattaattgctcagctggaaattatttagtaattctctgacttttaaatccccaaggttttcttcttgatatagtactgttagacatcttaaaatgtaaatttttgaaggcattactcctccctttcacttctagttctcaaatgtacctttaatgtgtctagtaacaataataaacacttactgagcccttaagatatggtgagcattaatctaactcttatatgttctatctcattttccccttacaattacttccatgaagtaggagtgctattattattctttgagagcctttagaagagataacttacttaggagtataccagtgagtaagtggctgagtagaggtttaacccaagaagtccaatcaagagcagagtgattaagtactgtagtaacctgccttgaaagtaaatagaaataaacatagagctgtatatttcatggtagctaacaaatttctaacatgtggacagaagaagaaaaagactagtaccttcaactcacgtggatcagattcaatggttctttgtattgtaaggaaaattattgtcaaggagcaaaactatttatctcagagactagaatttgttagtgcaagcctatgtgacattaaaatacaatgtgtgaaaggcatccacaatctctccaacaaatagaatcaggatcctctatttgattactcgatgggaagtaggagatgaaaagaaggcattgtacagctaatttagtatcaaattgttaaataataagagtagagagactgtcagaataatgactttatatatttccatttaagtagctttttcttgcaaactctttaaggtaaaatcaaccaaaccaaaacttcactgtaaggcatgacttttgacccagatgtctatcagggaaaagaaagatcacaaaacctgtgcaccaatgccctggagtcagactgcctggttcaaattcttcttcagttccttgataggttgcttaccctttacaagctattcaacctttctaaatttcaatttgtttataaaattagaactaatagtacctccctcactgtgttgataaaaattctgggttccaaaattcaagttctttccactatgtcattctagataatagaaaaccaagaaagaatgccataacaagcaataagtatgaggtaatgtgttctttgttggggatagctatccattttttttcataaatattgattgaatgcccattatatgtcagacttgattctaaaggatatgccccttaaatgtcatgccaacttctaatatttaattaaagagcaggaaagggcctgttgtttttgttgctgtggttgttgactgtagcggagtgttgggtagtgaaaaagatgactgaactaggatgtgtgaccttggtggcaggcacagacctcccaggttggagcctttgggcaagtctcttttctctactcctgagtactcaatttcttatctctaaaaggaaagactaggtaacacactgagccagatattattcacaaatagggtcagattcacaaacttttgatagtcagatacaggatacagcaatgaattataatgggatagcaaagatgaattataggaagagtgggtaatacttctcatcagaaacatcaagcaaacctacaaaaagagatgctgtgactatgaagacagattatgttatattccagacaatcttgggtgcctggaaaggagtctggaattactctattggcagcgaggccaccaaaagaagtcagttcctacctatttctcccatgtcatcaaatgtgaaacccagacctctgtccattttattaaaattatcctagattccatcttgcttctccacggtgcctatggttttgtctactgacaatctatgactaagattctcaagttatactttatgtgtgttcacataaaatagcacactatactttaaaatgtagccagctattcagcatcatcactgtaatttgtatttatagtattgaagctaatcctgtgtctcacttactatgtgaaactctctgaagaatattttgggtgttctcatacaactttgtagatggcccataaatcaataaggaccttctttcaacaaaccagtcattttattccttcttgatttctaaacgtctcagactcacataacccaacattagtgttctttctttctctttgaaaactacaatcagtatgtttaaaacatactgctcatatatacagaagcaatacgtatatgaaaaagacaaaaaaataggactatttcatttaagagagggacattttgtcgtttgggcagatacctgccagtctaggctttctatacttttattttacttattggaataacggtttaagctgcagaaccaaagagaaccaagacaggttggaaacttttcagggtgaaagtgaccagtaataaaccaggcaaagcaagaggaaagagactggaagaaaaaaaggcctgtgggtgctgttttatgggatagtgttgagaaattttgacggaatgaacaaggtaattttaacatgtgctccactgtgtaagatattgagacagagctggggaaagattttgaaggttttctctgtcttagtgatgtaattttcatttgctgtctattatagctgattttatcctaaatttttaatggcagattttttctctttttttttttaataaattttaaaagaaaacaattactttttatgggcaagcagtgtgcaagcacctttgttcaagctgttcataaaccacaaatctggcaacttctaaattggaaaactcagggtgtcattaagagcagagattgccggaatgctgattctcataacaaaggccaccaataggctcacttttctgaaagaaggcaactttggtggcaagatttgctcctctgttcatatgatgaaaccctagcactagtggaaaggttggtggcacacaatggaaaagtacgcttactgaaaaaatatttttctttttctgtttttctgacctttgacttggcaatgctaaattaaaaacggctaagtggaaaactatacttggaaaaaatagaagttgatctaataaatcagaatactgaaatgttcactatcatttggccaacgtaagacaggtagctttttgtttttaccgttttgggagtatttattcattcatttgacttagttttgtccattgatgatttgttctctaaaaacatgcagagaagtcccttcctctcttctctgtgaacacatagaagccagcgggtcctgcttttgtggtcctgtcacatcatccattagatatggcatttatctacctctccggcatcccttcttttggaatttcattgaggggatgaaccacatcccctttttctttcgtattcattatcttagaatagcccctgaaccatagcctactcatcaaatcactctttaagacactgtcatatttgaattgagatctttcacattatccactgctgttgtgaaaatattaggatttcactgatataacaactttataggtgaagctaacagattcctcagaagtttctggcaatgtgtgaggtttcctctaggacgaataacacctttaaatccactcccaatgcattttctgaagttaatttaaaataatatacaatctgtttgtcccagcttcagattccccatgtcctcttctttccttttcggttttggttatgcttagtctaaagtcacatgtgcatttgaaagcaacagaacaaggaattctacaccaaatttcatctcgccaaaccatttttttcccctactcatgtaagttcctaaaatttcttgcttactctgcattaatgctaaattacaacatatagaatgtctcccaatgatttccaaccaaagacatagtacatattggtttccctttctgcttatttaataaagttagtagacccacattgccctgatcagtcacagaactattattaaaattatgcaaaatgtagaatttcacaaaatactgattattcttaactctcagcaattctgctgcttaaatgtttcaaaatataacttgctttcagttagatgatataaaaagttatatagtttcaaacttaagaaatagttttaatcattaaaaatacatataaaccctattttgtatttagcttatccaatattcttcacaatgcccatgcattaatggtagaattggagacaactccatatttgttttcaaataccacaagacttattgtgagctaaatgtctattgagcagaattttacccattgtacataacgacatgatagaaaattatgatgatttggagattcataaaagttgaaagctatatcctaagcatcaacagatactatctgggcttttcatgggaatcatgggtattgctagtgttttctcaaaaagaaagaacactcataagggaagtttatatgtctagaaatgtaggacagaccagtctttagagggaaaaaatactcatctagcagtataatatttcataagaaaaagaagtgtctcgaataggaaagatgatttactttttgtgctattaataaagccttaataaagggatttttaatgtgaatatgccatgatcattctctcctgtatggcgatagagtaatttggctacttatagggtattcatccagacacatgattcttcagtgttattgtataagtaattgcattttaaaggctgtaagctttacacagggtcttatgtctagcactgaagttccaaaaggctaaaataaattataacatcccacctgttgctctgacaacctttaagtttgtgtagaattatttctttgttaagtctgtgtgtcagaaactatgctgggttctggatgaggcaaaattgtataacagcttcatagcatgagtcccatcatacatataagacccattgtgaatatatgatcactagataccttttcttaaaatctctctccttagtgagctgttccctaacaataatattgacaatattaatcacctcttccaataccacacactttccttccttgttttaatctttttttgtaagaacttaacactacctaaccgcatatatgtgtgtgtgtgtaaattagtattttttgttgtattattttgcaagttgagaataaaatttcatgagattagaaaattttatctatttttgttcagtgatatgttctcagttcctacaacctacaacaagcttcataagtatttagagagtgatgaagacagtataattagtagtagggtagatttttatgatgatgtgatagcacgaatgataaaccccgcactggttaaagtttttacaggaaaatcatatttaatctgagttttcatggataagtaggagctcaccatgtggacaagggagcatggagagaggctaattcaggaagagagaagagcatctacagagcatgaggacgcatgttgaaaaacggcagtcagttctgggatagagaataaaggcaacaggtgtcaagggaatttggcagggggtggggtggtcagaaagggtcagagaaaaaagttactgaaaggatcagaaaacaggtagagattggactaagaatgttttatatctttgttagaagtttaaatttcaggcttacagcaatgagaaatctttgaagggctttctgcagggcagtggaaagatcagatttgcccttgaaagatcactgtgttggcagtgtggggggatggatagaaactcgatatttgttgcgttaatgaatgatttctcaacgttactttagaccttacaatttggtgattcttcaagctttactataaatattgacagattgagaaaataaataactgagtgatggagcagctctagtgaggaagacaagattgcacccaatttttcagggcattaaaattggggagctttctctaagcctcttactatttctgcaactattcctaccattacactaatctaggttactcctattaataatctcttttctctgaaaatctttaactgtcttaaacagaagctttctactttaaaaacaaaaacaatttttgacttttgctgtctgccaaaattgatttgctacaaatcaggtttagctatgtacttcttattcattatggaaagtagttaatgcaaatttaaatatcagcactccccaccacagataaaaacaaacttacataaaaaacagattgccaggcaggctttgaggagtctctgatgtacacacattcagaacgattacttgttccaaattccctttcaataacacaccttttattctctcatctactccaatacgttgggaattagttttctcagatggttgtttgaaagtggttagcgtctttaaccctgagtagaaaagtagtataggcaatttggtattctttctttcaaagcctgatataactaatgcatttatcaagagcagaaattaagtatagattgtctctaaactgctatttgtatgtaaatatcaacaagttttttaagatgtaagaattggcttaattttaacaatgcttttgacctaagcctttagttatgtaattatttactcaagtaaaagtttaggtagcagtatagtagagtgtgtattaaggaagtactgagctaattttcttcaattaaataaaacctctctctggccagattatataaatcagctttggcaccatgtgaaaaaagaattcatttgtcattaatgaaatgatattttgtgaaaacttcggcataaattatttacaaatttatactaggttagtaaattctgaccattccgtggaaaagttgagaatattatgcagaccatggcttgaaaagaacactgtatcacatttattcattttgcacattttttactgggtgtcttatagatgtcaggcagagaggagtgaagaccagcaagatcccttctgtgacagcacttacacttcagtaaaaagaggagaaaggcaataaacaaataaacaagtaaactacaaggaatatcacatagtcaaaagggctttgctgaaaatataactaatgaggaaggctgcagggctgctctgcagggctcttaagcggtcggaaaatcattgctgagaacacaagacttgaagttgatctctgattttctcagaaggcctctcttacttcaacaaggtgtgattcaacaataacatcaacaaatcacaccagcagttcagaggttagggttgatcatttaccacattttttaactttatactgttagcattttaaagtcacccagcattattattagcaagtggatttattttcaatttcatttcctagtaatgtgatttaaaactatctcaaaaaatggaaattatggtttcagtagttaaaattattttatgggtttggagcatatgaaatcaaagagctacaattagcctaagccagtatcagttcaagcttcccccacatggttttactaatacccttcaaattctgacttctgccattccagccatatgtctctttaagcagatacactgtgtagtgccaaagtgtgtcaaggacatcactaggttaccaaaatcatttttatgtgcaacttcttgcaatattccaaagtactcttccacctgaaccccaccccaacccctaaaatataattttaataacacacattaaaatgtcatgctgataataaactcagagataaattacagggaatctgtctgtatttttttttaacgcttttggcactaacataatggtgtaagcacatggactcacacacattgcctaaattcagtttctttcatttttttgcaggctttgggtacagagtagtgcaaaaatttataattgttattcagtgcatacattttaagaaagagctagaatgctaggcatatgaatttgtgtttgcaaggtgtatactaagagaatagaattgtacatatatgtgatgtggctttttagtttctgattgcagttttatcaccatattatcttgtgttgctgctggggaaagcaacaaacagtggcttttgccatctcagtgaacggagatctctggaaattgcacctgttcattatatgagaaatccttctgtgggcagagaggagggattcagttttattctcaaactgttgcctaattcttataacttgtgcatatttttttgagtcatgattgtacaatctgctacccattttgggataaaaacactattgaaattgagcatactaactttaaccaagctgcattttttatgaatcaggttgtaaagttgactgccacgatacagtcatgtcctgtacaaatgagcacacacacacacacacactctctctctcacacacacactctctctctcacacacacactctctctcacacacactctctctcacacacacacactcacacacacacacacacacacacactcacaaacacaccagggagaggattacattgaacactcggaagctcattattcttccaaaataaagagttaattttttccctactggtctttccatctttgaaacaccatgagtcacggtgtttcccatttcacaaacaccacggattctttattgtctgtgaggcttccatgtactgcagtaattttgaattggatatgttatgtccaaattgacagtagtgattaagccaaaaataagtgcattttcctttaaatgttagctgcagcatcaagtaacattccctacattatgctatactgaaacaagtcagtcggcaccgaccaaaatgttgatggatatacagcagatcaaaaagaggagaatcattttgaagtgctcgctatctgtctgagacgataggcttctgaatttgtacctctttgcaaaaagagacttcacattattttgtcagtttgtttcaatttgagaggtgttgaaaattggtattcatttttttgatataacccttaaattgtacaatttaagaaaactgactgaaagagataaattaaatgggtagaaatattttcaaatcaaagaccaactgacacatataaaaatgatgtatgtttcttacatggtccacagggagaattctgcaggcttgctatgatctctacaatttgcttcagggcaaactagattctgggatattctattatccctttggtctgtttatcatggaaactgatgtacaaatcgagaggtctttttggtctctttctttctatatggttggaactggtaagaattcacttatctcatgtcctcaccttcggtaaagtgctacagaagagttcagtgaccagtaatcaattattattgagaagcaatcaattgctaatttccataattatgcacatctaaacactatgaacaagaaagagaaacaaagctgcactcccagcattgccttgttagcagtattttgttaacacaggctctaaaaaaagctgccgcagctggtaccacaaatgtgtttccagtattcaggccatcaacgtgattcgtcgctaaatgtatagaatcagcttcttgctaaaaactacaattacaggtgatatacagattgaaatcacagggctggtttgtcgaagaaaattgtcctaatgatgggttttcggatggggaatgcagctcttttctttctctgtgatgggttgtgaaggcagctgcacctgcctctatgctgtattctgccgcacttaatgatatctgatgatatcattaggcaaagtgttcataaacagatgttgagcctgtgcctaaatgctgtcagatgagcggttgctggcctgaaacagtattatttatatagaacatttacgtttgttatgttaataaccccactattagctctctggatgttgcgttaggaatgtaaatgtagttaatatgaataacaacctctttactctttgtgctgcagttgagtataacttttaggctttgggagagaaacaaagatacccccaccaagtccttttgacttcgtgatttttttttttttttttggcaccatttgaaattttgatcagaagataaatggtaagaatcctaagacagatgttaaatattagaatttgattttcctcacggttcataattttgagagattttgatatctgtaagttattttgtgtgagcccagtttgttaccctaataaatcagagtgatgatcatggacactcaattgacaaagtatccatttcaactagaatgtcctaaacatactgtcagatatggacccatttttgttccagctcttttgctgacatgatcatattttttccccagtaacctattggggcactaaggtcatatgtcacagtcatttttgtcatatttgtgttggtgatttaggcaataccttgatgtcatactcacaatgcctcaaaatgtcacatgacaattactgcgtgtgtgtttaagccaaagttgaattttatgcctcatagttaattcatgcagagtaagttatgtaaattctgacagtcatcaaatgtgcgctatttctctgaaataatgttctactctgatagccacactatttttttcgaaagtgcctttgtcattctttatgatattttaactctttcttaaatttccagtactgaaaaattgcacttgcctattttcaggattaaaaaaaaactgttattttcaattgttaatgaagaataaaaccaaacagtgttaaactggtgcttcattacaaccataattagaggttagagtgctttctgaagtgtcagcttcatctcaattaatgcttatgaagtcattcacgttgctaaaagtggtaaaggtgtccatgtatgttggtctgtaggtgtgagcagcaaactagaggtacacgtttacatgtgcgactattctcattccatcttacacctaaggatagtctgaattatttgtgattttaaataatcattataaaatttcaatggtgatagtttttcccatgcctccactacctgtcatttcaatactgatcttctagaaaatgctgaaaatgccagatcctttttatatggagatttacctccaatcttccaaataaggaaatgggaaaagtaaattaagtcagaaggtgttccattctctatgaatcgcctcctgattatgatgtttatgtggagtagatttttaaaaatctgtaactgttcgataagagaaatgtgggtactggaaggaatgaaataactcctaacatcctgaacaacacatacaaatataacatgtcaaaggactcttaagattatcaagttatttagaccctccaaagtttcttttattgacattgttggaagttgttcagaagaaacttgaagattgcatttttatttgttcatctagtcaacacttaggaaagctagccaataaaaatgttcattctgaacttggaaatttagatcgatttgagtgagaggataaaagggactgctgaaaacatcaactattgttgaaaaaagatcaattcatcaaagtctatttaacaggcatgggagcctaccactgtctccaagaagtcttcagttcctgtcttttcctcagtggcagtaattctgatcagttccttaggatgagtgcctatccatggcatatattaattcaccttcattcttaaagatggaaagtaatgcagtcatttagcttgtaattttctaaaataattcagtttcttatgttgaaattgagtgagggtcactttgcatgtgaagatatctctgctgaagccaattaatgcattctattttttgatatttgtatttacctacataactagactttcatgtaaatctcttaatgtataataaatatcttttgtattagtatgatgacattgttaacctatgtgcagggattgtagcttttcctgtgtttcacaacaaactccagagtccgagtgtaaagcaatgaataaatctgaaatctagcaatgtgaattttagcctcagctaagctaatttctatgtatggttgagcaagtgcattacctttctaggcctcaatttctctgctataatatatttatgctaccttactctcttgtttcttggaaggatatgcatatggatgataagatattaagatctgtagaagaagaatggtttgagtccaccatttcaatttaaacttagtggcagttagttgaaatataataggcctttttgacaacacattaaaataagcacttattataaaatatctccttgcaataatattatcgtagttttatttttattttcttaatttttgtttataccctaaaaatggagagagtatataaaaatatattttaccatcacaaaacagatttttggactatcttccctcagtgaaaactactttaagtcaatatctattcatgtttataattagtttaattttcagcatattttttaaaaagcatatctttgattcactgatactgcattttgtgcctcctgtatgtattctaactggaatgaccagggatttttatcatttgcctgagtttcaacatctgtaatagttaggagagttcatgtagaactctacactcatgaacataagaaaactgtttgcctttttaaaagtaaggctagtatcttcagaatggaccataactagtttcatatcaaagaaaagttggaaactgcctagaggatgctaatccattagttattttattttatcatttatttttccaatgtatgaaattatatattttgtgggctgggtgtggtggctcacgcatgtaatcccagcactttgggaggccgaggggggtggatcacgaggtcaggagatcgagaccatcctggctaacacagtgaaaccccgtctctattaaaaattaaaaaaaaaaaaaaaagaaagaaaaaattagccaggcgtggtggtgggcatctgtagtcccaactactcagaaggctgaggcaggagaatggcgtgaacccaggaggtggagtgtgcagtgagccgagatcgcgccactgcactccagtctcgatgacagagcgagactcagtctcaaaaaaaaaaaaaaaaaaaaaaaagaaattatatattttgtggtaagatggcctcaaggagcaaataggaaatattcagccaattgtctcggttctctttatgtatcttactggtctttattaaaatatctattatagtatgtaagtaaagccagtttcaaagtctggggcttatatagtacccagaaggtcatttaggtctttatgagagaaaactggagttgtaaagacaatagacatgctgtagctgtgaaggtcaaaagtttaagaatggatgccgtatgcacaaagtatgcttctgacaataactgcaaaaagttacgtgcattaatatgaactcttgattgttatttagcatgtataaggactactagtctattcttaccattttgtgttggtcttttagtctaaaacagccgtaagcaatcaactaatatattttaaaggttcatcatgattgatatatgtttttgataaggcacattcttctactgggtgctttaatatcatcagggaattgtccagcaaataactgaagacctcaaagctgattttcacctggaaaggaagagaagggggaaaaggggagggagagagtgagactactgaatttctggatataacactataatcaaattccaccttcattaagcaaaatgcttcaatggacaaagtatatttgccatgatgagcagaatttgccctaggtggtcagagtcaccagtttcttgggtccatttcttctacaaggaatggctttttaacctggcgggataggcgatgtctatggtagtggcccgaatttgggcatctgtaattatgttagcttgcaattaagctgacttgtggtgggaggattaatgtcagaagattccccatttttcaatcttgtgtctacatcagtaagatcgaactaattgctaattggcatttagaaaatgaactactctggtaccctggagctttgctgtgatatggcatggaattaggaatatgatatttctctctttgataaaagagaatggtatttactccaggaagtaacatagattctcattatacttttcttatctaaaatataaataaaaggatcagttcactatttatagaacatatttatttacaagatgtggatttcctagataccattatcttggactaaatcataagaaacagacatcattcatcaagaattaagacaaagcttcaccctgaataacctttattgtcctcaactttcgaacaacattacaattctttgtagtttgatttacattgtattgcagtattttaaatgtgcccctctgccccccattgcttttggcaaagaataccctaacatatttagtgatttttagttttttatgatatattttccggggaaatttatagtttggaaaacatttgtttaaagagctttctttatgtactactgccatctaaataaataaatattgttaagaagctactaccagaaaattatgttaagattcatttaatagacttttaaaaaatagatttgcctttctctaccttctagagtcattgaaataaaataatgatctttaaaatgtggttgccttcaaaacacctaaatatttggggtttcatttcaatcactctgattagcatttttttagactagtattttctaaaatgtggcccatactttccatgatgatctatggaaaaattatcaatggtcaaataagtttgagggaatttgcatgtgctataatattttctacctggagagccacaatacaaattaacatcaaggctgtgagaagtcctgaataaaaatatttctttgcttaactcagaatttaaaatatttctgtaactatggaatatccttttatctttggattaaatactgcagagctgatggtcaacccagctcacattgaccaacattttacaaattattttgcatgaaaggcataggcagattatttccacataaataaactgtcaccttaacaaattctaatttcttccacatcctttgcgaattgaatagctaaaatgttactgagttgtaaataaatctttcttaaaaagtgtacaatctttgaaagttccattgcatcatcattatcaaaaccattatttataattttactttaataagtacatgaaattttctgatttagggtttctcctactgttgaaatgacatataacattgaactagaataacactttataaacaatttaaagaaactttttttttcaggaaaagaatagatgtgtaatacattttaaaaaaaattagaaggcacataagcaagaaatgattgacaagctgggcctggtggcacatgtttgtagttccagctacaccggaggctgagtctgaggattgtagggcccaagagtttgaggctgcattgagctatgatcacaccacttcactccagcctggacaacaatgtgagatcctgtctctaaaaaaattaaataataaaagattgacattgaatgtaaggacaaccaagattagtccagccctttaagagaaacttcttgtgctataaagggttttggtgcttttttagcaaagtgggaaaatgcaactgtatacttatgtcttgctggttaatatcccactggtctctacactctttagttaggttaaatacatggtgtgaaggtggttttgcattgctaaagatctttttatttttaattttttttagaatctcaaaatttttactcattcagttagataaatgaacctgtgtccgaattacatgagacaggagatacacagaaataacgcctatcattcttcaacctgaaaccgacaaatgaaagcttcttctcattccagggttctaaaattgtgagatggttgcagcccgatttcataatttccatgtatttgttgattgactgggaaactaaggaaccataacttagaaactgttttagaatgtgccaagattatcctgcagtgtcttaggcatggatttttgtttataaatattttctcagaacatcaataattgtcttttcagttcaaacatattaaaaatgctacggtaacaaattatcattgaagtttgttgccccaaagttgtcatgatggagcaagattttaaggctctagaatgatgttgtctacagagcaattttacctgttcaggtattttttttttttcttcaaacaagaacctctcccttgcattggtggcctcagtaaaacagagatggccctctgaattccttcctgataaatggattccgaacaggaatgacaattatcccacattcatagtttagaatgagaaattcacatcatctccaagtctcttcacactttcagagggaactggtaagctctgaggttcagtatgagaggcagttttgaaactgcagctcctccctccaaggaaccgcgttcacctcagtcggaatgaataagtagaaatctgtgacacaatgatagtggtgacattcgtgcaaacaagtgtctcattgaaagcaaagaagcacattgcttggtaggatccctaagagccctaaaagtatggctgtctacgagcacactcatacacacagtagtatttcagtactgttggcttagctagcaaacaaaacatggttcaaatggtttaacagtcctagaaacggaaggcaccagtttaatgaggtctcctctgcttgaaattaaagtggaaggagttttacggagaacagtattcaataacaaaatattaaatgataaacacagattgcttaaaatcagacgggccattttaagaaaagcattttagctcatcatgatatgtagcaccttatttaaattaggaggtgttaattcgtagcttgaataatatattaatataatatgtaaagtgaatggcattgttaatcacagtcgcgcctggaacgactttgcttctgtgcactgaatgttaattttgcaaaacattaatttcaaagattttgcagcagtgcttttgtaattaaatattaatgtcacatgttattgcagtagcatgtttatgaaagccggcaacacttcaagtcaactcatttgtttttatatttattcttgtacatctgcaatcccttccatttcacaatttcaaagtgaaggccattttgaatagtcaatatgtgaacatttttcattgtaagcgttttttaacatccaacagggtaaatatttaatgttgtgtttttagctggtataatttttgagaaaattggctataacttttaacaactcaaaggtacctaaactgtctccagttttggcttaagtaatctgaaaataaactagcaataaatgtgatgaagctgtgtaaaaatatttaagaattagaaggctttatataaaagtttgaaattagaattgcaattccatacacaggatatatcagcagttaccaattctccatatatttttattatggcactgtattatctcaagaaaactgaaaagacagcctagactttcggttaacttttttcaagttccataactagacaaagaatagaaaaatgtttcttgtcggtgatgtgatttacacttattacatgttctgaagttatacatttgcatgaaaggaaaatcctttttatgttcaccatcttattccaagtatagacagtatacaggtcattatatttggtttgcccacgactattctgaccaaatcactacagctagtaatcttgtccatgatattaccaatcagttaattacagttagcctaacaattaagttatccccatttttgaaccttgacaagaaataacattcaaggaattatattttaaagctgttattttatccatctagtaaagttgtctttacaatcaaatccctagatacattttgtcttttgaaatatggaatgagttatccatagtaccaaaaaaatcaggaaaaatcaagatatattatgtttggttatgggcacatttaacagttaaaaattatatctgcacctgatgttgcatgttaacagctaatgccatttgacagtgatgaaattaaaggatgaagaagagatacaaactacattttacaagcatgatgggtctccaacaatgccatttaaatattatttgtcactatttaaaatgaacctttcccctttaagctatgccattacgctcatttgtcctgtcaccactgacaggctatatgactcacacacaaaaatggtcattaggtactgcatcttcatcttattaaaaaaaaaagagagagagagagaaagaaagaaagcattctgatgcctctaaaagcctgtaattattttcatccgaagagatagtgttgctcggaaggtaatttaataaccttttgcatgtacctggggaatgcctctccagggaaccaaggtgccgacatgccattcagtcgtcaaaacatgacctttaatggttgcttggagagaagttagcgtggaatgttgtacacactgcaatgctaattctgctttctaatatatgcaaaatttagttcttgagcaatgatctttgtaagatgaattaatataggtactgctccaggaaacaaaagaaattgcaacatgaaggcaccaccccccttcccccaccatgatcttttatacttcaaactgaagtagctaacaacttgcacaatttgtattaaaaatagtgcgaaacactccagaagtctttgcttcctttccccctttaagttggttgatgaattctattctatatactatggaaatgtaaaacaggattaaagggattttctttgataagtttatttcccaaaataaagcattggccccaactccctgaagaagaaaaagaaacgcttacctttaatataccctctctgttttataacacaatttatgtggctcgttgaaattactaatgcagttactgagttaattttaaaaaaatccttcatggattttcatgttgaaatatgatattttgaacacttgcatatacaaaaagatgcacaggctgtttcctgtgacaaccaggttcagaaactccttattttggtagtctgatattagatcccgccttagttagaaatgctaggatttcaactcctacccctgacacgccatccgtcaatttattagcacgctggtgcagtaagccactgaacaggctatatcaattcgtttagtttttttctttaaaatgtctgtaatcctcagctctgctttctcaaccggtcagcattaaagatttatgttgcactttttttcatcaccacacctgaatatggattacttaaatgggctgtaaataatttatatctgggaataagtttccattactgaccaatgttgtaatttaatatactgtattatgggttatacaattttagattgttttctgtgtgcattctgcagtcaggcagacaacagtttaagtaaaaagggtgagatgtttgttcagcttattttcatgttcactctgtgtgctcaaatcagcaacagggctaaaggaagcagaaagctactttcaactacatgtttttctgctatttatggaaatctttttttttttaggcacttgacctgaagcaaaatacaaaaacacataatagctattattgataaatacaaaaaaagaaaatgtgctaatgtaggtggctagaaatcttaattcttgagaactgaaaaatattcttgattcctgaacccaaaggttaactttcctctttaatgcttggttcttctgtgcagaaaaatgcacataataaaattataatttatttgacaggtttgaatgaggctactggatcaaatatgtaaaatgttaaagtacaagctatttttaaagcataggcaagtgtttactcttaaagctttaaacaatttaagattaagttgagtatagtaaaaattaataatagattaatacatgaaaatctatgaagacacataagataatgatttaaaaaggaataatttaaaaagatgaattaaaaagtcgaatcagaaaagaaggccagcataaactagggaaaaacatgctgtgaataaagtctgttagatcttgaaataggagaactgctaaataatgcatagttttatttttctatcatttgcataaaccttaagagagtatttatttgtgtaaaacttgatgtatcgagtaaggagaatgaaaaaaatggcattcattttgttttcattttggtatttaggaaaaatattctgttacatatggactacttagacctaatcatctgactgaatgtgatgtgtgccttgagccaggttggaaagggctggctgcagaacagtgccctggtcttgctgcaggcgatgcaggttggcccatgctctgctggggagcagatggtgagccaatgcttgtagtcacacttaccttccttgctaaatccataatccctcactggacacggagccaaggcaggctttggaggcagaaaggaggttacaatctggacttgggtagtgactgccagaactgagaaaacagctcagaaatttcaaatgcttaacaagttatctgtcttgtccctaagccagtgcagcatttttaaaagtaattaagacatgattgaaaatgtgtatgccatctaaatacaaaaatcttcaaaaatcaccaaaaccaatcattaaaagccacatttaatatgacattatgcaaaaatatatttaaaataaaatatatttttgtgattgaaagaaaatatgtaaagtaaaaaaaaaagaggaagcatttattttttaggaaaaggcacttattttctttacaaacctggaccttatagaaggaaaatatttcatacatgtctataaatatgctgcatggatgaaatattttccttctataaggaaatagatagctatgcaacatatctatactaacagattcttctatataagtttttctttcaaaatattaaatgattatagttgatttttctatataggatacttatgtatgtatatgtatgtttttatatgtgtgaatggagttcatcatcaacacagacattataaatcagaaagacaaaataaaaatattgagtgggtagccaaattctaatcatttataataaaagggatagtaagtaccatctgtttaatgtaaaaaaaaaaaccaactgataaaatgcatacatatctagtaaattaaaatcatggagtaattcatataaaacaaaatatgtataaaatgtcaacatattccattagggtgcgattgatttaaacatgtactatctacataatagtatgatatgagaaatagaaaaatcttttgattatgtttggtgctacaccacaattttttaaaatgtttttctattaagtggtaggaacaaaattccttagttttctccactgaatttttgagtcctcattatcttaggcaatacttttttcttgcaaatgattcttaggcatactttcattgaagttcattgactttgagggaatttcttataaccttccttactccatcttgcaacatctacatttctcaagctgacaaaatgctaccaataccctatttgtgtttatgaataacttgagctctccagtctaggactatcatcaacacctttcataatttccccctttttctattgcctctttttttgaaaaatattgtcactcttaggaaaatgttcttaatttcttctctttgtgactcttcttcagaattcatttcttgccagtgccttcatccctcaatatgtccttttctggttatactgttttcttccaaaatcgatgcaaagaaataaagaaaaatgtagaagcttctttctctgcctcacccaaaaattcaagaaatgtgccttgataggagatatgtgcaggtcagtatttataaaaggagatataagaacaaaaatgtttatcataatacatttgggaaatattatgcttagtttttattcacacaataatgtgcctgttggttttaacttttattttaatttagtttacattagaaaacggaacccttgactacaattatatttacagaaagtaatgttttcatgatttcggtaggaaaattttactatagggtgacatcataaagtagtttatcacttcattcccaaacctaaaatgaggaaatatgatatttacaaacacttttttcttttaaaaagggctaattacatagagtttcaaaaaggcctggaaagattgagttaatgtgatttttgttctcaggtgagaaaagaaagtgagaaaatttcaatggttattttgacaatgcaagtttcctataaaatcacatttcagaaggccagactggtggctcatgcctgtaatcccagaactttgggagaccatggtaggaggactgctagaggcctggagttaggaaccagcctgatcaaaatagacaccatctctacaaggaattaaaaaaaaaaaaaaaatagcacattatggtggtgctcggctgtagtcccaagctacttaggaggctgaggagggaggattgctttagcccaagagtttgaggttgcagtgagccgtgattgtgccactgcaatcgcgcctgggtggtggagaaagacctcatctcaaaaataaaaaagaactttgaaaatcacattgctcttaataaatatcaaaagattattctaggacattgtaggcatcaacaacttaaaagcaacaagtcaacacgatataaattttagcaaaaaaaaaaatgatctttaatattagatatatttcctctgtccaagagttttaagcaaagacattggacttgaaaacaggaaacctgagtttgcattccagttctgcctctgaccaactaagaaatataagaagtatttatatctctggaccttagtttcctcacctgtataattacagcatttttctaatgatttctagcattttgattgcttacaaaacagtctgtgactatgtgaaggtggaagagttaagtactaataaatagcacaatacaggtgatatctccaagcaacacatgcttaattatcaaataagagattcaggcaattcttgaaactagttaacaaagtaaacatttatatgggttcttaatgttttatgttctaaatttctcattgcataatttttgatacataaattggaacacattttggccaatttagttgacattaacaatgggaaatgtctctatgtagatctctgaacaaaattttgtaacaccgtccatgtctcagaacattaccaccagaaatgccattggcacgttccacgcatgagttccacatttttagggaatctaaggttccagaattgcagagagagaagctatatctatagacactagggagaaagtgagtagcagaagtgatctacacaagcaaaaaaaaattttttttaaatgtactcaagattgaattagaaatccaatttatcaaaatccttggagatggcttctgatctccagttgaatcttcagccctttgatatgtcacctattagccacccaagaggcacgtgccaattctcatgtagtatataaagtctccaaataattattatcttaactatcaacattattacaaacattattaattaagagagacctctgtatttccgtaaaagggaagagcactcttatggaaaaggacgtattaaagaattggaattgtcagaagttgcatctcttggatgaagcataaagcagagatcttgatgttaatggtcacagaagattctgtgttgccatctgtcaggaattatttaccagtttttgctgaccaaattccaaattaaggagctccatttattggctcaaacctaccctctgtcttaattaaaaatagtgtccatctttactatttatgacctattatgagacacatggactttgggatttaaaaaaaaaaattctgcttcctcttctttagttcaggttctcatcatctattaattgaatttctaccataggttcataaacaatattcacatcagacttcttgacccactctaagccattctcctggggctggctgccagagagattattccaaaatgcaaacagtttttctagttgttcactgttaataatttctctatgaatcccaatagcctttaggaaaaacagttcaaactctttactataactttcaaagttctccgtgatctggctactgcttatctctctagtgttatatcctatgctgaatcgaagttctatccatcctggaagcctacctacaagttaccaaagtttaagttggttttccagatttcttttttaaccaggaatgctgttctacctagccacatttcctcatttttcctccaaaaggccattcctaatcgctttccccaacccccaagtctggttggatgtatcctttttacgtgctcctataataccctgaattatcacaattatacatcagcgtaaaattgtctgtttccctgtgtctcccattagaatacgaacttcaggttcaggggccaggttatattacttttcatatttccaaggcctaggctattctgtggcaaaaagcagtatttggcacagttgtgctctgtcctaaaataccttcttctctgggcttctttggcatcagccagtcaaggaatgtttcttctgcctctttgggaattctgcgtcctcctcttcacctcttatttgtggagattcccagggattgatcttcaacccctttatttccttaatatctgcaatagtctagatgattttattcgggatgaaaatctctacagttagtcttgaccatagatcttcagacctatacatccaactgtttctttgatgtctttatttggatgtttaatatgcatcttaaactaacaagactaaacaagaatacttattttccttcccactcaaaatctgtttctctcttgttatttcctaccataataaatgaactactctaactacttggttgtacaaggtaaaaatctaggattcattcgtgactcctatctgaacacaccccagtctaaataatcactgtgacctctcagccctgtgttaaagccacctgaacacatctgcttttttctgtctccattaagcaatcatggtccatgtcaccattatcattctctggactactatagtaagcttccagttggtcaccatacttatgttctaactctcctatcctacctttttcaagagttgccagaatgatcttttaaatgtgtaaatgaagtcaagccattttcctattcaaaactttataataattttcattctatttagaaaaaaatctgccatctaatcctggtttaatattctctgcatcattcaacctcctccaacattctagctccatctcatcccattcccttcttttcactttgctgtggccacactggtcttcattcatttttttggaacatgttaactcagttttgtcctaaaggttttgtccctactgtttcttctgtctagaaaactcttgcccaggtggggtggcttatgcctctaatcccagcacttttggaggccaaggaggaggatcacttgaggccaggagtatgagaccagccttgctaacatggtgaaaccctgtctctactaaaaatacaaaaaattaattgggcttggagttgcttgaacccgggaggtggagtttacagtgagccgagattgagccactgcactctggcctggataacagagcaagactctgtcttcagaaaagaaaaaaagaatgaaaaatagaacactcttgctactgttctttatatagttttcttctttctgtcattcaaattttacctgcttgccaaggctttccttaagggctatttcaaaaagtagccacttagtcatttgctgtcacaatattctatataccacctatcattatcacatatttctctgcatatcacctatcattttaatactctgcacaacacctatcatcacctctatatgtttgtcaatcaattttgatttatcgtctccaaactcaccaaaatactaacttcatcagatcatgggacttgcctgtcttcttcactgcagtattcccaacacctagaactgggttccaaacaatagaaactcaaaaataattgtcagataaaggaaatagcaattgcatgggaaatcaagtttgaacagtgaaacttatttgaggattactactaatagatggagagtggaagaagttacatgtcttcttctcaaattttaaaatgtttagtaagatcaacgagcaagattaaaaagttcctttaacaaagacaccaatttctagagtagagaaagaccttataaagtatttgatgttgtcttaagaggtaccggggaagccaaatctctttcaactatttttccccatcgcaataagccaaaaatcagagaggaaacagtagcaaaaaaacaaacaacaacaacaaaaaaaaaaaaaaaacattcaatcatccattacataaactaacagatatcatctgaataatattgtaggcacagattcaccttactcttgtgctattatataacagaaatttaattttttccttccttggagttttacttggaaattattttgttctctcacagaagtagtttaggattcatttaggagtgggagtgagaagtgggagggacagcatttcattatttaagaaatatttattaaacactttctaaggagcttacaatctaataaaaatataaaacctgagcatgatacttataatatgtgctagacaattacaagtatgatattataagtaccaagtaaatgctgggaaactttagaagagagaaaaattatgccccaatgaagaatcagtagggttcatgtattggaaaaatcaagaaagcttggttttgaagtacgcacagaattttaccatgttgcagataggggaagaaagatatttcaaggaaaaaggactctcacagagtacatgtactaatttaagtagttccaggccaggcacggtggctcaggcctgtaattcccagcactttgggaggccaaggcaggcggatcacttgaggccaggatttccagaaaaccctgtctcttaaaaatacaacaattatccaggcatggtagcaggtgcctgtaatcccagctacgcagaaggctgaggcacgagaattgcttgaaaccaggaggcggaggttgcagtgagcaaagactgggccgctgcactccagccttggcaacagagcgagactctgtgtgggaaataaaataaataaataaataaataaatagtttcattctaacaagacacaggaaaggaaggtggaacagtagtcttagttcttataatatagaggatgtagtacacccgaataaggaaaagaaatgttctaaagttctctgtagcatgtaaaacaactgaccacccaatttgtgttaaaaccttatgaccctatctcctatactttgtcttatcttgtgcctttttctgttttcatctttggcttctcttctccagtcctaaggagtaaaataaataagaagctaacctgagccatctattaggacaggatattcagcaaatgctttggcacaagactctgttgctttaggtcttagggaaatctggcaatcatcctttcagatcaaaatctctagattcctgattcagtttcctgctgctaactttctggtggatagtttgtgtgacaatgctgatccctctatttgcacattgccgtaattgtcaggcatatcagacatactttgccttttaagcactcgaaaatgtgcaccatgatctagcaccaaccatcacctccactttgaaatctcactcggatcttctatgtatacaccacacaaatcaccagcaagaaattacagagcctggattataaacatagaacttcccgaaattgaatcttgccttctcacttaggtcatacaggaccttagacaagttttttaacatcgctaattctaaatcgatttatatgtaaaatagcaataatcatacccacctttgaaagaaccaactctgtgaagttacaaccacaactatttttgcttcaatgcacaaatattccgaagatcaatgacagaaggtgtgtaaaacaccaggtacatactaagaacttaatagagattagcacctccttgttttgggtttttcgattcttctagaaagcttacttcacatttccagctgtctaatttttactcttatttttatattcagctcctatatattctaaaatattttttgaatgaccaattgaaaagaagttttattaccactaatttctccattttccaaattccctaagcattttatcagaaactctttaatcgtagttttccttctctgccttggttatggtagcacagatagatagtctctctcttattatgtgttgaggtccaattttaattttgtatcctcacagcattaaatatgctattttttcaagtaacagatcctgtatctacacatgctgaatcactttttttggatgattctttctgatgttaaaccgttgtcaaataatgtagattgtggaaaatctgtaaaattatatctagtaatttacctaataaggtctatactttgctatggacagctagatattacactaataatacatgaattttcttagtttctagttaacaaatttatatcaaactgcctaaaatctattcaagatcaccaattcaaaagaataataatttgcacatttgataaaaattccatgaggaaaacaaataatattttgctcctaggtcaaagttatagtgttgataataaacaaaatactaaaaattgtgcattttggtatcgactttttgtgaattttctttagggaatttgattaatgccttctagactaattctataaaaatctatatgtttcagtttattatttgaagatttatttaatagggttaaagaaatgattcaagtaaacttagaagcaaaataaaatcacacacaaaaatctattggctctttaattcttaaaatccaacttagaaaaaacaatctttaaaaaatttcagttggaaaaatcgtagttatgtaattattcattcctcctgaaatttaaaataaaatacataaagggtggtctgggtatttctctgtctgtggcaacatcttttaacttgactctgctatcttagtgtttacttgatttatcttaaagatatttttcaaagtgtcctgtatcataattggcaggtccatgacacttgcaattggctctaaaaatgtttatagtagccaagatgcagtagtagcattgtttaattttacttttgttttaaatagaatgaaacatgtaaaagaaaacttcttcaattgattagacattacataacaatcttaatttccttcaacagttttttcctattctttgggtaatgtatgtctgtgtttgcttcatcaacctctccactatttgtggacaatgaagatcccccaaaattaattttatcatcacctctacctttgctgtcaataagttatctcttccatctctgagggttctgacctcttgcccttcctacagttgaaaaatgttgttttatttatcttcatcatcctcacaattttctctttatttgccatctttcctttatcatgttgtactcccttgacttcattttataatcctccccatcctgttttgagtctcacacaacttatcctgcatattgctcttccttattcctgattatttttgtattttcttgttcatactaattggctccatttttatttccagtatatttataactaaatggcattcattgcctttgggcatacattaatttatctttcaggattttccatttactctctgcatcttttctttatatatttcttcttgtaacctccatttcacttcatttttctcatatgttttggtgtattatttttgttgttgctttttaaatatcccttcatatctgtaattcatgcttcatgtgttattaggagggtttataaaataaaccactgtgtatttgtcacaaacagcattaatttgaatagtctaaaaataggtttggattcattgtactgcaattttccggccaccttctttacagccatactatagggcttaactaaataaataattagaagctaattttacaaattaaaagaactacagatattttaatttatttacctgaggtcagaaaagggtagtttattgaaagatcaatggacaaaggcaaaacttatttcaagagagagatgtttagacctttggaggtaattaactgataagaaagtggtgcatatatgctaacatcattaatcttcatacttttctatgccttcatgcatataataaaggacacatttaaagccagatatcccttcttcaagaaaatccttgaaaagcacaaatttgaggcaaataaaaatgtaccaaataaactacagtgcaatgtggaaaatattacatgttaaataacagtatatttagtgtgtgattggagtaaagaaatatgaagagcgtcttagacgactttctagagcaaataacatttcagctaagtatcaaagaatcatacacacattgccacctggagatgaggaacagtgttcagagatgttgttccacattataattgaaagggagacttaacagggagagaggcacgaaagaaaaataaaatatcagcatatcttttactaagacatttggaattttcctacagttcagtgggagtcattggagagtttaagcaaagaagtgacatgatcagatttgattttggaatgagaactccagtagacatgaagaaactggacagcaacaccacagccacttagagtggtaaaataataatatcaatgagacagaatgaggacacaaactaaagcagaatctgaaggaataattagaagatatgtgagagtcattaaaaggttcagtcaagagaacttgaggacacttaggcgtgggggcagaagaaagcaagtgagaagcaagtggaaagcaatttttccataggattcaaagccacccacttaatttcaattagaaaaatagagctgtgaaatggctattaagtttaatttcatccagatagattctccagtttgcattgatgattagatcactactaccttatgacagtgattacctaccttatgacttatgattaacagttgaataaattaaatgtatagtcaacagagaaaataaaaataacaatattagaatgatactttctttattgcataaatgaatagtgacacattcagacttcccaatgtgcagcaagggagcccaaaaaacaataaaaaatattgcacagacattcatgcaaaatgaaccctgatggtagtaaattctaaaaatggcagaatttagttttaaatgcaatttccacatttgcatactatgtaagaaggcatcttataactatgttcatagtatattgttcatctcatttccataatctaattcagtgatacttatgctcttcaaatagtattcactgatcatattttatctcttttttatcttaaattatggttctgtgaattacagaccacatcagggaaagattgtaaatatcataaatataatgccaattttcctttaaaatggcaaattatataaaatatattttctgctttttcttacaaggaccaaaagtagacaaacctttgagcttagaagtggattagaataccttttaattacatagcatataatttttttaattcctcagtttattaaaagattataattttgaaaaggtaatcctgagtaatgtagagctgttgattttaaacagacttcaatttagtcaaactttcttatccaaacttccaaagtttccaatataattgcaggttgaatttgccatagataatgcaggcatttgggccatacatataatatactatctatttaagctatataatccattgttatatactgagaccattttagtgcaaggtattctaccaggcactttgcagagaatattttatgtaatacaacaacttttcagagaacgcagtattctttttcttcttcttcttttcctcctactttttcttcctcctcctattattattatatcaatttatttactgaaaattgaatttccaggaagttatataatttgcccaatatttctcccccgtagatgtaaatcctgaattgggattcatatctgttttattctaaaacgcatgctcacttccactgaattatgctgtcataaggtagcaacatcacaatcattttgggacagtaagaagtagataaggagtaggtcttaaaacagttcttctttggtgcaaaagaactacatcattttatgtaataaaaaactgaactgtaagaaccctaaggaatgataacacaaaccttaacaaacaggacttatgcaagcataccaatttcccccagagatgtttagctcatggtgtttctttaataacaaaactcaaaaaacagtgaatttcatcaattacatacttaagatccttggcatgtcttgctttttcatttctccagcccatgtcaatagtactgagggggaatatcacactctggggactgttgtggggtgggggaaggggggagggatagcactgggagatatacctaatgctagatgacgagttagtgggtgcagcgcaccagcatggcacatgtatacatatgtaactaacctgcacattgtgcacatgtaccctaaaacttaaagtataataataaaaaagtagtactattgtatcaagtcatactgattatattgtatatacttacagcttttgtaattatttaatatatatttgatgccttatgaggaaattatctaattagaaggcaacatcttctacatcgtttctaaaattattttattatatttgttcaacaatagttagaattcttaactctgacaagcatctaccaagcaggatttgagtctgttctatgtggactagtatacttcatgatactcaaagcaacttcagattccttttcccagtggtgatgtgtggtatttgagacaagcacacttcctttcatttacttctttctctactatggtatcttgtaaacccatgttaaaagtttaatgtttagtttttttccatgtttcaaatgattatgaaagacaagataccttgtttgcttaatcatgactttttttctcctttgagaccacttggaccaaagtgactatcaaaatagttgtacaatgtgccctgataaattggggggaataggttgttggggaattttatttgtttttatttattgttgtttgttgtggtcattgttttgactgtagacacctatttgaggtctacttttgaaaaagaatattattggatatagaaagtaattcaaatattattggcaagataaatttattttactttaagttccgggatacatgtgcagaacgtgcaggtttgttacataggtatacgtgtgccatgggggtttgctgcacctattaacctgtcatctaggttttaagccctgcatgcattaggtagataaatttctgcaagaagtataatgagaaggacaaattgatgaggacatcttctctaacaatgaagaaagagttttatatattatttggcaatctctagagtttctacatgagactccaagatggcatattgtccgtctttctatctccctacctacctatttatccatctatctgtctgcctgcctgtctatctatccgtcttcgtctcctctccccacccccaacacaaatatgacagaaatgaatacattcagattatatacatacagattcagtttcatctggtttgatttggtttggtaataatccatacactgagctaagtgctccaattttctttttcttttttctttttcgaggctagcttgttcccctgttttggaaaatttcctccttactgaaacatcacattacaaccaatattatactttgccaaatattttgttgtaaattctgatggcccactcttaagcaatcatttatatgtgtacttctagtacataagacttcattgagttttcagtttgtgcattccattatcatgaatgtactgagaagcaacttaatgatttattccttaacccaaacacttaattttactcctttgacttttacaaaaatatcattagtctttcaagaataggaaatcttacaaatcaacactaaagaacttactcatgtaaccaaatactacctgttccccacgagcctatggaaataaataaataaataaataaataaataaataaataggactagtcagctgggcacagtgactcacacctgtaatcacagcactttgggaggctgaggcaggaggatcacttgagcccaggatttcgagaccaatctggcaacatagtgaaaccccatctctacgaaaaatagagaaaaaaatagccaggcatggtgacacgtgcctgtaatcccaggtactcggaaggaagaggtgggaggatcacctgagcctgaggaggtcgaggctgcagtgagccgtgatggtgtctctgcattccagcctggcgacaaaaaataaaatggagtagtcgatttaaaaaaaaaaaaaaaaaaaaaaggacccagagactccaagagttctatttcaccaatgataccatagcttcttaatctactcatgtacatgtgactgtgcttatataaatttgaattttaaaattgcttgtagacaaattaagatagaaaaagaaataagatatcacattaatgaatgggtattcataaatttatatataaacttcatattgtatattccaaagggatctggaaatttttatatttttatgggagttaggaagattctttctttaccactttcattacattatttcattaaggaatctgatgaaagatatggatacttgccttagaaaaaatttcacataaacaatgtcaaattgtggaattcctgaagctcattcacaggcctccctggagtctttgatttcagtgttatgtcagttaacatgtattaaattcctgtcatatgctaagcaattttaagaaggcttgaaaagtttgggcacaaaaatgatatgttctagatgataaagataaagtatgtgcacctcatttcactgatgagtagtgagtggacaccttttaaaagcctatgacagtgcctgtacataaaaagagattaataaatgttaaccatcctctctcctcttaaaaaaaaaaaaaaaaaatctagtgagggagatacacatttaagcaattatattcaaaaaatagatgagacagataaagagaaaatagcacataattacacagtacttacaatttcatagtcccttttatattggacaactttataaccccttttgtatatttactcatctgaatctcaggtcattattagtcaggtactgttattcccattttatagatgaaaatatcaaggactagagaggtaatgaaacttgctcaagattgcacaagtattggcagaaccaggactaaaagccaggtaatgtgttccaagaatccatgtgcttaaccgtcacatttgctatctcataaaaatacaacaaaggccaggcacggtggctcacgcctgtaatccgagcactttgggaggccgaggcaggtggatcacgaggtcaggagatcgagaccatcctggctaacacgatgaaacatcatctctactaaaaatacaaaaaattagctgggagtggtggagggtgcctgtagtcccagctgcttgggaggctgaggcaggagaatggcatgagctggggaggcggagcttgcagtgagccaagatagcaccactgcactccagcctgggtgagagagccagactctatctcaaaaaaaaaaaaaaaaaaaaaaaaaaaaaaacacagaaatgtctcaagcaatatggaatggcaagatgaaagagcaattacttttgttggtagtctaggaaaagtctcagagaagcacatcaaatttgtgttaggcattgaaagagtagaggagacatatagtacctagggtgggatgtcttattaaatataaatatgacttaacatacttagtgtaatattaataaagttctatgtctcctaatgaaagaataaaacataattattgagttactcatgaacaagaaatcccaaatacatgaaacatcctgtggacctagcaaacctgcaaaaccattttcctgaggctaaactgttttcagaaatatgttagctcttaaaaacaggtctataacaacaaatcccaaatattgtgtatctgtgaggtacaattattctgttactcacatataactgatttgtacttttgttatttctcaaagaattggcaaagggtgccgcaacgtaagtggatgaaagccattataatgggtgaaataaaatccggtggctaagaaagaacagatttctaaaggggaaaatattattcagttcctagttttaaaaaatgggatatagaatattataggtggattatgggatattgtcactggaatgtaccactttcacctggagccacactatttggtgtcattagtagctgcttattctcgccattttccccaccccatttctttcccactgctaccccaccctgccatatcctgcacagagacaatccattctttgattcttctttggacaataagagtaatttttacatgtcagcactcgtaaatccaccctatgaccatagtaggttgttttttgggggggtttctgtttgcttttttgagatagtgtcttgctctgtcactcaggctgaattgcagtgatgtgatcttggctcactgcagcctcaactccctggactcaaaattctcctgcctcagccccctaagtagctgtgaccacaggcatgcaccaccacacctggctaatttttgtattttttgtagagatagggtctcactgtgttgtccaggctggtctcaacctcctgggcttaagcaatcctcctgccttggcttcccaaagttctgggattacaggcatgagctactgctcctggccataggtacttctggaaagagttgttctaccccaccagactaatgactcctccaggacaggtatgtataatccttttcccattttataatctcagaatttaatgctgttaatacatgtgtgccaaaatgattgattataaaagggaaaataaatgaatatatgatcatcacagattcactatgagggtgaatcaacagtgggatccatatttgtaaaataaaacaatgaaaaaataagaggttagaaagaaaggaaatttggctagatatgttaatcacagatgtggacattaaaatgtagtctaagtcatcttatgacaaaataggtactgatatatgacagtttatatttttaaaaagcaaatgtttatttaatttcaaggttaacattagtgatgttatgctaaaatgtgtgtgttcctagtaataattgcattactaacatctatctagatgagagctctctactataatcaatagaaatgtcattggcctcccctcctctcttcacctctcattctgccatttctccctagagcactattaaatgtaaatttcccaaattcttttctgtgacttttatggcctgaaagtaagtaatctgattggtgatgaaaattcagaacaacatagcccaagtaccctgggaatcacagttctgccaagcacttatgaactaagaaaaatatactctcttgcacatgtggaatgtcagaggaggaactgtgcggctcactcagctcactaggtgttagaacaacagtgcaagggtatccagtggtgacatacataaagacatggcctccctgggagctccagtgatttagaaatgaaatcttagactgccctgtgaaagttgaagatcctgttgctttacaaaggaatggatattgcataacttgaagataaagagagcaaacccactgataatactgccatggttaagtgttcttactgaaaacttctatcaacactatggctctaaagagttcattccggcagccaagaacagggaaatgccagctgagaccccaactactccaaatgctcattaaatagattttacttttttcggtgatggttgtttgaaaataggagtgtttatgagaagcgcaagctctctttaaagaaaaagtagaaaatgacaacagaacaagctcacattgtaaaatgcactatgcaaagagaaaaacaaacaaatacacacgcatgtggcattctttgtcatctctgacatcttcaacttccgcgtttcccattggttgcaatcagagctggtgtttagaataatgactgctaggttctgtaagattctcaacattacagatatatttcattatgcaaccctttagtattctaaaagtggaaggagaaatgaactaagccattttaagatagatttaaattacaaagatagaaaagcagagagatttttattcattctgagctaaccaggaaaatcaattaactaaaattcctgattgccagagcatgctatgtaatttgtatgatattaactttggttttacttaccttcaattgtttatagcctgtcaatgaaaatatttcctgaacaatgttcaagtattaacattcattgatagaatcaattcactgcagcctactctgtctggcttgcgtaaggttggtgtagaaaacgaagcttccaaaatcaggatccggaccagaaggaaagctttgtatattatgagctaagaacatttatttttatcaatttcagatatgtatatggtaagacttagaacacatagaataaaattcagaaagtaacatgtaccgtggaagctaacactaagcattagaaaatttgatcttaattagatttattttaaagggtatgccatataaaatctatcattaatattataataatttaatatttaatttaaattcatactttaatttactcccactttcttctggctttctgtttctcaattttatatttctttttgagcctataataaaacataaacctggtctcagctcagtttaatattttgagatgtcgaatatttaatttcacaaaacatactttttccactcctcaaatgcattccttttttgctttttagattgcacatatactgtgttttgtattattggtaatggtaaatactttcctgtaatgccttttaaatattttgctcagtaagtaataaacaagaacttcaattcatttgcctggcattaaaatgagactttgctcccttattgaggaagtacaagttttggatttcgtttacaaatggcatatatggactgctttccccaacatttagtagggttttcaatgacaggctaataaaatgtatcttaaaacatttgggtaaaattgtaatcctataaagaataaatactttaaaaaaaatccagccaatacttaccaaatgaagttatatactgtacaagagaatttttaagtaggaagaaactttagtgatcatttattctagtttcttgttctaattaacatactttttaaaaacctctttctacaaaattgaagaataaaaaattgctagcacattttcagtatttttttcttttcattattagaaaaagtgttttgtaatacataattatttcagaaaaattgaaaaaataaaataataatgcccaaagtgtctattattaaatatattacataagagttacatatttttctgcctttatttacctttacatatacattgttattttataaattgggatctgaagctagttttgtttcctattttttttcactaaatttagagtgtgaaagttacaagtcactaaatacttttcgaaagacaatttaatttctatgaagtttataataaatgtaatacaacaaatacagtgttaaaaaggtttgagttggagttttgtaattaatttacagcaataaattaacaaagtagcaaacaaaatattatagaacatatgcctttgcatcagaacttttttgttcctgattgagtatacatcagtttaagacatttcagtcttctcaatgtattgctcaaaagcgaattctttgaatgatgtttataaataggctttttttatatgtactttacatctctctctgatttaaatagtcccttttcccctcacaacaaatataccaaaatatagtctccagttaaacattaataattaatttaatacactcagaatgtcataacacttaatgagtagaatactttggctttagaaacagcctttggagataaatgcagaaaggaaaataaacataatgtttactgaaattaactagaatggtgaagggtccccctcaccaatgccttggatgcatgactttgggagatatgtttcaattcagcaaagcaggtgatctagtaatagtggctaatgtgattagcacttgtgaaaataaggtcataaagcacaatttctaagatcttttagaaataacttgtaggtggttagaaattcaaagccattcttgagtctggagatacgaaacagtttattaaacagatattaaagtacttctaaaactttaagaaataaagacacttttctatcagtctcatctggtattaaggctaatgttatgtatccatgttacctcttggcatattggggtcaattcccagttatctatccaaaatagtaatatactggatcaaacccaatatctttcctgttctgaattctctctctgataacagcggtagtttataaaagagctgtagtcactcttaatgccttagagaaagaatatacttccaaaacaaaaatcaatgggaactttgaatcactcaagagtatcattttagccagttttttccaacatcttcctaagcaccatcctctaccagttctgctaaaagtagaaacattgattgatgtgttttatctccttccccctccactgccatcctctagcagagattctagaaagagaagaaatgccctaaagacaggttgcttgaggaaaatggagaagtcaaagatttgaattatatccacaaactggataatcaatctctaaagtattgaaagttgactgtacacaaaaagtgcagtagataaatattacagtttgtaagttgaagcatgtaaaatattgaagggaatgggtggaatctttgatgttacatgtgataaaccttggaaccaataaggttttttttaattatttttttattttttatttatttattttttaagttttaaaggtttgaaccatgaagttttaaatgggaatttcaaaaatttgcaagttaagcatccccgatgacttgttttagaacttcaaatttccacatatgcactcattaaaagcagagatgattaatcaattgtctcaagtgcatgcatacatgccttccatgtacatgactaaactaaaaatgggagtgaaggttgagaactcagtctgtgcaccacatgagtaaatcaccatccaagcatccaagcataaatttgcctgttgttgctgatcagtgcttgaattcatagtaaaatgacccacactgatcatttaacaaggtggttttttaggcatatatatatatatatgtgtgtgtgtatacatttgcctgttggtgccgatcagtgcttgaattcatagtaaaatgacccacactgaccattcatagtaaaatgacccacactgaccattaacaaggtggtttttaggcatatatatgtgtgtgtgtgtgtgtgtgtgtgtgtgtgtgtgtgtgtgtgtgtatgagagagagagaatcagcttcatcatggtatagtttacacaattctctctttagtttcctgaaaaagaatctgaagtttctaatgtgaactttcattgtttttgtcttctacaaagatgtattgtcaactatagagaaaagtgaacaaccaaaagttgtcataaaaattaaattgaaaataaaggaatctgaaataattattaataaatttccctttttcaagtaaatatacttcaaaatttaagtaggaaaaataatgactatttttttcaaagaaaaagtaaaggaaacaaatacacaaataggtaaattttaaagacgttcttactcaacatccattaaacaaatattttattgtgccaggaactagattctcattttcaatcctcaaaatttgcagtggaacagagcaaaaagaacaaaattacccatttttgtatgtatctactttgtgtaaagcagtatagtaggtactttccaaagaaaatgatgaaggaagggataaaaagaaatacatcaggactgtggttatagccctcaagcagatctaatctaattggagaattgagtaggcaactgatagtgtaaacaaaacagataaagcagattaatgagttctaatgtaatatgttagtactctgcttcttattagtctcctacttaatctactatttgaagtaataatgtagtatagtaggaagaacgttactctgtggtttccattcctggctctgttactaacatttgggctgaccatgggcaaatgacttaataacaggaatagctaccattgatttgattgcctgggtgctttgcatgcattgttttgttcaatcctcacgtcaaccatatggtatcattctgactataaaagtgactgtaagtccagtttgttagagatagtcctgcttttgccctattgtccaagtacacttgttaccagtgtcagtgtctccttttaccctcaagagtgctccagtttggatgatataataaattttctccatttgatgagaaacttgataattgcaatctaacaagtagtagaaacagatttgatccaaggctgttgatgcctaaagcccatatacatagccactctatatatgttcattctggttaaatagttgctgcgcttccttgtatatacataaaatgaagcctttaaagtaaatgatctccaggattccttccatctctgaaccctaggactccaagtacagacagacacatatgtgtgggctcatgatactgggatataaactttacatcaggcttagcgaacagaattaggaaacaatgatgaaaagaaggctagacagaatgggacatttaacacattatagaattcataatacaggtgcggctctgaatacttaacagaaagaaactagcatccccgggcaatgtgaatgagagatgaccctggactgttagttaagcgaagctgtatcttggtgtgtgaatgacacgttaagaacatggtataatgtggcatcctggttcttgtattttgaaaatacttgaatattgtttagagtcatttgcatctatttaaaacaagactaattgtattaaaacaagtctagttgcgtgtatttaaaacaagtctagtcgagtgaagtcttcattcaaattctctttttgctgaatattatatggcctacaaagagttgtttggctttgctgtgattttaaggtgcacttcagatttatattctccccagatgattatattttcctggggaatgttgatgcattcccgccagctttgacttctcatattcccttctttaccctcatcttattggatgtctgccatcaatattaaattgtcttaatcctgatttttctacctattgctgcttttgcagttggcactgattcttatgccccttgaaaggtacttgtgtggcaaaagattgaaaaaaaaattggcagttgttgtcagggttaatgtagaaaaataaatctcttatattgccagtttggatttacttttcatttttaatggccccaacagatgttggaggaatcctctacttcctgcacacttccatttttacagctggtactgcttgactggttcttgactttgggggagcagttcctgggtgtttacacagtgatttacaggcaccctctcactatagactatgaccatcctcttgtgtcttttttcccttgcgatttttcttgaaactgatgtaactctcaatgcagcacctcacaaagtttttctaacccagtgtttcctgagcaatagattctttccctactgtgcagcattctgaaatgtgtggtatgttagattttttaaaaaaagcataaaggggaggaggtacaaataagaggtgattttcaaacttagcaaatcaggcaatctatcctttttgatatctctctttgtatctttttcttatgttttcccaaagtattcatcacaattttcatctaggtggttcacttctcttgatgcttttgctttttcctaaaaccaccctcccttctttcctttcttgcttctttccttccttccttccttcctttccttccttcctccctccctttccttccttcctccctccctcctcccttcctttctttcttcctcccttccttccaccagcctcagtgtcactagcttccaaaaactgtactaatatcctaaggctactgtaacaaagtaccacacaaacaggaggcttaaaacaacagtaacctcttgtctcactgttttggaggctagacatctgaaatcaaggtgtcttcagggcacgctcccactgaaacctggaggaatcatgccttgcctctctggtttctggtggacagctgccaatctttgacagtccttggtgtgcagctggatcatccaagcctctgcctttgctgtcacatggtgttctccttgtgtgtcttcacattctctgtgcatgtatgtctcagagtccaaatttcccttttggtaaggacaccaatcatattgaattagggtccccttaatgacctcattttaacttgattagctctgcaaagaccctgtatccaaatccggtcaccttctgaggtactgggggttaggactttaacatatcttttcttgagggggacacaattcaacccataacaccaactaagaacagaattttcctcacacttgcttccgaaagaaatgttgacagcttttagcaattgggaagatcccgtgaggctgaaagtgccatcgccggctgctgtcttgtctgcgacttttctgtgctgttcacttgctctcttggtttgagagttcccgtagcagaaaaggcagagtcagacacaaaactctcataaaaagcatttgcttaagtgacagattcgaaccacagcctttcaagaagctctttagtgaactgtataaaatttgcttggtaaacatcctgacttgagaaaagaaaaactatcaagcattgtgagaaagaaaattatcaagtaccagtaacactagccatagttttattttcttcccaaattcttacgtagacgtgtgtcaaggttgcagaggataccaaaaaagcttatcaaccctcaactgtgatgccctgtttcagtaattaataaagccatttaaaaagtcttttaaattatactagggataggaaaaaaacacattagaaatgacatttcagaactattgcacaatttgcctaagaaggcttcaaagttttcttctaataacaaataatgtataattgtcattgtcacttctattggaaaatggaggaaaatagaacacttttctcaagcagatttcttggctcacttatataaggttagcaaggcaatacttttatttgaatgtatctttaagaattagaaatagccatgaatattcttgattactaataaaattgttttaatgtcaaaagaattatatttacaaatcctctattgttaataatgctgctataaacctatgtggaatccaaatcgtctctctcggaagtgctttactgaaagtaattatgccaaatatggaaagtatacacaataatttgtataacattctcgatattaagccagatcctcgcagttctcaaacaattcttcagtatgttaatttgatttaaatttttaaaaagttgattcaggaaactgtagaaaaacaaaatagttaagccacttgttcagtcaaaaccagtaattatgtgcctaaagtattttgtctcctaattcatttgctttgacatcacatagacctagtcttatatatggtagcttatactagaccataaaaggtgttacgcagtgaaatactaaacaagtcacattggacaaatctgataaaatcaatattctaggggcaggatttacaagatggggtcttagagtctatgatgaaatatttacagcaataaagaaacaggtattggagagaaaactaaaattgacagtcacctgcatgatcttctggggccaccctggaaagtccttgccatcctcctcagacaagagaaaagtcatcattaggctcccgagggtaattcaaccttgcagatgactattcctctacttggaaatagtttgactatacgtaagtgaaaaagactcttaagaattttattttaaaattttattttaaaaatctcaggacatttaaacgtatgcctgttgattttttttttcttttcgttgatttttcatggagttgatggagataaaaagatcagcctggcagcttgctggcatggaactggagtgtttagggtttgttttgcctttttgcaagattggtccacaagaactttaaaaggagaaaaagacgatgcaaattaaatacgttagaaacgtatgtcccatctgtttttatttcatttttagaataaggttttcataccttcttttatttttatattctatgataccacactataatgttggccacctcggagactaactaaattagctatcctgaccatatggaaaggaaaagctttaccagctaaagaaataaatttaactcaggcaaaaaggcctatgtgttttagagttaaaaaaaaaaaaaaatgttgctaagtacatagtaggggaatgtaacccacctgcataagtaaaatttgaaaagagatttggatattcaaaatagctgtctcttttcttggcgtcattcaggaatcacccatatttgaagtgtccttctgttgtgctatcatctggatgtatttgtaagtaaactcacaatcagagacatgaaggctccttgaaaggccatctatttctgcctctgcctctgagaaaaattaatcctaacctgtccggggataccttaccttaccccattatgggggttggggggaggaaaaaagcttcagtgcattcagagaaaaaaacttttcccctaatatctttactttggaacactgaataagacattcctttatagaaagatactttgtttcattctacaaaagcccatactgtcaagcacttgatagaagccctaggctaccattttattttacctagagagaagcttctcataaattcaccatgtaaaattgatgactgcttcagtaatctaccaatcttaggtttttatataaaccacagtgagggaatagagcttgcagaagtcaagcatatgttttgtagccacgcaaagagtaaaggagtgtctgcctgatctaggaccacttttgagttgacacatgcagttatttacaatgattgagaacgttgtagttcatgtacaactcatgaagacaagataaatagatgggtagagaagcttaaactaaaaaaaggtcaaccgaagtgttttctgtcacttgactgtaactctcagcacaggaccactcaacttttagagtgctgaagttaaaattctctttatttcaacagaataatagctaaacttataagtgaaggcatatgttttgagaatttttctgtatacattggaaagcctttttttctggacactcttaccagcaggcatttcaccaaagttcataccaactactaaaattacctgaatgtattcaagatgtgtctccatatattttttctgtactaaggaaggtggaattatagtagtaattccttttcccaaatcatgggacactcagtgtaaccattatctagcctgtaatataactttccaactctcagatatcaagctagtaggatggctttgaagtaccatattgttctccgaaactaaagccgtttgtttgtattagatgaaacaaactaatcaagcaaaagtattttttctttagaaaatgtagatgtcttagataaacattgatctagattttttaggttctttgattcatatctgtattaatattaagataaccagaagagacagaactataagaccagttaaaaggccatctcagactctagcagttgtgtttgatagtggaacacagtgttgatgctctgaactacataaataaatacttcctctctgtcgtttcttaggacatcttaactttcatattcaactctaatcattgtcatagtccagtttatggccaagcataaagaatgaatagtttccttaaaacctacatgatgtaattcacattatcaatagagggaggaaacgcagatgaattccacttgaggtatattacagcctgataccactcagccaccaacacagagctgatatatcatttgtgtattctcaggttggatgttataaactagacaaaaatggccatgggtttttccaaggaaaaaaatgttaaaaatctaaatagatatggccaaatatgcaattttccactatgagttagtaaaatgagccatatatcaaaaaatagaattttctttaatttagagcttgttttgtagttaaggaatacaatttttgcaaatgccagtggggggaaaaaacgagaaagcacaacttgtcttggattaaaaggagaaaaatcaatgcctactgaagactcatgcttgagaaagtaacatgtaaataaatactaggctcttcaggtaaagcaaaattcaaaaatattagtgagaaatagactgaagttagaataccttttttcactcacataataaagggccaacagcacacacatgtacacatacaatgctagagtgtctacttctgtgcatatttatcttcaaaatggccagcttataatattgtataaaggttacctgtttcacagtacaaatatacacaacagagtacaagcatgcacaacaacctcactactttgccatgtaatattttaccacaaatagttataaaacattaattcctttttggtttcttttgttgttgttgttggttgtttattttttttttggtgggaacatggatggagctgggggccattatccttagcaaactaatgcaggaacagaaaaccaaatactgcatgttctcacttttaagtgggagctaagtgataagaactcatggatacaaagagaaacaacagacactgaggcctacttgagggtggaggctgggaggagggaaaggagaaaaaataactattgggtactaggcttagtacctggatgatgaaataatctgtacaacaaactgccgtgacacaagtttacttgtgtaacaaacttgcacatgcacccctgaacctaaactaaaagttaaaaaaatcattaattcctagggaaaaaagatgaaaaagagttcagatagtgattgcacattttgtaatggtggaagttccttttgtaaaggaatttaggaacattgatgaatgttgaatgaaagtaatttttatctgatgtcctgataccactgataataagtgacaatgattttgaaaattaaacagaatgtaagagtcccaactcaggaatctccttcacatttgtcattatatcttatctttgatgagtgaactctttaaaaaaataaagattagctgccaataatactgataatataaataccaattattgagcacccattgtgagccaggccctgttgtatactcttttcaattattagtcaacagattcacaaaatgaattggcattgtattgacattttacagatgaagaaacagatacacagagcaggtagagaacttgcctatgcacatgtagctagtccactgttaattaccaggtatgaaccaggccatagagatgaaaatgaatagaatgtattattgaatcttcccaaaatagaaaaaaaaaaacacagctactgatctttattacaaaaagtgggaaaaaacagagttcttaactgctactccagaacccttgtcagtacccttatctgaaggtgaaagaatacacatacacacacacgcatgcaagcacacacacacgcatggacgcacatacacatacacgcatgcgtgcacatacacatacacgcatgcctgcacacacacacacacacacgcatgcatgcacatacacacacaagcaaatgatatttagaagatctcttaaacaggcccactgaaatgcctcaaagactacctaatgctttcccttttctttctaaaatgttattaactcatatcaacactactaaatactgctaatattccactttttggtatgcctatgttactgtgcacctgacagttaagtgaggtacttaaaaagaaaactatttgtttccaaaattattcacgttatttgtaattaatatacaaatacatcatttaattaaatattacatgaacttatgaaataacagtgttcaaagaagctgtcatttgtatgaaaaccaaaggtgaatgctttgcaagacttgataaataagttgctaaaagaatttttcccaaattagatatgagcaagacaactgtgaaaagctgcaaaagaaatcttaaaaatccagaaggattctgtacttggtttactttgtatgtatcactgaattggcactctaacgaaatcaaaagtagaaattatgtgatacactacagatgggtttatgggagagagacagcacaaacccccaaacttgggccttcagacaaagaaaggctttggccctacataagagtgttgccaactaaatatgtatttgctctaaacttaataggcttagggaggcatcgtgtatgtataaactatacatacatacatacatatgtgtttatacatacacaatgcctataatgattcttcacttaatttttcaaatttctcatcaagtattggtcttaattgttccttttaagagtgcttctgtaagtattaaatctaacttatatattccattaatttgtaatttaattgcgtgtccaatgtacagcagtaacaatcagaatcttcacaaaggccagtgccattttgtaaaatctttttaaaggattaattcagttatgttataattaagtataaacatcgatatgaatactttcaagtctccagttcatattactatatgtcaagtggagaattaatttttttttaatttggtaaactagtagtttagatagcttcagtgtaggtagtccctaaaaatatctgggtagactgtgaaattgtctcatatgccttgataatttcagtttttaaaaggagtagcttaatatttctattttctgttcttttactcagacattattattattattattattattattattttttattattattattttacaaattgtatttagtatgtgtttttgaaacacaaaactggcatgctggtgtatctggtgaatttactattaagcccaggtctgcaccagatgggcaggtgaaaatgtgattatgaggtgtgtggcgttatatccatctctgtaatacttgactctccaggtgacttgtacgtctgttacattcatgaattcactttacggttattcttacagatactgaaagaagcaaccttacaccacgcaaggtctatggaaaacaaaaacttccctcctttaacacaatcacaataaatgtttcataacaaccagataaatagaaacatgtcagcattttccccggcaggttcagaagtttgatgctgaaatactggtttgcacatctagaccaagactaaagtgagtttgctatttcaaaggaaaatgcaaattgaggcttaggctgcacctttctgtatcactgttttggtaagtccacatggggcagacaaagccaaacaccagctaggtggtagaattccccaaatattcatctgtgctgaaaccttcaaaagtcaggtgcctggagagctcatttaatgaaagggttatctctgccaaccagtcagtagttgatatttttttcaccagaagttgtgaaatattatttatgtatgtagaagacaggggcttcctgccgttgttgtttacttgtgtgtttgggcaagtttcctcctttccagaaagcaagttttccataaaagcaactttgcaatggccctactccttttgtttgataccccaggcaaaaagcttttcatggtattgaaataattttcatttaaaaacagggagctcagatgaaccagtcctttattaaaaaaaaaaaaaaaagcagtaaggtatccttggttaactttttagttatttaaaagtagcttgttgaagattgaatatttctatgtttcactagagcctttaaatataaaagagatatgagactatatctgacaccatcaggcatattatattaaaatttatgaacaacttcatcaaaaaccactttccctctcctgcatagagacagatttgctctgacataaacgttacatggctggttgcagcctcagattaatgcgaagaccctggcgattccttttagacgttattttatgaaataatacctgtcagctgctgcctgatcctagaaaagggggcaggttttccaggtcatcttaccatctgtcagctaaagctcatctgtccctccacattaccacctgatctgtgctaacaggcctcacggggaggcctgcttcattggcccagtgggaaccagggaaagagactgtgagaggacatcacctgtgatgctgagatttaattatcgctgaagtgatgaagatgtgcacacagattgaaatgcttttgaataaattcatggagcaggagatgctctgccccactctccgcttccccctcccttccttttctccctctttagccccaactcccagccaagtgtgcttcctagttccaacacaaagcttgcagatccccccaccgtggatatttccaagtacacccttggaaaacacatgcacacacacacacacacacacacacacacacacacgtgcaaagagagaaatacacttgctaaggtaccaacccaaagggagggaacaatccttgtactccggggaaaatttgcctccgctttttacagcaaccctgattattttctgccaaagttccttgttatcaaattttaaagccgtattgattgttgctggcttgaaaatcagatttcattgtgggaccagctttttacctagggttttactcagtttgtggtaacaccagcacagagttacctggggtctcctgtggagagttaatgtgaaagttcacagtggaggtggaagcgcggtagaatataaaaggtaaagaagggcatagaaagtccctggaaacccctgtgactgtgggctccctcacgttctctgaatcaataccctgcacaaaagttattacaggtccaggcctttttgctttcaaagctgcttaggcagtatgtggcattaattccctcctgtacaaaaatgtagttgataatcacctggctgaggaaaggatttaaggctagaacagcagatttcctcacagattacagaataaaacctagtttcttgggataaatcaggataattaactgtagtgaagtatgttacccttgttgattcatgtccatgtgatacctttgttagatgcaaccacagagaaacatttatgccattatgtgaggcgagatctgatttctaccaaagcatgctatgcagcacaatacaagtttttattttcttggttttggggagcctgccttcagtctggaggccagttattaagcaagcacttaactcaattgattcctaattataaagttacaagagaaaatgatacactaccaccagtcccctttcctgccaccttttgagcaaagttgcatggccctgaactgctcttgactctgtggctgtcagaagttacagaatttccttcccaccatcacttgcagagcaggatacccctttccctgagaaggaagacttggaacagccgaagaagacccaagggttttttctagcacagtggtaaactgaaattgtatatttcctttttctttttaagggaaatcatgagcaaacattgccttaattcacatttcaaaaatgattactacagatttcaagacatttatcatgttgtcattggaacctgggaaaggttattcttgtggtacttcaggtcacaaaaaagaacgtattattagaaactaacacataggctatccaagagattcctgaggggaaattagaggtccactggctttgacaaaaaaaacaaaaaaaggtgacaggaatgaattaggtaacagggacccacagaaacttatcatgctctgaatggtcagtttccaaagtaactccaatctattacatgatacagttcttgtgagaacacaccggaaatatacttacagtccctgttatacttttccaaatacttactacttttattctctgcaatggcatggatttttatgaagctgccattttccaataattttagagaaatgttaaatgtaaataagtatataatagaaaatattttaaaaagaaatattatcctgccaagtcttttgtcatttgatccacatcatcaactttcagaaatatattatttgtaaaaatatgtattgaaattatatcttctgaaagacttatatgtcatctattttttcaacagatgtagatttaaaatcctatacatacaattgagtgttaaatcctacctatatgatgtggcatgttcaagtaatgagtgtatctccacaatatatccccttagctcacagcaacacttacatatatactctactcatagaagacaaatgagatttattttggatagctttggatgagtgtggctgtttcagcagcttgaagtaatgctatgaaatcagcaagtgaagtagagatggatgaggtattgaagaaacataaacagaaaattaatgaatctgctgagagttttttgttttgggtttttgggagtatagaaaaaattctgtacagtacatatgtctctaatgatataatcttgacctttgggtgactggtctagttttcaacaaaagtcattatctttggagaattgttcagtaattagaaactttttttcaaactaactcattgtagatgtgcatctcaagacagaaatctccatagataaaaaaaacctcatagtcaatcttaaaaatacagagtatatgttaagtgtgtgtaaaggagaagaagagggagaggagaaggatgattttcagatacatcttagctttttcccctcttttataaaatacattgtttacaaagagatgatttaaagccttttattctaaaggtttctgtccctgttttcagttttggattgctgaaattgaagaaaaataaagttaaacctagacagctcaaagatctacccagccaaagctagcttcctctctcttttgcctagattataagatttagattattataaattttataatccagggactatcattgttaatattgcattttatgcattaagtgctaggtcttatatcaccaataataatttgtccactagatagacatcattattaatattattaagaagaatgctagttatccataatttatcttttagaaaatctctctagataatttacaagaaatcttatgttattacttaattgttacttaagaaatctaaagtgagctgggcacggtggctcatgcctgtaatcccaccactttgggaggcgaaggtgggtggatcatgaagtcaggagatcaagacgatcctgaccaacatggtgaaaccccatctctactaaaaacacaaaattagccaggcctggtgctgcgcacctgtatcccagctacttgggaggctgaggcaggagaatggcttgaagcttggaggcagagtttgcagtgagccgattgtgccactgcactccaacctgggtgacagagcgagactctgtctaaaaaaaaaaaaaaaaaaaaaaaaaaaagtgaaatttggaggaaggacattaaggtgtctttcacaggactgtcttccccgttgggacataattaaaacagaaacacttcaaattgctattaccgtacagccgatctgactgtaggaagagcaatctactgaaaatatctactcggcaagcaatacttctcagtaaacatttgtcagcattggcattcttatgagctggaggatggaacccccaacagggccatgtccatcctgcttctgtggtttaggaagacagcaaatattaagtgtttttctaaaaactccacccttttctaaagcaaggctattaattattggtgcatatacacagtgatcactaaataagcctacaatacatacaatgacaacttaattagggcttttcaaatggacttctttgctcatccagtgcgacacacacttaacttccatacaactttaagctacaacctcattaccattctgcataaactaattgactcttagcgatgaaagcagccacaaatatgctagtctgtgaaagagagggagatgtccaaggtgactcaagagctagtgacagccaagacaagaacacaaatgactctctcccttgttggaaagttgtaaaaaaagaagactgcaaaattgtggacataagaaagactaatgagaccatggcaagaataattgttaacagtgcaagcatggtttccaagagaccttgactctacattacagatgccttataccctctgtaagtcaccaacccagagggatcttttaatggtgataatgataaagagaaattctgtcaacctctcacattccaaatggccactttaatgactagtactgtcttctacctgcggaaaacaacagaaattaaaatatgaagactttcccaggttagggaagccatgtttcaggaataggcatctttttttaaatcctagttgaggacttatggtaaagtacaaagaatcatcccatacacttcaatgtcagttgtatttcacattttgaaatgcttgttagagttaaggagactggagaaatcctaggttacatgataaaatgagttttcagagagcaatgagacagtttattgatcagctgattatcttgctatgtcttatgaggaggagaaaaaagattccaagactccagcctgtatcatattttcaagaaaaaaatttgaaagtggtcgaaatttaccattcagaggatacagtgaagaaggcaaggagcaagaaagattgctatgcttagtctgaaagacactgtctttctggatcacctactaccacatttagcaaccaaaccaaacataaataataaaaattcaaagcacatagattataaaacgtgaataatataataattttaaaaatgatagttgtttacattaaaggagcttaaaatttattgaggaacagtcattactatataagaatatcaaagaggaattaaatcagattgtgggaggggagcatttcagcttgactttaaataattgagtagatattcaacaagcaaggaggtgagagagatttcaagtgagaatgagtgatgtcccaagtcaatagaaatgttccagcccctcttatatttctgacctagaactaagaattctctggtgaataaaacaaagtcgatgacttcatggtgtttgtggtctaaatcaaaagaaggatactaagcaaataattaaatattcacacatttgcagagagctgttcaagaagagtacaaagtacaatgggaacacacacatagttacctatagaagatgttcttgtgatataaaaagcaaaggaacataattagtgttaaaggctgtctccagcagtatctagtctagagggtgaaggaagactctcctaaggaagagacttttaggaaaaggagaacaagtaaccatgcatgagtgaaaagagaatctaaaaggtttacagatagaaaaagtatctcattcagtggccctgtggcaggagaaagcatggcatatttgaagagctagaagaggtctggaaaaagagaatgagaaagacagaaaggcataaggcctgtgaggtagacagaaacgtaatacaggtccctgtcagctatactaaacatgtttcacttttatctatgaacagtgagatgctattgatggttttggcaagcagagacaaggtgagttggtcctggtgtgcagggtacagaagtcaggtgtactggcagatgaagatgatgctagtcaaaatcagaaccagaactcaaaaatcccaggaaacacaagtacttccttcatactgcattaatcgatattgtggaactgttggtctttgtcactacaccctagacactgtcagcttctgagcaaatttctctcttaaaattttaccacaaatcaagatactttactgatgttctcatcaaaaacgaggtaaaaggattctgtgtttttagttttttttctgagtctattttattccgctgtgtttgggagcaacagaaagaaactaaacatttatattattgcttctgtacttccagaaaattcttccatttcaacagagtaagaacgttattagtaatatcagaatttcatgaagcaaaccatagcatcttctctgtgccataactacattttcaataacataccaaagagtgtaaactgatggccagcttaactcaggaatacagcatcacctgttaagggttttaataagcaatgagtcccccagtcaagtggtccccagagaccaacaatttaatgatgctatgacagaccaagtaaagtgtttggttcaataataaggagcttattgtgtgcgtgtgtgttttttaagtacgctccatataaatattccaaagaaaaagggatttaagtttttttttttttttaatctaaacgggtatctccagcttcctgaatggtttcatgaacttcatgctaaggaaaactatcctaggaaataactatccattggaatatctgtcgctcatctagatgcacattgaggtccaaatggctcaagcatattcagtcaaggagatgaagcatctcaatacccaggacctttcccaggagcacactggagtgcatttaacaattgtgattgtaggaatatgtatatagctctttgaagtctgtgaagattatttatatgaattatctcaatatttctaacctgcaacagtaaaggcgatgaggtatagtgaggcaatgactcacctaaagttagagatggaggaagaggaagaattctggaaaagtctttgacatttctttttgaaaatagagttctcctcctccacattatttcctaatttttcagtgctgcaaagagaaaaagtccacagactcctctttgccagttcaagggcaacctatgtacagatggaagtagatccagattcatggcaagagaatacaactggggtcagaagacataaatccctaaacatagtttggatgattatttcatctcaatgaagtagttgtgaagatcactgatttatgtgaacaataatgataaataagaatgacaagaaagacaaatatggacaataataatatgagatatgtatgtgtgtgtgtgtgtgtgtgtgtgtgtgtgtatatatatatctccaaccttagtttcatgtgataaatgtgtgactagtacttacatttctggtcatttgttttgcatgaacaattttttatgtaattttaaaaattgcttattaaaaaattgctaaatctcttagattctaaaggaagagaatataaagttgatgtattagagatactgtgtggaaacaattaatatgttaaaatattggcaaaaaaaaacgaagaagaaataaaatataaccctagcatttttacttgcagtcttctcatttttgcttaacttttttcataaatagcaatttaacaaaacctaacactttaatgtgacaaaaccaaacactttaagaaaaactgagctctacagtgtactatacctgataaggtgctggatgtcaccaacatcattaatttccactgagctgaaatttctctaacatgcaggtctatctcacaatgtttcatcttcatttagaatatttggagtagtcctctttaattatttgaaatgtatatagatagattcatatcttcaatgaattgattataaaaattctcaaagaaagcaagaaattatttttctgagtaactggatgaaatctgtaacctgagtgtagactctcatcattaactcctctctgccttgaaatgttttctttctgcttttactgaactcttaaatctgctttttaaaagtttcactattgtacaaaagtcccataactatgagtcatctttatttcatcctcccacttagcaaatgtaagagcaagaatcagatttcatactcctcagcctaagcagttagactccaaggtggactcaagaggtgctggggaaggcaattctgttttgtgatttaggcaaagttaatgtaccacctcagttatgggttaaatgtcaattgccataaactctaagagaattaaagtttcctagaattttgtatcctctaccattgcttaaactcagcagcccagctggggttttggaagctttcagctttgagcttttgtagttgctaactccgcttgttgtaaatgcaaacctgtatttccatctgcagtgttgttgatttcctccagaaaacactgaggcacactcagttcataggcacagatgactgggttaagagcttcctccaagcataatgctgtatatgattgaatgtaaacgaccaactctgatcatcacccacacagtggaatggaaataagagttgccgaatgatcctgaattttctggttcataaacaaacagaaaataacaaacctaatatattgagttttatgtgcagtttggccatgaaacaaactttcttccccttgcaatgtttaatgagaagcatccctctcattgcactttcactttagatttaaacttccctatctcaaataatcaattgtttataataaatgaaaaaaatcctcatttttttttttgaaatggtttctggcatctaattacggaggatttttgacctggctagacagataatgttaacacagcttcaatactaaacaagcctgaacatgtgtgtgcttgacttttattaaactcctactgaagaaacagattaattggaggctgattcactggtgaacaggcgttaaagacagaaggaccttctcacattttgttctgttatccaggcttatgccatctcaggttggcaaggagatcccaactgtagtgttttgaaatataactgaaagaaattgtagaataacaggtgcaaaaaaaatgcaaaccacttataaaaagttgatctcattcctttctttttctgttgccaactggccacctgacactttatggactgaggtactgcccagataacatttcacataataatataatgtggaggctgactatggaggtttgcagctgtcgtaattatcccttatacaattattacttttttttttatcctttgagacattttttctttagaagaagaggggtacaagctgtaagtaaaccatttcacttaggctcaaagagcactgaggcaaaaaaataaaaaaaaatgcccttcttggcagctttgcttctatctaaaaaagctggaattttattccctgaggtttcttttgttgtttaatggtttatgttccataagataagcaaagcaaaataataataataacgataatgataaagcaacaaggaactaagttgctggtgagttggaaaagggccttgtaatgtatttgtggagaacattacgatttacagggttttcccacgtattatctcattcataatatctctgtgaaataggtgccaccagatttttacagctgggaaaaaagcctcttaaaaaggttaagagacttcctacagtcgttcacagagtaagttaggcaaccagaactccaacccagaccatctgactccgggtctgcctagggcttttctaggaatgtgcccctctggaaagcccctcaagccttctggatctgatccttttcctctatcagataaggacattggtgggaagatgatcttgaaatctccttccaacttcaaaatgtgatgttgaaatgtgattataaactactacaattataaaaataagcaacagattagtcaacaaatatctgttgcaatttgactccaggcaagggtgatctgttcagatcctcaaagtcacatcagcacacacccaagtctagttcatatcactaggtggttctgtgaactggttgttttttgacaaagctccattagtatcatcattttcttctgtgtaaatacatctctgcaagccattaatataaacaatgagatgaatgtctgagtttaaggatttcagtgttatatttttttaagtctcaactgttagaaattaaatgttacaatagaaatttgggtgggttacagattttatcatattttaaggaatttaggcttaaaataaggagaaaatacaatttgttgaaagtgaatgattgaacttttaggtggtggctctacaggaggagtttgcacttcaaactactttatttgtaaatagggtaaaattcatttactttaaagaagcaagaaagaagagttatctagttgtttgtttactgagaccctgtatcttttcaccagagttttgaggtagtctataacttacatttttgtaattaagtgccctgagatcacctggtgaattatgagctatcacataaaaatatgcaagtgccatgcaaatcctcatatccattcacttcaaggtaggatacacatgcaaaattgaaatggacctatactagatatacagataaccaaatacgaagggaggcctttattttcagtaattacctttaggaaatacgttgactgtgctgtctacctttaacttatggatagggtgttccgtccttcttatttaaattttatgctggatgacaaatagttaagatgacatatagtagagaaaattgcagggtattgtttagtctcaattctccccctataggggagttgagtagacttttctatatatgttttcaacagctgattggggacttattgatttttgagtacatttcagtgtagaatgaaagtccgagaactcagtgaactttttcatctctccacattccaagcctggtaaaaccattccgcctgctaaatgatgttataaatatcaagattagtttcttctgaaatcaccagcgccaggtgcattccatttctcatgtcatataatattctgttaccagtgttcacagtttaagatttaaagaatgtgtagacaaaaaaaagagtaaggacacataaatgtgacaactatttacatatcctatataagatatgctggaaagcaggattaataatttctttttagttttgtctttgttttgtttaggtggggtaggatgaatggaggtagaaataaatatttataaattagctattatctctatcataaatagatagaaaaatttaaatatattacttgcaaaaccaatgttattgtattttgttagctgcacttccaatgcataaaaatctcagcactcaagatgtccccataaaatctttcactaaacctttgttttaaagtatttgaaaggacatcattccatgtgggaatattacatacagccactgattcaacagtaactgagaacttatgtacaaaacattctttacatattgacaaatatttctaaaaaatgaattggtattttttgttgttgagtgtttcatgagtgacctttacctctgtagacatatgcagttttcagttttttgggtgagactttcaaaatatttttttagagtgttcaatgttagcagtgacatttttacagtgatttcagagccttgtagtttagaatattctatttgctttatttctaattacttataccatcctcgttttaaatcctgtgcagatgtaattgacagtgatgatatacaatatgtatgaaatgagctttttcctatcggtggtgtgtgtcatgcaagactccattgcaatatttacagttaaactaaactttttagaacgagcaaaattgcatttgttttgcagatttgctcatcattaaatgtgaaacatttcacatttgtctttttgagtaattggctttttaaaatgataaggtgctctgaacacttgttatgtggataggtctgacgttgtatcccagaaatccatatgccatacagacagaacagaagaaagatattcacaagcatgtcacagattggactaaagcaagccaaaaacccaagtgccatggcattaacaatagcaccagatttactgtcacgatcacaatctgtgctgcatcacagacagaaggagaacttttgataggtaacacctcagtgtttttttaatctttttggcaaattatcatttatcattatatttttgcctgccatataatattattacaatgatataaaaaatgcaggatacgtttattaagccccaacaaaagaactgacttattcagtcaggccatgtaggattaaagagagaatgagaggcacagatattctgttgttttattacagatcaaactaaagttggaaaaatagacaacagcaaaggtactagggaagatttagcttcttctgagttcgcaaaaggaaatggcttattagtgacagagaaaacaaaagaattaacctgcttgggaacttgaaaactctgatgtttccaaaatatgtggttccccaggataaaaactcacagctaattttattttctaaattggaagggggggtgggtggggactattttgagatgtgaaactgtccaatcctttctgctctgtgtgcgtttccccatgatgcagatatgaagagaccacaattcacaggatgtcccaataggtactaaaaaaagatttacaaaatcacagcttgagaaagagcctcatgttgggctgattgaaggaaaaaccccagaaacactgcacagagattcctggcatctaatagagtagagaaacatcagtcgattgtttttcttaattgaaggtcactttgggacttcgatgaaaattttttttcacctgttagctgtctacctggctaaggacatttctagaggacaacctatatttttcttatagaagaatatattcttaagtcatctggttttgttaatttcaaatattaaaacctagtttctcaaagatttaaaaggattcaagtaaaacctttaaaagtaattagtaaaatgctaagctatacaagtatagctatgtggaaacaaaggaatatcaatccataagttaattttaaattcagttggctgaaatattatatattctaaagtaaatctagtttatatcattttcaaaccatatttttccaccaaaattgtaattattttttattttttttctttttagccttgaaaccaataagaccgtttgatttctagtcttgtattaatttggagacctgggtatattattttctttcaacactccacttgccaatgcctgtcttccttaaagctctgaggatttatttactgtggaccacttccagttcacatgcctcactttcatgggacttaatatatttcttctaattttcaaactccatcaactcaatttaacttatttttcactaactcagagatagattaagtattgtgatggttagaaagaggcacataatagttactattttcaaaaatacatatgtattactagggatcaaattagaaaaaaaaatacaacccaaaacaaaaacacaaccaatttcttaaactgtttttaaaaattgcataatacataataatggagaaggcatgcccagcaatggaagaaatatatgcgtgagatatgaaaacagaccagaaaaagactggagtttcagcagtcaagggaagagtgcatgtgtatacgtgtatttttctgtgtgtgtgtaattttaaatacaattatttaaattttgtaaaataatcgttctataaaatcactcaatccctttgattgttgagtttctattatgagtatatgaagctaacataaacagcacttaaattttcaccagagacaactatccatgcaagactctcgggagctgcacacttggtaccaggatgtaattttttttttttaaagaaaaggaaggggagccacattactcaagacatattcaagtgagagtagattgcaatttctctagtttaaatggaaaatccccataatgttaatatttactggctttggagttgttgagaaacatgatgtagctatgatattaaagttattaaatattcagttgttaaaaggaagggagtccaaagacaacatggtggcaaattttggcatcagtaggggttagaatatactgatgattctgaaccttgaaggacaagggaaacataagtgatcatatactgcaggcaaaggagatggagaaaacaagaatgatagagttcaagaacaagaattggtaaagacaatgatagtggcaatgatagaattatgaaagtccggaaggcaaaacattctatggaagaaatttgtattgaagaagtaaaatttgatagagaccctaagatatgtatagaatataaatgaataaattgacagaaacagatgggatcaaattatagcctgaaaatgttgtatgtatcatttaatctaatacaaaaatttatattttttcaggagcatgtttatcacctaaagcatgggtacttctaatttaaaataagtatctgatactgcatgtgtgggtttcctttaggttagtattagttgattaatatttgatttaaacagtctttgttcagcttaaataagatgtaaactatgaagtcatgtttgatttagtcattcagcagcaaacacttatgaattcctaccaggtgcctgacacaagctctagggatggttctgagaagctctggcatagagcaaccaaaggaagatgagtgcctcatcaggcaacagcattaaggaaaattggtgaattgcattgagtttataaaataagaaaaagtaaataacgggactcgtgatcatgctcttaaaattaatgaaaattattattacttaggtagtggtgagaacttacacattaaaacagagacagatgatattggcatacgcagtatgatgtttctcaaagcctgcctgagatgaaacccatattatcaaaatttacaacttctacatgaaaacaatctgtaggttagatttttctctctttgcagtgattccaaagtatgaaaataataggtgaaaaatcaaggtgaactttacaatgacagagttaacccttgctaaataatttgtaatgcaaataaatctttttatcaaattctatatcaatttaatgtgtgataggagaaagcattttatgaagtatattaagtaagtttgatgttataatgtataccttcctatagcaaaacaaataaataaatgcttataagccaggtgttttttttttctgcttttgcttttgctttatttgttttgtatcgtggccttaatcaaattttgcttatcattttgtgttttttatttttttgatttcccctcttatgagaattcattattcttacggttatccttgtacattttagtacttgtttcatcaacttcagtaaaatttactccctttataaaacataaaaaatttgtgctccccttttcacattgtcataaactacatatagatttattagttatattttttgtcaagttgactatatattttcttctgtcactctaattctcagtaagttttagcttaaggagtgtccctcattttatataacaactttctcacttgaagatgtttttaactgttttgattattgattggttggaatcaaatgtattacgagactcacattgtccaaggccatctttttgggtgcctttgtgtgtgaacatacacttgactacatacaaagtgcttgggtaatgcttcatttctaccaggaccctagactttctccatcgtttcttgcataagaatattgacataaagaagtctgaagtcagcatgttttgctctaataagtgacttcatatttctgccttgaggtccacaggacttttttctttgtccataaagtctggtaatgctgcaagatcatattttaggattttaattctgtggcattttttcctagaacacttacatcttatctacttgtaaattcaggtttttctctatttcaggggagttttcatctgtcagatctttgaatatttttctgtttcattttatttcaattttctttttcaattgtaccaatgatgagcatcttacatgtcttttgttgttttctcatatctattggctttcataaatggatgtacctcagttaataattttttactagtttgtattttgatcgtagaattttcaccacatgcccatattttgtaagctaatgttgttcaattttaagagtttataattctagttttaaagtcttttttaccaaaatattctttagaagagtgtttgtttatatgctatgacttccaagagaatggattcttttcagctatactatttgcttttaatttctaattgtaggacatcatagttaagaggtgtggctttggtggatcattgatactgtctttgtgtcttaagctacagttaatattttaaaatattcttctttatgatatgtgtagacaattgtgtttacatcattgtgttctttaaatccccatgttcctactttgtcaatctgtcaatttaagtttgtcactttttccatttatttgtcaatatatgttcaaatttatccttgtatttctgaccatttttgctttatatactttatttaatcaggcattattttattttctcacataaaatgcattttaccaagatagactacttctatggtagcactaggcatcataatacatgaatttcatattctcagtgtcttagcacaaagtttatttcttgatcatatcatagttcattgagtgtgttctctgtaaggcaatgaacaccatggtcatttagggactcaggtttctcccatcttatggttccatcttctattagtttctgagagtcctctccattcagctaaaggaaaaggaaaggggatgaaagttgtacaggagaacatcaaagggccaggtctggaagtggtggatttactgtccgtattctgttaagcatacataactacaagggaggcttagaaatggagtctagctgagttcctacatggaggaaaaaaatctggtgaaaaatagaaatatttgggctaccatttattcatgcttatccctattatatcttttgttttctgaatattgaaagtttatttcacattttttataacatttcaggagtatacatttgcatccttcattttaagcttcattgttttcttagtttaatctcttgtgaatagtgtattgatagatatctctctctctcttaactcagcctcataagctctattcattaatgggaaaatataacccattcatattttttaagatgaagtgtttaatatttctgtgattttattttatgctaattgttaaaccgtaagtagtcatcatttcctttcctattttctacctttagaaaatgtaatgactttttgggatctattttcatctatgtagtggtttagaaatatcattcactgaatgaatcaagattctgagcatgctttttcactcctcagtggaaatgaaaacaacagcaacaacaacaaaccaaataccctgggatgttcttcatgtagatattggttttttgttgctttgatggaaatgtgacaggagagtaggactaatgtttgtgttcactctaccagtaggattaaatccaatattctcttcaaaatctttgatttcattttttttattttgtgtattttaccctacctgtcattgtacctattctatttcttgcatttttagtgtattttaatttttggtataatttttcttgtaatactgaattcttttgggctctcagtatgctcgttttatatttttgccaaattatcttttcctttaccatttgcatttattcttgtatatttgtttcagtaggtccaagttttcctagaaaaaattgtgtgtgacattttctcctgttttctggaataatttttcttctggtgtgggtttttaaagtctgacttctgtgtgtgtatatatatatatatatatatatatatatatatatatatatatatcctttttcctctcactcttttctgaggaagtaaaagcaagagttgtaatgtctgtgcctgtgcctgagccccacacagaatgctctctgttcattaatcttggtatagaaagggttgatttcaatttcaaactatttaatctgaagaaagttgtgaatttttctttggacagtctctctccctctctcccttcctcccttcttcctcctccttttcttctctcttttcatattcttaatctgcaaactacttttaatagattttttctataaaaatctataaaatttttatataatttttttatataaattttgtgcgcttttctatatctggacttcttttccttcctcactgaaactctggaccacactattaagatctcttccagctttaggctgcatatatctaagcctactactatctttgagaacatgttatgaaatattacaaattatttcacatctaaaagttgagattagattaagaatttcctaacatctgctgtcttagaactcccccactcattatgctaatagttctcatatcatttttgccaaaggtgatttcaaacagattaaaaactccacagacattacttatactcttgaaatacatcagtattgtgtatgtgttcaagtacttctattatgtaaataattgcaaaaaagtaaaatatcttctttaaatatagatgatatttgaagcatttgattagaatgtatacatatctaaaacattcattttttaattttcataaattagaaaatatcaaacttcagtataattaaattaatattttaaccattcagctaataaaattttctgtggtttgggaaggaagaatgatagcttaaattaattccctttgttattttgagattttttgttcatttgggactatagataaaagaagataatgttctcttcctttaaagcttggattgaagggtgtatcttacatgtattataaacaatataaaatattctgataatgacattgtttaattatgagtgtttgacatagaaagcaatgatctctgacactttttattttttcagaataaattgaaaatatattacctggctacctaaccaggtgccaccatgttaagcaattttattatagtttcagagaaaagctagcctatgtaaagcatgttctttgaagatacaagtctaacacattgacacatatatcatacacccacacctaccaatagaaaacaacaacaacacaacaacctcattaaaattaatgaggcaaatggtgctatttttgatgggacactaatgagagaatcttttttttttaaccaaatagaatcttattaatttatgtcagaaacagaagtggagacacagtcatattagaagtgttaattccgcaagggaatatctccaatggtcctttaactgggcttaaccacttatttaatcaaacttatttagcttcatgttaacgttacatgatttaagatcattcctatatcatagtataagctctctgaaaaaatgttattattcacctatatacccccagtacaaagaataatacagtcatgcactgcataacaatgttttgatcaatgacagctcatatatgtggtggcagttccgtaggaatataatacagtatttttaccataccatttctatgcttaaatatattgagatacacaaatacttaccattatgctacaattgcctgtagtgttcagtacagtaatatgctagactagtttatagcctacaagcaataggctataccatgtagcctaagtgtgtggtaggctataccatctaggtttgtgtaagtgtacactctatgatattcccacaatgacaaaattgtgtaatggtgcatttctcagaatgtatccctgtcattaagtgatgtgtgactgtactttgaatgctgtaggagcaccctttcttcccctattctaaaataaaaatatattttgtttcacttttatagtttttgaatgtaaaaaaaattaaataaaactgagatgttgatcttttaaattgaaccaaaaatctttctgaaaccagtgttggtacacatcattttgaagggtactatataaataaataaaaataaaatcaaattttaattaaattttattataccaacatattaaaagtaatggtgaattccattataaaatggtatattccttgtaatgtgaacatctgttatttgtcttgatgacaaataagatgtcatcatcacatcacatgaagatccatgtgatgtttcatcaactactgatgtggacacatgtgcatagtaacaaattcatctttgagatgaatgtaaaaaatgtgcttaatatgcttattaattgacaccaggctacgtgattgtctatcacaatacacccacttttatgtcagcattttctcatatttgagatagaatacctatagtctatcctggaggggaagaaagcatgcaaaaatgcatgaacattcattctgcaaatacttagttgagcgcctactttgcatcacagagtggtatacatatgtgtcgagcattaagatatgtactgagaaatagcagttaacatacagaaaaggactctgctcccatggagtttatatcctaatttaatgagactggaaatgggcagaaaaataaaatatgtagtgtatatgtgttgctatgacaacaagaaaattaaaacagagagcagatactggaaatttaaatagggtggccagagaaggcctcagaaaggtgacatttgagtaaaatctgaaggaggtgaaggttttttttttttttttgaaaaagtatagttaggttttgttgatgacagggatttatatgatcatgatagcttcaatcagagtaaaataaaaaacgaaaatatcgtaggaggccaggcgtgatggctcacgcctgtaatctcagcactttggaaggccaaggcagacggatcacctgaggtcaggagttcacgaaccagcctgaccaacatggaaaaaccctgtctttattaaaaatataaaaattagcagggcatgacggcaggcacctgtgatcccagctactcgggagactgaggcaggaaaatcacttgaacctcagaagcaggggctgcagtgggccaagatcatgccactgcactccagcctgggcgacagagcgagactatctcaaaaaaacaaaagaagaaagaaaatatagtaggaaagggtacattaagatacttataaaactatatattttaaagaccatagcaggattcatattttaggaaccatggcctttagttctgtatttaataaatttaacagaaaattattctctaaatataagcatttaaagtaatcattaacttgctgtttggagatatgcacattaatcaattacttttctatcaaaacaaacaaagtttacatcattgtgacatggactttgcttccgttaacttctctattatagttaccatattgattactagttatttgtgtgttttgttattattctatagctttattgaatataaggaccctatgtgttcatctttttcttgtgtacaaaagcagagtaacgcatggcactcagtaataacttttgaataaattgattcattcattcaataaataagtattgacatactactgttttaagaactggagatacattggtaactaaaacagaaaaaatatctggattcatgaagtctacatgttagtggaaaaagtcaataaatcaaataagcaaaaatacatgtcaattaaaatctattataagaaaaatcgagaaagtaatagcaagtagtgagaaagtatatactctcttaccttttatacctcccagaggcagtgatattgaagatgaatcagaaagagagggaataatttgagtcaaggggattcctgaaagaggaaaccagaagtccaaaagctcaggtcttgctcaaaggcacagagcaagaggctgaggtttgagaggagaggggtcaatatgataggcaaatggtcaggtcacataaacctgtaaactgtgatcgagtgtttcaatttgaaccagtagtgtgtttgggccagagaagtgacatgattctgtttatatcttttaatgattgctctgtcagcttggtaatgaaattgagtgtaaagggttaggaacggaggcaggtggaacagttcggaagctctatgtcgtgtttttaagaggtggtccctgtgttgatctagagtagtagaaacaagggtgattaagaacaaaacggaaatggattaaatataatagtacgaagggaagcgtcattgaaaatatctggttggacttttcaaatacatgatttcttgtaaatgtattgatatatataatggtgatatttgaattgtatcactatttggtagcttttaacaaaaatttcagctatcaaagtgaaatatttatcagaatcaacctcaaattgttattgaggatgagtgctatcttttcacaggtttcttgtgaaaattacttttaattgtagtattaactggtaatttattattgcttctttaaattaaaaatcacctttttggggagttcttctaagaatttcttggtctttagtttttgtatttacttatggtatagctaggacggattttttaaaaatttatttatcctggttgaggtttgtagtgatttttgaatctgtggcttaatgtgtttcagcagctttgaaaagttctcagccattaggtttaaatacagcttctcctctctctcctcttttactgagaccccagttatacatctcaaaaccttttcttatatcttatgctgttttcacaattttccattcttttgtttctctgtgctccaggtatgcatgttttattctgacctattcagtttatttttctatgtttaatctactatcaaatttctcttaatttcaactattttcaggtctaaatttttattttattggttatttccaattagctgccaaaacttttcatcttacttatattttgaaaatattgtatctatatctggatcatctagatttattatggatccaatttcatcaaattctctatttgttgtcaattgtttattaaaaatctttttgaatcaagtgtaagacattacatattaaaaagtacagagataatttaagaatctggaggatgatattttattccagaaagaatgtgtttcttttccattttttgcaggccctttaggttaggagcagatcaccttaatccgagtagagatgatgtttattcaataccgggtttctgcctttgtgagggatggtatatttctggtttgctcttctgtttaaggcatagtccttcaggatcccaactgaatgcctcagggcccctttaccttggtagaatataaacggcaattttgtttctcaagccctgtgaggctgccatcaactctgataagcttctcagcctatcacctatagcttttaattaatttttattgattgattcagacagtcaatcaataacagctgtaataatagctcaccgtaatcttgtgaactctttcacttaagtgatcctcccacctgaacctcttgaataggttggactacagctgtaagccaccacaaccaactaatttattttttatgttttgtaaagatggggtcttactatgttgcccaggctgattctgaactcctgggctcaagcgatcctcccaccttgacctcccaaagtgttggtattacaggcatgagccacttcaaccagcgtactcatagcttttcaatgcagaatgcctcaggagaagaagcaagaccaaactgtgagctcatctgtccaggattccattctcttcaaaatcttggctcacatgttttctatgtgttgttagctcttgagtgccctagatggaaggtaggtagttgtgtgtgtgtgtgtgtgtgtgtgtgtgtgtgtgtgtgtgcgcgctctctggcagaaagttaatctgaagctagtcagccattgcctgaaacgttttgcttgatggaaaaaaatgacagaatacaaaatatttttagaggactattaatcaccttattgcatatatttaggaaacaaaaaatatatatgtatatgtatacttatatatgtaattaaatatttaaaaggtataaaaatcaaaataaccccaaagaaaatgtactaaaaaatttaataaagataaaagccaaaaacgaaatgatgaggcagcaaactaaaaatgaagcagatttgatcaataaaactgaaaagctgttcccttaaaaagaaacagtagtaacattgaaaatatttgacaattatagccaaaaagagcgaaaagaaattatactggagataagaaaatggctacaagtaagaaatgtcttacaaaaagtatttgcataaaactccattaataactcagaaaacatagataatattaattatttttaggaaaatttaagcctagaaaattaactcaagaaattgaaattttctcaatagaaaaaatttgaaaaataataaaatatctgtacctgaaagagcataaggaacattttttatagatgcatattaccaaaccttcaaagaccaagcactctccatgttatataaggtcttacacgtagaaatatgaaaaacaggcagggcatggtggctcacatctctaatcccaacactttggatggcgaaggcaggtggatcacttgaggtcaggagtttgagaccagcttggctaacatggtaaaaccctgtctcttgtaaaatacaaaagttagccgggcgtggtggcgcatgcctataatcccattacttgagaggctgaggcagaaccgctagaacctgggaggcagaggttgcagtgagtcaagatcacaccactgcactccagcccgggcaacagagcaagactctgtctcaagaaaaaagaaatatggaaaacatcccaatttatttatgagaattgaataaccagaaaacaaaatcaagcaaggatagcaccaaaaaggaaactaactgcaggctgatcatgatgatggtaggatttcaaaatacaatattagtaaccaaatcttgttgaccaagtgaaatacttatattcagagtgcaagtatctctaacaggatgaaatttgttttggtatatcctaactaagacacaataaagaagaaaaatcaagtgatcatctcattcattgtttaggaaaaaaaattgataaaattgaatacctgattttagagaatagtggaccacaatagaaatagattatcataggaaaaaatgacttatgtaaacaaattttaaaaccataaaatttaaaacctctttgtgactaaagatactacaaagaacataaaaaaaggattggcagatgaaaaaaatatatttgcaaggagggaaaatataagacagcacctcgaaatgcataagaaatatgccaatagataactaaaaaaaatttaaaggcaaataattaaaattttgaataagcttatagaaaaaaaagtttaactttactaagagtcagggaattgcagcctaaattgggacaccattctcacctatcatgttgataaatattaaaaagtaaaaagattaatcatgttccgttttaaaagaatgctggtgaaaggcattcttattcaagatgatgtctaggtgaaaggcaaagttatagcagcacaatttgtaattgcaaaaatgtggaaccaaaccaaatgcccattaatcaacgagtgggtaaagaaactgtggtatatatatacaatggaatactactaagccataaaaatgaatgaattaatggcatttgcagcaacctggatgagattggagactattattccaagtgaagtaactcccgaatggaaaaccagacatcgtatgttctcactcataagtgggagctaagatatgaggatgcagaggcataaaaatgacacaatggactttggggactcaaggggaaagggtgggaaggggctaaggcataaaagactacaaatcaggtgcagtgtatgctgcctgggtgatgggtacaccaacacctcacaaatcaccgctaaagaacttactcatgtaaccaaacaccacctgttccccaataacctatggaaataataattaaaaaaaaaaaaacctagatgatggattgttagttgcagcaaaccaccgtgacacatgtttacctatgtaacaaacatgcacatccttcacatgtaccctggaacttaaaataatttttaaaaaaacaaaaacaaagggtgaagttacttggtctcgtggcatataaaataatagtctgtattctccaagtctttcatttattctttcaataaatagcactttctctttgccaaactgaattaaaggtcctggggaccctgcaagccataaagaggcaaaattagagtttctgtcctcatagagtttgccttctaaggagaatccttgctggtttcactcgattgcagttggtctggtctccccgttgttctttgtcctctgttactctgtcatgcttgcctggattttgttgttgttgtcaatttgctttggtttgttttctagctggtatcaagctgctcccactgccaaagttggtaagccctttcttttgttttacttctgaggtcccttctttctccagcctcttggtcctgacctcaggttggagcttttagtgcatctgtaattgttctcacgggcacagcaacgcaaacacagtaacacaagccatttacagactgtcttagtcctaggcatagaccctgcctctgcccttgcttccctgcctgccacttcccccaccacccccccacccccacgcccccacgcccccacgcccccaacaccactccaccagaagcttaggatcaggcaacagatttctctcagcatactgtctcacctctaacccctcttgggatgggggtcaggactaccaattcgcttttcagggattctggcaggcgttttcactctaatagggattctgcgaagtctctgtggttgaggtgctcctttccttttttgcttcttagaagttgccattgaggtgaaaacttctttgaaaaagttggtctaagaggtattggagaatgtagtgcctgagtaagcagaaagattcaacctgggtctcggggggtcttaagtcaggtctctttatccccttctacataggatttaattgctgcagcctacaataatatgctcattacttgtcacattttctaattgcattttgtaatttatctgtgcctgatgatcacacctgtgcattatggagatataccacacatgcttatgcataggtgtgaacggttacacatactttcttctttctcctgccattcttttgaagagtttctcttatttcacaaaatgcactaggagaagagcatctgggggaagtaaaatgagaggggtggtttcagatacaccttgttctgtacttgtctgtacttaatatggataattagatactctttactaggtactttgccacagggttttcatggattgcatttaattgttgccacattcttatgcagtggctaccctttttaatctctacaggtgagacagaagcaccaagtagtgaaatgacttgtgcaggactgagcttgtgaatgacgggcacagatatgaccaaagtggtatctgccaagcccatatgtttcaacttgagcgatactgtctcttgctgttctgctacttttatgttctgcttctgcactcaaagttataggctttcattttgttagacattataaagatgtaaaagaaatttaagccatagtccaaaaattgagaatgccatatgatatatccaaatgtcataatattacatgactactaaaaagattgtttatgaagagtttatagtaacttgagaaaccaatttttggataaaggtaaaaacctggatccacaattggatgaaagtttctgcaactgctgatggagtagggtttcacctgccatcatctgtagaacaagaaactcaaactaataggaatagtatattttgggtacaataatactattttttattgtcagaaaatttgcatggctttggattagtaccctagtagcacctgttagcttagagtcaattgcagagactgtgtcctgtgagaaacacatgctacaggcccaacaacaggaagaggataaagggatagtggcctcactggagtcatcaggacagccccgtggtaaatgatgtgatagaaaaattctccccatctacttgtgctgagcctttcctttcttggagttgtagtttctcttttgctgagacacctgttgtcctcaagttcttctccaggcctctctcaaaattccatttcaaatacctaaggctaagtgtaaatattcaaatgaaactgtcaaaatttactaagagatataaataaaaccttgcaatagtgagacatactttcttttctgaggtggaagtcttactagttttaaattttttgttcgtcccaaattaatatagatataatatacaatcttatcaaattcccaataggatcttctggaggaagagaagaaatatttaaagttcacataaaagatttagggtccttcagatgatttctaagaattaaaatataaattggaaaaattacaaagaagtaatacctaaagcttacaatggaaaaattaaaaataacacatttatatgtaaataaggttgtcccatgaacaatgtggatttgaattgcaggggcccattaatatgagaggggtttttttcccaataaatacaggggtctctctgtatctgatgtttccacatctgcaaccaagagtgcagagggaaagagcagtattcacagaatatgaaacacctgatattgatggctgacttcttgtatcgaagatttgctttgggctaatggtgggactcaagtatgtgcaaattgtggtattcacagcagccctggaatcaagctcctttgaataccaagaaacaaaaataatttcattaaaagtgccattcaaaataaattggggaaaatttatgtggtaattgtcaccaaaatttaataaacttccttaaaactgcattccaatcttaaaaatactaaaacttaaaaatgtgtaagcacattagtaagaaattctaagaaaaaaaaaccacaaatgcctaattataaaagaaatgcaagcctaagaaaaaaggagtttcttataaaattcacaaagtatataatgtgttacttcagagaaaatatgaattgaaatgggcttatgctttaaattttggtgagataatacaacttggaacaaactttctagaaaatgattagtaatgcatttcagcagcctttcaaaattcttttatttgacctagtaattctatttctaacaatctcttctaagaaaaacaaatcagaaatcttaacaaaaagtcatgcttatgcagcgtgggtttatttaactaaattgtggaaaaataggaagacacttcaatttattaaagtaaatctctataacaaaatgttaggaagtcattaaacagatgctttcaaagaataatgccatggaaaagccttcatgatatgttaaaaaaaataataagatacgatattgtatatttaatttgacctatgtatgacctatatatatatatacaaacacatatatatgtatataaacataacatatgtattaaagagtctgaaggaaaatacattaaatactaagagggatattttgagtactatgattagaagtgtttttagtttttatacatttctggttttgcatattttaagtcttcgagtatgcatttatattcagaaatagtttgctttaatatattttcctaagaaaagtaacagcaatatctaaacaaaacagcaatatcattgaaaatgtatagaaaaatatcatcctttcacttaattgttttaaaggcttcatctaaaggaataacttaattaaaattccagaccttagacggcaggtttagggaattagtttgtcatccaaagaggcttcttaaggctcccagaatcacactacatggcaattgacagtactgccgatataagttttaaggtcaggtcaggatacggttactgaagtctcacttacggacaatgtggggaaatgcagttcaccaatacataggcatttacccaagtttctcaaatgtagtggcagttttagaacacagcaatgataatgggctaggtggaggagactcaatttactcatttttttgagcctgcaaattttggaaaataatgacatggggaaagaaagggatgaacagaagatggaaaaagaaaagagagcaatcttagagcagcaagcaccttgaattgtagtcttgaaggcagcacagaagaattgagatagctgggggaattgtattgtgtatctgaagtacaccagctctgtttcataggccttgtgccatcacatcatctgggttacattacaaaaacactctactcctcacatagcataagtctctggtaattttggtgcaggaaggatgagtaatttttactatatttaattatcattgtggtaagtgttctctgaaagccttgatgtagctgaagcctctgcggtaatttaccaagaagtctttggagtccgcttagaatcttgccatcctgggcccttcgatgaccctgactttttgtgattttgcttaagatatcctatcaggtatctgcctgatgtcatgggagcataaaggcatgtgttgatggcaagaagaccatggagtcttattctctgataatgtttattccacatctgtgatttgtgtcctacaaggctcttgggacttaaaccacatgtgctatatttgcattaatgggaatttaagaaggagaggccataacactattaaaatgtttagctttcgctcccatcacacagacacatgctagtaactactcccagatcttgtatcatggtgctgcaggatgcaacgtggagtgcactcattgtttcaatacaagggacttgaaaacaaatagctgccatctctgtctctgatagtttgccaggcttttaacttctttggtttttccctctccagatcatggtgaggtatctcagatgtattccaaacagcacattgccccatctttgtttcttcttttataaaggaactcttgctttaaggtatatttagaaaacctagagtctaagccaaattctgaagaaccacatgataattctactttcaaatggcaggaaaggacttagtgcagaatcacccacacagggttattgatcacccaggcctaatagtcacaaacgtgacaaatatgctggaagtttttcctaggtttaaatatccaactgttaaattacatatgaagatattttgaagcatcttataaacagagaggcagggagggtgcagggtgggaagagaaaagaaggggaagggaaggagggacaaagggactgggagagaaagagggaggaaaagagaaagagagcacatcaaggaacagggcatgaagatcacatcttcattactccctaggccagagtttttcaaattgcaaattctgtgatcctttagtgggtcacagaatcaatttagtgagttgggaccagcatttttaaatgaaatcaattaaagaaaaaaagaaaccaggatagaagatatattacatcacatatagtaaagggaggtattattaaataaaacttttgtttcaattatatgatatatatacatatataaatgaacatatgcacatggtgtatatatatatatatatatatatatatatatatatgtgtgtgtttcattattatacattgaataatagatgaatttatgtgtagaaagatacctagatgacagaaagagagagagtgtgagagaaagagaaagggggggagagagagcaagaaagaggtactgattggcaatgattacttcttaacatgtttcatgaacaaaaatgtttgaaagccatcaccagattatacctccaggacagtggcttctttaaatttggaatacgttcttcccttagtgcctcctccacctgcattcaggtaaattaacaagctgcatataagtctcatctaattaagccacaaacttttaaagaaaatgttgtggatgaaactcagtgaaatatgaatccaatgctgtgagcctcaagggtagcagattacaaacccaatactggttctcatgatagaaaaatgtcctccttaatgtcctactccccaggatactagagaatgataaatggcacaatagttgatagtaagcctcagaaattgagggagaaacttactatactgatgatctttagatatcatttattcagggattgggattattgtttgagatcatgaaaaaacaagttaatggcaatggaaccatcttgatgaagcaggcaaaaaactatagttgggacaactactatggaaaagtttgagctgataatattggaaggaagtgtgtcttctggacagaatacagaacccaaaaagtaagataacaaaattcagttcaggctgttagggtgtgagttccaaccagaaataacaaggatattttaaagaccattggatgattgctgaatacactgacatgactcattttcagatattcttataactatggtgccttgaacgcaagtatggattatttcttgattacatgtgtaacaattcagatgggtgaggcagatggaaggtggatttaaagaactcagtgaggtgcaatgaggatcagggagatgctctgcagagccccagttcctaaaagggggcctggcaaaaggacactaccagccgagagagtctggtatgtgagataaaccaccagaatagggaaccacaagccggaagcaagaagaggatacagctacagaaatgagctttggcaaagacaggatatccaagactgtgcattctcaactctcaaggcctgagatcacgtcaagtcactttgggttatagcaaaggtctttattcaaataccaagcatctcaaggtggagcatctaacattgaaagcagagaagcatctgttgagttgtgtaaaagaggaaaagatcaggaaccagaaagagctggagaaaccccaggggcccatggaagaggtattcttcttaccaagatggtgtatcatcttttcagatagatgcattgatacaaccttagaaggcagtggtatgttgacagttatggaagttgcaatatagagccagctttaagaggatgtcttccccactgtgacactgtggaatagctcactaatacaggttctcagtgactaatcattgctttcctctttactagtataccaaataaaatctgttttctacatttcataagcctttcattatgtggataccaaaaccctttagtattaacctaagccaattgagctatcattcattctatacccctttattgagagctggtgctattccagatacttggctgaatgcagggacatgtggttttgtggtcagggagcttaatgtgtagaaaggtcaagacactggatgtgtacagtagtgagatgcacaccattatgaagttagtacaaactgctggagggatacctcttttttgacctctagatgttataaaggactttccggaataggcagtgtctgagtagtttcctgaatgaagaggtggagtttgcaaagtccaggagacaatcaatgaatcagtcaataagtgaaatcaaataataacataatattttaagtgctaagtatgtaccaggtattatgttaagttcttctcctggattgtattttatgtagcccttataatggtcctatgatgtaggtattattgtttttctcaggttataggtgagaatatagaaacacaaaaattttaaataaattgttcaaagttatgcagttaataagtagaggaattgaaaaggttagagacagagaaattatgaaatgttttgcaacatacattaaataattgaggttttatccttgggataaaaggaatccattcagtggcttttaagtggcatgtgacagatatggatttaggtagatcatctttctatggtctagagcagcagactccaatacagcataattttcaaatcactcgtggagctctgtaaacagacagactactaggccctatctccagggtctgattcttttaggtcctagtgaatgtgagaatcagacttacaaagatctccaaggacaaagttgatgtcagtcaacttaggagtttactgatgagtggatgtaaagaatggattgtaactataccatctgtcattaaggaggtcagaccagaagtcacattggtccgaattgcaatagagttacacattagggatctattagttttacaaatctaattttttttaaaaaaatgagaaatggtaatataattctggagcgtgtctgtaagggagaagaatcatgtcttacaggaaaatgtttggtaacaccaccatttaagggatgagtgaagggaaaagattccacagagagggcatagggacagcttcttcatgtcctttagagatgctgtatactttccttcctctgaatctttgtacaagcttttcctttcacctgtgttgtcctcttaccctgccttttcttctactaaatctcatccatccttttaggatccttctccaacattcatccctgggtcctccattataccctcaaggaaagtttgatttctttcattgaaaaccattatgtgtcccatcttgaatccttatgtaattgttgtttctaatgttttcacatgctggtcttttctcacactagattagaagcttcttaagaggaagggtcactgctaacttttttgtatacctcacagttcttagaattggaccaatgacaggtattcactaggcacctaaatggttattaaatgactctcagtattgtgtgtgttggctagtgatccatatgtcccagagacacaaaataggcctggtttataccagttgtcctggtgtgttattaacagtgccttttgccttcagcattatcatagtttcaacaataaattatatagtcaccctactgatagtgctaccaatacattttttaaaagtctagcatctttaagtggtaacatttcaatacaaatgtcattttgttttggggagtaaggagtgttaagatatttttgcacacatttggcatggagtgatatgtcattccagatgtctccttattaggtgggtggcctgttgctcaattgacagatgtcattgtctattatagagtcacaggtggtttattttaataaaaataccattaaattatctctatttttctgttgtgctctctttatatatagagagaaatagaacacatatgtacacatgtactatattacatattatatataactttatagtatgtatgtacatatatgatacgtatcactacatcatatgtcactatatgtgatatacctatatatcatatatagtgatatatatatgaacatattacatgtacatatgtactatatgttttgtaaaccactaactatagttttagaaatgtcagatgctttttcatgtttggtttaaagataacccttttgagtaaacagttaggaatgttctccaaacagcagaattacaatttttccacattctcagaagaaaattttcaacattttcaatttatttaagcctctcattcatggaaaaagaagcattactactcattcatgaacatcttaattacatagatagttagtttcattcctaatgaatgatcatgctctttcatggagagcaaaatctagattgtcaagctcttggttaaacacaatttcaaaattatgagacaccaaaagtaagtttgtagtattacacttacttcttgaattatgcagtttggattctataaaaaagaattcactggttaatttccaaatctccacctaatatttgttcctctccccaaagtatataacttgacagcagagaaggaaatagataccgttctttcttgtgagccacacactctgcaagggccattcctagttctgctatttcccaggacagagtatcaggaatcatgtgggaatagttcatatgtgtgtgtgcctgggctaatctgtgtttactagtgtagtacagaggggcactgtttatgtctgagaaaatagttataaatcacacttcttctgatcacaaatactcatttatctttagactatatcaccacctgagttatttttatgtaaatattgcacctcttaaatataatgatgataatagaggctgtgaatccttagatttgctcaagtgttccctttttcaataactgaaaatatttaaatcccagaagctttagcatcctaagagaagtagcagacagatgtgtcaatagagtgagacctacagaagttgtgagtaatgaataagtcagagtcatgggcttctgtaagggaactgcggtgcatttcctaggttggtatgttctggctatgctgcgaaccgtagcccagaaatgactgactcagagagagtcctcagctgctttgctcctttcagctctgtcatcacatagaaaggtctctttggcaaagtgtcggaaacaacacaaggtgggcaagcatctgcagatttcctcactcagtcagaagaccagctagagtcatccagcttctggaaatcagtaaagagaccaactttgggtagcgagtccccaagatcacagagaatctatgttgtggtggcatcaccattccttatttgttggcatccttgtctggaaactgcctcatttggctataatttaacttgaagattaaagcacagattttcatatgtatcttctgttctctgaatgtaaaattatgaaatacacctacattcacttctaagtggcagtattgtaattgagcagatttttgtttttcactgaaacctggagttgaattgtcttgagccggaaggcattcaagttgctgttttttacttagctatatttctctataagcatctaattgtttcaaaaagtgaggtaaagtatgtgaaaacctgaatctaatgcaaataagtctgtacagcactaaagctaacaggtgttctcattaatgtaagcagacatggaacaattcttgaatgttttataaacactcataatcatggccaaatatgttacaatagcataaagatacatactgtaacatcttttattcttgttgtacactctcagtacttattaataggagactagtggcaacaatacctacttctgcttaagtcactgtatcataaagttagctaatacttctaaataaaattaacaacgtaactactacctcctcccacagtttgcttatttattaatattaacagtgttcttgtaaaattgctacaatgctgatggacagcaatgagcatctttgcatcactgagtttctctaaagacttgacccattaacctaagtattagctctttaaaattttgaacttatgttccagttcccatactgtcaactcccaattaccaaagcctatatttagggtgagattcttagatgatctagtatagatgatccctgtaaaatacttgggtggctttggaatataatcaagaacgttctattttagagatatgcattgaaatatgactcttgtgcttcccagcccttccaagtttaatcctattgtctgatgtctaggacttgctgactgctgggaaaatatagccttcagactgccattatcaatcttcaaaatagtttgcctactctactcttatgaagtgttttcagtagacgtcagtattacattacttatattacctgaaagaatgcaattgtattgcagccttcaaaattttatgacaatagagaatgagttaaatatattatggcatatcaaacaatgcaatataatgcattcaccaaaatgaataaagtagataaggtttgtctattgattattttcttagtgttccttatgtgtctgttgttcagccatgcatgtagacaattgtcattggcctcaggattattatagcatagtggggggaatggaaagaccaacaaggcattgcaacataaaccagtttgtgctaagataaaggagaagcaggatgttatgagcgcacttgggggaatatctatttcaaagaagcctttactgaaaaggtgacatctcaaatgatttgaatgatatgacagaggatgtcaaaggggtctaggcagcaggaacaacctgctctaaagtatgggacagctggggaaccaaaaaaatcagtatggctggattgtggaaatgcagaggaaaatgtggagcagcggaagtgcagagtgggtcagtgccagagcacacaggggctggcatgccaaattaaagagtttgcactgcactgcaacagctgtggggagcctcagaatgatatcaagcagaagaatgggatgatcatatccaagtttcagagggatcactttggctgcaatatatagtatggacttgaaggaaaaacatggatgagacagtgaggaaagcaaaggatattatgactaaattctcatgagagatgatggtagtatatatagtaaaaggcacaaaaattttcataataatatacatgatattttcattaaactgtaaacatacataatgtttcctcgtgggtcaaaaaggtatgtagaaagagacaacaagtcagtgtatcttgaaggaagggagattctatgtttgttaatttgaatttattaaaacttttaaaattgagcattacctacataaggacagtaataataaaaataataccaatttgaaaacaatgggggcagcagattcccaagtgtcatgtgactgtgactaaatgagtaattgaacacagtgaatatagctcaggcaagaaggtgatctgtggttggcagggagtgactggtgacaaatcccaggatgattcatttatctacagacaagtacacccccccagtttaaaaattaagagcaataaaagtctaagttgatatctttatacaccaactgctttgattagtctctttttgagtcgtttttcatatgagcaccacaggcaaaagttttggtgtggctgctgcaaaactgtggaaattgctaaactatctactaattacttggatagtattctttcatgaatattgagaagactgtttctcagtacttaaaatattttaacacaataaaaagaatgaacatgagggttttttttttttttttgcttgtttgaaataaattttgggtttagatatttgttaataaacagaaagttagagtgggcaagtaatatggggtgtgaatgttcactacagggacaattttattatgcagaacaaatctctgttgtacgaatgcatggacaaaattatttgggtgtcaaagtacagctcaatttcacttaaaaagcattgtttcttgaaaggttggccttaaaccttagattttggaatgtactggaggtctgtcatgtacgtaacccgacattgtttactttccattaaataagaaattgcttacatgggcaggttattttgatatgatgacaccactgagggttccaataaatgtacatgcaaatcaatcaaccccaaacacattgaaaacatatccaataagcgtctggaaactaatgaacgcacatttgttaacatagggggagttgtggaaatgctgagatccattggtggcctggcttatttagtagcatgtggatttaggaacatttcacggagtcagaagaaacagagtaattataacataaggttcaacatctttagatatgtagaacattttccgttgcttaaaacaaatattccctaagaaagtataaaacatttttctgacttgcaaagtttttgcagtctatcatttaaattacttaaataaagggagctttactgctccccaaagctgagaatataacaccctccatgcatattagcttgatcttcttgacagaccagaaaagtgtttgtgtgtgccaattaaaacaaaaatggatccctagtggcttgttcctcatacaacttttgaagactgctatcattgtttgctagggtaaccctggataaggctgctatccaaagtaaacaaacttttcaaaactttcatgacagatggggattacaaatgcattttaataagagagttgccaaagtaacttttttttttttttttgtaatcagcatatatttacttaacatctagcaacattgggaacacaaggcagatactttctcacaaaatgctttaacaagtaacatttttggaaaggcaaattgaagaccttttacatctaactgatattttacccttagttttattttaactttgctcaacatgttaagagaaatgttaggaattactcaaaccagactgtaatttgagacagacattcagcctgatagtgtaatttctttggtggtcataaacacctttgagaccaagtaatttagctattagtataaccatgacaaccttcatttgatcagctatatgtggagtgatgcaagatgaaaaaaatgtgaatctgtgtgggttttgtaagcattattacttcgattttaggtcttgatatctccctatcatgtgtatattttctgctgggagtactgaatacagatatggacaaaattactatcacaaaaataattcatattcacttcaaataaagttagtgtatgttgatataactttttatttttacttaatttaactcaaatataaaaattatatcatgaagtccaaagtctctctaaacataatagcaattaaattccattcctcttatttatgtctctctagaaccactgtagccatattatttaacatgttttagggctctttggatatttggcatattttattatgcatttcctgcatactatttcagtttcactaaaatggaataatccctccttaggttctaatcaaaatgcgaaaggtatttgttcaagtgtaggattgctttagtcctttctaggatttgaaggagttgtagataacccaattcagtcttagatatattttttcatagcaagagagtgcttgtttttggaaagaaaaatcagagctaggattttgcatgatcttttaaaatcgggctatctttagcctaactgcaaggaaagaagcaactttgtctaaagttgctattccaaatttcataactgaaaccaaattatcacggcccttttcctgttcaaacacacagtccttgactgtatacaactgtttgctgagaactagtgaactagaaatcaagatctttgtaatctcttaattctatcatttaaaatgatgccaatttgatagaatggcattctcattttcctcatttgcttcattttcttcatttgcaaaattactttatgatagtggaggaaagctgcatttggagaatgtttattatgtgctttgagatcattaaagctgatatcactttgcataccaagtggtggtattcatatccttaatatactgaagttctgatacaatcaacgtttaaagaataacgtatcatgaccaccagtttatgcatactttcatgatgtaaatgtgcctgcagtaactactccttcctctgaaatcttgacatgagcattgtgtgtgctgctcacattgggactcagtatgagccattttctattgttatttatctgtatatgcatatgtcctatttatccaaacagattgtgagttcttgagggtgggggctgtgtatccctagcttctagcaatgtgccttgtacttaatggatgcttaatcagtcattgttaatgattagtaggatgttctgtcatgaacgcatcctctctattcttctgtacatgaaattatttgtgggatttattctgcaatcagaagggtggggctctcaaacagggtagcaccatgtcactcattatctcttacatctttggtaatctccccatgtgcatctgaagtcagttggaagctggtaatattttaccatcaaatatgttttgctgatgaggtgtatctatctataacattgatcattatttctgtttggttattatttataaaagattggcaataatgaaattaaaatacctacaatgtttactttgtgtagctatgcataattttgattctttatctttatttttcccaaattctacacaatgaagtattattcttagaaaaaagaagttctaaaaaaggttttgtttatattctagtaaacaaaagtatggaaatttataatggtataaatgccattctacacattaatttctcatttaaattaaaaaatctaatagcataaaatcttactgccagaatgaatattgatgagagtgttacttaattgacaatatttaaaagaacaatacttaaatcaacataaacactacttcttaaaactcttttaagatgttttaaattagcatagtaaagctccatttaattaaaatctaaaacgcaaatttcttcgctcttcatcagtgaagtctggacttgcatctacctgcctccatattaagaggaaccgtaccaaggacacagactattctaagcccacgtgaaaactattgttgaattaattcccaaaagccttaaggaatgtgcccactctgcatgttgctcagtggacacgcttctataatttcctgggcataaatttcttaccagcaagaattcagatggacccttatttagtatgaaaaagttcaagacaaatttccccagatggatacttaaagatatgcattattgacactgcacacttcattaaggttactttggtgccctgatatattccttcaaaatacgacctggtgtggtaatgagggatttcaagaaacatttgcctaaattaggtttctaagcaagatggagaccagcagctcttatctaaacctgttatgttgtctataagttcttccttcatccccttaccccagcatctgtcacggaggcaaaacatatagaaagagtacattagcacggcttaatatcaaagcctttatgtctgttatacatcattttagattgtcatcataagttgttcaatcaaaagatttagtcagagctaacattctttactgatgtcttttttccccaagagtgttggaaattcgattgttcaaagtgcaaatatgattcagcaaaccatttatcagaaatcctaaagaggtaaaataaaaaagcgggttgaggaacctgaattaaatgggctttaccagtcaaagattttgaaactactttcctgtgagtgactggaatagagcagaacaaagtcaattactgactgtaattaagaagtggatgcatttaaactgtagagagcagtagcagacttctccagactgcctggtaactcgaaagattagtgggaagacagaggaaaggatgtgaactgcatctctctgatagtatgttttgaatgaattgcattcatatagctctctgatctagcttctcaaaatgaattcgtaaatcactgattatgtatgattaatgcagtaatatatttggacaaaggaacttttaaaatacattttgcttttggttgtgttagcaatataagatcccctttgcattgcatagcatgcaccaaaaatgcaaacgcactgctaaagtacttatattttatcactgtttgaatttactagactgcaagctgaactatgttggctctttcgtaaaccctcataatatagcaaatctaattatgtttgtttctcgtacttcttaaatgtttctttttataattttaataatggtttatttatactggcagagaaacattacattgtacattgtgctttggctaattcatttgtctttgtgtatgttaacaaattatgatgttagaaatacattcataatcaaaatatttcactacagattaggatgaaggtagaggtctaggacattactagttttcttgtgttagaaatgaccttatatttttagattactatttcttaggcaacactctataaagtaaatatttggaactttatctgagtagagaacattgcaatggtgttcagataattaggcaaacatcacctgagctgtcttttactggatacataaaataggaggctgttttgagccatcctaaatcttatatgcagtttcattttaaaaagagagagaaagactgattggcctcagtaatctgtcaaattctagtgtgggcaattaaatctttttatttttaaatctttcacttcttataattgtatacactttagacagttcttctcacagttatagagacaacatttgatattggaacccatctcaatcaagaatggttactttgcagtactgattaatattgaatctctatagagtttttctaaaaacaaatgacaaatgaatatatatgcacatatgtaacagatttctttcaaaaccccaaaatcattgtcattaaatgttgccatgagaatccttgaaaccttcagaatgagccatttggggtagtaattgtcactttaatgatagaattatagagatggcctaaagcgtgatttgtgattttctgaacctgtgccacatttcagcgttcacctcctgtttagagcaaggaaggctgagaagaggtgactggctcctgattgagtattttgaaatgtcagtcctctaaacccctgaactctgtgtgacagtagttgggaaatgttcatcttccagttgcaaggaaaagtcaataatacaaagggaaaatcttcacagttcagattgatggccaaatacaaaaagcatgtccacacccactctaatcaattttttctctaagttgcccgttatgtgtgaaactaagagtattgctctgtttctgtagggtcgtatccttttctcacaagtctggggagaaaaagattcactgtaatgaaaaatggacagttacacgctaaatattgccaactacttagcagtctgagagtcaggaacctgaatgttcatttgataaatactctcccagagaggttcaaatatgtaaatgaacttttattttaatatactccttttgtggggaaattggtttttttattactttcctatagatctctgataagaaagtagaaatagtcaaatgttattcatttcaatgaacttttggaagtctgcaattagtgtttttggtaaataaactgttttagagctctccataaaaggaaatcaaatatagagatactattagatttgaaaaagacagacaggaaagaggcaaacgtgcagaatgaattctgacacacccgggtgcatttttctgcgggttctgacttaagtgtgtactgtctgcagttctctgaacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattggtatgtatttgttttggctgttacctttattaattaaaatgtagtcatttaaatcttattgctcaggcatataacacacacactcatttaaatagatcctatggactgagagggattaagttcttttagtttaaatagaatctactaaaaaccttttcagcagacaggatttgtagaactgtcgtttaatttctctctttcaaaaatatagtgcattctttctttttttctgaaataacatagacattcatttactggaggctgtaaaaagcacacaagcacttaataactactgatttttttttcattttcagtttatgcagtccatactacatactcctgtaaataaataacatatttaagactcactgttataataccaataaataaataataaccctttgtactgatttttattattcttccagctaagctagattgttcttcttatgaaaattacatatctagaacttcatgaaattatcctaaaacatacattcagagtatgttttctaagaatgaacttatttaaaaccactcattccatgctgagtctctagaacaaacatttaattttatgacactaatatttgcaaaattttgggaagaaatattcttaatacggaatacaacacaatagtaaaagattttctgtgtgattttcttgatacttaattgcaagctttcattataccattttgggattaacactttaaaaagtaaaataacaaatttactttttcctgttattagtatattccccttaaaggggtgtgtgtgtgaatgtgtgtgagtgcacatacatacatacacacagtttgttgccattgaggatggactctggaaccagactgctagagtttgaattctagttctatcatttgttacctgtgtggccttaggcaaattacttgcctattttggcctcattttcttaatgaggaaaataaggataataataataccacctactctatagaattgttgtaatgattaattgaactaatgcatgaatagtgcttagcatttagtaagtaccatcatatacatatataaactattattagagtattgagcttagcatagaggacctatcctcaaataattaccttacttcaaatttccccataaacagcaaaattgaacacaaaattctatggtgaatcctttctttctagtaaaattattcagtctaattatttgctgtttccagccaaaggattcaagttgtccatcaagaaacctggaattattcaaaatccaaagatcctctagcactgaattgctaagtcactacgacagtgatataaaagaacagaaaccagagcacagaaaatctttaagtgagtattttctttgacttgctcattttaagtttgtctaaatgcagtgcttatgaaatataaatgcattgaaatgagatttaagccaaactcatcatactcatggaagattcgtagccatttcctggccagggatttgtgcactggagggcagtctgggcactttgctcacatcattgttggtaatgccttttgagaaaataattgttccaaggtcatggtctctgcttacagcaaacctctgaatctctgagtaatagccatggtgttcagatcagtgattgattttgagagtgggaaatgtcaagcatctccaaccctggtatcctgactattttatttgcatacattaaagggtatgagtgaccaccagtgtggtctaacttaagtcaacaggctatgccactttccacaccttcagaccaccagaaacacttagaaacgtgctttccagagaggctgatagaaaatatgggatgtgaattagatgttctccaaggtcacacctagttctaatattctaagaattaaatttagagtaaaaagaatggtctcactacttacacagtgatcttgagtatctttcttaaccattccccagactgcttcttcctcaatgaaaaggggttattaaaatatgcaacacatatctcactgagttggtttgagtctcaacctcctgaaagaaaaggtagacatctggctgggcgaggtagctcacgcctgtaatcccagcactttgggaggctgaggtgggtggatcacgaggtcaggagctcgagatcatcctggtcaacatggccaaactccatctctactaaaactacaaaaataagctgggcatggtggcacgtgcctgtaatcccagctactcaggaggttgaggcaggagaattgcttgaaccagagagtcagaggttgcagtgagctgaaatcataccacagcattccagcctggttggcaacaaagcaagactctgtctcagaaaaggtagacatctttggaaccagagaaaacctatttcccaaagtcttaaaaattatagtattttgggggagtcttctacctggctgaccccaatcttgcaaatcatcatttttttcctgctatttccctctgacaaaatatcagtatactgacatcctaaactttagaatttaaagagaactcagtaagttgagaagagctgctaatggaatatatgtgtacatatatacatatatacatacacatacacacgtatgtatgtatgctagatgattatttgtacgtgtacatatatgtgtgcattaagaaatatatgtatatacacatacatgcacacaaagactcatacacatatgatagggaagagagaagctatttatatgtgataacatatttgccaaagttgaattactgaagtctacaaatctagaaattgcatgagaatttaagagtagaagcacccttttgaaattaagtctttatgcaaaatcccatgccataattttcaacaactgctagacacatttacttagccagttgtgctaagttggagtttaagattatcagtgttaatgtctagaaaatgcatggtttatttgtggagagttaatgccatttcaaaagacttttccataatggtacagtttagaggtatttcatttaaagaatgttttcctttcatgcctgatcattgtcttcttttacttcatatggtttgagacataaggtaagatttcagaattgggattcagttgggagtatatatttagtgttaatcatatagacattctgtagtacatataaaagaatatgtgatgcaatgactagtaggtctggaatcttagatataattgctggttcagagaccttaagatgtttctaaaacctgagctatggagaaaataaaggtttgcaaaaatgtatttgagaaacattgaggataatgaattctctattaagtaacagtcactttaaaagtattaagatgctgctgaaaaaaaaatcttagatagaacactcactacttctctttagaatctatttttaattggaaaagacaattatttttctactttgagcttaaactcaatcctacttaaaaacaagggaggccaggagtagtggctcatgcctgtaatcccagcactttgggaggccaaggcgggtggatcacctgaggtcaggagttcaagaccatcctggccaacatggtgaaaccctgtctctactaaaaatacaaaaattagccgggcatggtggcgagcacctgtaatcccagctactcgggaggctgaggcacaagaattgcttcaacccgggaggcggaagttgcagtgagctaagatttcaccactgcactccagcctgggcgacagagcaagactctgtctcaaaaaaaaaaaaaaaaaaaaaaaaaagggaagagatacatgatttattctattcatttcaaaatctaactaattgtacagtgacttcatactcaccttttactttgaagttaaaaaaaaactagaaaatatgaaacatttactgtgcaccaggcactgttccaagtgcttgtcttatagcaatacatttaatcctctcaccaatcctatgaggtagatactattagttaccttattttatagaggagaaaactgaggcatgaagaactaaggtaatttgtacaaagacaagttatggagacatgtttcaaacccaagcagtcttattttagagcctgtacttttaatcattacattataacaaagtgaacaagtaaaaggtaaacttagtttatatcgaacttagacttggatagaaatattatgttaaaaataagattcatagaaatcagtaaacttgaatcaggacccaaaaacttattggcaaaaataattaaaactgggtgttttctttcaattttgatttcactattaaaataataatttaatctttaacactagctctaattttagaaaatgattcttttctgtatcttggtgagtatgtatagttgtaagcctttttttttagggccagtatgttttttgcaatgtaggacacagttaatatccatctattactttgaattaagttcattcaatatgtatgtattcattttcatttgaaaggcataatgattgacccacccacacaatatcaaattagaccatgcatttgaaatagtgattgacatgttttatatttgatgctttgtaaaatatattttttcaagtaggaaataccctgtgtgaaacccctctgatctcagtcctagatttgaacacccaaacttaggtttcttaaaacttgcattcgcttttatgtcaccctttggagattaaataattatatagaatcagagactcaacagtatcctcttccttattagtagtctaagcacaaactttattgtcggttttctgcctttggcttcctgtgcccttgatgttcccatgagttttgccgccaagattgtagacagataaagccagaattacttttttaaaaggcatgtgaacatcattagcagctaacaggtggtgatttcgttgtccagtttgtctatataacatgggaaaaatatgttctctcaatgagtgaattcagaaagttatgtttacatatacttttcttttaaaaaatatgattctaacctgccaacactattaagaacgaatcagatattttaagatatcagttgagtctaacagacaagaagccagaaaatttaatgcaagggccaaatcactgtgggaaactcaggacaccagcctgggatgagagtaggagagcagctctccagggagggctgttatggaaagtggagagtcaatcaaagaagatgtgaacatatttctctgaggaaagagaattgtcttccactgacagcaaagagggggaaggcccaaatataataaatcttgcatcagataaccttggcgaggtttcttaacttttctgagctttactttccacatctataaaaatgggtctaatactgtccttaaaggatcgtgtgagaatttgaaattagacatgtaaatacttagctcatagcaggcactcagtaagtaggagctcttattattatcctccatgtccccaagcagatagcactgagacagggcttgagcctggtggtggttgatgaaagactggagcagggcatataagcttgccatcctactccctgagtgtatgaaaggtagaaaaagggtaccagaattggatatgggagtcatagctgcaaaaaatctaagtacgagcagctggtctttcccctggcaactcccatgtaaaaggggcaggtagggcattcttgggagcagcacaccaggaaacagtagaaaggagccaagaaacactcttgattctcctaaacccagaaaagcatgccattcagaaattcaagttgatgggaaggattcagcattagccatctcactattcctttacacaaagttctagtttattcattcatacacacattaattcttttttatgaagaaatacaactaaaggtatacaactaaaattcttgatttcactcatctgtgctttcaatttttaaaaaataacttttgtatgtaggttatgctttagtagtaatatatctcatacctatcaattgctaaactgtaaaatccatgagtgtggagaccttggataacttgaaaataaaactgacactttagtattggaaataagcaccctgaaatgaacatgagttagaagactaaagtcaaaaggtaagagagctaaaaggaaatgggttttcctttagctgtctcttgattaagttatcataaaaaacaaatgtgttctgggtgaaatcctaaatgcatatgtggatttcccaaatctacgttctcttaatgacatgtgcaataagggtatatgtaatatgtttctaataattagggtatatgtatttaaatgtgcatttcccagttccatatccccttaatgatgtgtgcaataagacaacagaaagaaaaaacttgaattgagagagttacacaataaaaattaaaatgctacggacttttaacttgtctttgtttaaaaaatttgcctgcaaagtatcatgaccatgccaagtgatgaaaacaagtttgatagagaaaacattaattttttgtactaatctaaataattataatactggtcttctacaactataagtaggctatgttctcaaaatccaattgtaaattggttgcttagacctggtatgttttcacaaggaaaccatgtaccaagccacaaaagcacacttgaactttctgcagtcacttacaatgttgtttctagggaacaactcattctgaatttgctgcacctctggccctgagagctaagacttcccagtagcattgctttcgatctagtttccggtctagatccccacttctgtaccgtctccaccaaagcgattaggagactcagaatggcttttgcttttgctaggattctggtgagccctgaaagtccccagtagtggcagggagggaatttaaagcctccgagccggaagaaataatagaaaaaggagagaattgaggactgggtaggcagcttttgtagcattaatgggaagtgagtccttagcaagacagatgttctttgtaaaaagtatgtgtaatgacagattaagtctggaattgtcccaaatataaacatttgatgaatctaggtggtgcataggcaagtgatcatgatcctattgtttcatttttttttgtatgtttgaaaagttctccagttaaaaattgaagtaaacgcacatacccacacaaaagtaggtatgtccatgtgcctaattcaataaaagaatatacatattttctgattatgacctgaacctttcaaagaaagatcaaattttctgaatataagttacattaagacctctttacatgaaacattgataactcattgttttcctattttcctccaaaaccaatatatttttttcctgtgaccattgagacctttctgggaactatgtaattaagaaaacttttaagatatttattattatccaaaattaaaaagtcacacgagtttcttggataaatatgtaattatcaattgttaaaacacatactgtgaagcctgttctggaggctcatataaatacatattttaaagttttttcttattaagaattttgtgtaaaacagtctaatcctgccaatgtatgaaaataataagatgaacaaaccatctgccaaggaaatgaaaacagtattaaaattgcacagataaaccatatctagttctgaagaaatggaagagctctttcctggaaaaacaaaaaagtcgtgacatttttgtagaatatcatgggttattatattatcaagaggacaaagttttctgatttgggtgagagggtcactcacccttttttttttttccccaaaataactagcgccactctggtaccagttttattcaaaaccctcttgagaaaaataaactattgagctaaaatgtggaaacaaatcacttcatattactatacttataagacagacaatatctaaagaatagttgagtgtcacttgtcttttcagttgtttttcacaggttgagagttacttatttcaaaatagttggtaaagaaaaaaattgaaaaattataaatgacatttatgttgttaaagctgcaagatgtaaacatcatgagaggaaaagagtaaaaattagacacatttgatagtcaagcatccacattaatttatcagaatagtattatgcatgaaggtcccaggcttcactatggccctgtgtgactctagccattgttctgacatatgttcccaagcagcagtacctactttttctgggacccgtagattgcactttcttcaaaacattcagttttcaatgaatcatttgataagaggacttcattatgagctgagcaaagaatgtcctgattaatctcttctttcccatctaaggggctgatctcgccctctgacctgtggatgtccattgtcgtgtatctcatagcatcagctactctgaaagtccacctaaccctctcagtgctcaagcactagatcaccctatcttccttctgaccctggcaataacaccatgagcatatttccccttagatgaactgcatttaatcaatttctgatttcattaggtcaaatggcatcttgctttcaataatagggcaaatccagagggctctttgctctaactctcaagcaatattttattggcattaatacactactgtgattgtaaacaaaagaaaaaaaaagatctttggtatcctcagaaagtgtccttttgtttattccatgactttaaaatgggcgtatattaatgttttcttataaagttaggcatataatcatcattcattgttgtcacagcagatttaaagaatctttgctaaagctgacatttaagcatttaaggtgtttgtacagtgaatccatgtgcagagcaaaacattattttgaatgcaaatgatcacctctttctgtatacaggatttatttggtcaattcctttttgtttctgaagtatggtaacttacgctactttccttcaaaattctaaagaagtaatttgctttttgatggatttatttggatgtcccaaataggcctaataacatgcttgggggaaaaaaaaaatccgttgttaacacatggaatctttgagattttcttgtaaaataagtttcttattactcatagtatagccctcactaaacaaaatcagatattgctttcacccaaaagtattagatgaacccagaaataccagatgttttcatcaaactttaataaagtgagatctgtaacattaggattcctagctttcttcaagaaatggctcatggatgacttgagaaacctaaagcaatctgccaatacatctttctttggttatttaagtagtacctgaaatcagttgttcctgctacccaattttcctaatgtaaataaatataccctatttgtatacaaaattaattggcctaaaaaggtagaggactagataggaaatgccataaccaagtagaaaatataggactgggattttgctgtcagataaggtcttctccaaaattgaagtcaaagattaagaacaattatttttttttttttttttttttttttgagaaggagtctcactctgtcacacaggcttgagtgcaatggcgtggtcttggctcactacaacctccgcctcccaagttcaagtgattctcctgcctcagcctccctagtagctgggactacaggctcgggcaacaccacgcctggctaatttttgtatttttagtagagatgcgatttcactctgttggccaggcaggtatcgacctcctgacctcacgatctgcccaccttggcctcccaaagtgctaggattacaggcgtgagccgctgcacccagccagattaagaacaatttctaatgactgcattggaattattgctcttggaattagagtccaagtttctgtatagaaagctcattatgatctgtgccccttctccagttttttttcatcactccctgacccataatttatgttccaggtaaatagtccctataatacctgatgcacactgctacatgctgacttttaccttgaaatcagggttatctctttacaaagttaacatcctttaggactcagcccagatcatacttcccaatattcccatcatccattctaacaccctattttatttgaaagagttactgtgattcatagttattcttgcagctcttctgtgggctctgacttggaattttcaagtttctattggaggcaataaaagaaaaagaaactctgtaatatataacaaataattacagtaattttgattatttttataagactgagaatacttttctctagtgtcagcttatttgtaaaaatccagtttaacacaaaagttatcaaagtgttagccctcagaaccctgttcaaaaggttgtatgagattgtgtaagaaatttgagtctgagagtcagaaaatttgagtacagttcttaactccaagatatacagccatatgactttgacaagtttcttaagtttcttgaaattgagtttccagataaatataatatatattttatataattataaaatattataaatgtaaatgttgattatctaaaaagattatatatgtatttgatctagagaaaatgtatatagtggatctaaaatatatcaaataactttgtagattatatattatgttataaaatgatttccatctgggtaaattctgagtaaaataatcatgacttttgtttgtttactataaatctaccaatttagaaatatagcaagaatgtacttttgcaactgttgaaacagttgccaaaatgcagcataaacaaatgcgtaattttttgaaggcttaatttcttaatatcttcattattttattgactctggttaacatatatccttttaccttttgttttcttaagggatcctaagtgtcatggggaataaatgcttggttttgtcattcctgagtgtgagcctgacacgatggcaatctctagagattaaagtttgtcaagtgtctgttgccatttccattcttttttttttttatttaagttttagggtacatgtgcacaatgtgcaggttagttacatatgtatacatgtgccatgctggtgcgctgcaccccttaactcgtcatctagcattaggtatatctcccaatgctatccctcccccctccccccaccccacaacagtccccagactgtgatgttccccttcctgtgtccatgtgttctcattgttcagttcccacctatgagtgagaatatgcagtgtttgggtttttgttcttgcaatagtttgctgagaatgatgatttccaatttcatccatgtccctacaaaggacatgaactcctcatttttatggctgcatagtattccatggtgtatatgtgccacattttcttaatccagtctatcattgttggacatttgggttggttccaagtctttgctattgtgaatagtcccgcaataaacatacgtgtgcatgtgtctttatagcagcatgatttatagtcctttgggtatatacccagtaatgggctgggtaaaatggtatttctagttctagggccatttccattcttatagaaaatagtaaaataatacaagggtagaattttgacagagagttatgtaaattcacttaaaagcaaggaaagattttatttaattttaatgtttaaataatacatattagaatcaactcagtgtcatgaagcatctggtgataaaaagatgggttttgttgactaaagtaaacatattatacaaatcacatggatattgagccacttataaggagtaaactgaaaaccactgaaagtctggtctcaccaaactatagtgtattgatcagctggcaagggatgcccaccatgttcactgtatcaaaaggattgtgatatctgagttctggggagtaatcctagctgacctagcttcagtcattagcttaaaccaggaccactctattccattagactgcaagtgcctggaggtataagccaagaccttctgctaattacccctccctatccccatcactcagaacagagtctgaaacctagtggtgttcagaattattagcttggctcaaaagtaattgcagttttgccattttttaaacctcgtttacttttgcactgacgaataaatgtctgagtgagtgaggaaacaagtgaccgagagcatgagaggggaaccctgaagaaacccttacagattttatgcatgaggaatgaagggaaaggctgaactgtgaggcactgtcctgttgatgggtgttttggtttgggttcctccagaagcagtccctgagacaaagatttgatcacaggtaatatatttggaagtgatccctggacacacataggtaggggctggcagaagagagccagggaagagaacatacctatgaaggagaataaaaggtttatggagtttaatgctgctgtggaactctagcagtttttcagatggagaaacaaggaatgacagagaagagcatggatagacttttgtacaggaaggaaagaaccatagagcataaaatagttgaagagcacaatagattggtgaggctggaatgtgcaaaacattggggcaacaactggagatcaggttggaaatgaagagtgaaccattggcaaagggtctctcacggaatgctaaaaaattaggacttttcactataaataatgggagcctagtgaaagacttcaatgcaggcaagagacatgaacagatttgatttttagagtaataattttggggaaaatgtggagaatggcagagataggtagcacagagtgagagatcagaggtaagaagatgaattcagagatcagaggtaaggagatgaattcagagactattagaatagaccatgtaccatatgctgcaggtccaaactaggcagtaggaataggtgaagaagaaagattccagagatatctgacttgatattgataggttttcttgacatatattgtaagtcttggcagctcccaaatacccattgcctctgtggtttggaaaacaaccatcaggatgccaaggagctaagcagaatctcattctttcaggagcctactagattcttgttactctagatataatccatggaccaacaatgacaatatcacctaggagcttgttagtaaatatggcctctccagcccaaccccaaaccaactgaactgaatctgcattttaacaggtgattcccatgcacattaaaatttgaaaaaaacattaccatatgacataaataacttctttaaagaggtttttgaaagtccagagccaaagggtggcctttgggacttggacaaaagacctactcatataaaagagctatcttgtcggcctttgtgtaaaataaccctgcatatggttattatattggtcatgctatgacaatgcatgattttgaatggtggctatttaatctcatcaatcccttccaacccatgattacggactaaatgagaaagaaccaagacttacactgccttgtaacttttgcctgtgccacacctaagtcagaaattctgaactcccacatcaaaaagtcaacagtcccagccaaagaacagcaacaatatcaaaaaatgattctgagcctaaactaccctcaccaaaacagacaaacaagaaaccaaagctccaagcaattccctggaaattatccattaattccctggatagctcaatgtgcaaaatccatttgaaattctacttatcccttatcttccatttgactcttcttttcggaacacataatctcacatgtagcctctttttgttatttcccttctcaagcaagaataatagtatttgattgcttaaatttctttatttttatgttgttcttgagtacttgaattcatttcccattggcctttcaggttagatgttaaaattctggatgagcagcaacgtagctgttttactcgtagactaagtttatttgctgcacctgccaaaagaatcaaggcccaccaggctgcacttcagtcaagctgttttgaaaaattgcaaagaaaacaaaagtaggcccacaatttcacaatttagttatcaaaaaatagaggaaagattcaaaataaagtctgattaaccctcttagtagggtgagatttcacttactgggaagaactgataatgattatttctgaaataaaacctcattttttttcatgtctacctttttttaattataggaaatggaaaccaaaatgggcaaataatcattcttttctcagtaagaatctttctcataaatttgcccctaaaatgtccagtcttttaaaaatgttttggacagtaatgagacaggtctgaaagagatgccttaaaattttagtagtgcctagattcacttcacttatttacctttcttactttaagacagcttacataagaataattaatctttttttttttcctagtgagtacctgggtttgttattgaggtttcataattaatctttttttttttttcctagtaggtacctgggtttgttactgaggtttcatgcttttttttttttttttaaatcgggcataaccataattgatttccacggaagggtttggctgaagacccaaagaatttttgcttaactcatttttattgaacgaaatccagaattttagtcaagaagcattagatattaatcacatatgagtggggtcattaaaatttcctttaccttccagaactgcaggtcattatggaatcataagaagcagtgagctcacttaatctttacaattacataaaagtgattattttcttaagtcttacaagaagctcttaactattagttgaagagcatgttggaatattagaacatctgtgttgtgttattatagatgtgacttgtgaattaaaaaaaaattctctgactcaaaactcttagaagttaccctttccagcttgaatagttttaattctttaacacagtttgggagtatatattttttacctcgcaagtagagaccttgttgctgaaatataaattccagtatcatttcttaattattacactctcaactttatagaaaatcagaggaacttcacaggttctaaagattaggaaaaaaagaagaagaaaattagaggagaaatgcaattttttttactgcacttaagaataacagttggtgacaatttaaggtgagtcagtttagggaaaaactgagacaaatccatcctctaaattattgttgcctgtctccatctttttcttgtaaccacttctcatctttgactttgaaacccaacagtttaaacttggttcttatttcagtgggctaatcccctttcataaatcttgctcaagagctgaaataatttgcacatcatttaaagagtatttgctttgaaatattcacctcaagcccttttgtatatcctctctctctaaagatttgtagtatttgttttgttctctgaggtataaaagacctggataaactttattcctgttgtttcaagattagttaacgaaaatgcatattaattcagcagggacggaaataaacctcagtaaagatgatcatacattcgcctctcggggatagcaaagtacaaaatgtcagtcttcaaatctccttggacttgctcaaaagagcatttggggatttaaatttccagaatatgtctacaaatgtattttctttgttgtggagaacagaagctatactgattatttttccccagaaaattgattctaatttgtgtttgaacaaaaattaagccatctagaaagtagcacttcaagaagacagaggaaaactgccactgaaaaggtaaatttaacattaaaaattatattcttgataagccactaaatttttagtttatttgtcatcagatcccaaatcccaggatagtttcacagaatttctgtatttttttctatgaaaaaattagaattgaaaggacctcagaaaatcaaaagtagacatatttaaatagagttaaatgttcctctgcatttataagctcaaattttaaagtttgttggtcagctcagaaaaaaaatacaaatttctctagataatatatttgtttcatatgttaagatgtgccctgtgtttttcttaaactgaaaatgaccataaacttttggcacttaagtgcttatccggaaatgactaagtggattcaggagtaataaatcactcatatggatccagccacccacagtcttgttccacttctcttctttacaagtgtagtaatagacatttccacagtcctcagggtgccgaactttgcaccattaggaaaatctgcaagtagcttgatttatcttcctcactcagttagctaagacccaactaactaaaaatcagcaggaatgaacttgacttgttaaacttttttaatagggagatgcaacaattacaactttcctcctttgccacttcaatttacattggatgtgaagcccctggtgaaaaatattcagatgagaactcaaattataggtgcatggctggatgatgctgactctaggttttcattatacacagagaatcgtctgctgtttgcaattaatccagacacaatcctcttggtactttgggaggaatgcggaagaaatagccattttataagttgtaaactcctaaattaccctaaattagagacactattaatcgaacactttgatataggtaggatctgcttattgtgtaggctcatcttcccctgatggagcaatcaattaaatatttaggatgtggaataccttccgggttggataatgcatttcatttaaattatggccctccaacccgaaacattaaaggggatcttaacggatggaagcacattactgtctcttggattgggcgcattaacactttaaaaatgaatgtgcttcccaggatttcctatttgttccaccagctgcctgtggatgtgccagataaacagtttaaggataagtatgtaaaagatgcatgtgtaactttttgtgtgctgaggtgcacccttgtagcaagagtcctcaactgtggcccctttggatttttttttttttttttgtctcaatgctgtagcagtctaaaatgagagtgctcatttgatcatgggagagtaggagggaaagccaacaaaagatgtaattagacttctgacaaaggttctgtctgtgtttaatcttttatcatttctacctataatttatcctaataaatagtgattattactagaaaatattgggatgatatagtagaattcaaaataagcataagctttcccattctaaaaatatttggcataaaggaaattatttaatttttacccaaggacaattactatgtcaaatttatgaacagtattgtaagaacagagttgttatgtctcccataccacggaagcatggtatagatatggtaaatactttagagagcttaccaggctgtaggcagcattctaagcactttaatctactctcattgaatcctgtcaaccctatgcagctcagtgacattattatcatccccattttatctattaagtgactgaggcactgaaaggttaatcaatttacacaaagttatataattaagaagtagctgagttagaatttgaaaccaagcagtctaacttcacagcctggaaccacaaaccactgtgtagcatccggcttctggagtgaggttgatggtttctgcaatttactagctctacaaactttgagccagtcacttaacctcactaagctactgttttataatcttaaaaatgtcaataataatagtatctacctcacagagttgattggaagcataaattagattaagtaatgtaacgtttatagcattgtttgggagaatgtaagtactcaataaatgttaatcataacgttagtacaagtattttcttttcttccatagtatttggaaaagttctcctaatttggttaagaaaatgttatcttaaagataaatgattgaaattcctagagattaatgtattttccaaaatgtctttggacttacaggggaaaaatagtatattgagtgccttacagaaggctataaacttcctgaaccatgagtctgttttcattcattttccatttataaaagtcttgattcactattaacataatacataaatatatcatattagcttactgagtgaaaacaaatttatccaatcggaaaaaaaaaaaaagatgttaaagataggggtcaatttctttgtttcccagagacaggcttttcatatcaaatctgatagaacacatgcttcagaagggagcagaaaactcagctaactggtataattatgtaactcaaatggtcatattgagagggttaaactttggcaatagaatgtggaaatacaaagttcaatgaagttgtaggaatttaactgaaaagaaattacttatcagcattttgatggggaataaacaaacaaaagaaacaaattggtcctttcaaagttgggtggaaagaatgttcctgaagccttccttagtaatcaccgtcattgagaggccctgaggactcgtatctgtagtaattgatacctagtcctcatgctcaaggaggaagacaactggtatttatgggcttgtcaagaaaggaattagttggaattcctttttctactccatctttcactagtctttattgagccaagtttattgtaagttaggggtgaatcatacagatacctttactctttcaatatgctaagaaaacaattgggatgaaaagagaatctgatattttaaacaccaagcaatgtgttttatttggctgggaatacagtcttatgggcaatcactgtatatttatctgtttgcttgtttatttggaagtcctaccagtggagtaaagctcctcatctattgagctctgatcttcttccactgaacagatagaaaggaaaggccttagacagaattataataaaggtgtatgaggcaactcaggctcaaccagaaagatcagccaatcaactctgaaaaccaacaaagatgcaagttgcacagagcaatactcctcctaatatttttcttacgttcataatatgggtggattaataatttttctgtgttgtaatatattcataatacaagcggattaactcagattaaaatgctctatatctggtgaatgagggaagacaaaataggccctaaaaatgggaatgcttatttagggaacaaacaaagatgacgtaaactctaaaaagctggagtactcagagcaagaactcagttcacacattcacatcacagacatttgtaggggagttgctttgtgcatgcactgttttaagcactggagttaaagagactccaaatgttatcaattccacattaacaaagagagtttgttactggaaggggctcccaatccagaccccaagacagggttcttggacctcgcgcaagaaagaatctgaggtgagtccacagagtaaagcaaaagcaagattattaaggaagtaaaggaataaaagaatagctactccatagagccgttctgagggctgctggttggctatttttattgtcgtttcttgattatatgctaaacaaggtgtggcttattcattagttttcaaggaaagaggtgagcaattcccggaactttttagaacatgctaaaggacatactaaaagacatttagcatgctgatgcattatagttagtgtataaggagcagtaaggacgaccaaaggtcactttcattgccatcttggttttggtgggatttggctggcttctttaccacatccttttatcagcaaggtctttgtgacctataccttgtactgacctcctatctcatcctgtgactaagaatatcttaaactcttgggattgcagccccagaggttttatccttattttacccagccgctattcaagatggagttgctctggttcaaacacctctgacatttatggtcaaattttaggtagctatttcccattctctaacaagttgatttaatttaaagatgattatacacatgatgaaatactgttaaaatattcctgcttgattttattaacaaaacgaatatagtattttgatctaatttacatgtctagctcatattgaattttttaagaaatttcgcatttacattaggtccaaactctcatctatggagtattaagtagcgccatgaccacagtccaccaaagtgtttaaaaggaaaaaagtttaataaatcaaaatgctccaatcttgagtcctggtgtctttttttaaaatcccaaatggtctggaggctgacattatttcctggctggccctaggagggaggatctgtcacttgttagtaatagacacagagttaaatgacctggagacctgccattaggaagcaaatactacccattatttaagtccagaggagggcagctcacctgagtatccagctgcactgtaataatgacgaatctgggtggtagagccagaagcctcagcttaaatcctgacgctgccagaacctacatttggcttatgcaaaatttcctcaaagactggcagtgagggctaaataacttagcccctgaaagttctcagaatagtgtctggagtatagtaagttttcattaaatgttggctattaacattgagacttctgttagaccaaatataacagtccatacaacttgcagaatattgaaaacaaaatggtaaacatataaatgacagagggcaacttaattggaggttgtagagaaatatttagaatcattaaaaatgaaatcattttgaattttctattgtgttacatactaaaattaacattaggaaacaatgtgaagtaaaggtgtagagtgaaatggctaaacttattttcataaagtgaaagcatttcccttccaaaaagaaaaaaattgtaatcaatctatatatattagtatcagtatgaattaaaaaaataaaattttgtattcaccatgagctgttctaagcatgtagcatgtattttctcatcttcaagacagttatatgttaataattttatattcatttacagaggaggaaacacagatatttagttttggagtctagattataacttcagcagtctaaatcagaacacattctattataccttttataggctttgtataattttccttttgtaacttgcctttaagttttatttgttattatatataagtaattatgttattaaattgtgtacatgtgttttgaaagacagatttgtgcagatataatgcatgtatgtctatagtatataaaaataaattttaaggggcatattgacagatggaaaaagcataaatgtcaaagaaagttgatttagaaattaatatataataaaaattaaactagcatttattaatttaacagatggtgagttaaaaagtaaaaacaaaatctcgaatcgtaacttgatttttacaattagtgtgattatttcacaaacttattcaaaagtttgctattttcttgttctatttaaaagaaaaaagctcccatctcaaagtttccaccaaataatttactactttcatttaacagattctgttcagaaatctgcatatgtacaaatgagcaccagaatataaaatttaatcatagaccaacatccaaaaaattatagtggatgtaggtgaggcatgctagctcatgcctgtaaccccagcactttaggagatagagactagaggatcacttgaggccaaaagttaaagaccagcctagccaacatagtaagacccagtctccacaaaaaataaaatacaaaacaattagctggacatggtagcatgcacctgtagtcccaggaggctgagggaacttacttgagcccaggagtttgaggttacagtgattatgccactgcactccagcctgggcaacagagtgaaaccctgtgttgtttttttttaatatatatatatttatgatgtaaaactatattttacatatttatattgttgactaatatatattataatttatactataaatacaaatattggacattgtttttaaatacccacagtatttattattaactatatactaaatccacaaaattatacatgcaaaaattattttaaaatgtgatctgtgtaagatataaaaaattgataacaagaaattaacaaaataccccaagtaccttattaatttaaaaattttctgtcaattgcttttgtcttaaggataaatccaatatcaaatttaatagtatgcaaccaaaataatattcagaggcaaatgcatagtattaaatgtttttaatattaaagaagtaaaacaattacataagaaatattttaggttaactaaacataactaaagaaatctgaggttagaaatgataaaataaagaaaaatcaatcacatgtaaaacaaaaaaatattattgcactaaaagttatttggaaagtagtctcttaggaatgaaataaaaataactctgaaaatctaattttagagaacataaagaaactagaaggacataagaaaaactagaatatttgaacatacatcttcaaaatctccctcaaaaaggtcccaggtctaaagatttactagtgaatgatgttaatcttctaactggtaattttcatgtcatttgaaagcacacaaataatcagtgagtaaaattttcaaatactcaagtaatgatcaaggaactgaaaaataaagcaacagacacatgccaacaccgctgtgtctgcagctatagtgaacggcatcaggatggtctgaaggcacttgaaatctaagtaggaccagagctttgacccttgttttccaggaaattccttcagggagacagttactgagacctgcgcaatgactctgcgcactacctgcagtgtgttcagagaccatttaaagggaaggagattcctgctgaagggccggtgatcatgggccagaggaaagaaaaatctgaaagttcttcgtgtccttgacatttgaaaatggactcttcaaatggggaacttgagaactctggctcttgtcaattaagatcattaagatagacatcattcggatgaatagtttagtgaggagaaaatttattccctcctttataatgttttcctctcctttgctaatgaaccattacattttgctttgaagttatgactcagctgttttgacattttcatagtgaccaaatatgccaaaatagagcaatttttttggaagaaaatatttgcaatacttggattgtgatcagcttgaggtaatatatgtaaaaaatggtaaacttgtcataatgcttagggtcacctgacctcttaaatgtagctgtttggtacatgatactaattttttttcttcttaatttaagcaactgactagaacttctttagtctcagtgaggtcatgctctcaaaaggcatattgccagctggtctcaatgcttggaggcatagttgtaaatttttatacagcaccttaagagtttttaaggttgctagtggcttcaattaaagaccacatttaatagattaacaagggatgccagattaagacttgaaaactttaagcaagtcacagtgaatttaagaaagttgcagtggggtataggaaatagaatgatttgagtagctaatgaaaaagagttgcaaagatttgtttttgccagcatccaatccaagttttaggatcaaggtaccactatctgattaaaatgccaaaatggtgcatctggttaaatggggggtggggggaaggatgctttatttgccttgtttcccatccttctcagtaacatttctaatcacaaagatgattagctctatcatttaaaaataaaactaaagtaagaaagtggcatattaatagttttcataaatcttatcaactactatatttcattgcatcataatcatgtagatataaaagcatgtgtgtgcccactcaggggtgtatataagtattttatctgtattgcatacctatgctttctgtatacaatatttggaaatacacactgaaagccttagaaatatgtgtactcttaattttttaaaaaaaagattgtactcctcaaacgatttcagttcttaaaatccattcaaagaaaactaaaagtctgaattgaagtgttttttgatcatagtgaaaaatttgaaataatctacctgtccaacagtgggcctttgtttaaaaaatcatggtgtatccctatgatggtatatatgtaatcaaaaacatttaagttttcaaagaaaattgtggaagcataattctaagtatgaagcatacttagaataaacgtgcataatgtgaagtatgggagagggatacaaaacttgtttgatatgaagtattaaagcagaggcctggtctgcttggccagagatgcatccctgcataaagtaagggctcattaaatatctgttaaataagtgaatgagtataggatgtaaaagaaaaatagcaacagcaactctaagtaatacagtgatcatgggtttactttgttttcttctctagtctccctccctaagtcttctaaattttccataataaatgtttgtttccaatatcagaaatagtataaaatatagcacaattgtgatggatgatgagcaagattattagtggaaatatatctcacaaagtgtgtactatgttttgcccatgaatatttggctcttctcttctgaaattcaaaactctgaggtttgctcacacgaatttttttccccacacttcaccagcccttgacatgtgactacaatatgtattttttgctactagttttattcatttcattttatcctctgcattcttgaaggcatgaatgacagacatctggaaaatatatatatatctagacactgaaaacataatttcttatcaaagagctggaatataaacatctagaagacaaagtatctgaataatgttaaattagaatctttattttatactaaccagatctcaaatatgaagcacaaattgtggtttattgcttgatatgtaattgcattagggttatcattctttttaatatcattttttccctcagttggattttatccaagaagtgatataatgtgctaggaagactttacctaaactttgatgcttttaaacaacatgtatgtgggactcctcctctctttgataagaagaaaatgggaaaatgaagagaaagctgaaacattaccattttaggggaaacttaggaaaggaacccagagtgggcagcttccaggggcagtttcaccattcttgtcagaagggaacagacacatagaatgtaaataacatacccaatattgactatgggaatagaggccccttctgccttccttttatttgaagtaaaatgtttgccccttcctcaggcttcaaattgcttagagcatctagaagacttggctgggcatggtggcgcacgcctgtaatcccaacactttgagaggccaaagcagatggatcgcctcgggtcaggagtttgagaccagcctggccaacatggtgaaaccctgtctgtactaaaaatataaaaattagccaggcacggtggcgcacacctgtaatcccagctactcgggatgctgaggcaggagaatcgcttgaatccaggagacagaagttgcagtcgcaccactgcattctagcctgggctacagaatgagactctgtctctcaaaaaaaaaaaaaaaaaaaaaaaaacagaactcaagcccacctttacattaaaatccttaaacaatttcttttgatgtggcgtattctattagactactcttatacgttgaacacaactgtggggtagtgaagttgtgatgtagaaactctgtttccttgaacttagtgctaactttagggagcacagatattaacatttcttcatttgggctaaatgttataagaacaatataaacactagaggattttagcttcaccaccattcgagaaaattggttttactcccaccattaaaaggaagcaatctaaagtaaaggaatcgatctataagtgtaagaacaacagcaaatttatcaggaaaatgtttaaacagacaaattaaccatttttcagtgtccattttcttcattatgaccaaggatatccttgactgtaaagaaaaattcaattatttgccaaaccgtaggtgctaatcctgtttctgcagttgtctgtaaatagaattcccctttgcagtgccgttttctgcatggtaccttaaacaaataggtcttagcaatagttccaataggattggaggttcaccattaaaaatagacttatcggcctgctgctgtggctcatgcctgtaatcccagcactttgggaggcagagtaaggctgatcgcttgagcagcctgggcaacatggcaaaaccccatctctacaaaaaatacaaaaattagccgggaatggtggtgcgcagctactcggagtagttccagctactcaggaggctgaggtgggaggatgacttgagcctgggaggcggaggttacagtgagtcaaggtcatgcctctgcactccagcctgggcaatagagccagaacttgtctcaataaaataaaatagacttattaccaggtgcacatgatatgtaaagttggttgtgtaaagtaaataaagtaaactataattgataggccatctccattctgctgggaattgttgtgttcacttgtttctaaaattttatttttgtggtggaagtttgcctctacaaaaatgacagcttacagttttaaactattggggaaaaaaaataaaactaaaagactacaaagaagaaatgattcctgaccattaagtcttctgcaatgccatgatagcaaaaaaaaggcacaaagttttactgaaggttagatacacctcacattcccagtagatatttacagaatctcatacatctattcattcaataagtgtgacactgtcctatgcactggagatacaataaacaaaatagatgagcgtccttctccaaaaatgtctcacatatgagggaatgctaaccttaaaatcaaagccatgtgcattgagtgttgaaaggtaaccaagactatacctaaccaacctacttttacaaaagacaaaagttagaccaaacagtcattgtagaatcactctgggttcaacagagaagcagtactactactagtaagatgtagtaagatggatggatggatggatggatggatggacagacggacagacagacagacaaaaagatttttccagttgcaggagcttgctatgcaagtctgaagttcataaagaaacagttagaaagggaagacacaaagtaggctggaactcccaaggcagaggctatttggggtctctgagcttagggaatatctaaaccaggcttgcttgtccaacctgcagcccctagtcctcctgtggcccaggatggctttgaatgcagcccaacacaaattcataaactttcttgaaacatgagatatttttgtgatttttttatttttagctcatcaactattgttagtgttagtgtattttatgtgtggcccaagacaattattcttcttccagtgtggcccagggagccaaatatactggaaaactctgataagcccactcctaggtagctcacctggcctagtctgatatatccataatatatatatattataggccgggtgcggtggctcacgcctgtaatcccagcactttgggaggccaaggcgggtggatcacttgaggtcaaaagtttgggactagcctggccaacatggggaaaccctgtctctactaaaaatagaaaaattagccaggtgtagtggcgggcacctgtaatcctatctactcaggaggctgaaacaggaaaatcactaaccctggaggcagaagttgtagtgagctgggatcatgccattgcattccaacctcgtaatcaagagcgaaactccatcttggggggtggggggggaagatgtcttatagataggggtgtctataataaatcagaacaggccagttgcaacctttttatctaaccatccatccagctatcctacatcttactggtagtggtactgcttctctgttgaacccaggatgattatacaatgcctttttggtctaaattttgccttttgtaaaataatataccttctgattaacttaaagtctgattattagagactttaatttcctctaaaaatttcttcacagcaccacctaaattggtgtgtgattgaatgactaggctatatagttcaccctagctaggttgacatattaaaaagccattacaggcacattcacttgcccagtgtcacacagctgtcaagtggctggaactaaaactgactcatttcctccccagttcattctgtgatgggcatacctatccaacattcacaccctccattctcctgttcttgaagacatctccattcaacagtaaaatgttgctttcaactacctcttaccctcttttcaaagaacaagattataaaatgacctgtaatagttggcatgtctataaatttaattatattttagtcaaaaccactcatttagctttgaattggtaaggctgatgacaaagccagtttggctagaacttctagagtctcggaaaaaataggctatttttctataagaaataaggtaacctatttattaaattgatagagaatcaaggtcaataattctttattccattttatttattttaatagtgacctagtaaagtagatataacttgatagaaataaagaatagactgaaaatataatcttatggaaaacaggtgtctagccttggagaaacagaacaaattacattagcgatttaagacatacaacaacatatcctaaaaagaattcttattaacatggcaaacattgccttaaaaagcataaataaataaataaatcctctgtatattcatgtaaatttggaaaactatgcttagtcttgccagacaagttatttatattactaaatataaatgacagaaatttctatgacaaattctagtcaagacaaacttctgttgcagtgaaaatgatgtaatcaagccgttttgcctctttacttgctgatagtcaaaacatctcaagaagtttgtgttggaggataatgacatttccagagatttctattataggctgtaccctcataatttttttgttctaattttgtctttatcataggtaatcatgatattaaaattctatcactattctttggattcctacattcccttaaagctttttattggaaaattttgctttatcttacataaaaatctttttcatcttatataaggcaattacgtcgtttttcacaatcaaatatttattataacaagttttattttttaaacttaaaaaacacccttcttttaaaatagttcctcacatgaataaaattgtttcactctttaagtgttgagactgaaagcctttctcccatcagtctctcaaaatgtttctattattcctcccttttaacccattgctattttctttccttcttccttaggtctccttaacctcctcctgttttttattttctctggttttccattaacattttaaaatacactttaatgagcctcagccaaaggctctaagatgaacaaaagcctggagaagagaatcaagagagggaggacaagaaggaaaagaggaatagtgggcactgctctcagttttaaacgaatttctgtggctggctctcacttttatagctggacctgaatgctacagcacttactaaggccactaaatcatagcaaagtaagggtctggctattaagaattggaccgtccttaaatcagggattattactgtaatctttacatttaaatattacatatatgggctattgaaaatgtagcaaatctgctcactgaaggcctttactctgttgatatctgcattttcagggtataactggcagtccttttaaatatctgttgtatttattttagcataaaggtaatgctttgtatttttttccagtttagaaatccaaatgctaatatatacatgcatatattacatgaaaaaagcataaaatacttgaaaacataattaccttttagatgctaataaagcaagaaaaataagttttttttttcttttcatcactactttttgacatgtcggccaataaaaatcaactaaagtttaccttctgttatattagcatcagtgactttctaatttgcttcactttctccatttgtgcttaggtatgacactttttgcaattccaaattcacatcacctctctagttcctctcttccaaaaagacaaaaagtcccttgcatgggttggatactctatgtctctgtttagggattcatttaacagataccccagcactgccagtaaacaaacggatgccttgaacagtgatggtttacaatggagactgacttctttctttatttccctgcattccaaaattttttttttttattttctttgtagtttgcctttgtcacattggcatgcagggtgagctcgggtcccagcaaatatccccaggatggtaaaattagtccagaagagaagttttattttgattggctattgtattttcagtctgtcatggttctctacttctatataggaggacaaattatttgggccaaacaatacaatgtggtttggaaacaattggcttttatgggcacaatcttattctttccatatccatttttttaaaaattgtgaaaatcaagccaatttttttttcagaactatgcaatttcccaagactcatggaaaagacagcttgggttgaattttttttttcaatttctgcttatggggaaaaagagttggttgtataaatcagcatatatatttgtccaagcattcatacattgtgtttggagtattagtggaaaagagtattttacataatgggctttgtcttctggtttagttcttcaagttcctgactcctagtccaatactcataaatcaagcatattcaggcaaaaagcaggtaattgagaggagctattctctgggtaattccatcctcttttttgtgcacacatttgcaaatgtaagtggttttcatctgtgcagacacccttgaggggctcgtctatcctcacatcatttttagacatccaagaagtttctttgtaaaactcttattctgtgatgccagatggttgatgccaccctacaagaccatattttgagtaaaaaggaccagtttagcaggtagatgaaacaacacccattacaattattgttgcatctcctgattcagtaatggcaaaatgtacttctcatcacatgttcattccaaacacaaaaatgagtaaaattcatatggttttccttttactctaagaattgggcacagctgctcccttacaagcattaaaaggaaaaaataaaggaaaaacgtctttaatttctcgtgtttttcagcatctcttcgaaaaatatcttagtgatacatggctcaacagcctgaaaatacctactcttgctatactcttaagcatagttttccttcacattatagtatgacagagggaagatttctaatatatagactggggaatctaaggaggagaaaatgaaaacttgaaataatgcttagtcatgctattcaattactccatggcctttttttttttttttttttttttgcagtcttttgtttgattcctgatctatgcagtctctgaaatgagtgtacaattcatttaccttgtctgaaaaaaaagttagtagttacatatgtggcaaatattgagtaaagatgaacattttaagtacttgttagactttcaattatttgggtttttccagaaaattaaaatgcattgatcacaaatgtaacagtacttggtttggggttgtataatcttcaggaaattatatgtgcaataaattaatgcatcaatataaccaataagcatttgttactgatttaaaaaatactaaaataaacccaggtacccaaaactattgtctgcttccatcataaggattgactagaaatttcccgaagaatatctttagatgacaacatagatataatacataattcaagttattaacttctccatttaggcttatagatcttatagacacaactgttttaaaagaagaacaagattttcatgcaaaaatatgaattatacagtagttttactgagtctattgctaatgcacatggagttcagaaccataatgacgatattgggcacttaagtcattagcctgtcatattacagcaaaattatttgtactatataatcattgtttccttttttatattgcacagatctaagcttagttcatctatctttgccatagcagtaccactttattgttgtaaatacctattttttaacaatgatttgagtatgttcgttgtagtttaagttcatgtttattagacctttgcttccttaaagctggaaaacatgaagtttacaatctgccatagggtgccttgtttgattgtgtattacttcatagcatcaattactgtatagtttatattttaagtacttgtatacacactaaaaatttcaaggggaatgggaacaagttttttctggttttttttttctagcaacatttccatcttattcatcatatttaagacatgctcttattcttaatattaaaatggaattctgtttgtagtcaactttttttcctttagggacttttaaagatgaacatgtataagtgatctctgatgactattttcaataagaacaaaatcatttgtggaaaaaaaagctgaaactgaaagcttcagctgcaactcatttgtgaacataaggtgaatatggctgtggttttcagaactggttccagggtttcataaaccttttagaaatggatattgattattactattcaactaataaaactgctttctcagaatctgttttgcttgtatttgatgccataaaggattgtttgccctataattaaatcctagagattatagcacaatataactcacctagcccataggttgctatgggtttctttgtgagagagagagagagagagagagagagagagtgtgtgtgtgtgtgtgtgtgtgttgtaaaagttaagaggtgtgcatacttctgagtttgaataagttgtggctgagactatttgaattgatttcatactgggaaatggcatacaagtaaaatcagtagtctattcaaatcattgtacagtcaagtcagctaaatatatggcaatgaagaagtaaaatcaaacctcaaattgaacaaaaccagtctattctgtagtcaagtagacactatgtctgtctctctaacttctctgcccagaccaaaatcatgatttggagaatgcactgtaaccagacaatgcctatccagcctttcctatattaaaaaatagatcatctggaactgaccctttatgagaatttatatttttttactttgccatgagttttcaagaataaaatattgtgtaataagagaaaggatcagataagcattgccactttagaagctttataactgtctcaagcacagactataaacttcaaatacccaggacccctgagaacctgtagtcgacccattcacacctgacagatatattttaaagtctgggtataaatataattatggagagatgactagcatgagtgaaatttcacaggtagcatgctagaataaagcagcgcttgaaaatgggcatactaaaattcagaaacctaatgattgcagataaaagaatgaaatgcaacttgtacaacctgctctaccgatgtgagatacaaatacattttaaaactttttcttcttatacacccctgcccactgccatagtgagcctatcgctgagtcaggccactgtgccaactgtagcaatgccccacacgcgagctccagtgggccagttctttgtattgacacatacgcaagttcggacatgacacccagaggcttgctccagacctacaccatccaataagaatgttactagcctcatgcaaacactgagcatttgaaacgtggctagactgaattgagatccactttaggtatgacttacacacaagatttcagagacttagtacaatgaaaaggatatgagatatctcattaacaaattttatattgcttccatggggaaatgataatactttggatagattgagtgaaatatatttttaaaattaatactatttctttttaatgtggctaccagaaaatttaaagttatatatgtgccccacattgtatttctatatggaaagtgctggtctaggggtctgagacctcagccacatgctggactaccctttccaagaacctcaatctgactctctcactctctctctttttttttctctctctctctctccataattgtcagatacagagaattctctttatcatcctcatcctatttattgtcattagtcacacaggactcttatctttacaatgttttcctttgtcttccattcaccttgccaatgataaagatgacttagaatgatttcagtatatccatggatgtataagtatccttaaaaaaaatttaactttttttattttaatgtattctatttttctttaagaaagagctcaacatgatttggcactagtatctgtgaataggtcaataaggagaaaaatactacaactctttctaggtgttcaaggttttggaaaaaaaaaaaaaaagggaactgagagcctggatctcctctaagacctgttgtgtatataaactcaaactgtcatttagtgataattaccaatcatcagttcccttcttcataaaacattaggtggtttattttcttagagcatagggcttttccataaatgtttaaatgttagaaacaagagattaagagttttcatttttctaaaaaaggaattcataatattcttttgttttatatatatatatatatttcattctgggaaatagcataaaagtagtgtgtgtgtgtacatatatatatgcatgtgtgtgtatatatgtgtatatatatacatatgtgtgtatatatgtgtgtgtatatatatacatgtatatatgtgtgtgtatatatatatgtatatatgtgtatatatatgtgttgcctgggtaagcatccaaacctgtagatggaggtgattggttacacttcttgtcagtcattcatcctactccaaacaggttggcatatatatatatatcctgctccaaacagtttcgcatatatatatatacacacacacgtatatttatgtgtgtgtgtatatatatacacgtatatttatgtgtgtatatatatacacgtatgtgtatatgtgtatatatgtgtgtatatacacacatgtgtatcatatgtgtgtacatacacacgtgtatcatatacatgtgtgtatagataaagaagatatgaatatgtgtgtatatatgcacacacacatgtgtgcatatatacacatatgatacacatgtataaatgtatatgatacacatgtgtatatatacacacatatacacatacatgtatacacacatgtgtgtgtatagatacagaaagaggatatgaatatgtgtgtgtatatatacacacatatatgtgtgtatatatacacacacatgtgtatgtgtatatgtgtatatatacacacatatatatatacacatagagagcatgcatttatttttgtttgtgtatatatgcacacacatactgagcacttttttgcttaaagattatctgggaccagagtctctagaactgagactagagtctctacaaaactaagtaattaaaaaattggcaaaaatcctgctctgggaaagcctctctaatgggagagaagaaaaaagagatattattaaaagaagtaaaatacatattagatagtgatgtttagcaaagtaaaaacaaaaacaaaaacacagaaaagaaaggggatagagggctcctaagtggggaaaacttacaattttaagtagagaaagaacctaggagaggagggaatgtttggggacaggcctgaaggaagtgaggtatgttaccatgtggatgtctaagaaaagaatgttcaggtcagaggaagaagcatgtgcaaaggacctgaggcaggatgtgctcaagaaagagcaggaagaccaatctgtttggagtaggatgaatgactgataagaagtgtaaccaatcacctccatctacaggtttgaatgcttacccaggagacactcattttgaggacccatcttttactctgctgttcagagctaatctatctgaaaagtgacggaaattaccctatggcctgcagaagcaaagcaaagggtctcctgcctactaatctactcccttacccccaaccgtactcacagctcagttccttggatctttagattctccccagagctgacattccatctgcaattaatcaagtgttgtgttaaattttttttaatatgtaaaagatgtttcagctgtgattatcaaagtatacaattgtgtgtcctaaggctacatggcatgggatatacatctgatgcaattctgatcattatcatcactacataaggtaacattgttccacatttatcaaatcagacctcctgccatttctgtttgggtagacacggcataaattttaaattaaggtgtataaaataaaagatttctatatatttttttaaaattattattaggagaagtggtagtagtaacccacaccatgcattcaccagggagatttatactaccagtacatttattgctatcaagttgcaattaacaaacattcatgcagttggagaattgggtatgcaatgcgtcaaaagtgtgagaaaatgtactgtctcaacaggcgattcctagggctcttcctattcaatatgaacatgactttttaatgagagctagtattaatataagcttaatttaattttatatacttattccaagtttcttaaattattcatatcctctttctgtttagacgcatcagtattgtgaggtttaattgttagctcccaaagcctaaggactatctctatttaactcacttttcagctaagctagtgaaagctgtaaattatgatgatgatggggggaatgatgaagaggaggaggaagggaggggaggactgtaatctacttgagtatatataaagcactgtgatattgtacatcatagtatttaatccttgcaacatggcaccaagatctttttatccttattatgcagatgaggagactgggctccagggaagttaagtcacacacttgctaagtggtagacccaggactcaaaattagatctcttaatgcgcaagcctgtgtgctttccaccatacatcttgctctgatactattcaattattaaacatttttattgatcaccgctacatactaggcttgatgacagacagtgtaggaaccaccattaaactccaaactagaacgtgaagacccacctcaccccaccttcagcctcacctccagtttgcattccaacaacattttatttcttgtggccatgaaatgagaaaagaaatatttttgccaaaccatcacatgactcagagaaattctcagctggccattgacttgcaatggagcaataaatttccattttcctttgcaaaggcccacctaagctccatgtttctgtccccctctgctttccttagccattgcattccccagcacttgttcgtgttttcacactaacgttcacaggtggccttttcttttttctgctgtgccagagtgcaaacagctaaactttctttctgatgactaagtgaaggaaatatttcctggtggatatttcctaactgaactgcttgacaaaaatggggagggagtcagatcctgccagaatatttctcttttactcttggttctgctttgacagtttggaggattaagggacaacaatgacagtagttcttgttattagccatgtcttaccgtgtctttctcaccattcacagtgtccctgttggaataaatgctgatgactacatctgttgtgttatttaaagtagatctttaagtcaaaatgaggatgtgtgcgcactgcctcattttgagtttgcttaatgtttccagccatattttagaaataaatcccaaatgcttttttgctaagtgcattttcctttcgattttaaacctatgtgtattttaaaggtcatttaatctgtgcatttccaattcctccagtcttaaatcatcactgtgttattttatgtaagaggtacttaatgtctcaagaagcttttggaggcctttaaaacccaaagacttttcttttccaagaccagaagttccattttgtgaagagtaaacaagcctgaagaagaccgaaatctcagcccgttcaatagtccaaaagttcaagtttcagaggggttggaatttggcgaaatgaattttcccatccatagctcaatcctctatattccctcctagcttaggctgaaacacatggaaattatatccagcaggcactcttctcagtgacatctgcatctgtaggggtgtcctggcattcagcaacaaaatcctcttcccccagggaaaaggaagactcaaaaccccaaataataataatctattacagatttcaggttaccaaaagttaaagaaatggataaaagcaaaacacttagcattgctacatgtcaaaaggaaggctactgtaatcaccccccacccttgaggcatgtatttttcaggttattatgcataattatgcatacaaatttaaatatatttccatattatattcaaaactgcccaattcttaaaaaatgtaggataaaacaaaattaattgatggcaattactgcatttagatttaaatctaaaattcctggttactggaagaattgggccagtagtgggcacctcgaacaacagaactgtctcttctggaacattcttctggatttaggaacagtgtttctctaaaattaaatgtgagattagagaggcataaagaggtgctgacagaaaaccagaaatggtgattaagaaatttggattgaacctttatttcttactacgtggccttaaccaaatgatttaaacaatttgggcgtctttttcttcatctgaaaagctaggcgcattcactccatgctctctcaagttccctccagatttaatatttcatgtttctgagactccaacatgaactgtgcccaagaatggggttatctgacggtcaacaacagaaaaaagcttggcaatttgattacaattaactcatttaggaaagaagtaaaatatttgggataacactggagttttggcagtaagtaaatctcccatcacaatttttaaatggaaggaagagttaatccaaaagggtggctggaagcagaaagtagttccatttgtcacacacatggtgaccaccatcaccatacagcacccagagggatttcaaaatggacaacacataaaacaacctatatccagaccacatcaagtgtcagaatgatgtggatctttgtggggcttttcctagttttctctccttctttagaaatgtatgttatgaattatgattattgcaatagagccaagtattcaccgggctccagctagatctttgtttagtgagcataagctccctgccagctgcaaactgcagctgtctgtcagcatttgtgaggacaaaccaccccactatccctgatcacttagccgtagacgacatactgtgtcctcagatctgctcagagcaccccttgcatttttcaatacacttcctgtgggggagggcatcagtgcttcgcacgcacattttggagcaaatagcttaaatcttatgtcaaaatgatgcttttaatagagggttctgtcccaacaaaactattctgtgagagactcactgactctggcctgacatttccggatattcgatgtcctgaaaaaggcaagggaggctaccactctgacaaccaactgttcctcaagacacagtgggccctacagagggtgccaagagcatgggccccaggccaggaacctgtcttacagctggggaatgtgggggtaagaaggccatggcaaaggggtgaagccagaggaagggcatagcccagggtgcccagagcagccatcctcctgggccatagcttacagccagagacaagacccaaaggaatccttatttcaggagaaatcgttgtctagaacattcaagtaaacttggaactctgcagttttagaggggctttgagggatgatacatttttcttgactctcatttgccagcctcctatgcaatttattttcctttaaattgcaaggcatgctcagaatgggagagaaactggcagcaccacaccagatttaattaaagcattgttggagttaaccaagagtctcccctgtttttatcaaaagtgactcatgtgggtgagaaaaatcatttttagaggggtgccaatttcaggaataccctgagaattaccctcggaatttaggaatactctgctttttccaggcacttgtatacagtaaacttggggtttcttaaaggataaaaactattgctgaagtttctttgggctctggggtacttctgaaacactccaagaagcctgagctatggtcccctagtacttgtggaaaagacttctttgaaacatgtttaataataatattttcaagtaaaaaaaataaatctggaattcttcctactcatgggggtattgtgagaatgctctttgttatgtaagagtactgtttcagtaagaactgtgtccccttgggaagaaaggcacaatgcaaattcaaattaataataaaactgtacaatatgtagcatatgcccaaagttggcttaagtcacataatgaagaaaacattctaaggtttgggaaaagactcagccctatgcatatgtgtgtgtggagctgtatgtgtttatgggcaggagagcactgacccaacataaacactttctttcccacaacttaaacatatacacaatacttaaaatagtttctttcaggagtagaaaccatgagagtcacagggtcattaaacaatagcaaagctctgttagtccatgatctttccttattcaagaggattataaaataaaaacaaagattctgcaaggaatcaatattttgcaaacacatagcaatttacagtacaagagtatttggattgctaagtaccttcacttctgtgttgctgtttgctgcttcattgtgaaacctttttgctggatgtgttacatgcgatgagcttgggtgttataataaacagagaggaaggctgcaataatgtatttcagttaggaagaagcacttgaaagaaattgcttttgctatacacatgatgtgagccaatcaatagtggtttagtctgacaagccctgtcaatatccattgtcacagttcagaaagtcgttaatggatagttcttcaaaacccaatgattttaacacatgttcaaagtcttgaaatacactctacctggcagaaattaatcacaggtaactcttgggaaagtatacaagcatttttttaatgagagccaaatcatttacacacacacacacatgctcgcacacacacacacacactcgcgcacacacacacacatatacagcagctaagggtctaatctaataacaacagatgcatagtgaatgctcagtaaatgttgaaaaagtgagagacactgggatggaggctgagaagggtcctttttatacacctgttctgtaaatttaatgattattacagtggtgatgatgatgcaggatgcctatcatattttaattattaatcatattttaatcattaatattaatctattaagattaataattgcttctgttaactacatatgtattatacattagacattgagctggatgtttttcctatatcagaacatttaacatacacaaaaatccttggcatggatattattatccccatctaacagatgatacaatacaggcacaaaaaactggcatagcttgaataagatacaacgttaagtgacagagttggaattcaaaatccaaagcctatattattcaaaaaagaaagaatgggtaggagagaaaggaacacacttgaaaaaaaggaagaaagaaagaaaaaagaaagaaatggcattagcaattggaaggaagcatatcaatggttcttatctgcttttccccaagtcctgatcctgaactcttacactcagttcctgtgaagcaaccaggaacaaaacaagcctctgagctctggggttgggcatagagaagaatgggatttcccagtttggctgaaagaagaactaaggagtttgcagaagtaaatgtattcacttacactgttgtgggctaagtgtgtgtctgaaaaagattgtgtgagggcaggggtaaaactgaaagacacagctaggttgctagccatttttgcctgaaaggaacccccaattcccacctacatctctccttctgtgttcattgttgtcttgctgcatagagcaatctggagcatggtgagtgatttgtcttctgcccagtatgcatccttgcagcagaactcaattcatgtccatggtggttacagttctgtcctacccagatgtattcttcaactgttcttattggcaatccagagagtattcagccaccagctccactgttgtcccatgattcactcatcttacctaagatgactctttttctctctcagccgtacaatgatacacaccacatggatagtttcagtaatcagttcatggtaaagcagatgatttaagaccttaggttgcaagtacttgagtatggtgaggcaagggggtgggggacattaccatctctctatgtccttagacacggtgacagcattgccacacagatggacaggcagggccttagggcagggaatcagacaccacctgagttgtggttctgccactgatttgctacttggcttaacttctctgaacctcagatttctaatctgtaaaatggataataatggaacctaccatattgataaggattaaatgagatcaatgtgcttagtaaattccttattatatagcaaataacttcaaaatattagtcattattataaatatgacattagaataatccgattgtctagcaaaagtggaaattaagactattttagaagaattatgtataacttataatctaagaaacattttcccacttcttaactattgattatttggctttaagacatttctcaaactatctgcacatgtcatgtatgtttttctgtcctggctgaaaattttgtttggaaaattaaggatacattatagcatattctttactaaagatacattgtaacacacagtccaggaatttagagatttaaagaagaagcctcaaaattactatatgttactcccctctatacctgctgagaatgtatctttacaggcatttttacaaatgtgcaaacaaatacgtacatatgatatacagtggtagctctcactatgtatgtatacatggaaagagtatttaaatgccactcaactgaaatactgctaatgatggttcagaatctgagtccatacatcagtactgaaatatccaatattcttatatatgcatgtgttttattctccaacttgacttacttttttgcggaaatctaagtgttaatttcgtagaaggcagaggctatcacctctctggtggaattaccacgcctacaactctttttggggttttttttttttctcttttatggactgatgttcacatttatatttaaggctcttctcatttgatttggctgtggcctgttttctatcactagaagagaacccattcctgtatttaatatacaatctttcctcatggaaaacatatttctgcttcacagtgccctttgtgtggattgatgccctatgatattttcttcttttttttagtaattcagctttcaatatcagctactgccttagctcaataaccacttactttattagcaaatttatcaaagttttgaacagctctcaagtgacaaagttttactgacactatatcaagtcataagaagcccagttaaaatatataatcaatagaagaatgtctaaatgatctgaatctttacattttacactgtatctcattttgttttaaggaaaaaaaaaatgtcattgtgtttctctacatacaagataggttttgctgtttaggtatattttccctctttttattgtttttctgaaaatgtagtattttcataacctgtgacgcaaaaaaaaaaagtcattaaactctggcttataaaaggaaaccagataaatctatagtggaagggaaattaaacattgtgatggtatacttaatatttgcagtatgggattgaagttatcaatcatcattattaccattaaaagtactcactatgaaacccaaagctatgctaagtgctataacaaaaagagtttaaacaaaacaccctgccttacactatagaaatacattatcaatgtagatacacctaagatgtattacgagcaaaataaaaatactaagtctatacatgaaaagacagtgaagaatttacatcatagacaaatgcattagaagtagaagacatggatacataaattcctgagaaaagtagccatgaaattttcctatggctgaattgacagtagacgccagctgttcactgatatcaaaaatgcaaaaatgtggttagatttaactacttaaagttgataatgcagtctaaaagtaaacattttaattgtatgaattttcacttctccttaaatgggtagatagcatgaatattaatcatggaatagatgatgagtacacacccttctgttatgaatctaattgtctattttgtatttccacaatgtctaagtgggaattaagtggttaaaactgagcactgcagttaaagtgcccagcattccctctttcaattatttccagatttaatcatgatttgtgttttgagcaagtcacttaaagtttcaataacttagtttttcaggctgcaagttggggtttgaaattatgacttctatttacactgagcaagtgaaaaaaagagatattaaatgaccaacagtacattaagcccaaacttaccctttctgcccactctgacatagggagttatgtgcaaagttctgggagctctgaaaccacaggcgggggaaggcaaagcagtatttattacagccccatgaattagcacaagcgtgaatgccctggaaaggaataaacaggaggctggaaagaaatgtaataaacttgatttctttttttcaatcaatttgggataaggtgctcttatttatgtaatttggaaagtagttaagcagggtaattccaatacaagaagtttgtgttggaaaatgtgagtggagataattcagtactttgttatgtaatccctatgatggtgtgagaagagttttggaacctctggggattaagagcctgacaaaaccttattttgtcttttttttttctttgatttcctgctctgaatactgcagagtggtaagatgatggcactaaagctactgttgccagctttgcccttgatgtccttttggaattgaattgaaatgtttagagctcctagctgctaacaaaactatctacctacactgatgttgatctcaatgtcaaacctcaccgataaagtgagaacaagtagtgtagaaagctgtgtgtaatagcttttctgaagtataatgactccactttcctttagcaacatttctgaaatgttggctgtcccagcacttccaaatttcaaaaaaaaaataataacaacatgtaattgtaacatgggaataccgcgagaacagcagtttggcaggaaaagaaggtatttcaaaataaggtccccagaaagagatgttctggcagatgcacaattttggatcatattatccaaaccgttgaattctggaagatttgggggttttcttttttggttcccataccctaaatgggagtagatattcgtcgtccatccagagggcattgtttccccttcctgttactaaagtgagaaaataagtatactaagggcacccatttacagtaagcattcgtagctctagaggtgatttttaatagcacaatagctgtgtcaggtataacacttgtgttgggctaatgcctattctcatatgtaatactattaactgaagatcatcttagaaagcccactatcctaacatcttagaaagcccagaattctaactcccctctggtgagagcagttttagcaccaattaagtctctcaactggttaagaatggtatttaaagctaatgcctttggcctgtgtgttgagatttgaattgcctattgttattgaaaattctcagtctttgaaaagcattctatttgttcaggcttgacagaaaagatctccaatgggaaaagcagaggaaaacataaaggaaatataagtaaattctagaatacctggaaagctagtacatttcaggttaaggttaatgtttatggaggtaaaaatacctaggattaagagtgattgctctagtctcttatgcaaatcagattaaatatttcagagtttaaacccatatctcttttggctctatttattttcaaataaaaactcaaagtgggaatggaaaaaaaaaactactcgttggcttaacataaatctttaaactgcaggaagcttcaccctcaaaaagtagttgaatctctgagggaaaagaaaaggctgaattctatttttcataaatgatggattattgtaccacactgtgtattttccagtaaagtgtccttttatttgcactgtgtgattacaagtttctaaaagtatgtgtggggtcacttgggtgctgtgggaaaatggaaggaacactgttctgttaaaatcagtagtgaaatcagaagcaaactatgtcccgattatcacaggcatgtgtttaaattttgctttccttaattggttatgttgtatttacttaaaatgaacaatttggcaagtttttctcccttgacaacagaaaagcgtaaactgttttataagtttggctgttaaaatcagatttgtaaaccacgatattcaaagacttttacggctgtttacagggtcccagtgatggaccttgctttatatccacgcacttcttaacatttttattttgtatttatagtgctttcaagttatttggttaataaaaagtatgctatatattatagtcatctattgacttcaacctctacataactcttcttagaacaaaatgagtggaatgaatgatggcacaggccttgtaatttgacttgtcatctgaggacaattatttacggcatcaggaaatggaagttgacgttctagtctgtctccaggaaagtaatcattagagccaactttggagagtttggctacgttaaaaactgtctaatcatgtccaagactctgctagtttctcagtatgtatgagaaggaaacaagataaagcatttaaaaacatattttcattttctttgaaaaaccaatgcaccttacacgcatttctcacatgtggagccagatggtggtattgaagacaatatgatatacatatatatctctctaattaagaatactatcaccagaatacctaggggagtttcaaaaagatataactcataccgtaattattttcataatctagcatttatacgtcatgtgtgtatattttaatttgcaaagtactttctaatggcatcgtttttactagttccaaatggaagaaaaaaaatataccgtgcttggccctgcatttcttggtattctatcatgggaaatggcaaggtttttgaggtgagaccagaaatcgaaaatattacttttgtaacctgtgaaaacttagattgattattctgtgtcattccaaagatggacttgaaaccaaaattgccctgaggcagagttattctgaaggatgttaagtgtttcttcagtctccaacactagaatacagacctatgggactttgactacagctgtcagttgaagcagatcatacatgactggtggtcactgcgatgactggacctagaaggaaagttgttaggatagcacataaacacactttgttaagatgctcagaatgactcttccaactatacaattttgaatttgttaatggctgatattcaaggtcttgtaaaagcaatttttgtttgcttgggttctcagggcacttgatatttctccaaaatgacctgaggtcaatccctcctcttagatcctttaatctcttacatttccatttgactccttactgtgctgcattataattacacaggccagacaggcggccatggtggctcagacctgtaattccagcactttgggaggatgaggcaggaggatcacttgaggccaggagttcaagaccatcctggccaacctggtgaaatcccacctctattaaaaatacaaaaattaggccaggcgtggtagctcacacctgtaatcccagcactttgggaggctgggggtggggtggatcacttgaggtcagaagttcaagaccagcctggccaacatagtaaaaccccatctctactaaaaccacaaaaattagctaggcatggtggtgttcacctgtactcccagctactcaggaggctgaggcatgagaattgcttgaacccaggtggcaatggttgcagtgagccgagatcgcaccactgcactccagcgtgggcaacagagagagactccatctcaaaaaaaaaaaaaaaaattagccaggcttagtggcacatgcctgtaatcccagctactcgggaggctgaggcacgagaatcacttcaatttgggaagtggaagttgcagtgagctgagattgtgccattgcaacccagcctaagtgacagggtaatgattatctcaaaaataaatgaataaataataaaaataaaaataaataattacacaggccatatacatgttatccacaacaattaaacccagcactgccatgtatatagtaggtggtcaatttgtgtttattttttattatcttccagcactgtccaacatgaaacatatgtataatgtaaaatcttctggtagccacattttaaaaagcaaaaagaaacaatttaaataataagatattttatttagcagaaaatatccaaaaattatcatttcaacatatggctcaaactgcatgtcaagtgttcaatagccccaagtgactagtggctagtacattggatagcacaagtctaaagcagtgcttttcaaactattgagatacacagagacaatcatacttgtataacacactggtggaaactgctcatagccaaagaatatacagtacaactgccacaaggactcaggctgtcttggtcttgcctaaattaccctaagagctgaggacatctgttaactctcagacctatagtacccattttttaaagtttactttaatttaaaaaaaaatttttaatttccgggatacatgtgcagagtgtacaggtttgttacataggtatacatgtgccatggtggtttgctgcaactatcaacccgtcatctaggtttcaagccccacatgcattaggtatttgtcctaatgctctccctccccttgcccccaccccttgaaaggccctggtgtgtggtgttgtcctccctgtgtccattcttaagagccccatagctgggaagctgtctacctttctcacatgatagtcactgtacttttattatcaattcatttaaaaaatagatagctcatgacaaatatatagatagatggtagatatgtatgagattgtgtatatatacatacacacatatgctatagatatatagacatttatttttcttttcagagttcttttacattttctcaatgtatagatagaccttccaccgataaatgagaacttcagatggccctataatttttccaatcagtttaaggcaatgatcatcaacaggaagtaattctgtaccccaacctccaccctcatggacctatggcaaagtctggaggcatttttttttattgtcataattaaggagggcgtgctgctggcatattgtgggtacacaccacggatgctgttccatatcctacacagaggacaggcctctacaacaaagaattgtctaccctaatatgtcaatagtacaaaatttgggaagcaatactttaaagtaatataaagtattacagattttcaggtagcaagaattgtctcaatttagtaatttacagtacctagtcctatgtgataatccaaactttaattgaaaaataaaattccacccttctcccagctaggagataagcaggatatttttctttttctgtcattctcagtcttgaacttcaccttaattccccattttgctaattcaagtttgagcctgctttgtagtcaaaggcagggaaagcaggatgcaaaaattccctttctttgccagttatagagaggtttctcactccctggaccaggtagattttcaaaagcatatctatatttattaaaaagaatacctaataaagtatcccaaaccctctcattatgtcaacaattgaatgaaggcagtggagcgttcagttaagatatatatcttgtctacagacacaacaaattactatcagtaattaataataagacaccttgggccaggaacagtggctcacacctgtaatcctggcactttgggaggctgaggtgagcagatcacttgagcccaggagttcgagaccagcctgagcaatgaagtgagatcccatttctaccaaaaaaaaaaaaaaaactttagtcaggtgtagccagtagtcccagctacttgggaggctggggtgggaggatcatatgagcctgaagggttgaggctgcagtgagctatgatcacaccactacactccagcctgggtgacagagcaagactctgtctaaaaataagaggaggaggaggaagaagacatcttggatgtgtttagaccatgcttaatgaaaacccagacctcatgtattatattcatccccgaattcacagcctttagcatggagcctgattagtagacattcagcaaatatttgttcaggagtgaattttacacacacctgactttgaagataaatctgagaataggaaactgaggagaggggactaatgaagacatggaaaaagtttgaggcaaattatgtttctgaatttcacatagaactggtagtaattatacatcaataaggagagtaagaaatacctgcttcagaaaaataaatcacttcaggttaatatagaaaagaagattgacaagtttattcaagcaagcaggacctccagaaatgtctgcattagctagggatggtatataatcatatttaattgaaatcagcaatgctaaagagttgtctcctgtagtttagatgaatttttctttactctgaccacaattttgtgcataaatacatggaattatccatgtaaagattacgttaaatataaggaaatgaaagtgaaaataaattgtgaatatatggaactaatcccattctcattgtacattcatgctgcaacaacaggactaatactttcatgtgggcaaattttactcacatggcttgttgtagacagaagagcctgagctattaattcaggtagttgtttcataactactgttttctattcagatttgcataaagtaataatcataaaggagaaatttaccaaaagcctctgatttttttaaatcttcagtgttcagactgcatcacagtgcttccgatacaagcgacaaaaatcgagttaaaagcagattaaagaagtttattacccgaagaccttccctgaaaactctgcaagaaaaaggacttattaaaggtacaggtcattttatacttgtactataactgtgataaatgaatgtgcctctgtgttcatagctaatcagctctaaaggaatattagaatattttattcttcttaggttgcttattaaattttctactctgtaacagagaaaagaaaaataattgtccagaaaacagatcctgagaaaataaaggaggtatcatggggccattgaacaatatacctagttttgcccacagaggatctgtgttctgcactaggaacagagaaaggatatcctagtgtcctgctagaatgataccatgtcctcctgtgtctgggtggttccagttcacagctgggttttagtaagtatgaaccagcacacttaccaacccagcccttttcactatcagaaatgtccagatttggataaaaggttatctgatcatcctagtcatagtctgaagtaagtgctaggaagaaagtctaagacaaactagtgtcatgaaaatgtatggatattgagagctggcagtctaaaaactcaatccaaactgaaataactaggtagttttacaaatatatgtagagggcagaatagatgattgtaagaatagatgatggccaccaatcatggtctctggcattagactaattagatcaccagtcactcattttgacattgatcaagttatgatcttctctgtgcctcagctttctcatttgttaaatggggatacttatatacatcattgaaaggaataaatgacatagcctatgtaaagcattcaacagagtttctggaacaaaagtaaatattctatgaatgcccactgcttattaatataattattcattgttgttatcactgttagtgtgtcaaatgaaaggatgaatggatagatagaaccagtgattagtatatttctataactggaaattatcttacagaatatacagactaaattgattctttttaaaaacaagaaaacatgaagttcattattctctgtatttttcaaattttctagcttatgtgtacattttgaaaattaaatgtaagaaagaatttgaaattgggcgaaaagaaactcctaaccctcagaagaaagctgaaaggctaaactttatagaaatcgagaggtgatttaataagcaatcatttctcatgaagagggcaaagcagatcctaatttcagcattacttaaaaagattagcatttaaataatttataacaactgttcaatctatcagtttccgtccattttgaaacaggtgaacagatctgaaaaattagctagcactttgaaccaattgtagaaggtgaaatttcatgaagcaaaagcatacacattactaatagaatagaaaattcttaggatttaagggtaaaacgaggaccttgctttaaatcagagttgcctcagacttttactctccgatgcataatacttttctgagttgtagacagtaattgaccctctacagattcaacttcactaagtagtattactagtaccttcagttctgccttagaattcatcctatagatgatcattttcttggaaaagattcagttgcaggttaactgccatcttgaaaaatataaaaccagctaagcaaccaacaatcctaactttacataatgtccgagtttttcacgactgggacaaaataaaaggggttttaattcagtggcagggtctggctccacatgaaatgctgaaggattaattactacagtgctctagaattggtctcagaaagcattaggaaagctggatgcctaatgcagttttcataccgaagcaatggaaccgctaaacacactctgattcatgcatttcttatcttagagctccattaaattttcaccataactgaccaatgagtcagtattcattagtagggctatggaaaatctatgtaaaattctgatttgataagcttccattgttgtcttcagtagaatttttttccacgtacagatcaagttatgcaaatgtagtcacttcttgggcttgtttcagttttagctatgaactttttttaaggcttttactaagtttttgggtttttttttcccaactcggtaaaaggcattaaaccaatttttaaaaatacctggctagtcacacttagtactttaatccatttttttcttacacttaaagcaaagacttagaaaaacaataaaatcagtatttttaatcagttaagaaaaattgcatacaattaatgattaatggttaaatggttagtttttgcaagcaaaatgacttaactctttcaaagggaagaattatttagaaagaggaataatggctttagaattgttctgcagctcacttggccagataatctatatcatactttataaactgtctaatcttccagatcggcacaaaaggcctctattaccaaggttcaggaaagctgtgcttggcagtttgggccttaacaattgtgcttcctgaaacctgggagggattctgcagcgacatgtcagttttctttttctttttgtttttgtttttgtttttgttttgtgatggagtctcgctctgtcgcccaggctggagtgcagtggcgcaatctcggctcactgcaagctctgcctcctgggttcacgccattctcctgcctcagcctcccgagtagctgggactacaggtgcccgccaccacgcccggctaatattttgtatttttagtagagatggggtttcaccgtgttagccaggatggtctcaatctcctgacctcgtgatccacccgcctcagcctcccaaagtgacgggattacaggcatgagccaccacgcccggccggccatgtcaattttcaaagtgtttattctttcacgtaattcaccagtaggttgaggaggctgggctttgaattcaaccagcctttattgagcaccacgatgggggcaggaagggctaatattttattgaccctataacgcccatcagagtcacgtccacaaagcacttaatgtgaaaagagatttaccccaatatcacacaatctaaactcaatcacaagccctttcttcaaaacctgttttatatgtggtttcattagctagaacctagacttggaaacagtcccttgatggtgctgtattttcttatttatttatttatttgtttgtttatttttttgagacagaggctcactctgtcgcccaggctggagtgcagtggcatgatcttagctcactgcaacctctgtgtcccaggttctagtgattctcatgcttcagctcctgagtagctgggattacaggcatgcaccaccatgccccactgtttttttgtttgtttgttttttagtagagatggggttttgccatgttggccaggctggtcttgaactcctggcctcaaatgatctgcctgccttggcctcccaaagcgctggaattacaggcatgagcaaccgcacctggcccatattttctaatttctttaatatgactaaagagaagtacatattaagatatcaaataaagtgggccagaaaaaaattctgaatgattgctcaatgaaaagaaatcttaatagctcaggtgggtgtagcaaacattgtaccattgcagtggtagctttggaaaagttctccaagggcattcaagtttgccaaggaatggtgagccctttttaaatatatgagtttattaacattgagcatctcattgggaacaaaacttgaatccgtttaacatataaattataggcaaaagcgtccatttttgggtggtaggagtgtttataaatctccttggcctgcttttggaactgaagtaacagctctttagttttagccagactgccttatgtaatctttcaaataacagtattgacatccaagtttaggtaatacagtttttagagaagataaccattgtttggctttttaggagcaattagtatgcccttatgtcaaaataatagcatcagagaggatttagaaatgtttagtgtttagaaagtagtttcattcatcctaataaggacaaaaccatactggatggcattagtagaaactgaaattagtatcatattacttatttttgaatcagtatattataaaacctgcttgaagaataaatagcacacctcagggatttatgataaggagaagtgctttctagcctcatcttagttttgctccctaaaaggtaccactttgaacagtttctatttatagttctggtgatttggtccatacctacatccttcttatttagggtaaaagctggtttgtttttttgtcaatgtccttcttatcttcagtgttgtaatatcttactttatcagtcttagacagtactttaggtttctactgcaataggcgtgaattttactcaactacaccaagcctcatcttagctttttttattattattatttttattttttggagatggattctcactctgtcacccaggctggagtgctgtggcatgatctcagctcactgcaactcctgcctcccaggttcaagcaattctcctgcctcagcttcctgagtagctgggactataggtgcacaccaccacatccggctaattttttgtattttagtagagatggggtttcaccatgttgcccagcctggtcttgaactcctgagctaaggcgatctgcccgctttggcctcccaaagtgctaggattataggtgtgagccaccgcgcctggccctgcttggttcttctcctcgccagatacttacagtcaaatacagctcatcccacagtctccattagctttctccacaacttgcaagatgcctacatctctacttaagttttgttaaccctagaaaattgagcgctaagcctccattggtaagatgaagaatttacagccaccttctcctctcatctcctctgcctcttctcttctacttctatgtcatacaaacttattttactttacttgtttttataagtatggcttatttataggtaaattttaaaagttaaaaaaaacatggctgagcatggttggctcatgcctgtagtccaaacattttgggaggccaaaggaaaaggactgcctgaggtcagggttcaagatgagcctgggcacgataaagagaccctgtctctctacaaaaagtgaaaaaaagttagccaggcgtggtgatgcatgtctacagtcccagctacacaggagactgagatggaaggattgcttgagcccaagaagtcaaggctgcagtgagctatgatcacatcactgcactccagcctgggtgacagagtgagactccctttcttaaaaatcaatcatccgggcgtggtggctcacgcctgtaatcccagcactttgggaggcagaggcgggcagatcacgaggtcaggagatcaagaccatcctggctaccatagtggaaccccgtctcttctaaaaaatacaaaaaaattagccagccgtggtggcgggcacctgtagtcccagctactcgggaggctgaagcacgagaatggcgtgaacccctgaggcggagcttgcagtgagccgagaatacgccactgcactccagcctgggcgacagagcgagactctgtctcaaaaaaaaacaaaaaaaaccatcaattaatcaatctatcaacattcatactattatgcttacataagattgtttactgtagcaccacatagacttcctttcctgtacttataatatcacaactcccgtgactctcaaagggtaaggcccctgattattgtggaaaaactctccttttacatttgagggatatattaacagttttatgctgtttcacgttacctccatggctttttcatattttggactaaatggtgaaaaaaacaataatcagctttattttagtcatgtaaatactatcaaatctttggccaagttatatgccagattggttgaacatatccatgggtggcatgctgtgaattatgggccactccagttatactgttcttgctttcaaaccttatgctctatcatttgcttataatcacgcttttagtctgattcatttttccattttgaatttcctgcacagtgttcttcccctacccagagtttcatttttttcttgcattctgggcccttatgtcattatgtgctttcattctctcaaactgtctgtgtattctagtctgccactccttgcttttttccccctgagtatcttcttctaaagtcctttcagcctctttctccaatttgcactggttgctctccagctgattgccctgtgatctccttccactgctcctctgtgttggatccactgtcttcggcatcccatgccttcccttctattactctttaacagtttccatgaacccatttggaaagcatgagtcctcaacggtctaaaaaataccttcagtatgcccacacactcgatcagtagcttagttgggtataaaattccattgcctgtccaacactgagttgcagattccgctcttaaaattgttttgcttgtaccattgttactttgaatttctctctctcagaatcattggggggttttggtctttattttgagattctggaatcaagataatgtatatagtggacaggatttttaaattttattctgcttggcccttaattttaagaattatgattctttcttcagtgctggattttttatatttttgttattacattgatacattcctcccacctgttttctctgtttcctattctgaggtcttttttatgtgatcattagatcatctgaattgatggtttcattcagtgttatcttttctcaaattttgaaagaattctcagttttgttccccaatatttatattattttaactttagcaatcatgttttcaattttctagatttgtttcccattcttctttttttgcacatctcatttctcacataccatgaaaacaaaaactgtgttgaccactctactcctatacaatagtgaggatggcacatagaactcaataaatattcggtaattgaataaataggaaaagtagatattttttaaaagctatctgaggacatagattagaatttgttgttgttttggagtcttgtttttattttttattttaaattgttctcttctggtctttaaatgatcaatttcatctatggtccttttctttcctttatttgattcattctatttctatcaaattagtgactttgcccaaatgtctgatgggcaatagttgtccactcttattaaagaatgagtctctgtagagaatgactagagctctgaaaacatgggtagacctggccaatgatatggttttgccttagggtggtctgctggtgcatcccacactaatcccatacctcaaatatcatatattttcaaaggatacagaatgctttatattctcttgataaactgaatcaatcttactgctgatagtcaatttttcagctccattttacaattaagaaaaatgaggagaaaatatctcagattatttgaaagtatagcagctttgaaatttgaccaagccaggcttgaagccagattctttgatttaccagctattaacttaatatctggttattgactttcttctttatgaaatttacattgaaagtttaaatgaaatgatatatgcgaaaatggtgctcagcttatcttggccatcccacaactgttttctccctttcttttttgtttcttcctttcttctttccttcatttcatcttgcctttcttatttttatctttctttcctttctcccttttcctcttctttatttaggtgcacagagtaaattatgaccaagatggccctaggaaaccattctgttaagtatttgcttaaagctcgagaaatcattgaaggcaagcatctaggaaaggcagcagtaattcacttacttcaagaaacatacactgataacttgggcttggcttatatttctctttttggtaattttaatcatgatgctctttatacataaatgggcatgagctcatttttctaactacactcacttatatagtgtcatgcaactgctggaacatttaagtaattacccacacagacataactgattgtttaaggtgtctgccataaaagaaaataatgtctttgaaaaattatagttcttttaaaaatatgtcaattatgttgagaaacaaaaaaaagatttgtcattcaaactgcaaatacaagctatcagccctagacttaacagtcatgtttatgaatagcaacatcattgagttaagagaaaagtgttttttaaataatttgttagaactgatatatgacagagtaacataattgtcacactgttaatttaagcaaaatatatatgatcaacactgtaaaatagctttgggtagagacatgctccaactttgccactttatcagtgttagtctgagaataattatacttgaatttatatactagggcatgggtctatcattgcttgggtctgaaatactctgacaacttccacgatatgcactaatgtgcttaaaaatatcttgtaaatcttcttttttaaaaaacttctttatggttcaaaattgaactgtgatctttacgtgtgcgctgtgtcatgatttaatattagccaaaattaatagccaaccttaagcttctttatctcggcctacaagcttcctggttcctttgcatttatagttctcaggcagtttctgttatttaaaggctcttgggagcaaatgtgttggtaatacagtaccacatagttagcttttgttcaataataagatacaggacaccatgcgagatggagaaatgttgagaaaagggtgcacctgggtagcaggttaagcccatgtattttaaaagcctgttgtgcacacaggaaacaatccaggtcttgtgagatattaaaagcagaatagctttggagcaaactagagaaaatgaggttcagaaatgggagcaaattaggtaaggggaaaaagaatgagccagaatgataaattggtttccctgtggttcaagaatttattttcttatggggacagatctttttatacagatgttagtgagaatgtaatatttgagattgtgacttacatacacttgatttttttaacctacaaaatggttttaccagtaaatttctggtatgtaactcactatactttatgtgttagcaaacaacaatgataatcattctccttttagttcctttaaattacatttctttcacattaaatcaagtcctcaagatgtttcccttttctcaagtaaaagaaatgccagataataccaggcttcagccatgaaactgacccaatgcctagtaatagctatgcttaatgctgggaatgtaaaatgaataaaacccagttgattcagccagcatattggcattttgtttttagccaatgacccctaaaacccatactaaattttgccctggcaatagatgctggttttattcattctgtggactatgtatccttaaaagattgcccagaattctggcatgccctatagggttacatgaatctggtgccagtttgaaatattgtatttgagccttccagtttgaggactgacaagcttccacaaaataggaagaaatagatcatacacaccaaaaaggaagcagtaacaagtggaggcaggctttgtttcatcttatgactctatgccatgttttaagcatactctgtgctctaactcaaatcttgtgtgtgtgtgtctaaattgtaaaacagatacaaaacctccccttccacccccaacattgcaccaaagttgatgtgctctcgaaagcatatcctcaactagttggagacaaccaaaagtcaggctagggtggtagttcctccttgtgttagaagtctgctgcgctctggagagatggcccatggctgtttcagtcctctaatcacatcctaaatctttcctctgtgaaaccacctgatgagaagaaaaagatgcagggcccttgtcagtgttcaaaagaatcccctttttaaaggttagcatttattattgataccctgctgttctccagcaggtgttcttgtaccgcatagttccctcctgactcctaaagccagcttcacgagcagtggaagattcttcagcttagttcttgttagcttttcagggcctccatagacctacgaacagtatccaaagccagtgctggatgctgctttcgcctctgtcgttggtataattctactgctcacactaagtactagatggtgatttcattgtgtggcgaggtggataactgagggagaagaaagcagaatttcattctgacctggagattgattatttgagcaaatgtgtgaatgaatgcttcttatatagtgagacaagttgaattttccatgctattcaaggaaggaggtctcactccttcctcacttatgatatgaatgggattttagagttcacatggtgtgtatgttgagtgtgtctctaaagatagtacatgtcagagctctcataactcagatatcctcattagggaccccattcagcagatgtgttagactgctacgagcaaaggaaatattaatatccacaattcattttgacatatcctaagattaagagagtgctcttttatttcctttagcatcactgacagtttggcctacaaatcttttttctccaaattcatgtctattataaatcaacaacatttcataaatttctaagattcaaaaaaaacttgcattattttatttcaggggcccaaattttgtccgatattaaaagcatctctctttggacttcttaccccacctgattagtgataacgaaaattaactgggcctctgtaaaactgagtcatcaggaaaaataactccatgttgtaaaagtgctattcctgcattttctattcttctctgtgggagggaggcaagaggccatatcagaatttggatagtcataattggtggtctgtcagtattagtgaaattgcaatagggagaggtatatctcccagcttttctttgaaattgactatattgctgtaagtgtgttttatcaaagcattttctggggcaacagatctgaaaacataaactttatgtagcattgctcctccttagatatttccctttaatatgtcttttctttttgaagataaaataaaagtacataaaagagttctgggaataggcagctatatgtcataaacaccattcactccccctcacccagagctcccaccccccaaaatttggaaacgatttgattgaagtgatgactgccttgatcttgtttgaatactccttcttcattgtcttcttctctcaatgggaggcaacaaccctgtcacagagacattcctgggagggaaagaggtatttctagcaaccatattttccaaacacaaaattgagacacatggcctgacaatgccataatatttgaagtagggactgtgctcaaagatccagaacatatggtggaaagagttttcttataaaaggcagccatttaagacactttctagattcttattcacaaaaggctcattcccccatcccttttattctcattaaaaaatattacccacagatcagaagactgaccagttttccctcaaatttgcttttttgccagcttgagaaccaccctattgactaaaaagttaaatgcacagccatccaggaagaaatgcaaaccagactgccaaacatattatgaatatattgctcttcttaaaaatgctagttggtttttcatactggagtattgactaactgtctgtgtttgatgtatggtttaccagcctgatgtcgacttatggttagagcttaacttgttagttctgcttttgcagccaattcagaataactacagatgcctcgagatattaaaattgactgctcaaatggactcagtgcgggagtttcattggttttaaattgataacagctgaaagagtgaatgattaaagtgtaaatgggcataggacacagctctttcatagaaacacttgtgaacagacttcagtagtgtgggagttttttctttctttttctattgtagttatttctaagcaaccttgagttaaattttaaaagtgctcaggaatattcaggagcctagaggagaaataattcctgagaaactgagataaattttgatgaagtgggtttctattctacagggaacatttaaagttaagtagcattccataaggtggtaattgtgtctatttcccaggcatttaagttaagtaagctgtgtaggaagtataaactgtcataatagaagggttagagtgttgtgtacatctctttcttcaactcataaaaaccaaagctccaaagtgccttatcacagataagtcaaagaaagcctctcctttgctttcttattctcctaagaacaattattattattttcattatttaaaaagatgttctgaatactttcttgtcgcatggagaaaaagaatacaaaagagaaataaaaaaacttttctccccctccttaaatcagcaatacttatataaaacaggctttatgaaaacttactttcaccatttaatagtagcttaaggaaaaggcacagtaaagagaataattaagtgaaatgtaaagaaatttatgaaaaagaaatatctgtttataatacagccctttttcaacttaatatctttctaagagttaggtgtgctcattatacaatattgtgacctagctcctttctgttttcaaatgtctcttagtattttatctttgatattccatcaggaaatatttatacattttttattttatatatttttatatatacttttttaatatttatatatgaagaactttatatagctaactgattaaaagcatcaatctacagtaacacattaaggcaggatttgttgacaaaatataagtccatatagtatgtactaatttcacatattcattttaaaaaaattgaatcattgtgcctagctagtatgtccccacatatgtagcaaatattcaccttatgttaattacaatttgtggaataagagatttagatatatttgacagtaacattagtgaatagtgatatgtatgttcagatgtaagaaaatcaaattatgaaggatgctctgactttaaaacaaaataagccacaaatatcctggtcaatgtttacaagaaaatgtgttatatatttatttactgctcaaattttccccaaaattataatgtatatacctggaccacatcttaaaattgcagactcaagttgccttcatgaagcatacagccgttgaatcatgcttttgttgtgatagacagcttatgcagatagccgtctaagaaactgctaccaaggttgacattttcacaagatataattcctttagatatgtagagcaaaagagagaaatttcattctctttcaacagttgttcagctccaattttgtaatgattttttaaaatctatccatatgagacaggagggagattttagaagagatgtcatccaaataaaacatatgtgagggtcattaacttgaatataacactcctaacatgtccctttgaacttggaactcagattcataggaggaaagaaaagatggagctgaaagaggcctggtctgggttaacctcacagtaaaggaatctttcacataacaagagactgagaaataagccgatggtataaaagtgatatcttgaggatatcttaatatggtgagattccgaatactctaaatttcagaaaaaccattgctcccttggactccctcataatttgtaccacctcatacattcattcattccctggacagtgaaatacgatgtttacatcttttgtgacttcacattttaaatgcattgaagcctttacaatgttacaatgagcatgttacaatgtttgcatcttaaaaaagtaattagcataggagaccatttgatattacataaagaatttgacaggacctcactcaatgccttttaagaaataatatcgaaagaggaagtgagagcctgttttagttataaatctgttcacataattaccagttgaagaagatatcataaacattttagaagagcgaggttagaccctcacttcattaaaaacagaattccaaatgatgtcagatacctccagttctctagcatccgtttcttatgttcatgtacacacttgcatgcatgcctttttagtcagaaagatcatgtatttgtagtacgagtaaataattttgaagaaaaataacattggttagaaatatactactaaacacatgaagagagacaaccagatctgcatgtgaggttaagttcaacttgagatgccacagtgatatggacaaagtattccaaaggtggctttgcagtataggaatataaatattccaaatgtgactacacagtgtagcagccgactggacttttccataggagaggtctctgcctaggtttctctactacagcatgaagaacaggatgggaagcagaagcttttgccagggagctgtggcctcaaaggtattgaccgggcaggatgtgaatagtgggtaaagttggcaccacagccttacttcatccaggacagaaggtagaaagtaaacagtccattggaaaatgtttggggacacaagacatgggatctgaggaattctaggaatggtagtaaaagactttgggtttggctgggtgcagtggctcacaccagtaatcccagcattttgggaggctgaggcgagtggatcatctgaggtcaggagttcaagatcagcctagccaacatgatgaaaccccatctccactaaaaatacaaaaattagctgagtgtggtggcaggtgcctataatcccagctactcgggaggctgaggcaggagaatcacttgagcctgggaggcagaggttgaagtgagccaagatcgcaccattgcactccagcctgggtgtcaagagtaaaactccctctcaaaaaaacaaaaacaaacaaacaaacaaacaagactttgggatcaagtcttagtggaaagcacttccctgtgataagccaaagccatctgttcctataatcagttattacagcatgaatactacccaaagcctagaggaagcttctgtgtgtggatcgttttgttgttgttgttgttgttttgttttgagatggagtttcactcttgtcacccaggctggagtgcaatggcacgatctttgctcactgcaacctccgtctcccaggttcaagcaattctcctgcctcagtctcctggatagctgggactataggcacccaccactatgcctggctaatttttgtatttttagtagagatggggtttcaccatgttggccaggctggtctcgaactcttgacctcaagtgatccacccacctcaacctccccaaatgctgggattacaggtgtgagccactgtgcccgcccctgtgtgtggattctttctggcctcccagatgcaactctctgagaagctgccatgaatgtgtatgttgagcttcagtttcatttactgaccaggaccatggacatcgatcagagatctgctagagagagtctgcgctaaccaacttggcataccatctgcatgctagtagtggtctaggaagactctgctggggaaagcgttagccttttggctcagccttttgcccccgttatgaccagcctagaatcctagacacaaagaacatctaagaaaatatgtagtgcgttcttgggagaaagagatactacagcacaataactgtattagttttatataatgtttgagtatgtaaagcacacttgaaataattaaaatacatgaagaaaatctttttctttttgtgcttgggtgtgtataatgggaagtcataagttgtagtgaaaggggcaaccaagactcttcctgtgctatttaaaagagctgtattttacttattcaggaaaacagagtattgcagaaccataaagattaccaaattttgaagtagacttggctctgctacttacttgttttgtgaatttgggcaagatgatgaaatgttctttcttcacactctccagctaatacttctcaggactggtaatgttttataaaaagcaagtagcgtagcaaacaatagctattgatggttatactctactcccagttctacttagtattgcgtaccagtccttcacctgactgcagagaacacattctgaaaattgcaaaacagataatatatgatgagattttttgtgacattgcattaaaatacagttagcattttgaacactctgtgtgcctagactgtgattataactttttcaggcattatccaatgatgaggatgaagagctatgcttgcatttctttatgctacaggtatgattgttattcctattgcctactgacatgtattctctgagccactgtattctgagaggatacaaagctacacaaagcaaggtccccaggaagtgagtaaggaagataaatgcacaaaaacaacggtgtaatatatcagatgtcaaatgctctaaggggtatttaggtcacaaatttggggaaattacacatggaaaagtgtgggaaagattaatgcttttatcattttatggtctttaaactgagccttgaattagagccttggacttttgtaaaaatgggtgagacatttgaggtacacaatcgtaggaaagtctggagaacagccttagatgaaatgtaaagagtttgatgagaagaagtgtctgtggcaagtgttttgcacaatcccaggcttaggagtttgtattctactttataggcaattttgttattcatttaatattttttatttgtttttatttattttgaaaacatgtattgaggacctagcatgtggcaagccataggctgggcactgggcctacaaagatgtataagttgtgattccatccttcaaaattagacattccagcctgcttggaaggaaatattctgcctcaagaaaatcacctccatacccccaaaacttggctccactagaagacacactagaaggctatattatgaaattggtacttgttatctactttgagttaattcctacgtaatcgcaatggccaaagcccctgcagctgtgggaatgaacagagtaacactgaccttacagcacaaatgtcccaagtcatggctccctcctgtgtaatcacaacacagcctttctctgcctcctcagctactcaagggagtccctgaagtgtgttgcacaatttgatgaattactgtcttttgccccattgtgttctcctctctcatttctttctcttttatacccttactacccacaagctgcctgaagaaggcaccttaccttggctgtgcagccagcactttctgagagttacctgcttccctgcctaggtactggccagggctcctgagcctgcaaaaccttccatgtgccagaatgtgctccatccctctggatcccactgaatttctagtccactttgtcttcaaaggaaacagaaaggctgttctcctccccaccctgcctgcatggtgcacctgattttttagggcctgaagcaacaactcttactcattgaatctcacaaggtgagagagtagcttctttccactgtgtctgaggctctttcctcaacagaaattacacctagtccctgggacttagccagagtacatgtgccatttgccatatctcaggagttcacaattctcctgactgtgttttaccaactaatatcagctcttgcaagtaagcatccatggtggcgaacatcattctgccaatacagtaggcagatccaactgagatactccattccttctctaagtcccctccctccataagaggtcccagtagctggaaacataactgtcaagcatgcaacaaacctggcaaatgagcaatatacaaagcagcatctcacaacatgatacctattcattcagtttggtgggcaactttgggacaggataaggtgttttggaaatgttgttgcattgtcactttctgcagtagaaactgaaaaatgagaaacacactgtgtttgactggaagcccaaaggagacaaaatgttttcagaaatgtgtgcatcatggcctactaatttgggctcataactactctccaattacattcctggaaatgtttttcaatttctttgcgtggaataactagcagaccacagtgctcagaacagcccatggggaatggcattcctgagtagaggttacatcacacctccatggaactagccagcccttctgcagaaccacatgattccctggctcttaatatggtttattaaaaaatcctttacctacctcaaagcacttttcatcaaagccacttttaagctgaagctgaggactaaagaatgcctttaacagaatcctgaaatagcttttaacctgaggctgagagagaaagtgcttttaacctaaagtgctttcctcttaggtgcttcagtgcatacctagcactcagcattagtggctttgagaacacccttaagacccaaatgaaagagactccattattgatattcaaacctgttatgttaatatattaaagtaatatttgaaatcattaagcagttttactccaactaaatttgagtcttttcttattgaactatgcattcatgcaaataaattgaagtcgtaccacctgggattctaacaaatctatgctgatattaggaaaagtacagtcttctttcctaggttttactttaatctagagtgagtcaaaatttctacactttccccacccaaaaagaatctttcaactcttctcaatcactgaatgacacttccagctttagtccatataagttgtgccttaaagataaatcatttagtatttttaattacctgaataaattctgtgtatcaaattttctcctcagacttgtcactcaaacaaatgcaattaataatttcacagtagttttaatccccctataaagttcctacttagtcaagtaagtgacaacctaattgataagttttaacttcagattaatagtaagttatataattgagcatgtgaatttcatggacagttttctattcaaagtatgtaaagaacatacaaatatgggagaaggtagcagaacttaacatttgaattgtattacccttcccttcctttgctggccctctctgtaattctaatgagatgatgacaggcaaatgaaaagcagaaaatatcatcaatccacaatgtacgtcaacagtcagctgaacaaaatttggtcatgttaattatttgaaatacatgaaagcaaacaatgaaaatatgtttccctcatactcaagtgctcatattacaatctttagatagaaatcggtttcttggactacaacccagtgagaaaatattagactaattagtctgtcctactgtggtctgttagaaaaaaatattgaaatattagggtattttccttaaaaaataaaaacattctttataagctgttttaatatcaaaggaaataattttcttttgtaaatttttctcatatttatcttttaatctattcatacattcatttatgcactcattaggcaaccagaaggcatgtaatataataaatgcaataaatataaatacaagtagaagaaactgcattcatcttttcctaccgtgtaaagttttgttgaccttgaatatcattttgtagcttcctctacttagtaaaattgtaatcatttttactcttccaactcagttaccagtgccacaaagctatccctttcttcttcattctcaattagtcctaccttctctttatccaaaagctgtaatttcattattttaatatctttcaactggattatgagctgtatctagtagaccagatactattttactgaactccgtacttccaggagttagaaagaaataaggaaatgaagctggacatgaaatcttgcagtggttttagagttattatttacagcttcttattacttcctattgaaactctcatgtcagtgagtgcccctttggtggatcctgctcttctccccatcttcagaatgttgggttacccctatgttaaggccttggacttcttttctcatttcattcttattctcagactattggacattaaacattcagagttgaaatataccattcatgcagcttcgaattccatctagaggttgatgctttccaaacttaaaacatcagtctcaaacttcagacttgcatattcaaatattgatttcatgtcttttggggtgcttggtacatatctcagatttatctagagtaatccttgattcttcagatcccatgtgtcctctatctcaggaaatatcactgccatgtgccacctgggatcacccccgctttctactctgtctcttccttcatcagtagatcccacctttaaaatatattctaaattcaaccacttttgattacttccattggattcattcttacccaagcaccatcatctcttcctatatttcactacccccctgatgagccttcctacttctcctcttaacccccttaaatctaggcttcacacggcaattagaaggatcatttataaatgtaaatcatatcatgtcacccccccctcctccataatctccatttacttagaagaaactcattcttaatatctaatgtgtgtccttcctgtgacctatagggtcctacctgctttgaccctgaggctacattttatgttttttcctcagccatacttcctcttgttcacaccactccagccactcaggccttcctgctcctcctctaaggaacctggcttacaccagcagctttatacacttgctgctccccttgtatgtacatggctcagtcggtcacttcatttggtgtctgctcagatgccattgcctgagatgccttccctggcaacaccaatagctctctgtctctctgccttgcttcattttttccatagcgcttatcaccatctgacattatatgttaatgtgttttcatgtttattttccccatttacatatagactctgtgaagacagagagtgttcttttcactactccatccccagtgggcattgaaaaatactcatagatggttagattcaatggataaatccaaaaatgcataaaggatttacttggtgaaacccttctctatgccgttgtgattctgtgtgctgacgtacatgtgtgtatgtgtgtgatgttgctttagataagcagagggtgggagagataggtacaaagtattgacaaagttcttgccttgagtagacaaatatagaagaatttcatgcgcacagtgtcccatttggttaataactctttaagatgcaaatttcttcctggctggtgtaatcaccaaaatgcctactgcactagtcagaccaaaattagattgacatctatttccaggtgagtttaggagctgaaaacgaggggccaaagggtacttcacagaagtactgtttagggttgagagtgaaactatgaaaactgaagacggccagaagcctgagaaacaaagagaaaaagtagaaagggctgggaagaacttttctcttctgtcagtcccatccctgaaactcatctttgggctgccttgatcaaagggtgctacccccgcagctaaatgtccagcttcatttgaaagctgcagcaactccgctatccttgttcggggagatcctcttcccccaggctagtctctccgtagcagatattgtcattatcaccagagactttagaatctgttaggtttgatgagatgcaaaaatataaataaacatgtgggggaaaactattcacagaagcgcatatatttggtaactcctatttatttagattccaaactacttagaagttaaagtaattaagctttttcttgtacttgcctcttatgaaaaaaaaaaaaaataagtaaacaaggcaatgagagaggtttacttccagtgcatgtcgtagattcagcagagaatcggcccaatttttgatatctatgtaacataaagcagcaaccgatatttctaatcaaagccccaaagcatcataagttaacgcagtacctcctgaagcacttacagtatattctgtcgtgttttagcattaggcgtattttttctgtgtcttaattcaaaaacataggccattccataacctatagcactaacagaagtcacccagttctccaaacattctcagtaaagttttgggaaagttacatgacatggggctcatgtcgtgagcattttaaaggaaaagaaaagatggtgggaacagaactggagaaaatataaaagatgagagtagaggctgggcatggtggtccacacctataattccagcaccttgggaggccgaggcaggcggatcacgagctcgggagctcgagaccatcctggccaaagtggtgaaaccccatctcaactaaaaatacaaaaattagctgggtgtgctggcgcatgcctgtaatcccagctactcaggaggccgaggcaggagaatcgcttgaaccagggagtcagaggtgtagtgagccgagattgtaccactgcactccagcctggcgacagagtaagactccctcttaaaaaaaaaaaaaaaaaaaaaaaaaaaaatagaaacaccatgctttgataagcaatctaaaagttttgggctgaaaaccaattctcaaaaggaaaaactaatgtaatttatagtttaaaatcaaaagatggaattattaaattgctgaaatcacccatgtttggaatacgattttgtcttccaatatccgctgcctctctattatagcaacttagtaggaaataatctgcccatatgtgtggcattgctgtgggagaaaaattctaagtgaatgctacctactatggaaactacgagggctgtattttctctccccacccattatttttataacataatcctgatcaatgaagcatcatctagagaaacttccagtctagagcgattgatgactggaagttattatgacaatgctgatgctggtggtggccatgaaatgagcaccctgacccagctaccagagttagaagacagtcgctttttctccttcttccaatttcatggctccgctaagcatcttcatttctgaatatctccaagactggtcccctagcctctcataaattcattgaattccttcctacttccacccctcaacatcattcaaataaactttccgttgcttaatacagccacagtgttgtgtttttccgttgcttgcagccagaaaccttaatcaatatacgtcattaccacgatagttggataattgtctgatttgtttttgtgactaagccatttgggctgccattattgttttctgcttcgctctgtgttccgcatgtgtgtgtccttctaggtgctttgttcttcctttttgaagtttactagaatcgctgcaatggccctctctcctgaaagcagagtcacatcattttgaaaagcctgtggagactgtctcctgcataaatgatgataaaaccgtcacattatttgaacatttaactgcctctattgagcagttgtcctcatagttttgattcatttggaatctgactgacagagatcccattactgggtgttctttccataatttgtcaaaaaacttatagcagtgatgagggagaatgaaactaatttgtaatctggaagacttaacctggttatgctgatgaactaacaaaatcggtcaaaaagtttgagagcttaaagattaaaaaccaccattctctagttaaacactaattcattatgtaaacaacatgatttataagggcagtcatgtggagggtctatttatttttctcaccaaaagatgctttcaaagaaaaattgcagaaaatgaattttttttcccaatcaatgtatatcctgccacccctgatcattaagtgctgaaacggtgggatgaagatagaatgatcacactggccaaggtcacaggagtttgcagaagattccaaaaatattggcacccctagcaagaggtgctttctaaataatatgcatatttttatggttgttaagtgaggaagaaaggattaccagtaagcacacagatgggaatataggtgggaagtcaggagctcagggttttggaagtgttcttttttgtttgtttgtttgtttgtttgtttttgaagaggagagtagaaataatccttaatgttgttccaggacaagagacatgagcatttaggggacaaagttcattaatgcttgcctggaaagcagaatgccttttctctccctccctttttttatactattttaagatagaagtttccatggctcaaatggatttctatcattgaattgtcctccttggtgtatgaaactctaggtgtattagatttacaaatggagagcaatcctaccacagcacttaaattcaacaatgacagtgtagttaaatctctgatttcctttctttggacagcactatttactttgcaaagccatgtgatgtgcattatcatctcttctcaattatttaattcattgtctgtcaagggctaatgttgtagtctacattctttccactgtaaatgacagaaacttgtccaaactgtaaaagtcagaatggaatttactagctacttaattgaagagtccaagggacagggatagcttcaggcatgactggatctaggagttcaaaatgctatcaaatatatttgtcttccatcactcagctctgttttccactcttccagaggtggcagcatagcgtctagaagatcagactcatatcttcatagtttaatatctctcataaaaagagggttcctctctcccagtaacatcagaaaaagtctcaggatttacttgacaggatccacttgggccacatgttcatgcctgaaccaattactgtggccaagaagataaaatgcatattcgtcactggagatggagagggtggagtcaacactacccaaaacaaatggcagcaaaatgagaaaggaccatccccaagggaatctcagggtgttcttgccagagaataggaggatagacacaggaccagcaaaaccaattgatatctaccatactcttcctagccagtgtcatctgtaagcagtggatcccattgagctattttgccagacctggtcctgttgtgactgtaatccctttcttgaaacgtttgtccaatgctacatccatatttttgccaggtgtatttgcttgcaataaacagaaatttactcaagagttctattaaaatgggtgggaggggatctcatggtatttatggagctcatgacatgggtatggcaagtgccatggcaaggatacagagtgcctggagtaggcactggaaagtcaggagctgagttggatctgttccatttgcctctccctgcaaactagttcctgtgtccgctcatctgcggcacataagcatcttcccaaattggctgtcccagcccccagggtttaagtgtaggcagcctagagttctcatccctagaaacaaccacctcagtctctcagtatccaaattctaaattttgtagaagaagcgttgctttgttcaagcttggggcacatggtgacctttgatgtaaccaagttcacctgagatactaggttcttgtactccagagccccaccttcttgggtgagtacagcaagtttcaagagaggctataagtgagaagaacagttttggctttgctggtaactggggaaagcaaacatctgccctctagctagtgaaattccagatgtctaggctctttactcaccaagacaccaatggcagtttttcccttgtgagggactggatgcacttgcctggaccaccagtaagtggcagtaatgtacctcccccacttccaacattataaccgctaaaaataatcagcagtgtacttcacccagctccgtggcaataaaaaataccctgtagctgaaattctctcctatccatcccaattcaaaatcctcttccaggtcttatctccacttataactaagtagtccccatatgctagccttttcacctctaaagttcttaaaataggagtctatttgctgtctctacttcttcaccttctcttcaagtcttaattacaactatctgcttttcagtttcactcctctactgaaaccatttttcttaaggtcactcatatcctgaaattgccaaaatccagcgaacatttttcatcttgatctctcataaccattctgctgcatttgaaatacttttccttaatgtctaaattccatttccattctcaagaccctcaagtaactgcatctctgtcttctccagtcaagcaaggaacttggcagtcacttttacctggtggatcagctcacctcctacacccacttgccaaacccgactgaatcactccttcttgccatgacaggtttattgtcttagttcgggtccccatcctccctcccccaagagcctaatgctctgtgacctttcacaaataactcaatatctctgggccttagttccctcttctgtaaaatgaagatgatgatagtatacacgctcaaaggattgcaggtgcatgtgagaattaaatgttagaatatataaagtactttgagccctgcttggcttagtgtagtgtacaataaaccctcactatttttttacacgtatctgcaatagcattagtcatattatgttgtagctgcttgtgacagttattctgtccacctaaactgtaggagatggtgcatcattacattttcaggctggcacacagtgtctggcttataacctgcatgaaatagttactgaatgaataaagcaatctttgcattatttacaatatggagcacatggtaggtgttcactaaatagtcactgaatggaattggatggaattgggttaatctggagagaatgcagaagaggtgccataaaatttggtaaggcataaataatttaaattttaaggtgaaagtaattttctttgagactcctcctgaggattgaaattaaactgaaggcataactccacattcttagcaaatttagaacttttttttctgttttgttcactctccagttttagtttccatgtcctgccaaccctctttgttttcattctcacagcatagcttagatcatatttcaccaaaaacctggactcatcaccacctatgtgagtaagctattgctacatgacaaacaaacataaaatctcagtggcatataacaccgagcatctatttctcatgtgtctgtggtgcaggcttgactgggccactctgctttaagctgcaggtctgactggacttgtctcttcactgagggttgccctcagttctgtgccatatgtatgtattctggagcccaggctgaaggggcagcagctccccagggaagctcttctttggcaatagcagagaaacaagaggatgagtagaaatctgcaatgcgtcttaaggcctcagtctggaactgacacatttccactcacatcattccaaagaagacatttggccgagcccaatatcaaagaaatgggggaaaataaacactgcacactctattgggtggtacgagatggttccatggcaaaggaggtgaatgtatacatctaattcagagaagacaagaaggattgtgcacagtgattacacctatcacacccttatcctgattctggtcttcgtaacatctttcctaggtaatcacatcagtcgtttaactaatctccttgtgcttcatcttccccactatattaacccccccaccctcccttttctttacaaagtgctaccaagtaaaccttctcaagtagagtatgattataatgatcactttactaaaaaaccacaatcacttcctaatgtcatgtcatatgcttttggctgcagataatagaatacctagttaaaaatgacttctttcatatgaaaataagtctagataaggtgttttagtgttggtttaaaagctcagaagtgtcatcagggtctcaagttttgttgcttatttttaatacattagctgctgttcttagcactcattgtctcatggtgacaagattgctgcaatagctccaagcatcacatcattgcaaaatgatattcaaagatggattaaaagaaaaagaaaaaagacttcttatatatccctttcctttcttcaggggaaacaaatcttttgctatatagtcctgagtcactttcctagacatttcattgaccagagctatctaatcacccaaagttgcagagcaggtaaaaatcaatagagatgattttcactttctgtcatatgagtggcttctaaaaacaagaaagaaggtgggagaggaattacttatatgtagaaaatcaatggtatctgcacactctcaaataatttaacttacctggcaagatttaagatgctttataacataacctccatctcttttataacttaatacatcaagatttctctaagagtgaatgtattcctcggcataccccagtcttcctatcattcttcccatcattcatgcatttgtttccttcctttcattcccgaaaatgctctttgttccctcttttacttgtctttccttatctttgaggattcagttattcagagaagggaagcactcaaggctgatctgttgccccaccacatgctcccacattgcctctgcgtttccccagttatagcagttttctcatgataaaatgttcttacctgtttacttatatactgcctctactgggcaaagatttagaaaatagggaatgagtcttggttgttatattaccagagcctttcctagctctaaatacagtatagccactcaagatgttcttttgcaaataactaaatgaataaaagagtaaattccctggaatgctgttgtctgtatcttctcatatccacctgtctaaaacaaaacaatttctccaaacacaaactctctctctcccaccctctgttgtacaaacatacacacactgcacaccacgtctacactaaatgacacaaaaagacctcatactaaaggacatttttcttagcattcagtaccttttatgacacctgctatattcttttttttgtatattctttgaatacttttattagccccctataatattacaaacttctcgatattgtttttacaactcaatatgcctacctcattgctgtgaagatagaagataatatttgtgaaattgatttgagtaataaaatccattaatgggttttttactttatagcaattcttcttcctgactgtaatctccagacaatgtaaatcatttgatctgatctactgggttattttttcctagataatattttatgtcattctttcttggagtggttacacagtgttttgaacaagtcattgttacttgaccaaagtattcaaagcaaatgcccattactatttcccacttctctatactatgtccatgtgttttgagcttctttctgttacttggataaaaatgcacatttccatattggagttttgtttttgtttgttgttgttgttggtgttgttttgagatggagtctcactctgttgccaggcctggagggcagtggcgcgatctcagctcactgcaacctctccctccgggttgaagcaattctcctgcctcagcctcctgagtagctgggactacaggcacgcgccaccatgcccagctaatttttgtatttttaatagaaacggggtttcaccatgttggccaagatggtctaaatctcttgacctcatgatccgcccacctcagcctcccaaagtgctgggattacaggtgtgagtcaccatgcccggcctggagtatattattaatagtgttttagctttaattgttccctccatgttgggttgtcaccaattcaaaccattatgttttcctaagaaataaatgaaaattatgattcattgaattctctctacactcgattttgagtatccccttataacaatatatatcactgaacattattttatgctgcattattattctatctaattttacatatactttaaaaaatgtattgactacctccactgatggttaagatgatgtcttgcagtccctcattctacaaatgtttattgaacttctagtatgtgccaacactgtctaggtactcaggatccaataataaatggttgagatatgacgcctactctcctgggttttgccttctaagcaagggaaacagctaagcagaaaacatttcagtctcatatgtcaagtggagatatgtgctctaagaaatgtaaggctgggaaagtggcatagagaatggcatggagtggagccatttttttaaaggctggtaggaaaggctgcaataagaagataccatttgatcagagacctaaggcaatggagttccatgaagaagaaaatgcaaagtccctgcagcagaagagtgcttggcagccatgagaaacagcaatgtggggctattacaaatttaaagacggggaggaaagacccaaatgaaatccattaattagtggaggtcagattatgtaataccttataagttacagtagggactttgatttcattctgagtgaaatgggaagcccttggacccactaaatatttgtttcattatcagtaataaacagatactatctcaatagcaaaacccagaaattgatggtggtgagggttgcacaacattgtgaatgtacttaatgccaccgagtggtacatttaaaaatggtggaaatgatcaattctatgttatatgtgttttaccacaattataaaaaacaaacatctgtctttaaatactgcaggccagagtctgtgcaagcactggtgaagacatagatgattcagacactcagaatctgctttgagagaatctattccatatattataaatgtaaatacacaatgcaaggtagcgtcaatcatgttccaaatgagagggctaggctaggatttcacagtgggtattctcggaaacattagtctggagacatgctctctgaaatcaaaggatgttgctcaaataagtttgggggaaaatgcatccttcacccctcatggggattcacagcacacattggcatatcatgggctttaaaaataaatgcatgttaaacctgtctaactttgcagaacctaatgatgtgaaaccattttgttcgcaggccctttttcctgaatcatctattaacagcctgagggtctggtattccaaagaacctgtgtcacaggagacacaaagctgagataggaaggagttagtgaagaaagtgtgatctgaactgagccctaaaggaaaggtgatagttagattagagaagaggaagggcattcaaggcaggagaaatgctaagtaattcacttcgaagcaagtctcctagaacttgcctcctcatatactattgagttgcagaatgaatgtcctaaatatactgataacattgtaattttcgtaaccattaactggtaaacttcttctaaaacactcagtataccaaagacactaagataaattattttgcaaaaattttctcaattctttgtctttcctttatagaccacaaaattaaggcccagagagactataacttacatagtcatccctgcctaatcgatgcctgagcgtcagttttctcactctggggcgagggtcctgttccatcaaggagggagttgtggtcttcatatgtctgccatagacactatggaaataaagcaaaaaaaaaatcttatgcaagatgaagatttcagcatgcaatggatatggaaacggaatcaaattaaagaacaacgcaagcttggattttaatgaagctcatctttgtttcttttgcagatcaaatttttggctctcatctgcacaaagtgtgtgaacgtgaaaattccacagttccgtggtttgtaaagcaatgcattgaagctgttgagaaaagaggtgggtgactgaatgtgcagcagttccccccattactgcaccctctacacaaccaatactcaagttagcagtgccacctgatttgtctgagaagccatgcaattaaaacttgacttgtgttaatcggttaagaggatcatctttcttattaacttcagtttgtttttacaatagggacattagtaattctcactaatgttcttttttgtttttaatattttgtctgtctgacttactgttgattcaagtgcaaacttcttgttttcaagccagtgataaaacattcataaaatatcagcactcacagtgttagaaccttcctaacattcatgctggtagacgttgtgccagaacaatttttggtaagcccccaacattacccaagttaagcaaatagcattctgaatcacagacagtgatatcccaccttccacatgtctctgttcagtacagaatacgctaacgggttttttcaggaacaattaaaagacacacctcaaaagatgacctttgattcctctatttcagcattctgtttttcttctgaaattatttcatcttactgaagggaacaaaacaaaacccaactgaatcatcatttctactccactctatctgtggggtgtttttccttcaaactatgacttcattcattcaaggtcatttttcctggaagatacatatagtagatgcagaatcttaaaaaatgtattgtataaaaatgcaaggcttcatcaccatctgttacaagtttacaacatattcccaggatctagggggatatatatcatgtaaaagatagaggtgttttcagaaaaaaggattggtgaacctattcccatttccagctcctagtctcttaagacaatagaaccaaggggaaaaaatctttacccaataatctactaggaaaaagccattttaattctctcagtgttacctggctttattataaaagcataataaaaatggtctgcaatttctaactcctggaaattcatactttaattatactgtaaggacagccttgggatcctattattcccctatcagtagggaatgagagaataacaagaaggggaagagtgggtagggaatgtggataaagagaatgactttggggaaagcatatcaacacatcagagagaagagcagagagtacagtgagagtagaaagcagcaactgcaggatgaacatgaggagaggtatctgtgagaaatgaagtcaattggagtttagagaaaaatgtttttattgcaagttgcaatttcatttaattttataagtacatttttaggaataaatattctttggtaagtacttaaagacaaaatggatcactgagaatattataaagttattatttccaataactaaattgtcatcattttcaggaaatcttcatccacttataaatactcagccctgacagtgtgagcactattagaccaaaaacccaaatagggcgttggggaagcacataataagatgtgtgcatgtgtaaagaagcgctccattcctcccgatttatgtctccaccctaggcaaaacgaaaaactgctagatgcagctttgcggtgtgcagatattataatattgcagagtagaaaacgtctataaatagaaaccatgtcttttgttcatggcattttgttggtgatttttaataaaataagacaatgtttttgctgactggagcaatcacatctagcattatatttcattgtccctgtgtttactcttaaaatgaatttgtagatccagcactaaacaggcgctaatcacacatatgattattaaaataattcctaagcattttaatgaaactcaaagactttccaattccacaaagcaactgataattcaaagcactttggcagcatcagcttaaaggaaccctatggaaatattcagtaaaaactaagaagcacaagataaacctctcacatcattgcaagatttacaagtgtgtacttttgattataattttctatgatcattttgttggattaatattcttatatttatacaccaattctatttactcaaagtgttgtttttacgaaattctggcataaagcatttcaggacagaaataatttatgtgaatctaagtccaatgtttatgcaggcttctgatgacattttatgctggggttggtattaggaagtagcatataaaggcgccaagtctctcagcatggctgggactcagcatatctggatccctccttctaatggccagatactctcccagccaagaaactcaactgcagagtcatgggaaatgctgatggaccagttatgggaaaggaacatttaatgaaaactatgtgtttactctcacagtcttagggaaatggtcttgatactcactacatcggcacattggctgttataaaaaagatttgtttccttctctttttttttcttgtgattattttttactcctttaaaaaaacctacaaattgtggctatatctctaaaatgcttattagatggatgatttaaaatgaaacattatcaggaaggcagatctcactattcattcattaattcattcatttatccatccagtcagtcagtcagttatttgtcttacctgtttgtaatgaacagagccaaattgctcacacttctgtagtctctccaaggaaattctacccagtacttggcaaaagatgcattctttattcatccctggtaaagtgatattagttacattttaaattttgcaacttttggacatgcctagaagaaaatctaccaataaactgaatgtgaaccaatttagctaataacttgtttagtatgtttccttatcttgatttggttctctttattactctaaactaccagagcattctccttctcaccaactattataactagattaacttcatttctgtggtttctgacattgtctgctgagccttgaaaatacaagcaaaatttggaagacaaactgttaaggagcatgttagtctttaaagctcttccaagtggttccttcccgcttgccttgcctttatagtcgtagagcatgtatatgagaaatcataattagccaatgaaaaactcaacttatgtttcttttttgaagcaatttctgtgaaaatattaaaacacggttctgctaattcttaattcatatcctgggtacaatgaccaaaagcatgagatcatctgacactattttggaggtttgaggaaacaagcatgtagagcaggggtatctaatcttttggcttccttgggtcacattggaagaagaagaattgtcttgggctacacatagcgttacatacactaacgctaacaatagctaatgagctttaaaaaatgcagaaaatctcataatgctttcagaaagcttacaaatttgtgttgtgctgcattaaaacccctgggccatgggttgggaaagcttgatgtagaggaaggcattgtgacatatagtagatacaagcagtgagaagttcatttttcactatgttatagaacactttgtgtagtttatgatgacgtcatatgtgtagaaattgcttacttaaaaatgcgatcacctgtgtctcttagatagaagggcctaggagacctgaagtaaacaaagtatatattttaaactggtataacaagtaagaccttaattcatagttctttttatgcaaagcatgtaattgactatcctttgttgaggtccattatttggaaagaagctttatacagcacgtgacaccttgtaagtactcaataaatattggttaaatgaagcaatcgaagccaaatagctattgagtacctactttgtgtcatcttccatgttaccagctgataatacagaggagatagacattaagcaaacagacacacacggttatgtatgttagcataaactgtgataagtactatgagagaaaagaacagaccctacaagacagaagaaccataacaataataaaaagcagggaaatacgtgtgtttaaaaatgatgtaataaaccttgaacgataaacacatatttatctggttttatcttcattataagaccaggagacatttaattttgccttattttgcaagttattttcttaacattgtgactatgtgatatagggagtcctttggtgtgagatctaaaaggacatgccttaagtggcgaaccagtcatgtttctacccaataataccaaacatgcattttgccaaatagatattttatataagagtagtgttaactagataaatgagcatatttctaccctaaagatatttttatggatccaaaatttttttggttttaagggaataacattaatttttttaagtttgtaatataatttagattagcattcatttggaatatgtcttaactcatacttccttcatgattcccggttctggttaatatgtacccaaactattttaaaacattaaaatgatacctagagatttattgtacaacagtgtgaatatacttagaattactgaactatacacttaaaaaggattaggaagagaaattgtatgtcatatgcttttgaccacaatttttttaaaatgaaatcatgtttttcaaatgtgataattccaggtataagcaactttgcagaatgcctcagcagatgctaatcaacaagaagtttgccctttctgtcttttttctggaacacgaaatactatgacaggaatggtacacaaagttacatatttgacttggtgcctaaaagccaccctgggatccataaccttgcttaaagatttaagaaagacctttagtctacttctgagaaggtccttagcctcaaaaactttatctctcaacttgacttcttagcagctgttatattttttttgctgtcgtttgtttgacaggatccagttataggttccgatgtctgtttaaagaaacaaggaggctgttggctttaaaattccctcattgcttgtgtgatcagcattttcccaggcttttctacatagtttgccaagcaaagggactgaccttttgtagcaaacactttttcatttcaaaatgctcactttgatttttgtcccattttatgctcattccaaactgtttacaacccactaaaaatgactgtgaattatatgtttgtgtaatggattccttttgtggtctgagtggaatgtttactttgaacaattagttatctttgggtagattatagcaacttggaaaaaggatggctaaaattattattataccttaactgtttcttttttggtaattcctctactgttaggagaagtttgagagaatatgaaattaacaagcctgtgacattataaatgaaacctgtttaattatgtgactatttggatatgtgtgttaatatcacgagaaagcgtggctggacacctactcaactcagtaatatacttatctaacaaaaatgtaaaacttggcatgtaaataaatacatgaatatttgccatatacatgttgcatttgcatatgcacatgaatgtgttatataaataacagacatgttaatacagctattgtacagtacccattgtacagtatagtagcaagcattgtagttgttaatataattttcctgatatttgatccagtgcaccagtctgcctcttgagatcctaccgagtgcttacttgcaaaaatcagactttacatagttgtttcccgttgcctttgaatccaggccccgaaactgcagatcatattgccttccctagacaagctctgctcccagttctgctaattttatactgttcattctttcccactttgggataatctattatagttggatccaggcacgcactaaaggctgatacttccatgaagaatgtgcaatttgtactgttaagtttgtgatgagattcttgaaaacttttatgattctatcttgttccagagagacttctgcttgctagttttataagcagtgagtaaaaaaaagtaacaaaaacaaaacaaactgataaaaattacatgctccaaaaaaaaaaaaaatcaagagtacaagataagcactttttctttttccctggagaatatttgtggactgaacaaaaatgtttctgaggtcagtgacctatgtttttgtttttttttttaagtgtttgcttttcatgccttatgttaggcatctgcatgcatttacaatggaggtgatcttaaagaagctccatgaaagtttgcagtgaatctccttggcttttctgagttaaaattaagaccagtttagtgctttggtgttttgtgttttgttctgttttgttttaatgcagccacaaagactgccaccttcctgacagcacagtgttgtgctgggtccaagctggaattggctctttggggtagtcacgctggggcctctgtgtctgtaagaaagccacatttagggctcgaggggaagacaaaatcaaaaaagaataaacaggaaacagccagcaagagtataaaagagaaactaggaaaagacaaccaaaagaaatcagagatgacaaggtggagaggcgggggaaaagctgcattttgcaattaagaaaacaaatgtggataagaggacatgcttgtgaggtctgtaagaaagagaagacaaactagtgaaaacattgccatctctgccataggtacctgatacctgctttgctgttccagagaaacttacttatgctcaagaaaatgcttgaaacttaaaccttgcaatttatggcatgcattgaatgttcacaaactctgtatacggagctggttattaattaattcacatatttattagtgacatttaacagagtttatctatgtctagcaatgcatgacagtcttattatcaaaaagaaagcttaaacataacagaagttaatgtaggaataaacgtgcagttcaacaaccagagaggctatctaagaaatacagcaatgtggctctggtcaaatcagtcagcggatattcccacactttaaaatccacaatgcatcagaataaataatgtcgcttcccagatacagcctgagtctaatttccaacctccacccccaatgtaaagtttaggttcttaacatacttttcccttggagtcagttggaaggaacagagccaaaattaagaccctaggaaattagcttcttattgtgtatggggaatttaaataatgcaacacctcaacttaccaagatgcaatactctcaaatagcctatactggtgtcatttacacagtgggagttctaggactgggagttttcccattacaaggccctatatgcagaacttaagagttccaccataaaaataatcttggctgaaagttagcaggatgttttagcctggaagcaaatgtttacaaaatttgagaaaaaattgcatgcatttggaaagctttcaggttttcaaaaagcagaagcaaataataataaggcagtcagagattttcagatttttttgccctagcattcaaaaactgacttgtagcttttcagtagaaatgttttgattcttgtcccataatatgaactgattgattaaaaataatcaactttcacaacagtgtcactctgttttatgaaataatttgttgtttactggtagaaaaagaatctatacattgtatttgtgtaggtatttccctagggtttaaaaattaatgataattaagaaaccaaattaattcaggaagctataaatgaaacccaaatattatactcctttgtggatttcctaaagcatgatgttcttttttaaagtttataccaaaaaaaatgacattttccaagggatttttatactttcaaattgtatactcaatttaagcattaatcaattagtctacacatatatggtaaaagagacatacagattccaggtgaaataattacagtggtctatatgaatgaacatgacatatttttttgtacaggatatttagaactttttacccatttccttaaaagactcatgtcttagagattcctctaaattctttgggaggttatcttatagacgagtaggctatacagttaaagatgtttttcttgggttcaaaataatcatttattttcttgttttatctctctttgcctgattttatacgtttcaagtcgcttcctatttttggttcagaaaaaaaaaatggaaaaaatcaagggctggacactttgagaaaaaaacctaactctgcaaaaccaaaatagctctgaaatgataatgctggaagaattcttgaggttatagtagaccagagacccaatatgtaaatacacactcttttttaagaagataataatgtcctatatctagggtgtaagtatatcttatagaagaaaaatatttaaaatattaagtacatgatgtgctccctcgtgtataagccaacttctcatatggtacctaacacataatgaattctcagtaaatggtgtataatcagataaattatattcaacattgctgaaatcctcattggagagttgcacaccattgctaccgatgcatatagttgatagtataaaaagatcaatcaccaacagttgttggttgaaggcagctcagagaataacatggtctgtaaatccactttttaaacatttaaacaagttcatttctgataagagtatatcatattgttcaataaggtaccattcttgctatcaatacacagctatgctaaacaattgaagttaggtttccttaatgattttattttcatcgatttttggatactccatttaagttaaccatcagcaactactaaaatatccattctctactcattttcatcagaggaagtcatatcccattaggcattgtttcaattccaatagcctgctgtttttaatcaagtaactgaatggtaactatgacttgtaattgacatgcctgagaatggtcaggcttaggctcagttcccataaccacacagcaagttaagccccacatcttttcctttaattcagacttggaatgccatgttagtgctgttttgtattagtttacttccctgtgaatatatcaccctcttgattcattgtttgttttccatgtacctctcaggaaatttttatttggatgataatttttttgagttgatagagactgtccaataattaaaataagaaatatatggtcaatacacaggatctatcaatttgaagttaatgaagacagaatacatgattttgctattggatattgatttcatttcctccaaatttacttcctagcagaaaaaaaaagttaaactctgctgttgctatcaaaagctctgtaaagacgttgaatataccaatgttattaaaattggactgttgtctttcttcttttaaaatgatgttgttcttgttatattttgcattttctgacagtttgggatgactaactctttagtctccctatagaacagttgcacacctaacagatggtattgtcacgacaacagtgagatttttttcttccttttgtcttgaaggtaggcatttgacgatgtatttgatattacatagtctaatattggagtccatgtgtttggcctagagtttgacagcataagaaacattcatttcctctggatttaattattgactctgacatttcatgctactggttttctcagggtgatctcaattatacctaaagcttcagtgagcccttcaatgacttcagagctcctatatgcaaataattactcaagctgtttttttcccactcagatccatggtctagaaacaacccttcttgaatttccctctgtctcctcaaactgaacttttttgaactaaactcatcacttttcccaacaaagatgttcctcctattttatttcttaactcagcccgcagcattacaatctatattccccattgccctagaaagaaatatgttagacatcttagattcttctctctcattacagacagaatcattcaccaagcctcatgagctctactttcttactatctcttgaatctggttcttcctttcactttctgtgaccttgattgggcctccatacttccttttgagataaatctcctaaggaggtctttgcctttgttcttatttctgcccaggccactcttttcaatgctgccaaaatgatccctcttaaatacaaataagattgtgttatcccctcttagaatcctccaatgattcattgatctcataaggataaacaaaattccacactaattacccccataaaaaaggataagcatatgacctctgtctactgttcagcttcatatccttataagctgctttctatgctccaggaataccaagtacatgaatttttctaatggcctattcctttcccatgcttttctttctccctttttatccatctgccaaattcacattcatcttcttgtgaatatcacaagaatcaccttctccaaggaatattctctaacttaaatccataaccatcccgccatgatctcttgaacatcattagccccttcctccacaatattccagtgacagctttgcttttcctaatagagcccttattgcctggaactacaatggcttgtttcattatctgtttccctatctagagtgtgagtccttgagtctaggaattatggttggatcaccccgtccccacagtgcttagcacactatacctggcatatgatagggcctcaattcataatggatgattaaatggatgaagagacaaatattatccaagctttctgtttatccactcatccatgcctctatccttagagaaacaaagcttacagattgacgattcagtgacctgctagaagagacaatgattaaatgtctctttaaacataacgtaaagtcatattatccagaatgtaaagaaattaccttaaaagtgaaagtaagggttttgttttttgtttgttttgttgttgttgttgttgtttttccagggggcatgatatatatgtagaccagtatgacataccatatttgtaataatcttgaataggataggacggaaatagggcaatgacctttgtgtccaatacaggtttcagacaaaacatactttctcatttttaatagggagaaaccagtctctcaacaaataatgttaaattgtttcataaaactgagggattcgactaactaaagccaaatttgatgcttttgagaccgaccagtgtcataagaatagcactatccactttctggttcaaaatattatgctcttttttatataaaccttcaggcattgtgcctacttccttgtaagtttgtgtataatttttcccattatcaccccctaggtaatctttcaccatcaccactttccaggcatctaccatccactgaatagccatgtttctgattatcttctcccaaatgtatcagcttgcattatttaaagctgaatctcattttattatttcctgctcgtatttctaaactccttaagtccatttgtatgattcttttgtcctcacagatgtccacagttcctcccaatttagtatcatcagcaaatttaattaatgctctgtttacctctccttctaatgaaaccagtcccttgtttcatttcatgatacaaagtaaaaaatgtattggcaataaaacagtccaaagaaatgtttcctcactgtaggaggggaagttaaggatacagcaaagaacaatgtggtgaggagtggacagtgcagcagggtggtgagttagtttgctattgccctgaagcaaaacctttttcacagagactacactttggcatattgcctgggttgatgctgtgtgtgtatgtgtgtgcgcgcatgtgtgtgttctgttctggaaggtagctttaatatcctaactgaggacattttaccaaagatgtatttatgaatatatgaaaagcatattgaaaactataaatataaatgtaattatagctttatatacattagtatttatagttttaaatacaataaaaggtaagctagtaatgtctgattcatggtgtagttacaaatctagatatggatgcatacatctggatatatacagacattcaatcattttcagtgggctttttctagcattcactgtgatgtaaatttatctctgtccttaacttgattagtgttttaaatccaaattaacccttggatttgaatcaaattctttgtaaatagcaggtttatagggtaagaaaaaagaactttttttcagttgtatccaacatgcaaacttcaatcaaagaatattttaacctctacaattaataggctagaaaattgagcttgatcagagtaaaaggcctaacctgctaacttgaaggtaagccagcatatgttctaaaagttacactataactctttgaaggtgtggatatacagatattgtgtcatttacatgaggaaaacaaagatgacatttattaagcactcataatgttagtgctttccagcatacataccaatactgtggaataaaattgtacattaattactacctgatacttcatagtctgtattcttaactccagcaaaatctcataaacgtttgtcaagtttcatattaagagtcagtcttcagaatgtggatggattagtataaatccagtgactttactgggaaaaaaagtactttcaagtttatgctttgaatggacagacagatgttaagatcaagatctctattgttgtatacaggagacaatgcatgttcacaatgctgaaatgaaggctgatatgtactttccatacaggacaaggtcaccaaagatggcatcaccaagggatggtgttaacaaaacagtgactgggaatattgttaggtggttacagcctcacattgcttttctagtgagaaaaatatctgatgcataatgcatccttatgagagaattttctcagatgccaagattttacaggcataacttccataagctttaatgggaatttcctgccagcacctgttacagtatagagttcttacttttcacacataatccaagactgacttggaacactgacttggaaaaactaatatagtgaaagcttcttgtaatgtttcctcacatataatgttcatcttttaatctttggtctgatgatatatgtatgtccatgttttccattcaaattcttttcccaccagtaaggtttcttttcacaagtttttttatggatgagagcagaaaaagcaattcttcttactaggtaaactagtggaaatgatacataaaggggaaagttattaggatagcaagtgacttaatgctagaaatcaactattcttgacttaaagtagttttatagatatactgtagactcctgagcagccaacaattagagtaccgcatgcaaaaacaactgtcagggactccacagcaaaatcacaggtcaaaataatatagtttgaccatattttctcatatatttatagactagaatatggtaacttttaatatttaaaaagatattgtgtagatataccaaaggatctattttaatatttcaaaagatattgcatagatataccaaatgggcaatgcattgggtagaggagaaagttaaaagttttaaatttcatacatttctaattaattccccaaacttccgttaccaaaaaactcaaacaaaaacaggtcacagtgctcctgcttaactagaattattggagattgtacagaacgactattttatgaacaacaacttcacttttaactttttcactttcttgaagtttcttcttgtctagagtttctaacacacaatgacacattagaatgaaaacagacatttatactcaaattcctgaatcatttctgatcactaccctgagtgacaggatgatgagcagggggaatgcttttcacttgttgaatgttgaaagacagtaaatttttagttcatttttatgacaagatttttttaacaaatgttggcaggtaacatgattaacgttggaagaactctgaaaccccgaaaacaagagaagacgtgtgaacctgttcatttaatttctcacggggcaaaatacgggaactgaaggagaacagtgcattcgcatccttccttctctttctttggtgtgtgattacattactccatgatgtcaccttgagcccctgtctgacctctgatactctccttctggcacacctgcctcagaaatatcatttatactccagcttgatgttcagacacccttattcacacttttgagtattaccttgagcttaactgttttaaaaggtatcaataatttgtctcctattagagtatgttcaagcaccaggaaagaggattttgttttgtttcatttgataaggcaaagaaagggaaaagggagtctcactgacacttctaaaagcatgctgtgtttccaagcttggtaccctcctcctctcaaggggttttgactgtagcacactttgctcttagtggaaataaggttattactttcttttgatactctggccagtgaattaatagaaatgcatttgtttctgatgtaattgcctttattaaggtttattttaaaacttaagagcagattggaaatctaagacctcgttaagtctgccatagttcaaagccatgcattaccagctgaggccaataagccttaggttgttactggggaagacttaagacttgtggcattgtttgtgtatacatcactggctccatctgacacctctcatctctccagtgagcctgatggagttaggctttgtatccccacccacatctcttcttgaattgtaatctccataatccccacatgtcaatcgagagacgaggtggaagtaattgaatcctggggctggttcctccatgctgttctcataatagtgagtgagttctcacgagatctgatggctttataaggggctcttcctccctcactggcacttctttcttccaccttgagaagaaggtgccttgcttccccttcgccttccacccttactgtaagtcttccgaggcctctccagccatgctgaactgtgagtcaattaaacctctttcctttataaattaccgagtcataggcagttcgttatagcagtatgagcatgggctaatacagacccagtgatgtatacacagacaacgccacatacagtaaaactgcaggagagtgatacggtgagagaagtacctgtattctctgcagtccttacccagagaagagacaggcctggctcagagatctgatgatttcatgggagaatgccatgaaatattcacgacatttcaatctatagaaaaaaagacctatatggggccaggaaaagtggctcatgcctacaatcccagcactttgggaggctgaggtgggcagatctcttgagctgaggagttcgagatcaacctgggcaacatggcaaaacactgtctgtacaaaaaataccaaaaaaaatagccaggcgtggtggtgtgtgcctgcagtcgccagctacttgagagcctgaggtgggaggacctgagcctggagaggttgaggctgctgtgagctgtgatcataccactgcactctagcctgagtgatagactgagaacctgtctcaaaaaaaaaataaaaaacaaaacaaaaaaacctatatgaatttaggaacctcagtttagagcattgtactcacctgaaagaaaaattattttataagttttccctgaagatgttattttttacaatttccatatttctaatttccttatgatagaaaattactataagaataaattatgttaaaataaattgtgattaatcaagcttaaaaatgtgccccttctcccccaaatttctaagtacagtaatatacttctttttttctgtgtcttggtgtgtccaaaatagcaggtaacccaggaagggagaaactttggataatagcaaccactcttttgaattcatttgaagccaacatgttgtacccattttccctttctgttcctctcccattatgtacttgcccccttattctccatctttttctctcccacatcctacacaagtaaactcattgtacttgttttcttttcagttaaagtctgctcccagtaaaggatttaataaattaatccacatactaaagcgtatatgaccagtgaggtttgatgtgaaatcctccaataggatttcaagaaaaaaggacgaattctaattgcagaattttaggcataagcaaggctgtgtgaaagaaatattttaagaaagaattatcttcccagattttctgaaaataaactgcaaaagtagcctctataattaatattaacttacgttgggaaccaatggcataaaatccaagtcttcaaattgataatctttcatttctatctctcatggcacttcaagatttagctatactgcctgattatggatttcctaacattcaaactcaatggagtttctaacatcaaaactcaaactctgccatcccctggaggaaacagggaaattaagacatcctttatttacatttcatacaagagaaaacatgagatacatttataattgatatcttgccactttagaaagtcacatatatggagttagatatttcataaatgttgtatcaatgaacatcagcatatataaaacgtcttagttttttttaaatttgtggataatgtatgtttttttcacatacaacatgaagttttaaagtatatagatattgtgtaatagttaaatctatgtaattaacaaattacctcacatagttatcatagatgagagcacttaacattcactctcattacatttttcaggaatatatgtcatcattaactgtagtcgtcttgctatccaatagatcccttgaaatttattccttctagctaattataattatgtatcctttgaccaacattttctcattcctaccgtccgcctaatcataccagcctctagtagccaccattccattctcttcttctatgaggtcaacctttttgaattccacatgtgagtgagatcatgcaatacgtatttttctgttcctggtttatttcacttagcataacgtcctccatgttcattcatgttgtcacaaaagcaggatttttttttttattatttaagttttagggtacatgtgcacaacgtgcaggtttgttacatatgtgtacatgtgccatgttggggtgctgcacccattaactcatcatttagcattaggtatatctcctaatgctatccctcccccctccccccaccccacaaccgtccccggtgtgtgatgttccccttcctgtgtccatgtgttctcactgttcaattcccacctatgaacgagaacatgcggtgtttggttttttgtccttgcaatagtttgctgagaatgatggtttccaccttcatccatgtccctacaaagaacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgagatggctgggtcaaatggtatttctagttccagatccctgaggaatcaccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggctggccagtgatgatgagcattttttcatgtgttttttggctgcataaatgtcttcttttgagaagtgtctgttcatatcctttgcccactttttgacgaggttgtttgtttttttcttgtaaatttctttgagttcattgtagattctggatattagccctttgtcagatgagtaagttgcaaaaattttctcccattctgtaggttgcctgttcactctgatggtggtttcttttgctgtgcggaagctctttagtttaattagatcccatttgtcaattttggcttttgttgccattgcttttggtgttttagacatgaagtccttgcccatgcttatgtcttgaatggtattgcctaggttttcttctagagtttttatggttttagatctaacatgtaagtctttaatacatcttgaattaatttttgtataaagtgtaaggaggggatccagtttcagcttcctacatatggctagccagttttcccagcaccatttattaaatagggaatcctttccccattgcttgtttttgtcaggtttgtcaaagatcagatggctgtagatatgcagcattatttctgagggctctgttctgttccattgatctatatctctgttttggtgccagtaccatgctgttttggttactgtagccttgtagtgtagtttgaagtcaggtagcatgatgtctccagctttgttcttttggcttaggattgacttggcaatgcgggctcttttttggttccatatgaactttaaagcagttttttccaattctgtgaagaaagtcattggtagcttgatggggatggcattgaatctataaattaccttgggcagtatggccattttcacgatattgattcttcctacccatgagcatagaatattcttccatttgtttgtatcctcttttatttccttgagcagtagtttgtagttctccttgaagaggtccttcacatcccttgtaagttggattcctaggtattttattctctttgaagcaattgtgaatgggagttcactcatgatttggctctctgtttgtctgttattgctgtataggaatgcttgtgatttttgcacattgattttgtatcctgagactttgctgaagttgcttatcagcttaaggagattttgggctgagacaatggggttttctagatatacaatcatgtcatctgcaaacagagacaatttgacttcctcttttcttaattaaatgccctttatttccttctcctgcctgattaccctggccagaacttccaacactatgttgaataggagtggtgagagagggcatccctgtcttgtgccagttttcaaagggaatgcttccagtttttgtccactcagtatgatattggctgtgggtctgtgatagatagctcttattattttgagatatgtcccatcaatacctaatttattgagagtttttagcatgaagggttgttgaattttgtcaaaggccttttctgcatctattgagataatcatgtggtttttgtctttgattctctgtttatgctggattacgtttattgattttcatatgttgaaccagccttgcatcccagggatgaagcccacttgatcatggtgaataagctttttgatgtgctgctggattcggtttgccagtattttattgaggatttttgcaccaatgttcatcaaggatattggtctaaaattctctttttttgttgtgtctctgccaggctttggtatcaggacgatgctggtctcataaaatgagttagggaggattccctctttttctcttgattggtatagtttcagaaggaatggtaccagttcctccttgtacctctggtagaattcggctgtgaatccatctggtcctggatttttttggttggtaagctattaattattgcctcaatttcagagcctgttattggtctattcagagattcaacttcttcctggtttagtcttgggagggtgtatgtgttgaggaacttatccacttcttctagattttctagtttatttgtgtagaggtatttatagcattctctgatggtagtttgtgtttctgttggattggtagtgatatcccctttgtcattttttattgcgtctatttgattcttctctcttttcttctttattagtcttgctagcggtctatcagttttgttgatcttttcaaaaaaccagctcctggattcattgattttttgaagggttttttgtgtctctatttccttcagttctgctctgatcttagttatttcttgccttctgctagcttttggatgtgtttgctcttgcttctctagttcttttaattgtgatgttagggtgtcaattttagatctttcctgctttctcttgtgggcatttagtgctgtaaatttccccctacgcactgctttgaatgtgtcccagagattctggtatgttgtgtctttgttctcgttggtttcaaagaacatctttatttctgccttcatttcattaggtacccagtagtcattcaggagcaggttgttcagtttccatgtagttgagcagttttgagtgagtttcttaatcctgagttctagtttgattgcactgtggtctgagagacagtttgttataatttctgttctttcacatttgctgaggagtgctttacttccaactatgtggtcaattttggaataggagtggtgtggtgctgaaaagaatgtatattctgttgacttgtggtggagggttctgtagatgtctattaggtctgcttggtgcagagctgagttcaattcctggatatccttgtttactttctgtctcgttgatctgtctaatgttgacagtggggtgttaaaatctcccattattattgtgtgggagtctgagtctctttgtaggtcactaaggacttgctttatgaatctggatgctcctgtattgggtgcatatatatttaggatagttagttcttcttgttgaattgatccctttaccattatgtaatggccttctttgtctcttttgatctttgttggtttaaagtctgttttgtcagagactaggattgcaacccctgcctttttttgttttccatttgcttggtagatcttcctccgtccctttattttgagcctatatgtgtgtctgcacgtgatgggtttcctgaatacagcactatgatgggtcttgactctttatccaatttgccagtctgtgccttttaactggagcgtttagcccatttacatttaaggttagtattgttatgtgtgaatttgatcctgtcattatgttagctggttattttgcttgttagttgatgcagtttcttcctagccttgatggtctttacaatttggcctgttttttgcagtgggtggtaccggttgtttctttccatgtttagtgcttccttcaggagctcctttaaggcaggcctggtggtgacaaaatctctcagcatttgcttgtctgtaaagtattttatttctccttcccttatgaagcttagtttggctggatatgaaattctgggttgaaaattcttttctttaagaatgttgagtattggcccccactctcttctggcttgtagagtttctgctgggagatcagctgttagtctgatgggcttccctttgtggttaacctgacctttctctctggctgcccttaacattttttccttcatttcaactttggtgaatctgacaattatgtgtcttggcgttgctcttcccaaggagaatctttgtggcattctctgtatttcttgaatttgaatgttggcctgccttgctagattggggaagttctcctggataatatcctgcagagtgttttccaacttggttccattttcccgctcactttcaggtacacctatcaaatgtaggtttggtcttttcacatagacccatatttcttggaggctttgttcgtttctttttattcttttttctctaaacttgtcttcatgcttcatttcatttatttcatcttccatcgctgataccctttctgccagttgatcgcatcggttactgaggcttgtgtattcatcatgtagttcttgtgccatggttttcagctccatcaggtcctttaaggacttctctgcattggttattctagttatccattcgtctaattttttttcaaagtttttaacctctttgccattggttcgaacttcctcctttagctcagagtaatttgatcttctgaagccttcttctctcaactcgtcaaagtcattctccatccagctttgttctgttgctggtgaggagctgcgttcctttggaggaggagaggagctctgatttttagagtttccggtttttcagctctgttttttccccatctttgtggttttatctacctttggtctttgatggtggtgacatacagatgggtttttggtgtggatgtcctttctctttgttagttttccttctaacagtcaggaccctcagttgcaggtctgttggagtttactggaggtccactccagaccctgtttgcctgggtatcagcagtggtggctgcagaacagcggatattggtgaaccgcaaatgctgctgcctgatcgttcctctggaagttttgtctcagaggagtacccggccgtgtgaggtgttagtctgcccctactgggggatgcctcccagctaggctactcagcagtcagggacccacttgaggaggcagtctgcccgttctcagatctcaagctgtttgctgggcgaaccactactctcttcacagctgtcagacagggacctttaagtctgcagaggttattgctgtcttttgtttgtctgtgccctgcccccagaggtggagcctacagaggcaggcaggcctccttgagctgtggtgggctccacccagttcgaggttcctggctgctttgcttacctactcaagcctgagcaattgcgggcacccctcccccagcctcgctgccgccttgcagtttgatctcagaatgccatgctagcaatgagcgaggcttcgtgggcgtaggaccctccgagctaggtgtgggatataatctgctggtgtgtcgtttgttaagcccattggaagagcacagtatcggggtgggagtgacccgatttcccaggtgccatctgtcacccctttctttgactaggaaagggaattccctgaccccttgcacttcccgggtgaggcgatgcctcgccctgcttcggctcatgcacggtgcactgcacccactctcctgcaaccactgtccggcactccccagtgagatgaacctggtaactcagttggaaatgcagaaatcacccatcttctgcgtcactcacactggtagctgtagactggagctgttcctattcggccatcttggctctaccccaaaagcaggattttttaatggctgaatagtattccatttgtgtgtgtgtgtgcacatatatatcatatatgtgtatatgtgtgtgtgcatatatatcatatatatatgatttaaaatatatatatgatatatattatatatatgatatatatgatatgatatatagtatcacatatataatatatatgatatatataatatcacatatataatatatatatgatatatataatatcacatatataatatatatatgatatatataatatcacatatatagtatatatatgatatatataatatcacatatatagtatatatgatatatataatatcacatatatagtatatatatgatataatgtatatcatatataataacatatgatatatataatatcacattttatcattcaaccattgatggacacttaggttaattccatatcttggttattgtaaatattgctgtaataaaataagaatgcagatatctttttgatatactgattttatttcctttggatatatacccagtggtgggattgctggatcatatggtatttctatttttaattgtttgaggaatctctatattttttcccataattgttgtactaatttgcattcccaccaataatataaaagggtttccttttcttcacatccttgccaacacttgttatcttttgtctttttaataatagccattctatcagaggtaaggtgatatctcattattgttttaatttgcatgtatctgatgattagtgatgttgagcattttcccatttacctattggccatttgtatgtctttttttgagaagtatctttttagttttttgctcatttttaacttgggctcaggttgttttttggttgtttggtattgagttgtttgagtaccttatacattctgatgttaacatcctgtcaaatgtatattttgaaaataatttctcccattctataggttgccactccactctgttgattgtttcctttgctgtgcagaagcttcctagtttgatgtaatctcatttgtctattttttggcacatgttagtttaatatattttctttccatgacaatagatcagaaagaaatgagagatattaaatatatatatataaatatgtatgtgtatatatatgcaaatacccagatatttccacaagtctttcaatgtagatctatgtgacaaaatcccccagaagctgaaaatctggtttgtattacactagtgctagatgagtttaaataagggaacaactgttattggaatgcctttttttaagtcaacaaagtgttttgagtaaccagagggtgcatacttctttgttagatggttaacagcccttatgtagtacagaatgaagctgagaagttaggtctctcctagaccactagaggaaggctaatctttctactttatattgtgatcataggaagtcagaaagccaactttattgctacctcttgtcttttgcttatacatttctttttgtacgagtcccaaaatcacaaaagccaatggtataaattgtccagggaaaggtagagcttctaagtagggaagatgtttttgtcttttcagctctattccagataccttatatttctgtctccaaatctggatgtgatttccccaataagaaatagtttatgaaatacttaattttgagatttctactgtgtgtcccatgaagattttgaacctcattttaagagtcttaaaccatctttcagctaaattagagatacaaaatacagcattcaaggatacagaatagatttatgatagtctccaaacatttttcaagtggatctgtggggacataaactcataagtatatattatcaaataatttcaatctgtgtcataatgttttcataataaatgtcattaatatttgttcacaagagtaatatatatgtatatactacacacatgtgtatatatgtatatgtatataaacacataaaatagttgggaaatatgtaaaacgatttaaaaacagaatcatttttataatccacctcacagagaatatatgttctcacattttagtgcgtgttatggctctataacatctggaaatgtgtgtaccacatttgttactgtatccccaatgcctagcacacttttgctacatagtaagtacctacacaatatctgtcaaattgcctggagagttggaattcaccaattcaagggccacagaatatcttagaattgatctgttcttccatttaatcacagtttaacacaggtccatctgccaagcaggaaggaacatgacctagtcccacctctctgtggagcagaagtattagtaatatccactacgcagtttctcctgtactctcaaaaagaaaacagtcatcctatttgtgtttcctgagaataggaagctcaaatgtctcagcttcatccactgtcatggttaggagcaccttcttctttgcctgggaaagaggctagtgacactataatttctcagaagtttcgaaaggcagcaataagctgaaaagaaccattttgtctgtgatctaaataggactttgctgatggttagtatactcaaatgggtttgtagaatattttgtcttggtgcctggaatttgcttttacgaactcacttgagaggcagcggccagggaagagctctctctcacctgaatgcttagcagaggcaagccatcaaaaccttccaggaagtggcaagccaaagggtctgaattggaggcacctccccaaagatcaaaagttatgctccaccaacacagagacactgagaaatggttgaatgtgttctaaattaaactgccctggtggtgagcagagatctgccaaaatctttcaattaatcacttttaccttcagggcagagttaggcctgagagtatttcaatagatttttattggaacagagttatttcagatattaaactatgttgcacaaagtaaaaataatgttattttttaagttgctactcttgttaaataaaagttggcaagcgttctcggggtctgtattgtgtctgtgtatttgtgaatgtgtgtggctttttcttgtgccataatccccattgatttttaaaaagtgaacagcaatgaactaggtgataaatatatttatataatattttcattaataatgtgttataaataatagaagaaaggttttaagtatataattcgctacatcacaattgggatttttttttcctacgtcttcagcagtaagttaattagaatcacctgcatttccttgggtggacaccaaatggattgcaaacaaaaacagattaaaatagctgctggagctcatggcatacagatgacaagattcacaaaaaggacaatgaggcactgaaaatgttcgcttttcaaacaattctagaggaaatttagctctcgcgacttctctgtaaaagctgcctgtaagtgttttgctgaaaggctagaacagctttgtttctgatcccttgatgagtgagagaaatgtttaagaaagatcactttacagagagattcaggctgaaatgtgatgactgtgattcaagccaagccaaaaattacagttcagaatgaaaggggagggacgtggtttgggaatccattttcccacattcctgaatctcaatcatcccagccaatgtttagaaaaaaatccaatggaaaacaatgaggtcactttgtttagatgttaaaaaaaatacgggtggagggattgaaaagaatgatggcaaatatatgaattttaaatcagtatctatttcaagtatgatgggatcaaaggctacactttatataactcttatgacttcatcccaaaaggatccatttttcagttttcttctttgtgttggtgagccttttattgtgtttctttaatttatgaaatagtctcttgctaaaattaaaaaaaaaagtgtatgtaggcacagagtacagattactcctcctgagactccaagctttccttaggaatagcatctccaggaatctggttttctttctttaaacctgctgtggccaccccactgctgtgtagatctcaggttatgctggtgtattggcttgcaaactaccagatgataatggcagaccaaattagattcattgttcttgttacctctatttgttttaatgaaacacactaagcaagtcatactaccaaatgaatgatttatttacatcagcatgatcacagcgtaacagtagaactacaacataaaagaaactcagagaataatatgagataaaccaaatataacctccaacttcaatatcttccagatacactaagtttttcttcaaggcaacagctctcacttaatgataaccagaatcattgaccaaaatttgtcttcaagactaagatttttttaaaaaaaagaagatgtaagatttgtcaatgactgtttataggtaccttgtttcccaatctccagaaatcatttcaattcatcatctttggtctgatcagaccactgatgctaggttcttttctagagaaatttctcaagcaaactcagaatcttgctgagatctttcttatcttcagagatttccaaatgatcctaaggctggcatatatctgtaagtcacatttatgtctactatcctacaggcttcatgcagttaggcctcaaattcttagctgagcttagagagatatgtaagaatgaatgtgcagaaaataagacacaaataggacactattgttccactattgtttcatgttaaccaggtattaaggtacataaatggcttatcaatctatatcacattagccacactggaactttttccccttgtcttttccctggttgattaccatttggtaatccttaagttaaaaggaatcattttaaaggtgggaattaaattagatgtatagaggctatatacacaaacaagcctgatccataaagaatcacagcaaatggaaaccaggaaataatatttttgaaagtatactactgcctatacttccggattccaaaggtatagataagcatctccaattataaaaaaaaaaaattggttagatattgtggcaagaactaagtataaatataagggaaaattctaataatgaggcaagacagtggttttactcctgtatccaaattgaggagggatgactttttttttttttttgtaacatttgaagaagtcagtgagattttcttctacttattgaaatgtctgatatcctacttaacatgaatgaaggagatgaagaaactaggaaagtaatgcaataaattgttttccaagactgaatccaatcctgtgtctctatacaagaatacctgataatagtaaaaagcaagatagccaatcactctcctcccacacgtctccctaccatccccccacccacaatccccaaactctattgtcactgaacttttcaaggcataaatgatacaatgtagaaccactaagaaaaccaaaccagtaacacacttaacattcagggtatttagttcttttcctcacccaattttgatgctgaagcaatgtaacaacacctgtcttccctggtgtccaaataagacgaggtttgttaagagctcaggactgggcagaagagcaaataggaccaatattaatgataaatatttttgcaagaaaacaatcttatttcctcatattaacaaattgaagtaacaggggcaaaagaaggaagtgggagtgaagcatttgaaaatgatcccaattgcccaagtgttcaaagaaaagtccttgaaaagcattctcctttctgattcaagagtctatttgatatcaccttcttcttagtatatatgtatatacatatacatatatattcctttattatgtgctctttcgaggtatttaatttaaatctggaatttgcccctagctcagacactggctatataaacaattttaaataattgctcattttttagtatcataggttctaagccattttcttagaaacgaaaaaaaaaaatccttctcttagtgacctctttttagtctaacattaaagaaaaattacaacaaatatttatctcttccatgtcttaagagaataaaaattcttattttccatatgaatcccctacaaatacctgggaaattaaatacatttttttcagaaatgaataatcaaaaatgagccaataaaatctagataatgatgataaccaaaagcaaacaaaataataaaggaaaaattgaaggtattttgttatgacattaaaaagaaaaacttgttgcaataattgtgtctatgaagcaagcatttcatagcagaaatatgaggaaggtagaacaaaaaaccaaaatgagataaaaattgaaaagaaaaggctcacgaaagaaatggaagagaaaactaaaacaacttcaggtaataaaaggagaattgaaaaatgcataaatgatagtaggaatttctataaacacagaaaaggacaagagtaagaaacatgaaatgagagatgtactgaaaccctgtatcaacctatacttccaacattagaattggaatcacgtaacaactgttttaaatattcatagtttaatccctcaccatttatttcccatgtaccaataatgaaaataatataatagtatcttcccaaactaatgaaacttctgttttcagtttttaaagttcttttttatgaaaaacaatgtaggcctcacattcaagttggcagtctcaaaaaagcatgtctgattctctttcctcaaaaaaatcccaatgaaataatagaaaatatgtgttttaaaaacaaaaaaatggataatggtgctgaaaacagaaaaggtgccatcagcagatgagaaatagaaattccaggaagagaggaagcagatgggatcaaacaaatagagaaatgaaagcaggagaaacaccattcccagacaccacaattaggcacagttctttccaggggtgtcccagagaataaccaaacttggagtcaacaaacaaaaagaacagaaattgtcaagagggcagtaaagaaagtaattcattaaataacaggatctaacagctgtgagaactgggctcctctttctttatcctgcaccaaggaagcacctacagcaggtgcttgagcctgagagcaatttctgtaaggacggaaaagttgctggcatctgagaaagaagacagtggagaagaaagtgtctcaggtcttctccaacagaattagatatacctttgcccaggtgaaaaattggtaaatttctctatatcccaagttaagtcttccttactttgataactggggagaacccctggcctattgtctactcaccacccatttatcctgcgagacactccaacacaccattctcatttaagattggacaagttgtggggagggagagagttggacacatacagaggtacccatgaccactgtttaatcagtctcaatcataagggtaatccaatatttgataatccatcttaaataaattctagagaagagagataatagagggaaaacaatattgagcaaataatataagaaaatgttttccaaatgaaaaggcccagatggggagcacatatgagtgacattttactgctataagtttaaagagaaatttttttttaatccaagagcaaaagcaatttacctgcaaagtgtcaagaatcaatctgacatcagacttaacagcagggatgctagaagataatggaacatatatttttcaaagttagaaaagtaaaagattatgaaactgaaataaatactcaagtcaacaatcaattaggaagcaaaagaaaacagtcagatgggtaaagtaagaaaaattaccgatcacatacttttatgaatcaagaaacttcttaaacttcaatccaagaaagaataacaacggaatacaagagaaggagggtagttgatgctgacctagagccgcattgtctaaaatggtcatcaccagccacgtgtggttaagctactcaaagctgaataaaataaaattaagtccctcagttgtattaaccacgtttcaagtggttaataatctctgtagccagtcatatgtggccagtgaatgctggtttggacagcaaagacatagaacatttctatcattgcagaaacttctgttgggcagcacttaatctgaggaaatgaagaaacctagaaaggaggaagaggacaagttaagtcttaacttttgggagctctcctttgtgaaactaaattttaatgttaaaccccaacatgttccctttttaaaaaatagtggctattattaacccatagataagtctcaaaatagttataaaaaacaaaatgtcccaaattttaagaatataaacaaacgcataaagaataaaactgggaagggaagtggtagagagaagtaagagtaaatatactgctttgttttccatagctcagagataatttgatatgctaagatatagaaataggcaaattaactcaatgaagagaaagagggtgtacagataagtggtaggaactacgaatgcactaagctctttatcttttctgagaaatcaataaataccattcaaagttaataaattaataaacagaaatatgacatattaacattaacaaaaagaatgaaaatagaacttttcttttcgagacagggcctcactctgtccacccaggctggagtgcaatgctgtgatcaaggctcactacagcctcaacttcctgggctcaagtgattctcctacctcagcctcctgagtagctgggaccacaggcatgcgccaccatgccaggctaatttttaaattttggcggggggaagataggtttcactatgttgcccaggctgttcttggattcctgggctcaagtgattctcctgccttggcctcccaaagtgctgggattgttggtgtgagccactgaacctggcctaaaatagaactgttaacaataactgtctttggaaagcatgttggggcagctactgtacttagttctgattgtatattgttctgtatggttcaattttgtattttttattgtttttttaaccatggaaatatagcaaaaaaaactatatatttttagaatggtttttatgaagtcatatagttatcctatagaataaaatgattcttgtttgaaaatcaaaattgtgccagctatttcctaagggaatcattcttaggaaatagcaaggctattgaaggatgggtgtctcataagaaattaacaataattaaattaaaatggcagataggtacaaaatcaacaccactgagttggaagagagattagaattttaaattatatcctgtactctcagtcatcgaatttaaagtgtgtgaacaaataagctagcaagaaaatgttggaaacactcatttcaacttagaggaggaggcataggtctgaatggcaccagagcttctcatgtttagctcagaacccaagtagaaatttggaaggaccgagacagaaacgtgcagcgttgaggacaacctgagtgttcccgtgctcaaagattttcgccggagggagaagccagaagttcaaagtattgcgagaatggcacttcttgtggtagctctggcctcctaggaattaggaagtgccataaatctcaggagagggactgtttgtgcaaaattcccagcccacatttgcagactgtagaggttcagatgcattttgttatgggttagaaaaacaagcaggctttcaggacacaccactcaaccaggctcaaactccacatctgcatggtttgtccatcattcgggctaccaaaaatgctacctaaaccagttttcaactatttttaacagactcatctgcattgtcaaaaactgtccatattttggcagataagccagtcaaatctggtcttagatttctttttgcaaagtgtctaagatttatggtgggaattactcataacagctgcattctttccactgggcttagaccaccatttggtctaataactcctaattgtgtgtctatcccagtctaagcttcttcaggagaaaaaaaagtcggggtggggaggcaggggaagacttttaaaaatcccctacagcaatacccagtgatttctgccaacagtaaacactattttgaaatataagaaggtcagctgatgatgaacgaataaacaatatttcagtgaatgtggatttcttcagataatttttcatactaccattaatgccactcttatttaaaaataaaaaataaaatgacttagttttatcgtgttcccaaagtatttttagcataacaggcaaaaatcctgtcagcatttacggtcatgttactttcttgaaagaggtacctctcaaagcgatttttcaccaaccttctccaaagcacaaaagaggtaccttgaagacgttggtcatttaaaaatcatacgacgtctaattatatttccaaaataagtagtttgcaatccagcaaggataatgtggtcatgaaaaggatgtccaaatccaccaatttacattggtttggtttggcataactttcaaagttcttggagtaaaaggaggatggcacgtgaataattgtaatttgggtaatagtcctagaactttgggtttgctgttctgtgagccattcaggggaaagcaaatcaactccaagactgtacctatataatttataactgttaaaattcactgatatgttccagattattttgcaaaatgtaataccctcctttttaatatgtactttgtcattttcactctatttatgtaatttaaaaagtatgatagccggagagcatgagccattcaaagcaggagccgctaatgtcagagatcattatcactcacaagatatatagtgttggtatctttgaatctaaagggcttggaagttgtgtcaagatagattcatattgcatctaatatgttttgctttactcccttttactttctggtttctgtctccagccacagagcagtttctctgctgtgactcaggtctacaaccacagcggtagcacaggtctgatttaccctccctgtctccaccagctgtgctccctccttttatgccaaaagaaagttgtgttattactttaggatgaggctgctttctttaaacagtatactgctttccaattgtttatatgtgatatgtccaatccatactactttttcaaatggttttgattactggacttaaaaaattgtttacagaaatttatgaaagaccaaggaaagcacttcttatattgtaacactctaagagaaaaaagaagttttggatacagggaatttcatcagttaaaaaccagtttacaattctatgcatttcaatagcatatagaataatatttgaaaaggaagagtgctaacttcaaaatcaagacatgcacttgattttacaccttgtataaatgaatatgcatattaaaatgatgattaagtaaggcccttatttgcaattaaattttgaaatccaaataatttcatttataatagacctctgataagggtctagctaattagcaaaacaaaatttttaaaaacacacaatgttctcatttttattgtaatagatattcacattttatctttaatcactgtaaataggactaatttgattgattttttaaaaaattagaatttctcttttagagaacatagacccacatattccattgatgtttctattttctaaaataattattattctctaaattccttaaaatcaattgataatccatgggaaaataatcagggccacattcatttgatcaaactttgtttgtttgtggtggcaagcatcaaggtgactttattcaccactcatggttctgatgccatttgtctgcttccaaatccaaaactctctccaaaacccccaagcatgccattatgaacatttttctgtaaacatttcagggcctctgagggtgattttagagaagaattttaaaataatttcctcagtagctatatgctcaaaaaaattaagagggaaaactttgagaaggacacacttgaatgtacaatttttaatatttttaaatctatcacgttatttaaaatttcataggttaaaactaagtaccaaacagcatctaatgacaaaggaaaaaaagaaaatgataagttttttgtaaattaattttttaacattctgggtgtaagtgcatgaacttaagaccaaaatagaccaatactaaaagtaggaattaaatattagaaaaattttaattaggactattatcacatttaagctgtcaagcagaaattgtactttaaaacaaacaaaccagagtagacttagattaatggaggtaatttgtgcatcacgaagaaaaaatatattgatttttacaaatatatgtgtcttagaaactttcaccactggctaactggtgtccagcttcacccaattcctcacaatttatagttctcaggaagagacagagtctcagtaatttcttagattattctagaactataaagtcacatcaattaatacatttgttaatagctattccattttattgcaattatctcaagtaaccctaaagtttattacatggaagagtaaaaactatagtgaatgattgtcttaaattatgccattattaccaatgttataagtgatgttattctaccctaaccttccaatgcaatattttgcacaatggcagaagtgttcctaatacaaagtgtgtaaaatggtaaagcaataaatgagctcattttatgccagtaaagtgctttgggaagtctttattctgttacactatggcaataatttctaccaatctatttaatactgttgtgaattacaatgattatccatgatgctataccacctccctagagaaactgctaagacctctgcatctgctggcaatctcagctagtcctgagtgcccagacacatcaaagaatatacattcttgacattaaaattatgttttcagcatttttagatactattatagtgtttgactaagtgtttcccttttcgttttcctgtttcttcattgtcctcgtaacgtggccaagaaattaactagattctataaatagatgtgtggaaaacaagtgaatgattattgaaattcactgccaggataagttattttgaattacagatgaccagttctaaaataatctgaaactcattttaccatttcgctaaagattttttaaatttttctctccataatggagcacctcattacctataatacactagaaattatcaaactagcattatatctagaatagaatttttactctttagtttcaaataatcagatcaaaatatgttattctgtaacaatcacaggaaaacaagaatagaatagaatagaatagaatagaatagaatagaatagaatagaatagaatagaatagaatagaacagagtagaaatggagagaagaaaaagagctgagaagaggagaggaaggaaagaagagagacagaaaggcaggaagacagtaagtcaggccagtagcaaatgtcttacaaatgtctcgagttattttaccttgcagaaaaaaggcaataatacacaaacgtctggaggtttcccccctacccagttggattcctatattttccttgtaaatgaaccttaaatatatgatgtaatcctattctacccactgctctttttgcctcaattagacccaaatttattgatgataattttaattaagactgaacaccatgattactttgagattaaaattttgaagattgcataatttagaacacacaaattggttttatctgagaagaatagatatttgatttactccttcttttcatagattttttttaaaccatctcaattcctatatgtgctaatataaaatatgcccttttgtcttcaggtctagatgttgatggaatatatcgagttagtggcaatctggcaacaatacagaagttaagatttattgtcaaccaaggtaagtgatttccacttcagagattttttcaaacagtttcatatggaacaatatttcatacactgtgctgtatgtactgtgaataataataaaactttaacaggagaatgtgaaagtggaagaaatttaaaaattatcagaaaagtaaaagataaccaactagtttatctagaaaagaatagcatatacagataaacaaattaatagtctatgtgaaataaataatgaatggaacatgtcaaaataaaaatgggggaaagaatagaaaaagagtaaaagaaaaatgacccagattcaaaaaatgttattggcttataatggacacttactatatgttgatgaatgaaagaatgaatgatggaaaatgtaaaagtcaaaataacagataatagaaaaatatatagtaggtaagaaaaaaattaggaaacgcatatgccatcaaagagttgtaaattaaaacaatgagataccactacacacctgttagaatggctaaaatactgacaacaccaaatgctggccaagatgtggagcaacaggaactctcattcattgctggcggaagtgcgaaatgattgagtcactttggaagaaaatttggcagtttcttatgaaaataaatgtatttttattgtatgatccagtacttcttggtactaacccaaatgagttaaaaactcatgtacacacaaaaacctatacacaaatatttacggcagcttttttcataattggcaaagctagaatgcaactaagatgtccttcaataggtgcaaggacaaatacaccagaatacatccatataatggaatattattcagggatgaaaagaaatgagctttcaagccatgaaaagacttagagtaatctaaatgcatatgctgagtaaaacaagccagtgtgaaaaggtatgattccaacaatatactgggaaaaggaaaactagagagagtaaaagatgagtggaagcagtaggacgagcttgggggaaagagggagagatgaataggtgagcacaggggattttgagggcaaacaattctgtatgatgctgtaattacccatacatgtcattacacatttgtcaaaacccataaaatgcaacacaaagagtgaatcctcatgtaaattataatatttagttaataataatgtattgatattggcttatcaattataacaatctaccccattaatgcaagatgctattaatagggaaaattttgggaagagtgaggagatacatgttaactctctgtactttctgctcaattattctgtaaacttaacactgctctaaaagaagtctattaattcgaaaagtaaaaataagaaattagaaaatgaaaaacaagaagaccaacacatcttaagttggtgttatagacagctcataggttttaaaatcatacagatggggtagaacttagactctctccttgtatccttggcatcttaacctccctgtgcctctgtttcctatcaggaaaaacagtagggggatgccttggaaacatttgggaaaattaaactgggtagcatctatgacacttaggaatgtgacagactcatgttagttttccttttacttaaaaacagtcaaaagtgtcttcagaagaactccaaatccttgtactctagcttcccacttagcttctataatagctggcttcaggtcctctgaatgtttttcataatacatttaacatataaactgtactcccacatttacatactgttgtgttttttaatgtctttgcacatgctcttccctttactttcaatatcctcctatcttttccttcccatcccacatacacaagcttccagcctggtagatttcttctttttcttcaaggcccagattatagcaatttcattcaataagcctccagtcagatttcttctctgttccccttactctgagtagctgaatttacagtagtacattcacatctaacttttaaaattccatctattataagacccatagatttaatgccaacttttggaaaggatataatcaaatgtactcggtgattgtatttcagaaacattaaaatttgtaagtcttggaatcaaaaaataggatactggctgaaatgtctgtctctttcacaaatctctaaaaaggtaggacttgaatcatccttgtatcttttcccattaaccagttctagccttggtgtttccatacaaggagttcctcatacagggagtttttaattaatatttgttgaacaatgtgtgtgggtgttgcaggtaagagaagtattaaaactggaaagcattcaactctccagcaattcaacttgggttgaaccagttttttaaatgttgattgcaatacttttggccacttgccacatgactcttgtttctaagaatctctataactgagaatctctacagctctgcttgttcactaatgcaattctttgtctttcacaattactctctttcctgggcaaaacacagaactaaactttacctcattcatttatattatttccatttaactgaatcagcgtaccccctctgtgggtaaaatatggataaaatagccctagcctcatattcattctagcttataaccagctaaaatcattcttacaatatagtttatgctgaaacgatatcctgattgggattctagacagctgggcaacacatttcttctacaaagaagaaatctcaaaacagaagccatgctagaaacaaacactagttgcatttcctgcctttaaaaaaactatgctcagcagtttgaaaaggcaaagaaaaaaatctgcaatgaaaatatgaaatctgtccatctcgtcttttgcaatccaaacttcagcgtcctctgaggctatgtaactgctcatgtttccatgagaattgacaatgtaaggctggacagaggcctgagttggtatctggtagcacagaattgtcagtaaactgtctccctggtttatagcactgtcagaatgcaacatactcaacacaaattatgctacattaggacctttgatactggtaactttgtccaagttgtgttatggagttttctgaattagatgataagtgaaatgcatataccaacccctttcaaaatttgctaatcagattatcctttgaatgcgttttctggactggccccacaaccttgttgctaatgccataccttcccctccatctggaccaggactctaatagtagagctgacttgaaaataatcagtgctgggtgcaaagagattgtaagtgtacatgtggccctctgtggccctctctctgtgtgtctaatacaataaactggcaatgcagggaaaattccatgaaaagcataaagtgctatgtaaaggcagtgcatcatttttgcagtctaagctgaaacataaatgatttttgcatacctgccttgtattaacatattttattccttctttattcaccttgcacatgtttattttctagaaggctctaaatatacatttttaaacaagtaagccctgcccactgttagactagacaaataaaaactgatttttgagattttcaagacagatgaattgcaatttatgtatttcactaactttcttgaatgctataatcatcagcaattctaaatacaccagttgaatgactcaatttgttttggttttctatttgacttactaaatcagtgggaattagatacccttattatacttccagttcagatgacatgcaagttatattcaaagtgttcacttttgaaaagcatttcctaattataactagtaatgatgataatagtaattattatcataaaagtaagcagcattttcataatttattatgtgccaggcactgtactaagcactttatttacataatttaatctaatcctttcttacatcccatagagtaggcactattattattcccattttacagatgtaaaaactgaggttcagatagtaaataatgtcctaatgtcatacagcatataagtgaaggagctaagactagatcccagatctgtctgactcagagcctatgctgcaaaccactgccattattctgcatttccaattcatcagctgttgattatctctttataaaagcagagattagtcttttcatgctacacacgctcattcatgactttcctttacaccccgcctcttggtgttggtaactgatgagtactaccgttggagttttgctaaaattgttcaagagctatttggagaaacgccaaacatcacagttaggaagaagcctggcattgccattctctgtatggctttatgtatctatgtttggcccaagaaactactttaacacgctattctgttgcagcctttgggaaagggatcgaggattctcgatttactaggctgttggtgcgtttgtgagcagcgctctgccctgtttgttgaatttggtgacagctttcagtgacattttgctgatacagctcttctgctttgtgaaggcatccccaaagaaaactggtccatgaccttagatgtcaacctgtcatcagcctgcgacattgcgttgattcttcagaatgatctgtgacctccttacacttttcttgcatggggggtactttgcaaatgacagacttcagcatggaggatgctgcatgtcttgagaacttttgacagaaagtcttggaaattcccctaggctaaactccccctccttcccacattgatacttgggtttgagctgcccatctatgccttaggcttattgcccaaactacaaattcagttcagactcacttggtattatttagacatcctctttcaccctttgaaaaagggacaagagagattggcattctttttggaaaaatctagctatgaaccttcccaagcccatgagccaatgggagagctatgaagcattgccggaagaactgactgggaattttccagatgggtgtctgttagtacacagttacaaatattctctctgttttcctgaactgaagaaaattacttcttaccaggattttagacatgtttttcttttttctttttcttttttttttttttgagacggagtctcggtcggtctgtcacccagcctggagtgcagtggtgtgatctcggctcactgcaacctccacctcccgggttcaagcgattttcctgcctcagccacctgagtagctgggattacaggtgcccgccaccaagctcggctaatatttgtatttttagtagagacaaggtttcaccatgtctcaaactcctgacctcaagtgatctgcccacttcggccttccaaagtgctgggattacagagtaagccactgcgcccggccgacatgtttttcatttatagaaacaaaatttgaagaaaaactgttaaggacaaccttctctacttgtgcaaacaaggaggaacaaaatatacaaatgctataaatctacatgatcaagaatcttgtttgtgtgtttgtgagcacacacacgcatgtgcatttgttttaaatgagaggatttttttcattaatttatggtctcgtagatatctttatctacccagattttattggcataataatccaaattagatattggcttaaagagatggatgtgcttagtttaaacatgctaagaataagctccattaaaaacaaactattagaaaaacaattttgtttttatcaactgtacctaaactactttaatatagatttgtaccttaaagcaaagccaagcattaactttagtagctatccctgtgcttttcatattatttgcagcatcaaaaattgaataaaagaaagagaaagtgagaaagaatgtgaacaattggcagtttcatcatgaaataagcaattggatgaaacagaaaaagatctgaaaaaggatttcaaatttctgttcttataaaatagcccttgtatcaagtccattcatttttctattaaataagtttatattgccctcttattatttttaaaacgaggtatttccttaagcctgctctactctcaccgccaatcacagcaacaacgaaacaaactctgttattcgctttattccattccacagggtggttttttggtaagttgaatcattgatattgcacctttttggctttcatgtgacaagattatcttttaacaatgatttatttttcccattaaagttgaaaagatcacttgatcataaaagagccagactctaacatcattcagggctttggaaactttcttagacctcatttttcagctacattgagtcagggagctcaaagactattgatgaagcatgtattgttttctagctgcttaagaaaatgtattggcattagtaaataatgctgaacacagaggtcaaaagagtaagttattcatgttcatgcacatttagtttctgatttttacattatagtccaaaaataagtttatgaatcctgacagtctccaagacacacaaatcctggctacttattttaaagcaaaactataccacacatttaccgtggattgtattttctaattcattatgtaccaaccaataatgaactgacctaatgctgttgtgaaataaaggcagaaggcatctaatggggaaaagcaccagataaatgttgaaggatcgacctctttatcttgattctgaactatttggaagcctaatagaaattattttaacccctttaaatcaccaactcttcatttccaaaatgggaaaaataatggaaatgtgaggactttaaaaagtgaatcagccaggggatagttattattaactttaattaagatgacaagtagatagatgaaatcaaatcactattgcattttcttggtaatagcatgataccaaatatttataatcaaatatggtttttgccttctacatgattgaattttccttgatgataattggaagaaaaaacaaataaaactttggaaactctttactatccagtgtttgaaatcattactagccaaattcataggccttctgaattcttggacacaaaaaagaaaatttcatgttgtcagtatggtttgggaatattctaaattgcaaagaatagcttcatgttcattggagaaggggagcgaagtctactgaaatttaaagtattaattcggttgtagcttttccatatagacttgactactgagtctggaaattaaattagtcagagttatgtaactactaatccccaagaaaaacccctaagatatttacaaaattccatcatgatcatcaccatcatcatcatcacaaatcattgccataaccatcaaaattaataagtagttattaaaagcttcataggaaaacacaccatgcttgcttctgctctaacaacactgtagcactggttcccggccttgactgcatatcagaattgtactgcatatctcctgctgcctaaccatattactgccaacttagctacctaaagcaatacaaatttattatctcacagtttctgtgggtcagaagtctgggcacagcttagctgaatcctctgcaaggctgcaaaatcaaggtgtcagccataggcgggttctcatctagaggctcaactgaggataggtctgcttccaggttcacatagtcattggcaggattgagttccttgtgggttgttggactgaaggcctcaatccatcattggttgttggccaaaagccttgtggaccatcttacagcatggcagctgccctcatcaaagcagcaagggagagacagattattagtacagcagaagttttaatcccatgtaacataatcatgaaggttacatccaatcacctttgctacctactgttggttagaagcaagtcacagttcccaccttacatcctaggggaggggactacacaaggtataaacacaagaaaggggggataattaggggtcatcttagaacctgactgccataagaatctagtggtagagcttttcaaaaataaatatttttgaagctcattcattaaaaaatccaatgtaagaagtctgcagtttgagctataagtaagtgttttaaaagaaaaactccccagataagtaaagtgcatagccaggtttggaaactccctgcacaatggaagctagttttattctggctctctggtggagacatgacttaccaagacataacatatacaagatttgcatttgaaaaaaggggaaatagaccatgaatgcctgtttcgataactagttttctagtgaggggaagtcttctctttggctattgattaatgtaataatgttcaaaaacttttatgaactgcttcattatataactaaaaactaccatggatatattatgtatgttagtatgattaaaattacgcattttaccataacaatccttttccaatgttgtgagttctgaaataaatgaaaataaaaggtgctttacctaatcatttgctaacgaaactaaggggtaaataatatgaaaaatgtaatacatttatatcattgctgataataggagcatttaattgagaatctactacatgacaggtacacaaagttagaggaatctctgaccctcataaaagttttcgaggtagataaactttattatccacattcttcacataggaaatcatacttaagaaaaattaaataactcttaggccacaaaattaatacagtattgaaggcaggaggtgaatctattttaaacttactcccaaaaatatattgcctggtagctggattcaatttaccatggggaagggggcagagagatgttatcttctttttaacattaaggaatcccaaatcacttattctcattatagtactatattttccaggtgttcagcctatgggaccctctataagaaaaaaacatcaattttaaattacccttttaataaataacccccaaatgctttggggattataagagtaggaaacttgattcatttttgaatctccagcatggcaaagtgcctgccactttgaatgtatgaaattaaggtttgattctacaaaataagagaatgatgaacatcttatacaaaccaactctatataaaataacttcattggtacattatgttaggttccattttctcagcaaagaaaactcaagctatattttacattatattttctcccagatgcctataagttagcacttaattttagactggataaaagaaatgaatagtgaaggatcccatatccccattttctgtctcaacaaaacaaagcttgaggcgagataacttactgtccctcaacatggtatcttgttagtaattgaacatgtcagtcatgatattggaaatagtggtataacttggcatgccatcttagtcctccaaaatgttggaaatacttagggttggataaatagcaatgaagtcatactgctcttgctaacccccaggccctgaattttgaaagcatgtcttttgtttttgttttcacacaaggatccctgttgctggtaattacagctttagtgactcacatatatttatatagcacctcttttccaaggtgccccatgtactttggaaacatttcctaacaaaagtgtgctgtagaaaaaaagtattctcatctccttaaagctgttcctgaaaaggaaagtaacagttgcagagatgggaagaaattttttttcaggtccccaagcacaacgtgaaaataaatattcaaagttaacaaatgcagggctaaagcaagattcaaactaaggtctgaatgacttagaaccacacagattctattatgcccttatgtgtatggacccactggagaggtggtggaagatagccttatctgcttcttgcttcactgagggtcccagcacagcaggattaatatggaagggagagatgagctccataaaataagattttggcttttacagcattcatttgacagatgcttaaagagctcccactagatgccaggcagtatgtgggacaccggaagtacagcagtgactaggacaagtgacctttccattcacatggagcctccatgtgcatggacattgcaatctatcagctaagaaccctggtgatgggttcaatgtgaattagtgggaaaatactaggatctgcaggcatcccaggtctgctccctcctctctctctgacctcactgtgtagctctcttccgtcctcattattttccaaccaccacggcttcctttctttctcagattcatcaagctcatcctcttcctggggcttttgcatttgctcctgtctactggaaatgagtttccagcagatccccacaagatgcccccctttccacagtcaggtcaccttctcaggaagccctttcctgaataattcgtctgagacatgccttcactgtacccacccagccactacctttcccagtatcgtgttttcctttcttcagagcacatgctatctaaaactgccttgctgctgcttttttttttttgagacagagtctcgctctgtcgcccagtgccacgatctcggttcactgcaagctctgcctcccgggttcatgccattctcctgcctcagcctcccaagtagctgggactacaggtgcccgccaccacgcctggctaattttttgtatttttagtagagaaggggttttgccgtgttagccaggatggtctcgatctcctgacctcgtgatctgcccccctcggcctcccaaagtgctggcattacaggggtgagccacagcgtgcttctttatctatcacctcagtgcttgccttcctcctccacactgtggcatctatgtaagcaagaccttccctgtcttggtctcctcagtatccctagctcttactgtgccttcaaataaaagctttttggatttgaatgaatctaacaaacaagtgcattaatgagtcatgttgggtcaccagcaaaggataggctctgattgaaaagcaggcgttagccctcaggaccacaacccagacccaggaaaacatacagccccgaaaagaatatcttaagaatttgagagttgctttctagtcagtccagtgaaagatgttcctcttcccaaccctcaccttccacctccacctgaagtaactgtcttccaacccaacatggaatacattggaaagatttgggaagaagaggaggaagctgccaggcttggaagatcagagccagccctgccagccttgtcctttaggccaaaaaagactgcctaagaaacagaggacccccaaactcaggtgatactaaagccacatttagggtcttatgtgaattatatgaatttccatagtgtaatccctttcagtgaggtgatttgttgccaagtccctgtcggccccatatctcgctgtacctcaccttccgtttgccagagaacacctctggctcaaattacaagtggatgtcctggtcttgctatggcttcagtgaagtaacataaactgcaaaatagaataatcaggaaaggagggaaattagctaagggtataaaataaggcctaaatgctgggaaaactggctagtcatatgtagaaagctgaaactggatcccttccttacaccttatacaaaaattaattcaagatagattaaagacttacatgttagacttaaaaccataaaaaccctagaagaaaaactaggcaataccattcaggacataggcatgggcaaggacttcatgactaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctacccatctgacaaagggctaatatccagaatctacaaagaacttaaacaaatttacaagaaaaaaaccccatcaaaaagtgggcaaaggatatgaacagacacttctcaaaagaagacattcatgtagccaacagacatatgaaaaaatgctcatcatcactggtcatcagagaaatgcaaataaaaaccacaatgagataccatctcacaccagttagaatggcgatcattaaaaagtcaggaaacaacagatgtggagaggatgtggagaaataggaacgtttttacactgttggtggtagtgtaaactagttcagccattgtggaagacagtgtggcgattcctcaaggatctagaactagaaataccatttgacccagtgatcccattactggatatatacccaaagaattataaatcatgttactataaagacacatgcacacatatgtttattgcagcactattcacaatagcaaagacttggaaccaagccagatgtccatcattagtagactggattaagaaaatgtggcacatatacaccatggaatactatgcagccataaaaaaggatgaattcatgtcctttgcagggacatggatgaaactggaaactatcattctgagcaaactatcacaaggacagaaaatgaaacaccacatgttctcactcataggtgggaattgaacaatgagaacacttggtcacagggtagggaacatcacacaccagggcctgtcataggatggggggcagggggagggatagcactgggagaaatacctaatgtaaatgacaggttgatgggtgcagtgagccagcatggcacatgtatacttatgtaacaagcctgcacgttgtgcacatgtaccctagaacttaaagtataataatttaaacaaaaaaaaagcctaaaatattggcctaaatgaagacttcaaatggggatttattcattcaaaaatatttcttgaaaaccttttatgaaccaggatctcttctggaaaatcaggctctggtggatcatccattttggtgtcaagagatacataataaatacacaagataatttcagatgatatcagaaattataatcaagatcgtgatgtaatagagaagaacagatggagacgggtgaggtggcccttgattagatgacctgagaaggtctctttgaggaggagacatttgaatagacacttgacctgataggaagcagggaggcatggagagatgtggggggagtgcaaagcagggaaactggttctggggaatgagggcttctgtgagatcaggacacacagaaggccagagggatgggcaaagccaggccaggtaggccttgccaatcaagattagaagcttggcttttattctaagctcagtggaatgtcagtggggtgtagggcagcagtaagcagaaaattagctgaacctatttatttatttgtttttaaattattccactggctaagagaagaatgaattgtagggggaaagagtacatacaggggacaaattagaaggttgttacagtagcacagtcaagctataatagtggtggctgatttgtatgagggaatacttcatattctatttgtcttattttccatatgccttttaaaccatttcctttaagcaataaagtgtagagagaagagtggcccaggagttagaaagcctaggtcaattttcatgtcacctcttaataattgtgttgtcttgcccaagtcatttaacctccccaggtcaattttattatctttaaagcaagaatatattttcttttaagatgagtcaatcccatgagataatgaacctgttacaatggaaattgctacaccatatggaagttatatctaaatgtgtcccttacaaccatcctaatgaagtaatctattgtaatataatgaagtataacattttttaaaggaaagaatattttataaagaaagggcttatctcaagttcttcttggattatttaaatgtcactcaaattttccctggaacctccccccaaaccacaagaatcactcctcattttaaatcctatgtttacaacttcaactactcaatttacaataacctcatattgtgtataatgttatatatcactagtgaaaatcacatgcttatatcttatctactcaacacactaaacatttcttaagggcagagttcatatcttttaaacctgtctctcctactttacccagaagaatattttgcagctgatagaagcactacacattttaatttattgattgattccatccagagttggaccatttttttattaaagaaggtgaggaatttggcacatgctggagatcagtctcaaagtgaacaatttttcactgtgtactattgaactcagttccaaaaacaatagcaagaaatacataaaatgttagcattaggtattggtgatttttattgtcttcgtttttcaaaataccttcccaatttcctgcaatttacacattatttcttttgaaaacaaatattgaagaaaagagaagatatgtcttgtttcaaacaggtcaatccttttttttaacagaatagaatttacagaacataccaacagaaccaagagaatgtcagtacttgagttctctaaagcaggggtttccagccccccagccaggggccagtaccagtccatggcttgttaggaacctggcagcacagtaggaggtgagtggcaggtgagagagcattaccccctgagctccacctcttgtcagattagcagtggcattaatttctcataggagtacaaaccctattgcaaactgcacatgggagggatctaggttgcatgctccttatgagaatctaatgcctaatgatctgtcactgtctcccataacccccaaatgggactgtttatttgcaggaaaaaaagcttgaggttcccattgattctacattatggtgagcatgtaacaataatagaaataaggtgtacaataaatgtaatgtgcttgaatcatcctgaaaccatactcttccccttacaatctgtgaaaaaattgtcttccacgaaactggtccctggtgccaaaatggctggggaccactgctctaaagcacttgaaatgctattacactaaatctttgtaagaaagctacccactttatagatgaactaaagtctctatgaatttgaatgagttgctaagagttgcatttcttcattcagctgagatttggagaaggcattatgtgtttcctggtaatttagagagaaggtgacatgaaatcccagccacagtctcctaacatccatgggattctaaaaagcccatggaataattccctttaaatagcagcaggtattggtggcatctgcatttcttgctgtttcaccatctcctcatcctttctacttctccagattgtttgtctttttgtggtctcctcactctctggctacatttttcctgagcaagtaccccactccctcttcttgttagtctattactttcatgtctggcagccataaggggttcactcaccattatctgcttaggatgttggaattcaatatcccatcagtcctgggggctggagtatgtatgcgtattattatttgataggtcccagcagaacagtctttcagagcaagatgcacatcatcagtggttttgctgatggatgagctcacctccttgacacagatctcatgattcttggcataaatctcaacaggaattagctgcttcttccactgtgttcccatagcatgttgtccctgtgtttcagtactggttttagtctatttcatatgccacttctctccctttcatgactgttagatgctggagactgagctatttttcagtttcctctggattcctccctatgcccatcatgtgccatctgcattgtaggctttcagcaaagctgtgcctgccagatcctcttatttctgggtgccaaaatactcagcattacacttctacctcacaaagatctacctggcttaaaatcatcacccacctgtgtgtgcctttggagccttcatttcacccctgtcctcacccctgacacctgtaagacactgagtcttactgagcccactttctccatagtcatactctatgcacacagccatcttccccattcctctctccctctccctttcccttgccctgttctcagcgttatcatccccatctctcaagagtccactcagactttctaaggtgatcatttgttcatctgagcacagtaggtcatgcttcctgctactcctgggaatataaggtaagagacgtcatataatcaggtaaatagtgaggatttccagtctctacataaggtattttcaacagtagtgttgactcacctcaaatcacaccacttagacagctataaagccaggcttacctggaattttctttttctgactcatgaaactcttgtctctgtcatatgtgtatttttacttctgaattaatatagccatcctgaatcctaaatccacgcgtgatttctgagaccactactctcactgctaatctagttatgtaggaatccctcctaaataaaaattttaaaagataaaacatacaaccaaaacacaaagagccatattgagaaccatgcaaagcactttaaaagtggtaaaagatactagctagataaattcaaatctctagattacaaaaatggaaattcataaattaaaaaaatacctctagatacctttatatttgtttctttattccatcttgtgtgtttatagaagaaacaatattcaggtacttttcattttactgggatgagaaatggaaatgctaactacagtgcagcttcatgactcaaaagtctgtaactggtattaatgaacttttaaaatgctaattttaatgcttactccaacagaaagatgccttaaagcaaaacttcacatttcttatctgctaaaagcaatgtgttttgcatcccttacaaaataaaatggttgaaataaggtttttaaagggcttaaagtttcaaggacttctcttgttcttctagagaaaagaaatttataaaatcacatccattaatggtccctctgctagaaaacgaaaatactcccaaatatgttccactctaggaaaatcaaaaataacatgtaaactacaaatatgttagccaattcagaatatttattaactaaataatttaataataaagaaaatgccgacttgattaattgttacagagtaaaaattacaataaaactgtcttgatcagtgctttgcagaagcgccattactgtctgtgcagttgtttaacaaggatttaattggaaagataagtgaatgcacatttaaaagtattgttaatttgctttataatcaccccatccttcacagtattgacagcacaaggcacaaacccctttctgttttacaagtattattttccatatgtgcacaataaattctgaagcagtaattggaaattttatgggatccagtatacctagtatagtgggtttggaggtgcactcttcctttacaagaggtaacccagttctagttgttggaaacgagtgacaaatctttgatgtatatatttcccctatccatgtttgttcaggttcatatttggtccatttctagaaaaggttgcctctcttatattttatgtctaataaaatcaagattgagaggagaaaaaaatatgaattatttttagtctgtgactatttgtattactttcttgaaaatgtgcattatcagtggaggttctaaccaaggatggtttctagactgtagccaaacgaaatcacctgtatctgaaaatagtggtacctgaacctattaaaggagacaagagaaggggcaaagaacatctatgattgatctctacctctgcagccacactgacactcactcacacacatcccttagagtttggaatcatctcgtcaaaaatctaatcagtgtggtttgcaaaacaacatgagtgtaatgcctcagatttctaagaggtggcaaccttgactacccaagtttccaatatacaaagcccaaagaccttccttattgtagaaagagcctaaagctactttggaagcaggtcatttgctcatttcaaatgggtagagaatgttagagtgccttgtttattggctgattctcaaggagccacagtctttaggatttatttcaaaagataaaagagcctaaaacttaaagtataataataataaaattaaaaaataataataaaaaagatgaaaatatgagcgtcttcttgaaaatggggaactgttcattaaacctattttgaaggcaacagttgttcgaatcctctctattgataaaggctgcccacttggttatgacgagcagggagtgtccccaaagtgtctcatgccagtggcagtaaaagcatgaaaaaatatagggaacatgctaaatagcctcttggccatgcccccattagctagaattggtagaaatatctttaggtttggttaactatagatttatttttttcctgtagacagcaaacacttcaactataaaagcttagaaatgtcttctgaggaaaattttcgttagaatcctttgcagtgtaaacctctttgccctctggataaaatgtgttaccttacgtattgtcatgggaacaattatttttatctttagtttggctatgcctctaaatctctaaacttctcacatttacattagttttttatgcttacagagtaaaatagatacacatattgagtttcacatgtctagagattttccaatacatgctaatatccgatcactaataccaactcgcaaatcacataaatctatttcttcattctgacatgtatatatatttctctagtgaaaattcttaccttgctgagtttcactctccctatatgtgtaagtacttgtgtgttgtaaaaactgtgcgcagacacacatatgtgtacactttaaagattacttttactactttttcaaatttctccattggaggcatggattttaaaactgtttatctctggtgaaaatgtctttgggaccaagacctttatatgccccatttcaactagacagagctgagactggtgcaataatgaaacgtccagctgtcctttaattaactaaaatgaggaaaatgtaatgttttgatgagagaaccaggattctgtgagggataaggggaagactatatgtttctgcgccttcctgcatatgacacagccatggggtgcaggaaagagaggaggcatttttatgccccagtagggggagctttcttttccctactgtaaggacagcatggtgcatgtgtttaaatacaccatcctaaaatgcagacttttcattttcattttgcaagtgggaaatttcactatgtgatgggcacattactcttcttagcgacacattttgtgcaaactcatttgggaaagaataggaaatttaaaatactgccttcatatttcttctggaaatgttagcctgaatccattatttccaaacctgatgaggattacagttcatttgtatttcacagcaacccatattgtattctgttttgtgaagtaaataagagatgataccgttctaatagtgcctgtattttgctttccatgttaatagtcttattctgggggcaaaagggaaggaaaaaggcagagagtggaatactcaatttagccttctctagatggaaggaatgtgttattctgacaaagaagtgccctgaattattttataaataatctaaaccggaggaggtggaacacaaactcacttaggtcactgagtatatccatattcaaatgatattataaaaagcactgttcattaacacccaaatctctatctcttatttaactacgtttaaaatactcatggactaacctgatttgacagcagtgtaggtggatgcttatgtgccactgaagggaattctttacaaaataatttcccaccagcatttcactgtgcctgagatgccacaatttgaaaatcaattcattggctgaggcaggaaagacaaataatttcacctcttatactaaatacagttgtttcttggtgactgaccagatggttgtgttaagaaggatactgaaacattgtcctaaataagtgggaaagagttctgtgatccatccataatggatcacattaataatgtatggcacagatattatttaaaaagaaaaaaccaagtgcctgaatatgcacaccatgcactttatgtttccggtttaagatattggattaagaaaaaattgactgttatacaaataacatctgagtcttacactctatcgacgtaatcatgaacacaaatcttttaatctggtaggacatcatataacctagcatacctttaatggaatacagcaaagaacaggaaatatcagaagaatcagaagaagggaggattatatgataaagaaaaaagaactctgggagttgagttagattaaaaagtcacattttacttaacaattttaccacctctttttcacccactgactaaatttctttctgatataaagtatgactaaactattttggttgactctagttcatagattgaggttatttctattggaatgaaaggaagtccaaagtaatcctccattgaagaaatgtcccagcccaattaatgattttagctgatgaccatatagactatctttctgtctacaaagctgtcatcaaactatagctaaaactaatcctcctaattgcaaatcacttgaaaataaaagcaaatcacttgaaagagagaacatctacaatggaatgtataagtaaagtcttcccactttaccttcacttactttgggctcaggttggtgagatttattttcattaagacaaattcttaggccctgaaaaaatagatgaaacctaccatctgcaccacatttcaatatttgacttaagtcatctgttgactttgaacacactcgtgtaccattcctcatacgagctaaaatgtaatccccttcactggggactgtaaagaaatgttgactttcgatttctttacatatttgatctttcaagatatgagaatgctgcagctggaaaactcagcaccattagggaaacaaagcagaaaataaaacatacaagtgaatcagttaggactcttctgattttaagggacaaaaaccaaaggatttttttcctttatgtaactggaaaaatcaggaaatgatgcagcttcaagcataactaaattctgaagcttaaacagaatcgtaaggcctaacctctctcggtctctcagctctgctctcctccccattagcttcatactcaggctttgcatggttgtaaaatgaccaccagcagttctggatcaacatgatccctgcttctagtccctcaggaagctcctttcccaaagcacctgactattattaaccaaaattgtgtcattaactcatccctgaatcactcactgtggctaaggaaatagaatgggctgattggcttagaacaaggtaacaagccccctacatggaggtagagggagattcccatccagaattcaggaactgcagtataaggagggggatactccccagaggaaacctggtgcactatgttcagaaataagatgctctctacaacgagtaagtgaatttttacagttaagacaaaaaatgccagactgtacagatagaagagatgtcaaatgtcactcaggcaattctcttacttgcaagcagtctttgaacgtgcttaaaactctttagataaattaattttgcagagttttgggaactttttaaaaatattcagtaattgctttgggagctgatgtacataaacctcacagcaattgattggttcaggaaaggggtaatcatgtccaagttacgttggtttgctagctcaggtataagtgtggaccctcatatgtcctgagtatttcatttatacataatctttgaaatgttttaggagcaaaaaccacatgctttcaaggtcttttaggcaaccaacattgaaaagaaaaaaaactatcattaaagctaagcacatgttgtcattcaagtaccaagatatttaatagaaaattacaacatggagtatgaaagatgagagatttaactttcaacaggcaaaggtaaatattgagagggccagaataatgatgtggaattatgtagatgaaaatcttgccaagacctgatagcaaatacaatccagcaaagggccagggagagtaatgttgaaatctttgatgactctaggccatctagaaagcgccaatggcgctctatacatttttaaaaaaggtgggggggtagttttttggttgataattttggtcatttttagtggtatccctgtgcagaagaagatgcttttattcaataagagaaaactgtttactgtttttgttgtatcagggacacatgacaaagcattcaaatatgcaaataattgcaaactgatgtatccagcagtttaaaaattgaataaataatttagtttttacgcatgggcaactcttgctaaaaaaactacaaatcagaactcttctgtttgaatctattttattttgttaatagatgagctaatatgataggcatttaattgtataatatattattagccattttctttggcataccattaactttaaatagtattaatatttaacatttcataatatacactacaaagttcttattttttccagctgaacagaaaatgtacattgatagtaaatctctttaaagtgggttttaagatgctaagtatgcaaaacctgttccatttatactgtttgatcagaaatactcaaaatgccacagcataataaggcaaatgctgtaagatgacaatgatgccaaaactgtattatgattgtgtattcaaatacaatgtatcgcataattaagcataattatataatttgaatatttaagagagcatttaaaatgtgataggaagcatctaagtacatcgacttctcaggatggttaaatcagagagtgtaaagttgcgattagtatttgttactgaatggaaaactaattcaaacacaagtttgcaaggagaacacttgtagctggctcaaaatcataggccctaactttgtctcattacatttgaatctgtttaaatttgagtaccatgtttttctgtccttgcaaaacgtcatttagttagttgaggtggggctcagagtttctaggatagttgtaggatgcctaggataaatgatgctctttgttccatggatatcaattgtgcccttcattcagaccagcattctcagataggtgtgcccacgaccgtgaggggagctcgtccaaaaagaataaagggagcaactcaaatgcatccctgtttccaggaagactgcccagaggctatgccccacttagtataaatcagccagatctttttgtcgagggaagaatagtgctgatcatgcaacttcctaagtagaagatgaagcttgatttcttattaataaatatttggggggtataattttaagtgggcaagaattaagattctgaacttttccagcactccctgcacagagctttttttctccattaccagcactgaaacatttgttttatttttttatttttatttttatttatttatttaagttttagggtacatgtgcacattgtgcaggttaaaagaacttttcttcagctctcagtgttctttcttaataaaacaaatgtttcttcaaaacatttgttttattaagaaagaacactgagagctgaagaaaagttctttttatttctaattctccctaaattttcaatgatgtgaacataagcccaacagaccaggcttatggcatactctaaaattgcagtagaaactcgaacaattttttctacttcattttatgtaatggtgacttaattaggggctaaagacaggtgaaagaagttgtcccaacaacgagtatttaatatgtcaattttttcagagatttgtgccattgcaagtaaataggaaatgaaaagacaaaatttaactaaagatttcctgtatctgttagtaccaaagccagataaatttctccagaggtcaacatattctccagaagctgaccacatccaattatttccagcccacgcccaacacgaatcttatgctcctgcagacaaatataattattacaggcagagaatggtatgtttatttccacctcgatgacttgccggtgacaacagattctgtattctggatctcttcttttcccgaaattctcttgcttagcccatttttcaaaactccactgaggttccaagttcctgtgatgaattcagctcattttcttactcatccttcttttagatgtatttttaaattttaatatgcgttttatcacaattattttaataccttaaaatatttaatattttaatactttaaaatatcctagttttttgttttctgtatcattacaaatatattggtacataattctaattaatatatgtaattttccctttatactaattcatgcacttgtgccttgtcttcccaaccaaaaccatctagatcctcatggataggatcatatttgacttttatatttttaccctcaagctgtgcaagaaagtgcctataaataatggatgtttaataatgatggtcttaatgataactaatatatactgagcacttcctatgggctaggtactgtatgtgctaagttttgaacagtagtatcttgtgatcatcacaataatcccacttagcaggttctattttcattctcattttaagctaaaggaactgaggtagaatgtgatcagtaacttgactgcaggcacagaattggtaaccagcttcacacaggtatgcttgaacaccgtccatgttttcaggcatactcgatggactaattagctccacaaaaagccagaagatgcaagtgccaagtgacatttgtctcaatatgccataaaggttagagaagctgcattttttttatagtttcactttacagagaactgggctcattgtggcaaacaagcaacttgctgtgccagctggtacatggctatgtgtcattgcccacactgcagtcacatcttggagtgcccttccaccccacagccccatagccccacagccccacacccacctacaaatctcttattcatccttcaaaatcaagctaatatgttatcacctctctgaaactgtccttaaatttcccagggagaggcaacctctccttctctcctctggttttccttcattttatccatgcatttgccatagcatttagtactgtataatcatttaccttctcacttcgagagcttgaattccctaatagcaagtagggagggcttgttacctttacctctactgcctggcaaagggattagtacaacaatgtaaataaataggtcttaaatgagttacaggaaaaaaatgtaggttatacttggaattagctgtctcaactccggaaatggcacattctgtcgctattctccggcatctcccccaacttcacattcccagaatctttggaagagcaaaaactctcatcttcaaagacaattgcttaaaattttccaaggattggagcttctctttcacaatcatttcattggtggggagggtaaagggaggaaggaagaggtcagtttcttttcctgaatgacattatctctaaagactctggaaagtgataagtgccatttagcactcttttatttcaagtgtctatgatgtgaagagtgtttgcttctgcaggctgagcagccccattggagtctaatattagacgtgatataagatgtgcacatctttcacattatgaggctttatgtttcaaacccccataccttgcctctgtgtatttgacagctgctgtcctgcaaggcaatggccagtaagaggcatgattgcactaaattggaagcatgaggcaaaagggtgtgtttttattaggggggcagggaagaaatttgagggtagtaggttagaagaaatcatccacagatgctgatctctgtcggttagtggatgtgatttctgaattgtggtaattcctgtttctgtgacagttcatcaaaaatcgagggcactacttttgaaaattacccatggtttcatttccaaactagatgcagactctgtgcttttgattattagaattattcaactcactctgtggggcaatgaggaggggcattgataaatcctaccccaactgatactctgtaagagattcgttacagaagcatgaggtggcagagcaaactccatcactttttaacaagtgttatctaaacacacagtggcaaccgatgagtgagccaaagtgacaatttggaaattcatttctctccttcagaaagtctgtgtgggttgggaacagtagaactaaaagatgtggagacaaacttttttctacttttattaagcatttctagatgaattgtgaaaggcaactcagcagatgtctactggcatctctctttccccaaagacttcttttaaagtcatataaaacacttctcataccagcttgccaatgggtgaggaggagacaatacttcaaaaacttttcatggttaacaccagattgatagttcctttagcaaagctaaatcttgaaagctgtttttctttcattctaccaagaactggctcaggttgagtcccagcttttcttcagggatatgggaacactcagatgggaactgtgtagatggaagaagtgtggaaagggagagatgagtgtacattggctacgtctagtgcagggaaatcatttctccactggtctcacgtacagctggccaccctcctgatcttgctaaaggggcatataagtgccattgttaagagatggggcttaaaatgtaagaggagtttcaagagaagtgagctgcagatccacataggaacatgtcaggaattatttaagtggccggtaatatgagtatcatgctaccaacactgaacagtttatcacataaatataattgtcttctttgagaagaataataaaagctgactccatatgttacatattatttaaaattgttcctgcaagatgtattagtcccagagaagaagcaattcttctaccagaggacaacagcagttttattgtataacattgtcatttgtttaatttgtttgttcccagtagtagttttacagatttttacgaactgttacttttatagaaagttgagttactcatgatggatattgctggcattcgtaaagacaaaaatggggggggtggaagaggtcagaaaggtagatggtgtggatttccctaatgaaatttgcttaagccaatgcttctgaattcttagagaaaccaaaaattactgtagggagttaggttctgtttgggacatttctaagatttttgtgtgagtttatttaaacatgatcaagttaaactcagtctggaagacctcttgtgaactgacaaacaactacttttattcagaaataattgtgagtaaatgggagttctccgaggttttatgtttttgtatttgaaccaattaccaaagaatactaattttatagttcaatgtctactaccaatttttaggcattttattggttaagaaaaccagtttcctctgtcatttctcacaatttcaactaaactttactttttagctaaattaagtgaaacttttctaggtaaatttggaaattttggaattttaaaatggaaacattttagtttgcattctcctttgactgatagatttaatatataccgaatgagaaaatgccacccaagagtaaccattcatgttttttgaactgttaaaatgcattctattgcagtttcacaacactgaaagcaagtgtctaaaattaccgaaataaagctgtcccaacagggtagatgaaaaactggccagataatcagcagtaaagaccaatcttctttgatatcaaggtatctagacattcacaatttgttcatttgtagcattctggcagacttaaaactctagacgagaatagccatgctattgcaatataatctggataattagagcatttagaaatccgacaataggccatgtgcggtggctcatgcctgtaatatcagcactttgggaggccaaggtgggtggatcacttgaggttaggagttcgagaccagcctggccaacatggtgaaaccctatctctactaaaaatacaaaaattagctgggcgtggtggcaggcacctgtaatcccagctactagggaggctgagacaagaattgcttgaacccccaggaggcggaggttgcagtgatccaagatcatgccactgcactcaagtctgggcaacagaacaagactctgtcaaaaaacaacaacaacaacaacaacaatatagaaatataatacatatctacaaaagccaattgaagtcaaactggaattctgcaaagcaatctttatgaatgtgagtaagttaggtcatattaggttggtgcaaaaataattgcagtttggccattatgtttgcaccaacataatacatcttttattctcagtgcaagatttttgatctacatttctgaatagcttggaaaataaagtatggtcacatcagaaccagtggcaggtaaaatttctaattataaattggctcaaatgatttatatttgactttggaatgtcttgctaatatcttcgtacatgtattttactttttgctgttaaaacattttctaaacatactgataaagactagagagatggatcagaaacatactgggtgttaaaaaatcatcccgaggtttaaaatgttctttctaaatttagataaacgcaagataaatcccacaggaagttcacaattccatagatgtctaaaactaaaagaatgcagagattttctcagctccatgccgtttcttgtaattgtatgttgactgagtagagagttataaaaacaccccagcctgattttatgcaactatattgctgtttgtcaaaagaatacttaaaaacttgtcaaaagaatatttacaaactatatttaagaatatttaaataactgctataaaatttaaataatacaaaaatatacaaagaaaaattacatcatctagtcatttcataaataaacacatacataaatatacacataaataaatatcttaatatttagtgaacaacaccattctagatggccctatgtgttggtgtagagagattgatagagatgaatagtcagataaaaatatgattctgccacagtggttattccttagcaaaaatgttttatgtttagttctacttgaattttaagaagaaaaagaaattaaatgaacttgaaaaatgactgaacttcaaataaatgtttatttgacccaagaaatattagcttctgaaagaagtgtttttaataaaaagtgtttttattttagaccaaatctttctcattgatgaggaaattagtacaattattcttccttccagatagtcttccaagttatttaggattttattattgaaaatgttatattatttacatttataagtatatccccaatattgtttggtcttattctatgctgcacaggaaatatgttcacccctttgttattttaccaagttttctctgtaagggaaagtgccttgctgtaattttgtgtttattagatttaagcattcagttacttttccagaaagaatcatggttaggctactctctagtttctgaatgtttcacagtgtctgcaaatggtcttatactggaagagcatgtcacggtataaaataatatatctatatttaaatttctctaaattttgcacactttttcatgtagcactcagtgttgctgtgaagttctctgaggtcattcctcccaccaccacccccttggttagtatgatttacctgtgctgcctggaacaccatatggctatatttttaattcctaaattttaatagctacactaggatttgttagattaattgttctatgtcaaattttcctgggactaagtgtgtcactttagtaaggaaatttaagtccttctgtattttcaaaacttttcttctattacatctttaatttttttttctgtggcatttgctctattctcttcttcaagagaactagtcctatttttcttgtgtactgtaatcacttttatcaatatactaaaactattcatagacatattttatgtctttaatctttttcttttcattttatataatttcttctagtttgtataccattctgtgttttcagtcatgcatattttattttgcttctactttgacatttatagggatttgttaattccactaatttcctgagctctacccactgcttttcatctttttgaatacttatagttctttttaaatactctttccattgcataatatgtaaatattttttttttaactataggttaactatttgtctgaattccactggtttcttgaataattcatcttctgatgtatagcccttcttcctttttacttgggtctaattgatgatttcatgctgtttctgtaattagctactttttcttgaaaaaggccatttactcaattactctaattcttgattagggcaattttactcaatctcaatctctcaatctctcaatctctctctctctctttctctcctcctccatccctctccctttcctccctccaacacagctctgtgtgtcagaatctagaaatttctgtttcctcttcctccttcatgcaacttcctctttggcactgttcctatgtgatgatcctgaggaatggacaataaaatgattttgccttcagtaccacctcccttgactttctgcagcatgaaatttctaggtcatttccttactcataggatacagccattcccatgtcctgatactctaatcagattgtcagatattactcttgaaactgtaaccctttaaaggaaacctctttcatctgccatttttgaagtttgtgttgactctcagattcttccctcatcttggtgcagacttcgatttctatttttacagtatttcacagtacatatgactgtgtatggtttgatgctatggctatttttgttttactaaagattgaagggttgtattgttagtgtggtggctctctacttttcagggtttgttgttttgggaatgttttgaaagaaattagttctgatgcttttcactagaaataatctatgacctgagctcttgtggactcctaaagtttgtgccactgtgtttcggtcttacttcaaacattacttttaaaaaaaagcctctttctattgaattatttcaaacaaatcaaatatattatgtttcctgaataccccttgctttagttggcttttcccttcccataatgaaggatgaggaccttcctttcctttgtcttctgtctttcacagtcgtttctggaataccagcccttctatcagaactggatggagacctgtggacacccctagtaagctgcagatttttcacagtggtcatttgacctccagagcaagccaataatttgtcacttcattaaactggtatttatatttattaagttttttgagatacaatccctagtattgagtgatagaagagcagaaaagaagtctactgttgttagcacctcaactaactgaacccattaaatcaaaagcctttctcttaactggactcaccttccttagaagacgatttaacaatgttttctttctgctcaaggataatcatttagaattttagccctcttccttctttccaaacagcttatcaaagaaggctatgtaattgtccccctaacagaagttctaataatataaattcctcccactcattagatttcagttatgttttacaatcccttttggacaggagctctgggaagccaatggcacctgctgtctacccctccatctaactttcttccctttactacattctggagaagccatctcagttgctctaagtacttatgtatttgccttttcctaatattggagaaaatttaagctttctatttttttaatggcatactccactgcatcccaatttgcttttgtgagtagaagagacaggtgtaaatttttcttttaatttttactttaagttccaggagacatgtgcagaacgtgaggtttgctgcataggtatacatgtgccatggtggtttgctgcatttaatgacctgtcctctaagttccctccccttgctccccacccctaacaagccctggtgggtgtcgttcccttccctgtgtccatgtgttctcatttcaactcccacttacgagtaagaacatgcagtgtttggttttctcttcctgtgttagtttgctgaggatgatggcttccggcttcatccatgtccctgcaaagaacgtgatctcattcctttttgcggctgcatagtatcccatggaaatttttagctagttaaattgacttgtatacactctgggcatgcccaccaggaattctcccacaaataaacatcccctgtactgtgttaagcaataaatgattctggaacctgttcttttctgcccagtttaaaccctctgctttttggattgggcaagttttctatactctttaataaatttgttttcatatttgttgtcaaccagctgacagtttctctgccctttttataacctacttcctgattcaagacattgggtcaagacttttaaaaggccttgacttcccttttgctgattcctcttcattatttcacctattaaactaggcatgaaaaaaactcaccattgggccctcttgcctacccactactccctcagaaaacttgcagagttcaagcatcacttgcaatcaaattattctcatacctgcatttctaacccttagtttcctcctttcaacatatcattagaagtgtgattttcattgcctaaatatatacttccacttaagtagtcactggtcactggaatgatagagaaattttatctttgctccaagagatctacttcttctccatgtactctactgcttatagaaattgactgcatttcctttccaaaggtgacaagtttaagtcatttctaatacctgctttttgtctgtctcaaccacaactttaatagcatttcttgaacacaggcatcacactgtggactttatttatgttatctcatttagtaatcacagaatacaaagaagtagacattattatctcagttgttctggtaaggaaactgaggcttagtgaggttaacttactcaaaggccccatctagtttgtgacagagccaacattcaagtctagggttgatggactctaaagtcaatgtgctcttagccactttgcatatcattgccttaaacccatccctctttaggtctagggtaggcttcttgagtctgcagctactctcttttcaacaaacatcaatcaaatggctatgatatcccagacccaaggtaacaatataaagatgggtaggatgaggttcctgttcaaaagacttttggagctagggaaaaacagaagcactaaagcttggaagtaattttatccattaaacataaagtgaaactgttaaaaaattaaaattaaactcatataaataggtgaaatgtattttttcaggtatttattactttatgtgtgtaacttaacaactcagcaagaccgattttggcagaaaggtgtggcttatatgattctagaatatagaatacagtatgaaacaggatacttgacttgcacagaaaaatatcagtgaagatagtaaggattaaaactcattttgtatttgctccatgaagcagtcactgctttctagtgcccttgattcacctgaatgtccataccccagctgtttagctcatttccatgtgcatgccccatttctccttcttgagagaaaacaccatcttttaaatattttcttaatttttcacaatctgttttccagagtggatggcaatgctaacaggcaaaatttctgtttctctttaatttccaattaaaaagtagctcagaaacacttagcatacacttttgctctgttttcttcatagtattacagcacaaagctaccttgtttagttgtcctgtctgtctctctccatgagcagaaggatcttgcagtctcactcaccactatatcctcaaagactgacgccatgataggagtttaataactgctgtgtgagtatagggataaatgaaaagatttgggacaacagccactttagccctcactcctgtcctccaggtcactcctctcttgaccactgcataaaggacatcaggcctcagctgcctggccccttcttttcctcacccccaaccatccattcctcctgggtatctttatggaatctaagtgctgattagaaatccttccagaatcgccttctataatgtttctgttttattatctttatttttctagtagactacaagatacttgaaggcagggtgtgtcttttattttgtcactaacagcatctagtatattacttgggccttcactagatgttgttccagtggatatttgttattgaatgttttttattaattggcaaaaaattaagtttggatgtgtgccatgtatagctgcacattttttatcaagtggtgagtattcttgttgccgctgcttcaaagacttagtaattaatacatgtatctttgctctctctctctctcttgattcagtacctattgcagatgatagcctcatttgagaaacacagattttctttttatcatttatttcctacccaggagttatttcttcataaaaaattagtcatccaatccaggtcctagtgagaactacatgagtttgggatatcatgtgcatataggagctaaaaatatatatattgtaaatttccaaaagtatacatttggtgcttaactcactattcacagttactttattatttttcctactaatcctttccaactaacttctatccagaggatccacttccccaatcgatgtgattttgctttctatttttcagtaaaattttcaaaacatatgcattaaatataatattagattgtgacagtcagaccattcatttcatttctaggcacaaaacaacatttgcttaaaaatgtggatcctggaatcacagtggtttggggtaaattcatgccatgctgtgcaaaagtggcacagccttgaattggttaaaatacttcagggctctgcttcctcaactataaaataagactaataatacttcctaatttataaagttttaatatgaaacccaagtgaaatagatgactattattattgttattattatgcaagtgtttctgggataagttggttttttttgtttgttcttttttttttttctttttttttttagagaaagtcttgctcttgtcccccaggctggagtgcaatggcacgatctcggctcacgcaacctccgcctctcaggttcaagcgattctcctgcctcagcctcctgagtagctgggattacaggtgcctgccgccatgcctggctaatttttgtatttttagtagagacggggtttcaccatgttggccaggctggtctcgaactcctgacctcaggtgatccgcctgcctcagcctcccaaagtgctgggattagaggtgtgagccactgcacctggctgggataagatttttataactctattttgagaaggatttttgtctgaagaaactcacttttatcactttattttgcccaaataaagcactatagtccatatctctgtttcaaatattatttattaaattcaatgtttcctggataatatgccctttctgaatgacagtcaaatgccattcagtaattccctcatttttttctgccaatcctaatatatcctcatttgtttataaacaattcatttttaaaattatactctcatataataagtgaagtgtctttattttgttcagatatttattactttatatgtgtttaacttcataactcagcaagaaattatagcatcattttggaaaatctccagtcaaactctgatctttgcctataatgtatctggttttatttaactgaaatgggagaattgaatacttttaggtttttctgctattcttagttgactatttgactttagttgtgtcgttctgtaagaaaccttgacaagttaaatttatccatacagaaacctatagttaggagacctgtgagatgactataatttccttcccattagtttcaatgaattccatgcatgtgaaagagaattggagagtggagtctgcagccctgtgtttctcgttgtgcaggtatattgaggagggagatatagtccaggtctccttaagttgttcctctgctgcacattacccttaatcctcctttgagcaaatgcagactagagcagctatgccaagaagagaagacttaactctttaaacacaaggggcccttggacacttagcttatgcttcatacaaaacctgtgaaatggttaatatagaaatgtgagtgtcatttgtattgtagccaatatgaaccagaagaattgagctgtagccagcatttatttaagcatcatttttgccatctggattcttttgtggggaaagaaccattcgaagggaattgcctttggttacaaaggtgatttgacttttctctctatttatatgtgcaccatcccactggcaccgttgttcaaggttccataaagagacacttttgttctactgctgcttgagagtttaggtagcataggagagcctgaagaagatgtgggaaagcgtatcaaacatttttgtggacaaattggattcataaaggacattggcctgtatgtggaaaaaccaactaaataatttaatccaggtaaaaattatgcagccattcactcacacaggactcattggcgtcttccctaaaatacaagtcacttgatgtggcaaatcatttgtaggtcagtgttcaaacccaaatgcttgttggacacctacctgtcagctggtttaggtactgattcaatccattccttagcaatgaacctgtaaacaaaaaatggctatcacccaggaatcataatttctaattacctttgacctgtggcaaagtacaataatttaaagatgatagtgagcctctattacacaaatgttttgaagattaaaacttgagaagattggcattcacatctgggaattataaattttattttgatgttagaagaaaggcttttacatgagtatgatctgatatattttattgttaggtttataggattcagaatccgtggttattttatgattatgtgatcaggtaatttttatcttatctgagagctctttcataatactgcattaattaaatcgctcatctgaataaggagtttaaatggtacagtgggcaatgaagtaaaatctgtagaattcccagccatagcacatattattttaaactatattagagataaaactatttattgagtgctaacttctgcagagccttatcttaaatacccctagaatatataaaagaaacactcacaagtaaaggtcttttaaaccaacaataaagtaatagatcaacaaatgcaaaataatataatctgtgcaaaatatttatgtgccattcacatacacgttacaaaaatgattgaaatggaaatgaaaattattggtattctaagtattcatccccttatactattaattggaaactgatatattatttaactcttaagcagaaatgtgtgatgtttaaaaataaacagcaaattatgaagtcacaaggtaagtgttaaaatacatatatatgtgtgtgcatgtgtgtgcgtgtgtagatgtattaatctcatcattaaaaggaggaaaaaagagcctttaaagtttccattatccattatgtcaggtagcaaatatcttctcaatgtaactccagacattaaatctgtcgagaggaatgctgtaaaataaatgtctgggataccttcataaacaaaaatcttatttccataattcatacagctggctggcatttattggcacgtcaggtgcaatggggacatttcaggaacattaacatgtacagcatcatttgtcaacaaagcaacaatgtaagcaaatcgttcagaactcatacagatttacagctttctccgccagctgctaattacggtgtgctcggcctatttggtatggtctttttattggaaaatgacaaaggggttatagtatcccagtttggaatatagatgtggcttttagtaataatatgaatgtaatatgacgatgtagcttggagttgtgatccagttttcctggtcttataattgatcagctttgattgatgaaggacaagagaaattcacagcctattttgtttctgatgtaactaacctctaaaacaaaggaaaaataggggaaaaattatcaaagaccatgtcacagcagttcttaatgtttttccctatggaacatgacacataatatttacctctcaaagaaaatctgatatgttgattgctggtggagcaaatgttacaggagcctgtacatttcagaattctacgttgtactttgaacaatcagaaaggccttacacaaatatgcttaaataatgttaaggttatgacagaaggtgacaaatgtcagcagcatcaaagttaacatctataatcaccccctgcttacattgttcagttttaggaaaagacacaaccgtacaagcaaatgatggagtgtcaactctaccttcaaattccctggattgtgtcaaggcatattataatccataaaatgaagagtggtgctgtctttgtgcccatgatgtaaatctgtatttagagatggtccttctgtttaaccaaaatgcaaaaagctaaattggtaaatacttattcgaacattgtttagatttatcccatcccaaaccttattaaaatccattaaattccagagtgaaccgatttgacattcagcaaatcagttgctgtcagagcagctgacttgaccagatattaaaatattttcaactttgctggcatcagatcctcggcccttcctagagctgataatgtcaggacagcaatggttgactggatccaaaatgcattatactaaataagtatcattctcatgttccaaaaataaagattctaactccagaaatagtttgcagatagtgtccttctattttacgtaatgccccgtggaatcctgtaccatcttcgcttacacatttgtcattatgtattgtaattgttggtttcttcctcctccactagaataggattcctaaaatcagcaagtaaattatgtttaattttgtaccctcagagcctagtactacctggaatatagtagatgccaaattaagactagtcaaaagaatgaataaatgtgtacatattggggcagccctgcatgagattgtgatggaggaggaatttgctttaatatcttgcccactcatcctttcttgaggataccgtctcctaagtcctctgagatgcatatttcccatatacttttttctttgtcccttattctaaaacctacttgcagaagagtatctgaaactcataaacattaagatgtaaaatataaacaatcttccaaagtattgtcttttccaggggcatttatattcaaaccaagatccatcccttaaactgaaattgaaaattaatttgagggtattagacattattttttatgtaaagaaacatttttacagtgaaggtaccatcttggttttctttagtagaaaggcactcactcaacttttccccaaaccacccttgcttggtgctaaatggagatggtgttggttctattctccaggattatgtggcatgtagattctactaggaattgaaatgaagaccttagaatggaaatgtggcctagctaaggaagaatactatgattttaatttgcattaacatgaagtccttctagactgagtcaatatgaagagaaccatctagtgcatcagaacagagccttttcaacccatattattgtctttgtgaagcaaaacgtgctgctggaattaaaaacaagcaaaaggttgtattttttactgttcaaagaatgctaaaactttcaatgcataacaaccccagagaaacagggttgatggaatcagagaagttggaggacagacaccttaaatttaaaattgaatacttgtgaagagttgcaactcatagtctgcctttaaaatatagctgggcaaggaggtcttgtgtcaccctatatgatgatcacttcaaattggttttaaatttacaacaattatttgaataaaagccactatttccaaagccacccatttgcctaaaataatctctgaaagtaagttatttatatatatttatttataaactagcatttgtattaacccttacccaaatggttatccttacttgtatttaaaaccactaagtcagtgctttagaatagtctatgttaatctttacaaataattcatgttgcgctaattaatgattcatacatacttgagagagaatggattgatgtttacctgttcattatgcaaaaagtcttcacagaaaatatttccaaaattccaggaacattttaagtgtttttaattattttagaggtatctatgtatcttcacaaaagtaatattctaactataaatccctcataactaatcatttattcagaccctctaaggaccttcactaagaaccatttattatcctcaataatacataagaatcctattttaaatgatctcaaagttgactacaatttgtatttctcactaatttaaacaggcctctcctattcttgtcctcttcctacccctccctcaagcttcccatggtaatacatggctactaactggattgaaagcataaatgatatgaagcagagttttgagaatttgtaattcagaaaatatggcaaaatctaggaattctcatattttaatatcactattagttgatttgcttaaatgcaaaatattataataaagaaataaaaatataaaatttgtattttataagagcaatactaaaattacaatttaggatgcataatatgtatatatttaagcctatagatctcaatacaaatgcaactgaatgtagaaagtctacctttaatccagtttatgaggaaatgtcttaacgtcacctttctaggagaaagcaagagaccaatcatgagaaccatttagtccagcaatctctcaagatgccagtcgccagcttgatggagtgagcatttaattagcctagtaattccctcctattgttcccttctcaactctaattgaagagagaccttaatctcaaaggagaaatatttaacttttaaaaatgtcacagaaaggtggaaagtaactgttttgttaagtaaatagcatttactcacatgagaaaataacttttaaacaaatattttatgtttgtttcttaaggtctgtagtaaaacaaaaacaatttcaagcaaacaaacctgagagctcaatatcaacagattcttttgaaaaggaattatcaattgctgctgccataacaaaacacttaagactgggtaatttataaagagcagaagtttattccctcacagttctgggatctgggaagtccaagatcaagatactagcatctagtgagggtcctcttgccatgtactcacctgtcagaaggcagaagaacaagagagagtgggcctactcctgcaaaccctttttgtagtggcattaatccattcatgagggcaaagcctttatgacctaaactcctccccaaagtctccaccttccaacactgttgcattgagggttgtttccaacaatgaattttacaggacacatacagaccatagcagttattataaggacatatttcaagaataagctacattatcccagcaggagtgtctgaaatgcatgaagttaaggctaacaaagaacatctaaactaataggtaaatccaaagaaactccatgaaacaaggaagtctcatttgtgtggtgtaaaataaaagtctagatacggatcaaatcttggtcaaaaatagcatcaaatgtggctaaaggagtgatcaaagttaaaaacttcaaatgcctttagtatttctggaagtaaagacttcagttgtattaagtgaaatacacgtgttaaaattccgaggccatcatgctatgttacacagatggtcaccatccgctgtaaggtggctaaagggaaagaggtgagtagctggcttggggtagccacccaatagggctagccacccaataggtatatagccacattataccttacccctttactatgcctggcctgatctactgcagcaatgagctgttcactctttttgggctgggctcagtagttcacacctgtaatagcagcattttgggaagctgaggcgggagggtcacttgaagccaggagttcaagatcagcctggacagcaaagcaaaacccccatctccgtaaaaacatgaaaaataaagaattttaattatccaggcatggtgtacgccttcagtcccagctactcaggaggctgaagtgagaggatcacttaagttcaggagtttgaggctgccatgagctatgatcgcaccactgcactccatcctcggagacagcaagaccttatcttaaaaaataagttggttttttttttttaaaaaaaactaagttttattttattttttgaagttagaaagtatgcaacttgtctgtgggagacaaaaactctgagaaatatattaaacattggaaaggaagggagagtaggggtacattgttcagggttgcaaagtgaagttgagagtcttaaatagagggaggcctatgtactttcttaaaatcaaaccaacagcaaataggaacacaagcaatagattctggaagaattgtttgctatggagtaaatcatgtatttgtctattcaccaaatgctatatacctagatgcttctacaaggaagaacaaaaaaccatgttaatgaactcagacatttgaatagtgttgttgctgtccatagatgagagctttaatagtgttgttgctgtccatagatgagagcctaagcagttttcctaccagcaaagaataatgtaccttgagaaagatgtgtgaacatgtaagttcctattaatgcacatttatcacaaaaattaatctgagcataagcaatgggcaatgtgagtgttgaggatcgcttgaaatcaggagttcgagaccagcctgagtagcaaagcaagacccctacccccgccatctacacagaaaaaaaaattaatggtaactaaaacacaacgaaaatattgtcaatcagaaacaaataatacatgagaaagaaacgaagccataactaccaaaaccagaaatgtatgtctcagagaccagaaaacacttttgatccaaaattaaatatccaatattttcacacagttagaattcatcttatatttctagtctaatctatgcttgacgctttccattgctactgggtgacacggatcacttttctctaattttgttttcagttttgctatttcttatattgtgtatctgcctccatgagttttaaatggctaaattatttgcttagaattcaggtgtttttcttaacagattatttctagctgaagctgtttctgtcacatattgttgaattccaaatgcccccctaaaacataaccataaaagtaatttctttcctatcctcatcaacacttcagatagttaatagctgcgggcacatgttataaaagaagttgctgaagaagggaacttgaagtgaatttggcatagagtcatggatggtactaaacacatggatgaagttatttacttaaaatttttcttgtcggcctgatttggctatattttcaaaattgacacatactatgctgtagacttctattttcactagctgagaaacagaatgattacagacttttgcatgttatgcatttttaaatatcaccaagttaaacttagattttgattccgtgcccaggaccaagtggaaaaaaatctccatcttcaatagttcctattatcttttagtcacagggccacatactgtatttcttccatgagtaaaactcccacttggaattccaagcattgcataactagtggagtattcatatcatatataactcagtaggccttcatatcctaatcagctatttcatctgcacaatattcttcttagcagttaaaaatcttaaaatcatagttcagaatggagccaacatttaattcagccaacaaatatttattaaacacctacttctactactggtgttacaaccatgactactactttacatagttttgtattgctttaaattgtttttacaaacctcatctcatttactacagtgaaattacctactgctttgaaggagcttagagactcataaagtagattaaatcaattgtcagaaaaactgggctttaaagaacttgtctacgatggtaccggctactgtagtattttagatgattttggtgaactctcagttgattttaggtaaaagattcatctgcacaaatgtatatttatctttcattgtattttttattacaatctaatattttttaaaagctaagaaaatgcaatgaaaataacattttaaaaagtgtcagctatatgaatgatattctttaatgcatgtcacatttaaaatatgacctatttttaaagtacattgtatatgtcacaagccagatttggtcacaggccatggtttgctaatctctgtcctaaagcaatatggtagttctgaacgtttggctgaagaacatggatggcggtagaagtccctaaactggtcttcatagcttagaataacagaactgctgagtttgaaggaaaccgaacaacttatctcacttactctccaaacactgttcaatttctcttcatacttttttttacaatgtggtagtctctatatttatatttgattcaaaatataatgttttaaaacggcctgtactgatgtctcttcaaaatctttatcttgcttaatcttagaaactttcttgccaaggagtgtaggagtagacatgatagcaagggaaaggtaatagaataaattttgaaagctaaatgctttattttgatatagctaatattcatagaccttaacatttacattagtcagcaatcaaccaaaagtcatagtttcaaatacacgagggcagaatctgcctagctacacaggatttgaccacttaaaagttgagctctatgattattctgatgaagtggattggagaccatcacctttctcttagtaaatatttgtccttcacataccaatcgtaagtataattaagcattttttacttcatctggtgcttcaaattttgtatgatgcaggatttagttttctattctaattcctaaaagccatatttcaggctgcattctattaggggtgtctcacttaaaataagaatactattatgtagcttaacttgcatctatttcctttttattatggccactcaattgttcctgactttctttgggaatgatttgttaattttattccagtctcagctatgtgccttcacttaacaatgaacattgactactggatacttagcttaccttttttacaagatatatatttcaaggttttgttttcatataacataaaacagtaaggcattcattaatcactattaaattcattcttttcctctttattgaattctaaaggaaaatcagctagtcttttttttggcatgtgtcagcaaaagtatgttattatgaggtgttcttaaataatatatcttcataaaacaatataggtggaggtttaaggagaaataaggaaagaaattggaaccatctggatatccaaagtagagaaaagtttttactaatggttgtcatgtacacgttacaaaaataacattatacagctttctaactggacaggaaaaggcagaactatcaaaaagttgaaaaagaagatagccctggagtgaagcaattgacaaataaaatcatttataagacatgcatttagaagaaaagtggagattcatggttcttgggtcagtaaggattaaacatatctcagagatgacctgcttgttcctgggaatcgaaatacagttgcattccaaaaaggatggctccctgggaaatgcaaggaggggaggacaggagggaacagatttttgttgttgttgtttttgtttgtttgcttgttttcagggatgagtgggaaagcaccttctatgtacttgctcctaaatcagcctggtgaactgggaagagtagagattccatgaaagaaaagaatgtgaatacatgctttggagataagacagaaaatgggagaaaaagcaaagaaggaaagaaggaagggagggaggaagaaaagagagattctccagagacacactgcactccctcacatgtaaatgttatattaaagaagcaatatcactggaaattcacttcatcagatatttaagtattaatacataaattagaaatcaattttaggagtgttattcctccaatacaaacatttttttctggcttttcatctccttgtcatattcccagcaaataaccacacagacggggtgtgtgtctctccttaaatgagattagtgaaggtggcccgatcaattatttttaagcctgaccaaataggcgtactctaatcttgcctatttcagcataatgttgcccagcatgataaaatacttatttaaacaggtgtatcagtctcagagatctgtatgtatagtttaccttgaagtcaattgaaaacagaatattccttattgattttgcctgcctggctgctatatgtagtcaatgggactcacgtggatgtaaatagagtgaatcaactccttgctggccctggacctccttgagtcatgtgaagtaggtttctgattcctttatgttcaggcacagccagggagacaagagtactactgtcttctgctggtgcagagagttacctcaggctatgcaggaaaaatccttttttcttatttttagacctgaatcagtctatgccactaaatgtattcttgtgaatacagatgcactttgttgtcatgctcgtgggaaggcaatggagtaacctgtttggacgcagctgcaggccacctgtagagaaagtcaaattagggagagaccccactgttctttgcattaatgctttttgtattgttgtttgacttttccccctctgtcgatgtatctttttcaactagggagatcgggagcacattttaaggccttctgtccctttaaggcatctaatgattgaaaggactctaagatttgaaaggctgtaaaaactccccagttggcaatgaatgatggcaatacaaagaatcttaaagctgttgaagttgaagtagtcttcttacagatttagtttgtttggtgaacttccagcggcagctcttacaaggtactgttcaaatattcccacctatctgtgctgctgctccttctaaagatttatcatgttctcagtggaaaagtagttatccatattagcagttaactttactacagataagaaacaaaagaaattctaaaagaagaagaataaactcctcttcttcctttcctcatctaccaatgtgaagctctaaaaaagaagcccataaatgaaatatctactttagccataaatattaagggagggaaatgcacaaataaaacttgtttctggaaagcttgattttggctgaatatcaaaaaccatttcctgacaatgaaatccattagactacgaaataatctctcaaagtagtggttgcattgcttataagatttaacatttaaggttaggctgaagacagccacagatcctcaggctcaaatgcagaatgttatttcagaagttggagggacctactcttttgatcctagctgtttctcttgttttgggttcctttacttggaaattcaggttataatatagggttttatattaattttttggtgtcctccaccatggatccttgagagctgtttcagctgactgggatcgaatcacatgaaccagcctgactgtgtttgtgtgtgtgcactgttcttcacgcatctgaagcagaggagtcgtcacaattattctaaatgcagttagaggattctgtctgcctcagctttacaatgtttatcaagctcctgtattaactcagtaacacaacctgccattacaaaattcaaacttttgataaccagcatttcaccaatatgaatttatttatacaagatgccctttcagagaacatattatatctaggtagtgactgagaggttccctaatcaattcttcaagatgcagcttcagtaccttagtcctgaggaccatgactaaattcatttgatacatgtatgttatatattccactaaaatcaaagaagatatgatagaatttgttgcaactaaatagtggcactcagacaactttaattctcaaattcttggcacgcatcctgaaaactcgactctgcgctttctcctaaatgctctgctctcttttgctttattgtagtgaagaaaagagaaaagtaatgataataccgtgcatagcataatattttacagggtttttttgttttgttttgttttgtttttgtttttgttttttgagacagtctcactctgtcgctcaggctggagggcaatagagcaatctcagctcactgcaacctccacctcccaggttcaagtgattctcatgcctcagcctcctgagtagctaggattacagatatgcaccaccatgcctggctaagttttgtatttttagtagagacgggattttaccatgttggccaggtgggtcttgaactcctgctttggcctcccaaagtgctgggattacagatatgagccactgcacccagccatactttgcatttttacagcttgttttcacctatattttttgactaaatgctcacaacagcccagcaactgaggctgagattaagtgataagattcaggacttgaaggatggagctctgactctaagctctttgctctgtccacctcagcgccatagctgaattctcatatgaagaacatttttcatgtggtattctattctgctgggactgacacataattagcaccttaaactatatatccaggtaaagaattagtcctgtgtcagaaacaaggcatttccagaagcataaagtatagcacctcacaacaaggtagttggaacccagggtcaaaaacaagacagataccccaggggaaaaaaccatgtccctagctaatatccctagcaaatgatccctagctaatcatgatgccaaggtatgctgcctcaggaatcagattcgcggcatttaaagtaagaaatttttgacttccaatgtagggagacagaactgatgggccacagggagccaattgaaacctaccttaaaagcattcacctccaggcatggtggctcatgcctgtaatcccagcactttgggaggcagaggcaggcgaattgcctgagctcaggagttcgcgaacagcctggccaacacggtgaaaccctgtctctactaaaatacaaaaaaaaaaaaaaaaaaaaaaaaaaaattagccaggcatagcggcgtttgcctgtagttccagctacttgggaagctgaggcaggagaattgcttgaaactggcaggcaggggttgcagtgagcggagatggtgccactgcactccaacctgggcgccagagcaagactctgtctcaaaaaaaaaaaaaaaaaaaaaaaaaaaaaaaaaaagccatacatctgtctctttcgctacctgtgttttgaagttgaaatgattttatactacttttatccttggatgctttcttcatagcttaacacaggtattgtttaccaattaaaatgggaagctggtttaaatatcagcaatcatgctacaacagcacaattgaaggagtatttgactcaaagccttggctctcctattcacaaattttgagtggttatttcattgaacttccatttactatcttctaaaatgtggagaatatgaactaataacttttccccagattgttgtgattcttaagtgggatagcgaatgtgagtgctttgttatctgtaatgcactatatcaatattattgttatattttgcttcaatatatttattagcttgctaaaataacttcctaagttatctagctaatcgcctttttaacaccccagtctgatctctgcgtgcactcagctcatatcagagtagttaaaagtaaaatgggaaaacgtgagcaatgtataacaatccttatttcaaccactgtatatagacaactcctattttttgtcagctggtatatgagacatccacatgcaaccataaagcctgtgttgtaaagaagtttttaatgccagaaatcccatatggttttgatgtaactaaaaggtgtacactttcctcaaggtcaagtctaaaaattggaccactacaggctctgaccacatgtatgagaagccaaaggacctgtgatctcacctgcctcaatcatgtgccattatttactccacttgcctcttctgaatgggtatgatcccaaccaaacatagtgaaggggaaagttaaacaatatttggaaagccatgtatttggaaagccaatgtaaaaggtacattatattacatttgatataatgcaacagtaattataactatatatgcaattcgtatctacataagccatgatagtggaggatttcttgaaattactttcttttcccccagtgaaatgtcagttgtttttagttttaagttttgcaaaatttggaacctggttttcttacacactgtaaataattactgcagatacatttcagtcacgctgctctaacttgggagaagaatcagcaccaaaattctatgatgtttcaggtggggcagagtgtgagaagacaactcaaaaagaggctggagagtcttacttagcagaaacctcagctctcacttcttttatggctgtatttcataacacttatcttttgacttagaacatttgccaggaaaactttgattcttagggcaaataaccctgataatttagaacttagagatgtcttatgagtttgcaaacatcaatgcattatcaaaagccctgtgaattattagccatttaaataccagctacctatttttttctgattactgtttcattttaattgctcccatttcctgtcctgaccttaatgtttcagtgaaaagaaggccacccacgagagagagagagagagagagagagacagagagagagatctttcatttgtgaattgcaaagcttcagaggtccgaatttggccagtatgtttgctgcaaagccttggaatgctgttttgcagtttcaaaagtgatcatactcagcttcccagaattttttatgcctggaggatgccacaagaacaagggcagccttgttaacaagttccaatctctcaaaaacaagataggattcggatataaatcatcatttcagctcacaaagccatgttctccaccccactgaagggcttcatttacatctaaaatggttaatactgatctgcaccagaactcctaagtggaggaatgcagctgccatgtgcttagtgactctggggttagggaagaatgacatcaccaaatgtaagcatattatcatgctgacatagaggcaccttgttttctcctctgtggatagagcaaggattgtgttctgtctcttgtttttttccgctcgaagaatacctttccccctcccttcttagcagctgcaatatgaagggctgaaaatgtcacttcaactaatgatgaatgatgcttgacctctggatgggttactcagaattttatgcaattctaaattaatatgaaagatcccaactcaaaggacttcggccgttaagatttgcttcaaggatagatttgtgtaaagcagttagtagctttggggattttgttgctgttgttattgtacttggtgggggactgggagactcgtgctctgtaagcaaggtaaaaggcagaatgtgctaacatttttatgtgttatttttttcctgtgagattaatatctttttctactagaaatattgtcagtaagcagaaccagtttgtgaaaaaaacattctcaaaagggcacaggcccacacgtctttgttgtttttatttgaatataattaattatgtaaagcaatagttagtgtaagattaacaattagtagattctgtcaagtagtcacacggaaattactaactaattgaactactggtcgtctattgtgtcagaaagcagtactgagtgtcattctttttatctttttactttgttgttttcacagatcctcttgtttctaagatgtatgtttcacagccgactaataaataaataaccctggttgtaatttcataacatgcaaaaaggtttgaaataaaaacacctgttttaattagcattatggtttgttcactttaaaaaaagtgataatcctgatgcagttagctgacatttttaaagctttgaatttccatctgtatcttatattatgatgtttcaggattgtcatgagttaattatgttaacttgggaagcattgcttgcatttagaatgaaaaacttcagcttgaatagacagaaaagcagatgctatctttcttgtcaattgctttgttgtgggctgccttgcaagttttcatgtatttctggatctaaaaggaagtgtaaatctctatttattttaagtttaacataaactacacaatttcagtattcttctgttttggctgtatgtgtcttgtgtatctttacatgtgtagctttcctgcccccaaattcagaaatccacagtcaaattatctcttctttaattcttaatttgttttgttgtgcctaggcattatggagattagtacataataaaatttaagaataggacaactctactggctcaattctctctctagttatttttttctaccacctttttgcttttgtacatcaaccttttaaatggtacaaaatacatgcagcatctgggcacaacaaggcatgttaagaatggagtaggcactctaagtaggaatttccatgcttttgtgagtttaatgttcctttaacatagagagcagctgtgtttatgtcaataattacacattgggataaatgcgtgtacatgtttttctttatgggattaaggatgttaggtatggccttacacaaaagattcttgtccctcccatacccacccaaaaagtttctataaaattcaaaaccaagttacactgttctgagattctgaaatatttctctaggcatttgcacttctagatttcaactgacagaatatgggattgatgtgtttgtaatcttctctttgcccccccacctcatacccattctccactcttcactaccctgttcggtacccaggatctgtatgcactcgccttccaacaggcttccaactagattgggccaacgagaggcatctgcagcagaacagagggcaggagacaatgcaagaatgccaggactgtgaatgcttaatccctgaattggtgccatgagcaataaatgctcgtgctcaaaagaaagtgagatcaaggaaaagtggatcactctaggcagaacttctgggataaacaatcttcctttgggctttaaagaagtggtgggattgggccataggaggtgggtgggtatgatagcttaggtcaagaatgagcaagaaccacagtatggttcttgcttgggaatatcgagtatactagtataatgggcccagatgctcaggtctgaatgaggtcaaattttaagactgaatggcaggttgtggcctggaaaaagaggcctcgaatgatggaattagaaaacttagtgtttaaaatgtatggtgaaggtgtgttcagtatataaatccaatctgtaagtgatatggaaagtggaagtttattcaatgccttatcacatattcaaatgaacgtatggctgctctaccacttaaaaatagctctgttcattaaaggaaatgtaacctagattttcagaaaattaaaatacaatgttcttaagtcagtttaaactttaactgagattcatagtttggttctgccttcctaagcatttggactaaggcagagagtataaatctgatgggtcatcttcctgaccaatcgactttccattttgattgcaaacaatccacttgtttatttagatacaaccactgaaccaagtcatttagacacaaacattgaacaacaacccatgtgtttcattcctctcaactttaggtgtattttgcctcataaaatgtacggcattgtaattgttattaattagctacacatcaaagagcttgggttagcagtgggccatgatggcctgaatcacaaagtgtgacttgttcagtgtatttatttatttatttatttatttatttgagacagtctcactctgtcacccagggtacagtgcagtggtgtgatctcggctcactgcagcctctgcctcctggattcaagcaattctcctgtttcagcctcccgagtagctgggactacaggcacgcaccatcatgtccggctaatttttgtatttttagtagagacggggttttgccatgttgtccaggctggtctcgaactcctcacctcaagtgatccaaccaccttggcctcccaaagttctaggattacaggcgtgagccactgcacctggccttttacagtgtatgtaagactaacactactcctctagaaacaaggctgtataccgtaatggaatttaccttcccaaccaagctgatttgtttagatgctgatcattggaaataaattattaatccaggaactcatgttgtttgttagtttttttaatgtaatggtttgaagcaggctgcttatgagcctcgtgtaaaaatgattctgttattagttccagggcataaacttgaatgacactttttcccttcttgctctatatgttgctatacaactgttttcatcccttattgttttaggtggttttgcaaaataatttgtgagataaatcagggttggaatgttagccttgacactaacttcttgtatgaattcgagcaagttatttaatttctctggtccttagttcctcacttataaaatccgtgaatactaccttgctttgttactatgaaaatgacataagatcatgcagataaagtaccaagcacagcggctggcacatgacaggtgttaagttaatggtcttgtcgtctttgttgttacagttgttgttattattactcaactttcacttctatgctgataattttcaaatttgtctgtccagtctttatctctttaccaagctccatagtccaaagtccaaatatctacttagcatcaccaaacaaaagtgtcaatagcatcccccaaccaaactcattctcccaggcatctttttatcaaaaaacaaactgaacaaattaaaaatcctagctactctttctcaagtattacatgtaagataacttgcataactagctacaaacaatagttttctttggttcattccccctttaccacccctatgttcattaaatggatggcctcacatggccttttcgttgcatttctacaaatactatttagttctggccttcatggtatcttgctgggctgtttccagggtcttctaactaatttgcatattcctacttctcacctctcaaatgcattattctatttcctacagatttatcttcgtgaaatacagtctggatatttcctcatacaaacttttgacaattctttcacatctaacagagaccatttaatctattagcataacagttacacttttccctggcttccaagctaagttctcattacatttcatcattcacctttgcactggtcataatgaagcctcttgccaatatcaaattttgatccatttcatacctctttgctagaacagtggtcctcagagtttaacatgcatcaaaatcacctggaggacttgttaaatcatagactaattagtatttgtagaaatgcaatcacacagccagttgcatccaaaagcctctgtttcagttaaaactgaggtaggtcttgataattcaccttaaatgtcctgtgtgtgatgctgatatagctggttctgggacatccttcctcacccatctcagttcaacaaaatcctatgcacttctcactgccattgtgtgggagacgtttcatctgtcacctgtcagaatgaaccattccacacattgtgttcatgagataggaggcaggactcaaccacagaggcgaggctcagacaccaaaccaaaatgaggactagctaaagcagggacagggcagacctgggcaaagccaaaaggcatcccagtgaggcccgatttggagtttacctgtcctgtatcactagcagaatgattgaggttttaggtggagccagattgcctggactccgctactaaatacctgagtgaacctgaacaagttccttgatctctggagctgcttttccatcagtaaagttgaactaataacagtacatccagcatatgttgatgtgaggattaaatgaattcctgcatgtgaggcacttagaatagtgcctgagaagtgctcaactattattggttttctagtagtttatacctttactacaatgctcaatgacgcttaaagtttgtaggcctatctccttttgagatgtcagtttccttgaaagcagagaccacgttgttgtgaatccccagaaacatagccctgggcttagcactttatagaaatccagtaaataaaatttttaattaaatggagatcaaagaaagattgcaaaaggatcttaagtaagtaaaaatcttctaaacaataaacaaaccatccatttctttttccctcatcataaagatgaataaaaatgaggtcaattattaataatacattgaaagtaggtttgccttttcctttgaattttctaaactctataattaaaatgacttcaaattggaagattgttaagaagaaattaatcttattggtaagtaaaaaagcaaatcccatggttgatgatagatatgacctgttagcaatagtcacacttttatattttatttccttacaatcagcatgtggagaccaacataatccaattaactgtaattcccttttgtagcatccgtaaagtagtttatgatactaaaacaccattgaagtcttatctctggtcagataatccaaatggattctgatttgcaaactaccagcaggtctttataaacttcaggaaaatagaatattttgacttccctgaacctacaataaatgtgatacacaaaaattcgtctctgaactctaatcctttgtaaatgctagccatcagttttctagacttctttctctgcacctgtttcttattaactgacttcttttaaaagcatttttttccacagtgaatatccagtatttcaatacatcagagcctctcagctgagcttcttgctcattgtgtctttttggacacaccacccctcttctatacgcccactccaacccatcctacatgctactgccagagcatctttctagaatgttgctcccctgcttatggtcatccagactctttcagttgtaaggaccttcatgctgtaccttctgccttcttttctatcctcaacaccctgagatatggaatctatgcctctagggtctccgacaacttgtggcatcccaaatgcatcatgttcttcattccttggcgtgattgttacttctagttgaatttttcttcatctcttctcttcctctctcccagctcctgcaccaccctcactcacctgactgctcatcgtttaagatcattattatgtgacacctcatctggaaagccttctgactacacccagatgaagcttgatgctaatcttctatgttcccatagcagtctgcaagaagttatataataacatttaccgtacttgattacatttttttctatttgaccaaacttcctatatactatgaaatctttgagcatagaagctagatctttatttatcttatttttaccccagcagctataacatgcctagcacaaaatttgggttcaataaatatttgataagtgaatgaataacctacttatgtcttcagtatttgttaagtgttttgaaagagaatgataaacaaagagaatacaaaaataatgctgtgtgtgtatacatatatctattgtcatcatcgttggtattatattatgaaatagcctctgttatcaaaggaggttaaaatttgataggtggtacaaatatatgaatagctaataaaaatgagtgcatcagtcactggctaagcactggggatataaagaaaaataaaaacaaatttctttgagacagagatagaggagagaccctttgtttaaatcactatagttaaattaattaggcatgccccaggagtgatggggttctcaggctaggattagaaacatggtaagcaaagtttgaaatgaaacccaatgtagggaagagtcaagattaacagcatagatagctaggcatcacaaactatcggcagagaccgggaattggtgccacaggtttgtttaggccagaataattaagatgataatgttgttcagtagtttcaacaagaagttgttgcacagggacctagctattttaccttactttatgcaagtagttgtaaaatttatacatctcccaactcttattttgtgtacctttgtagagctttagtggtgattgtggtgaagaaaagtcctgtgatgcagaaaatttagtttactcccatgaatccaactaatcgagataacttaggttaaaaattatcattaataattactagaaatcatctcttcattttggttgtcttaattgacaactaacagatgtcttatctggggataacatagtttcaatgaatgagagtagcaatatcttaatctaccagttttgtttaccttttatttcaatttttctgaagaaatacttccagacagaaaattctaagttagcaaaaacccaaatccatatccttttcaatgttaccatttctaaccctacacatatcaccaacatagtaaggggaatgataaaagccagaaattatattacattctggaaatatttgccaaagtctgtctacattggatgcttttcatatattacatcacttaaatctcacacaaaattaagaactctcatttgacaagtgaagaaaccagaatgttaagtaacttctatatatgcatttttgcttacaatggacatattatctgtatatgggaatttataggacttagtttatttcctagatatcattaagagataggttttgacttggccctgtgcttcatatttgcaaacgtaatataacttggagggaacaatagcaatggtgttgaaatttaaagccactatgaagcaagctttcaaaaatgactttgtcgaaatttaatcctatgattctctcccctttggagtacgtaatgtatgaaatcatccatggaattccagcaaattcagaatctgtttggagaagatggttaaataaaaagaaccattgtgtacggtatctatagagtacaaaaagcctttgactgaatggaaataagaacagagttggaagctctgagtaagaaaggaattaaagaaatatatatgggtgccaggaaatacatcaatttttttttatgatcctcactgaaagaaaaaagtctgttcatttttgttgctgttgttgcatctaaacaggactaccttttctcagctacctaaacgaaatatctaaaagcctggagagcagcataatgtcactaacgtcattttataaggtagcattatgcatggagttatgatgatgggaagatgttttatgttatgccattataaattaaaaatgcacaaagcaatgacacatgtgttatactttccatctgtggcacctgcttcgcaagtttcagttgcacctattatgttattctttacattcaaatgaaatctgaggagaaataaaaataagacagtcttgctcctaactagcttcctgtactggatagagtagaagaccgttccacctccttccaagagagtaactaaagatatttcatatgagcctgtgacatgcgcatgctttggtcttctcaaataatttccaaagatatgcacaaaacctcaaagcacaccgaaagcaagctaacgtggcgtgccaaagtagcccattagatgttcagaaataaaagcttttaaagaaaagttttaaaatcttagaaagtttgtggttacttccttcctccctctgtcgtaattcaaggaggccacagaaaaccaggttttatagaccaggtggtaatagaaccatctattctacgcacaggtctgtctcctcttgccagaaaggaaccattttcaaacataggactcctaagagcttcctgggggttactgtgataaatcatatgaaacagatcttgttgattttgcatacaagttttcatatttaaaaccactttgctcctttctctttgataggtatcatgaccatagacagttgattggacttgagttgagtttttcctgaggaagtttccaatgttttctagtagtacttagagtctcaggtgatggcaaccatgcaatatttccactttagacatagtagttggacaaagaatgaatatgaaaacggcaatcatgattttattctttctctggagaccacactggagagtattctgcatgtttgtagagaaaatcatttgaaataggttaagcctgaataggcaggcaatttttcaactaattccagcttcaaatctgttctctgaatattggtaattatttttcttcaaatggaattacctaaagagctaactctgttgttcactgtgtttcacaagtgtagcatagcccttgtgttgagaagatgtataggtatgatccagaaatttgaccttgtctttctctgctcaaaaccttggggcattgtattagtttgcttgagctaccatactaaagtaccacagactgggtggtttaaacaccagaaatgtatttcctcacagttctaaaggctggaagtctgagattaaggtatcggtaagttgatttctcctaaggctccctccttggtgtataggcagtcaatttcctcctgtgtcttcacatggtctttcctctgtgtgcaccctaatctgttgttataaggacaccatacatattggatggggacccacatgacctcattttaccataattacctctttaaagatccaatctccaaacatagtcacactatgaaatattgggggttaagacttcaacgtttgattttgaggaatggaagaacacaattcagcacataacaggcacgatgcatatttttgggtgatatatttgttatttgagtttgtcctggcttgcccccaaggacaaaataatatgattctagggaagagtaacaggatgtaaaatgtccagaactttatattcactttctgagcacctgatgaagccctctcctttgaggaacataaagcagcctcaacagctgtagctttaaaaacacaaggcccagtatgtagtctccttccatctctgtttgtttgaaaacaattaagtgaacaaacaaattaactggccaactggtttagttttctcagataatatcctcaatgaagtctcatgttacagccaaggtgtggaaggaggagctttagccagtgcagcacagaaagatgctacttttggcacagggtgacatcaccgtgtttgagaatgcagaacctctctaatccaccagaaatcagaccaaaccatcactttcaggagccagcacagcaagaaaagttgagctagttgagtgattcaaccaacttacttttgatccattcctttaaatactaaactaaaaatcttctatatccttataaacagtgtcattttatccacattaatatctaatctttcaatttgattttagggccaaacatattatgttttggatcgatcatccctctggcatctcttccatttgggatgtgactttcatgtacccagcaggccttttagataagggatccaaatggtcatctgtgctggaagcagggacatcatcctttatgagagtttcatagtgtaacaagttcttttcactgtattaatgagatcagggctattctttctgtatcctgggaaagctagggtgtcttttcctctttttaaaattgcaacaataaaataaaagttggaaagaggttttaaaagtgctatgaaaactattacaaggtaaagaagcacttgtttttaacacatgaagaagattttctttcttgacttggttactcttctattctggatagtccaagtgcaagcatatttcaaaaaagactaggttaaaacaggttgagtctagttaaaattggacctgatatcacaactgctggttatatataccaatacctacaaagcaatatataatacaagaggaaaggggtaaactcctttttttttttcctttgagacggagtctcgctccgtcaccgaggcggatggggtgcagtggtgtgatcttggctgactgcaacctctacctcccaattctcctgcctcagcctcccgagtagctgggattacaggcatgccaccatgccgggctactttttgttatttttttttttaccatgttggccaggctggtctcaaactcctggcctcaggtgatctgcccacctcagcctcccaaagtgctggtattacaggcatgagtcactatacatggacagtaattaaactcttaatgatatttaaatgctccttgttccttggaaactaccattgacctactatggctatcaaaggttcatctttcagttctttttaagaaaaattattcctaatagctactgtcaaattttttctttcaaatataatttgtaaagcttgatataaataagtttttacttaaaagataccctaaaggctcttcaagaaagagcatttcagggtaaccttgtttgggtacaacatttaggttgtgtgtgtgtgtatgtgtgtgtgatctcataaaattcacatggtatttgcattgtggagcttaacctatctttaattctgtttataagctttaaggcaaaaccataaccaaaatggatttaagataacctaattagagggccaggagaaaccagcacagattgaaaggattgtgagacatcgtgattcaaccagacttcttcctaggattggactataacatgtgatatggtttggctgtgtccccacccagatgtcatgttgaattgtgttgaattgtaatccccaatgttgggggagggacctggtgggaggtgattggatcatgaagatggatatccctcttgctgtcctcgtgatagtaagttctcacaagatctggctgtttaaaagtgtatagcactttcctcttcactcctctctgctgctggccatgtgaagatgtgctggcttccccttcaccttctcccatgattggaagtttactgaggcctccccagttgttcttctatacagcctgcagaactgtgagccaattaaacctcttttctttgtaaattaaccaggcccaggtagttctttgtagcaatgtagtttttgttgatcccgttcaagaaactgcatcgtactgagataaatcctctaaaacaaccaggctggcttacaatgtttgttcagtgtttcagttgccttagtcccttttttattttatcattttggcctttactcacctgcctcattctggtgacatattggatatgtttgattccttatgctttaaaatgtttttcaggtacattttcccatttgataccaacaattatccttctatcttcattttacaaataaataaataaatagatatacaatgaattagtggtaaatccagtcctggagtgggtgtttcatatggtctttttcctactctatcatatttcctcttcactccattgctacctaacaatttgctccatctgtgcccgtttcctaatgcagttgcttcttattaccaatttgttttgtatctgtttatataagaatctgtgccttctacaagtctgtaattaccaaagatgagagtcagtttacaggtaaaagcatagcctcgagttagacatttaaggataaaatgtaaaaattacaatcttgacataatagtcaatcaactaccatttgcaattactgtttatttgccttttccctttctgcttctgccagccaagattaagtctgaacacagtgattttaaacatagtgggggcttactggctctttatcctggtttcatcacttggcagccatgggaaaattgtttaatctacctatgcctcactttccctatctgtaaaatggacatgatgataacaatagcatcttcctcattccttgctgaaagcattaaattagataatgaatgtagagtgcatagcacagtccctggtacagtgtaagctctaagtaattgttggttatcgctttcgttgcaaagtagcctgaatgagttcatatggattttgttctataaaaagttatgattttgtcaagaataattaccaactcaaggtcatattaaggaaatatcaatatgtgtgtatctaattttctagttccctgaccacctatggtagacttcgtaaatctttgttgagttacttctacagacacttatggacttcactatagtggctctcaaccaagaataattttgcaccatggggagatacgtggcaatctctagacacaatttttatcatccccactgggaaatgctactggcatctattagataaaggtcagggatactgctaaacatactagaatgtacaagacagcccccaccacaaagaattttccagccccaaatgtcaatagtgtggtgcttttgagaaactctactctattagaaaagggaaaagtataagacatcatcactgtgtagaatctagttagaaaatgcttatcaaataatgcaaatatatttgtaataatgcctgttaacaccagggtagggttatggttagttcatcttgaggactggttggcttcatgagaaggcatactatatggacataacttcatgtttagataaactacagtggccttgcaaaatttgccttaacatcacctggtttacaagggatcttaaccttggttgattatgaaaacttgatataaaaattagtattatatttcaaaatactctttccaactatttgccatattgcctatttaagctacttgccgaagggctacaaattattattatttctttaaatggaaactacatgggaatctatagtaggaatcttggtttaagggacacagttaatattatatggtattttaagtagatataatcaaatggtatctattcatgggtaaattttctttagatatcactatgttcgattttcatgttcacttgaattaactgatattaatgtggaaatgagtaatagtaatgctgttttcctttggttaagccattatttgttgctgctgctgttgtttccttgctcaagttaaaatcattctcttttttacctgctgaacactttcctttagcaatttcaaacttgtgcaccaaaacggcattttgtgttggacttttctgataaatttttggtagagatagttgtgtgtgtgtgtgtgtgtttgtgtgtgtgtgtgtttaggtttccacttaaagttcagtgccaaagctacagtacttatacattttctaaatgtgttttaagcaataagttgtacaacatttttagaacatgtgttaagctatttctctaagaatgaagctcttaacaaaacataagcactctgcatgagatcttagcagcaaagtgcttaaaagataaagtaagaattggtaccatgggaagaacaccagctgtagagcacacaggtccattatgagaagtatggtagtgggtagggagaaaatgatttaatcaggagtaaaaccaattttattataagggcacgcagggggtgtggcaccatagtgagagggacatttcaaaatatctgacagatttcaacaatgtgaaaaccccgttctttaaagtgacagtaaaccccatcaggtctccctttttgatgctattgttaacagttgactgtttaaagctggcctgctaagatgctgtcggcctatttcaatagtgtgtagccaaataaaagactaattgttgaaatacaatcaatcaaaaatgattgcagggcagaaagaaggtctcctctgctgattttgttgtgtatcacattattgtgttatgattgaggtaggaatgaagactgaaagggaagattagcccgtctgaaataaacagattcaccttcatgtcttctctttgcaaacacactgttgagcaggaacaccacttactataagccttagaaacgatcgttcatttatttaaaaaaaaaaaaaaaaaaaaaaaaaagaactgctgaagatttgggctaatgtttttaaaaggacgtgaacattattagcaaaacagcccatgcagagaatccctacagtgacaattctcagcttttcttacattttggtgcaaaatgctcctctggattcataaaactgacatccaagggacatgtgaatgcgagcccaagacatcagtaaagaaacaaattttcagttgaccaaatacctcggcgcttgccagtattctcagcttttcagttaacccccagattgtctaaaatgattagtttaaggtttcatgaagccccgaatccaaaaccttttccatgttgcacgtttagaaagacaaatcgtctggctcgacagcagtgcctttgtacctcgcttccttttaattttatgtcaagatgtccctttcagacgtgaatgcatccacttcttgggtgagactaattccagacattcatattgagggtgaaaaggacaaaaataattgcccagcgcactttatttctattaaaaccttcattttgggatttactttctttagtatttcaacatctccactcactcaagcttcccaagcaaatatttctgttgtttctaaaaagagttggtaagcacttgtggtttgtctttagtgtgttatcatttttgacagctttgcatagcctacgtaggccaacaggggtctgtctaatattgttgctgggcatattttcctcactgagatgagaactaaaaaaaaaagattttgaagcagtaagaaaagaattaatatcctttctcactcagtattctcttccttgctgactttatattcaggcaaaaaaagggaaaaagtgttacccattattcccttgtacatagcaaggctaacacatgtaaagcaataactcattttctattgccatgtttagcatatgtctcctgttggctcagcaaggcctttaggccggtcccttgagccggccatcattggcaactcttagcccctcggcctcaaaaccaaatagctttgaatcatgttgagctgtgatgctaattttcatactgatgcattatgggaataaacgtatctgacatactgtgtcaatggcactgtctctttgtgtctcttgtttttttgttagctgcattcctacagatggtattccattgaaaatgttcccttcctacggaaagagggaggaaaaaaaaatgcacagcaccaaacctctaggtgcagaaggctgttaacggttgctgatgatagtaggcaaacattaacataataattagtgtcttgtaattgtttcattaaaaccagttgttccatttctcctcgtgttttcccagaagagaagctgaatttggacgacagccagtgggaggacatccacgttgtcaccggagcactgaagatgtttttccgggagctgcctgagccgctcttcccttacagtttctttgagcagtttgtggaagcgatcagtaagtacctcacagaaaagggcaggtggtagaataacctgacatcctggaattattaagtaaataataagaatgattataataataatcatggggaacagatagtatccccgatgctccatatcttacgttttcgtttttgtgttttgatggcttgttttatttctggccctgcagtattatctgaggtttgtttgtttttaattaggaaaaaaaatatgacatcctatttagggtagccaatttaactaagtatcctcaaatgaaaatagtgtctcatcaaatctgctttaaagggttcactgtgtgcacccctcatctctgcctttatactttcagaattgcaatgagtttgaatacaaagcggtctcgaaaaggatcctaagtgaattaaatattacatttcatgaaatatgtgttaaattatcaactaagacatcatgttctcttggttcactcacccttcacccaccaacactagtaaacagtcagccataatttgcttatgagcagcgtgattatcaaatgaagtaatggcaagtttcttctgttaaactggtgactttataagagagtgagttatatctactactaaccagtagtcattgtacactccatgaagcttccttttctgttttttttttaattcataaaacacacacacacacttaagtaaaagtgaataaatgaatgaatgaatcaatgaaaatcttttccaaatggaagggtacttctgctattaatccttggagaagcaactactggtacgtctctaaatttaatatcttagggtatgcttactgtaactgtgacagcttggaaaaagtttcctggcaagccagctgatttaaggaagaaaaagaaagaagaaagaaaggtaaaattaaaaaccttgcaagcctggcaggagcttaattaaaatcctaacgagacaaatctccaagaaaaaaaaaactgctgtattcaggaggtctgatcttggatggctgggtatgaagtgttcccattagcacaagtggagatttgggggtcctgtgttggaaaacagcccctcaacatgccctctaattctgtcattcacaaagccttcacccttgtttaaagctctggcaaaacggtatcaagaaaaagaagaaatttctctcccaaggtctttctcttgttgcttgctcacaatttcagattttgttgttgctattgctgctgctgctgctgctgctgctgttgttgaatgcagtaacaatactctaaagatgggttttgagttgaggctggaactcttatcccttgtcgtgacttcatctcatgacccctctacttcttcagaacagcaatgtttcatagttcagcatgctttcctaacttcatttgaaaagaagaaataaaaaataaacaagcaggcatttccataacagctttttctgatattctgtcttggaacacccaagcaacttacaatgttggaacagcgttctggtaggaaattggagggactttgcatttggatgcctatttctgattgtgtacatttaaagaagtcatataaatttcacatcatcatctccacacattcaagtgaggatgatctcatttggaaatatacttcggtatgtgctatttgggggctataactaggatatccatcatttaagcttcctttagttcacctgattctaaagatgttaggaaagtcattttcttagcttgagagatatggaaagcaggccctccgaatccacatgagagtatgtcttttgaatttctctaaggagtaggatcatctcagggatattctagacttaagtccaaattttatagaatttcagaaatataggcatggtaagaacggaacatggcagagttgaggcagcagactattgggattgatggctcttgcaagggtttctgccaacacctataaaatgggttatggcgagaatgaataagaaagtgcctaagaaagtctttcaaaaatgtaagagggtgcacaaacagtgctaaaagtgtttctccatatgagctttgtttgataatgtaatttggaagagaagagagaggagacttcgtccttcattgttcaaggcaacaagaatcaaactcagggttattgtgtcaggacgtggttcctgccggtgggttcgtggtcttgctgacttcaagaatggagccgtagaccttctaggtgagtgttacagctctttaagatggcacagacccaaagagtgagtggtagcaaggtttattgtgaagagcgaaaggacaaagcttccacagcatggaaggggaccccagcgggttacccctgctggctggggtggccagcttttattcccttatttgtcccctcccatgttctgtttctgtcctatcagaatgcccttttttcaatcctccccgcgattggctacttttagaatcctgctgattggtgcattttacagagcactggttggtgcatttacaatccccctgctagctacagagcgctgattggtgcgtttttacaatcctcttgtaagacagaaaagttctccaagtccccgctcgacccaggaattccagctggcttcacctgtcattatgatctgaaagtttgtttcccatcaaaatgtatatgttgaagttctcacccccaaggtcatggtattaagagatgggggggctttagatggagattaggtcattagggcagagccctcatgagtgggattagtggccttgtaaaagaagcccaagagaaacctgtatcttcttccaccatgtaatggcacaactagaagttgccatctattagccagagagtgggccctcaccaatacattaaatgggctgtcaacttggtctcatacttccaagactccagaacagtgagaaggaaatttctgttgtttatgaattgctaaatttatggcattttttatagtaggccaaatggactaagacactcagcagccttgcttcaactcaaaacagaatagtagaatgtcattattttttaatatgtaaaacagagggatcaaccaacagggtaatggggctgagacatatgatattggacagagacgtacatttactaacccacgtatttttgatataaccttgaagctagtccttgtgttctaaacctaggaaaaactctaggttgtaattcatatttaaatattcttaagcaatgagagaatggccacctagatccttggcaatggtaaaaaccacaccagaggaaatactttctctccatgtgtaccaattgtactaaaaagtctttcaaaattttaagaacatttataccccgtcacagggctttatcatagcttacatagcctcttgtaaaaatctatgcagtgagaaactcaacagatccactcgcgagttttcggctttatatggaaagggaccaaccaggtaaagtaaattcacaggacaggatgaattgaggacaaagaggctgggtctgggcctctttgtcctcagatcctagttcttcccttttattctctgtaccataggagggttggtcctagccagctatattttgcagatgctgtttttgtggggttttttttcgacttttattttagattaagaaggtacatgtgtaggtttgttacctgggtatactgcgtgatgctgaggtttgaggtacaaataatgccatcacccaggtatagagcatactacccaacagtttttcaactcttgctcacctccctccctctcccatctagttgtccccagtgtctattgttgccatctttatgtccatgtgtacccagtgttcagctcccacttataagaaagaacatggggtatttggttttctgtctctgcattaatttgcttaggataatggcctccagctgtatccatgttgctccagaggacatgatttcattcttttttatggctgtgtagtattctgtgtgtatgtaccacattttctttatccagtccaccatcactgggcacctaggttgattccatatctttgctatcgtgaatagtgttgcgatgaacatgcaagtacttgtgtctttttggtagaaagatttgtttccttttggatgtatacccagtaatgggattgctgggcccaatggtagctcagttttaagttaagttatttgagaaatctccaaacttacatgtgctcttgagatgctgttgcacccggtcaaagccactggaaggagatggtagaaagagagagaagacaaaggccagcagtttatgagtttatccccaacccgttcacccttgccacccatctgcctcaggtagcttttcagcctgaggctccttctcctctacagcttcagctttgaccagacagggcccatctggtttcagctcccatctggtgacacagactctcctttctttgcttttccagcctggagaaggtagtggcttcctgatgtgtctactttcttggttactccactcttccttatctggttctcagcttcttctttatatgggtaaccaattgtctgcatcaaattaattccctttgttggtgtaaatacttaaaatggtttctgttttttgcttacacacaagtaaaacatcatgtcagttgatgtcatggtacatgttgtcataacattatttcccttttctcttttattacccccaagcccagtttgtggagagttaacatttttatttggccccagattgggagatctgttactctttcatggaagagttaaaaggtggttagaccaaacagaattttgcatccaactggaatactttgcatctgaggagaaaatgctatttctagtacaagcaattaatgaccactggagcggtctgaattactttaatttttattatatgtttgaaagttatcacatagtccaagaagagtgaacagaaggcatttactttttaaaataacttctttttggaccaaaaaaaaaaaaaccccattaatatcataagaccctgcaattgccatagtaatcccttgtctgataatactcattggggtaacaaaaacactagggattgttttatatctcagaatccaagtacagcaactattgatctgaaattctatacttgagatcaatccaactgggtcacctgcaggttatttcatggggatttaacccactgactgcaaagatttaattccctggaaatgacttgtactgaaggcattattagtactgtaaatgtgaactcagtagaaaagcacagccagggagttttatgataggtgatgcaatcttgtggctagaggcctgcaggggtccagacatttccagtagatctaaatcctaggaaatgtactaactttaccactgttcccatctttttcttctggtaactctacagatccaaagaaaaaagacaacaagcaatgttttttctgttttaatgtctgcatttttccaaagttcctgaaaaagagaaagggaggagaaaaactcattggcatttctaataattgtctcatgtaattctcaaaataagaaagcaggagatattggagaaatggaaagatcatctgcacaataatttctagctcataaagtagttactatgagaatgagaatagaacaggattttcttactccatgttaggcacttagtaagctatttaaaaagaaattagtttttagagaagttataaatgcacatagctcaaaaaactagacttggcattcaaatacaaatataaatactttgtatcattgtatattgccttgagcaatagctattgccaagtatctgtattttatatcatcctacagaagacccatatgtcctatgtcatcttatataagactacaagcattttttctacattttaaaagctgagtttagaattaaattaatggtcagaaatttcagtattggagttttaggttagaaataaagtagaactttccaagagtgagtgagatttcaatgtttagtactagatattaaaagcattcatgccttaaatgttgacttctctgggtacattttaaccctgcactctgatttctatgatcaattgctcaatatctccttttgaaatttatttatatgtacacaatgttacttttctatttcatatgagtattttaattgtattaagattcttatttataattatttacttgatcaaattacaatattcaacaaacaaaatcttacagaagaagttaggatgaaaagcaatggattgggccctatcacatcatatcccctgacctactcgtgagaggaaacctcatttagtgattttaatttttatctcttctggttactttcataactctagataatatctctacttttgatttatcaactatggataatatctgttacctaatattgtttcattctactccacttcttttagtatgtggtagccatatattataattgcaagctaaataatatgcctaaacctcgttttcttgtttcatcaacattcaacaatatctgctaactcttccattcataaggtgagcatatactccttcccaccctttccttaatctttctatagtttatttttaatttttaataattgaggatttttttctagttctactgaggtataattggcatacaatgaactgcatgttttaaaagcttaactttgataagttttgacaaatgtttgcaccacaaccaggaaaaagaacatctctgttattcccaaaagtttcctcttaatccttgacaattctctttccttcccctttccacctgctctgcactcccatcccaagccaccactgatctgcttcctgtcactatcgatacatttacattttctagaattttatataaatggaatcatacagtatgcactcttttgggggagaggctttttttcattcaacataattattttgagatttatccatgttatattagttcatttttcattaatgagtaatatttcattatttgaagataacacaatttgttcagttgtttatggatatttgggttgtttctagtctttgattgttacaaatgaagcatttacaaatctgtgaacatttatatacaaatttttgtgtggacaaatgcttttagtcttcctggtgatacttagaagtggagagctggttcatatggtaggtatatatgaactttttaagaaattgctaagctgttttccaaagtcattgagccatttttcaattcccgtcaacagtatatgagagttccagtttccccacatcctcagcaacacttggtgtggtcagtgtttttaattttagccattctatgtgtgaagtggtattttgtggtttaatttgcatttcactaaagattaatgatgttaagcatcttttcatgtgcttattggccattccattattttctgcagttaagaaacctactttttcaaaaaaattggctatttctttgctattgagtttcaagagttccctatatattcttaatgttagttctttatcaaatatataacttgccaatattttcacccattctatggctttgttttccttcttttaacagtgttttcagaagagcagacatttttaattttgataaagtccagtttatccattttgtcttttatggatcttgctgtgccttcacgtggactaatactattttcttcaacatctgttctgttgttagtctcagccagtgaattttttttaatcttaggcattgcagttattatttttagaagtttgcatttttaaatatattctgccttaaggtgtctaatttttctctagctgttttagcttttattattttaaatgatgcataattgtacatatttatggggtagaatatgatggtttgatacatgtatacagtgtgtaacaatcaaatcagggtatgtgagctggcagttgttgatttgttgaagtttccaaagttgccttttgtgtacaaaaataacttttcctcccactcctgggcaatgttccatacattttccattattagaatgcaatcaatgctaactccgtgatcaaaaacaattttatgattccaatgccatcacttttggtgtttttttctggcttgactaatagtaatatataaaaccatatgaacatatatattgtgttcatatatatatacatatgaatgtatgtatgcataggacacagagattaggcaagtcggtgctaaattgagatagtaatgatgttacatacaagtcttcaatttaaaggctacaatcacacatgcctttgaagagtgtttttttaaatgcctggttttttttaaatgattaattaaggagtaaaacaagttgtgagaaatggcatccataagatcaactgagcaccattaaaatgcagactattagccaccaaaagtagagattatcctgtgcctaaacggaactcatatccctgtctatacatcagtcacatcctcatcagataaaaataatacattgccctatggcaaaaagtacctattgcatgttctaatggtttttccccccatggcctttattccattttgcctttagagtatactctcaataggtaattgtggggggaaaagccagtcaagtatatttgcaaatattttctttactcttgactttatcttgccctttggtcaaactatttctgatgcatcatcaactccatgatgacactctttaggagaaaagaaacagagcttgcaaggcacttgactaaaaacggttgctaaacatgaaagcatgatagtgacaaattgccttaaaaccagagaaagagcagggtgtaaaggttcatcacaaagaaagcagagatgtaaaaataatgcagtataaaaatatcctctattgcagcatttcaaggaaatttgaaattgaaacaaaggtaaattttacaaagcctgtttttttagtttccactgcaagctaacattctcacagacttggtatttttgttgtggttgctttttaatgtgtgtgtgtgtgcacgtgtgcacgcaaactggaaagtttatggctaatgcctagcctgtctcttaactcattctaattatattcataatgaaattgaagaaaaatacttgactagagccaaatggcttgcacaggtgtctttttgtaagaatggtttagtgctagatgataaacaactggacctccatctccttaatttggcttaatgaaaagccctttataagtaaaactagaaggtgattcagaattaaaattgggccttgactcagaaattaattgagtggtaagacatcagctccattagaaaatgtggtgcttgtctttttgcctttcctgaaaacttttattttacttgcactcctttcttccatctacgtaaggtcactttttcaaagcaataaactcttcaagctgagcaaccagccaggcagccttcatgagtcagcttccctagcatccttacttctactgaatagacctgcttttaaaaaatagataacaaaacgcaaaatttctcctcaaaacttggtggaaagcaattatcttcacctattcttctaatagtggaattgagtggttggttttcactgcatcaatagattgtaataaaactgaaggttgggaggccttctatcctacactgaggcttctgcctaatttcttatgctttgcttgacaccacattgtgatcaccactgatgagtcctctaaaatatctgcccacttacccccaactctgactcaggccatctctaggagaatggtctctcctatttcccatattcatttttttctctacccaacccagcatgattctagttctaaaatacacgcaaactgatatatctggcttgcatttcattttgagaaaaatccttccaaggtcttcaaagtcctttatgatctggtcacccacaaggtctccaacttcatcatttactgttccctgccttgcccattgcattccagcccattggtaccctggctcttctttgaataccccaagcacattgaaagtctttgactgctccatctgtctaccgaacacactctcccagattgctactccactgtcaagtcctcagggaagtctctcatcagctaagctaaagtttctacccgcaccgcacaccaccacctgtattcaaatcctgtctccaccatttactatctagacctagagcaaatatttaatctctctaggcctccatttccacatttataaaatggagggaaaagttgtatcttcaccatggcaattgtaaaaagaatttcatgaaatgcacttatttacagaatccctggcacacagtatcaagttcactggtattatcatattagaatataatcagagtgtcctttagttaacagtctcagagctttagttaacagtctcagaggaccttgctgtccattctaactaatctttccacttctctggaaaagccatttcaaattattgtcttaaagcggccatcttcattctgctttaatattttgctttgagaatttcacacagcaccaaacatgtttcatatgacaggatattctcttgcttcgtgacccagggatcccatttccttcatctcatgacatttctcctttgttctgccagatgttctcaagcccaaccccacttggataatccaaagcctaccactttattatagaacttacgcctttatcataacccaaatgctatccagcttctccgacctgagcttgccttgcttctatgaaatattagcaaatctgtgatgttcacggtggcaccagaagagccaactccaaagtgataccttctctcagttgggaaatttgtaacactgtagatcccaaaatgttatcagttgaacacagggacagacagacacacacacacacgttctccaaactggaaatgtttcactttttctttcagttgccacacaatactctagctttgaaaggtagactttttattttttaattatctcaagagaactttcatattaacctctcaggagctttttttttttttttttttttttttttttcaaattttttgtaaagacagggtctcactatgttgcccaggctggtctcgaactcccggactcaagcaattctcctgcctcagcccccgaaagtgctgagactacaatcccaagtcaccatgcccagcctcgtgctattttcaaagcctgttatggaataagaatggatcctttacccagtactcttgtttgcctacattcagtcagacattctcatttgctcaagcacttgtcctttctccagccctcctctgtcaatacaagaattttccttaaatagcttctaggactatcataagcaccttgaattgtggcttttcttgatctggctcattcctactgctctgcagagttaaacattagatgtgatggctcctggagtactataaatttcctgggggcattctgctcatgttggaacagtggaatatccacactgagaattgtcatgtggtttagagaatggaatttttccctaaggataggctcatacattttctacctacactttctgaacagaaacatggaaaatgaatacactattatagaaaataagtagtggtgctggtttaagagtaaaagtaatatgtttggaaggatgacagcagatatatatatatattttaatctatgaactataaaaaaattatattggataattatgagtgttttcttttcattggcttatttatagttttctatttaaatgtgaagttcctcccacttccaaccatttaattacatataacacctttatttttcagaaattggaattctaaaagatcaaatacctaaagcctgagtccatgattactgtctagccagacagttagttcttggcccctttcctttttcttctcaccttgagtgtccagcaggtgaaaggttgaccctttcccatttccagcccattcctctgccaagtaacggatgggcagatctaattagtaccatctgtcccgctagttgcaggtggttactgtcttacaaagagatgaaagcaacaatcttttaagcttttcttccaggtccctaactctaggcacaatggtaacattattctttgacaccttgtgtgtattattctctgaatatctaattggcatctaagaagaaaccattacctcattgaaatattctttggaaatttctatgtgcttgtgtcatgttatgaaaatgttttagaaaaagtcgtcaggaaaagaagaatgatcctgaacaaatattagacccagaaaggcttcagaagctcctgtctgtaagcttggatttgtgatgctcagagcttctgcgagctgggccccctccgtgttaactgagcagaaatctccaccaaggagaaagacaagccagagcacaactagaaaaaccactttggtcaatgtcagatttccagcaggatctttttctaacagccccttaaatatttttaaaacacttaaagtgtaacccgtagagcctgttcagtgctctcctttcttcctctgcactttcaataatttatcatgaatcaaagtttccagacccttcatcaccaagatcacactccctcaaatgtgccctcctaaggtttggaaattgtctcagtcagatcaggaagctatagcaaaataccagagagtgtgtggcttaaataatggaaatttatttctcacagttctggagcctggaagtccaagatgagggcaccagcatggtcagttcctggtgagggcccttaccctggcttgcagatggccaccttctcattgtgtactcaaacacaagatcattgtgtcctcaaatacaagaaggagtgggctctgatctttccctctttctgtaagggcactaatcctaccaggagagccccaccctcatgaccctatctaaactttgttgccccccccaaagacccttctccaaataccatcacattgagggttagggcttcaatgtattaatttttgggacacattcagtgaataagagaaatcatacttcagtggaccgttttatttgcacaactttatcagtgcagaataaagcttcctcctatattctcacaatatcttcctcttactatgataaaatatttgattttttccttattaatattatactattgggatccaaaattgaatttagagtccaagttctcacttttaccattttctctctcagataagtttgtacaagtttaaatttccatgctgaaatgtgcacaccatcttgtaccatggtacaagagaattttgctttaagttttgcatattcaaaagacttatgtcacctgagtctcataacaacaggagctgggaccaaaacccaagtttttaactacaaattcattgtgccttcctcctagtattgtgatatttacaaacctgagcagtttgtcttccaagtccatatttacgtcctcaaatacattcaaaaccatataagacaaattgcaaggccatttaaaacaatggagcagttagagataaaaatttacaacatttggggaggaaattcaaatattgtgccaaaaaaaaaaaactcatccgacaaagggctaatatccagaatctacaatgaactcaaacaaatctacatgaaaaaaacaaacaaccccatcaaaaagtgggcgaaggacatgaacagacacttctcaaaagaagacatttaggcagccaaaaaacacatgaaaaaatgctcaccatcactggccatcagagaaatgcaaatctaaaccgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcactattcacgatagcaaagacttggaaccaacccaaatgtccaacaatgatagactggattaagaaaatgtggcacatatacaccatggaatactatgcagccataaaaaatgatgagttcatgtggtttgtagggacatggatgaaattggaaatcatcattctcagtaaactatctcaagaacaaaaaaccaaacaccgcatattctcactcataggtgggaattgaacaatgagatcacatggacacaggaaggggaatatcacactctggggactgtggtggggtggggggaggggggagggatagcattgggaggtatacctaatgctagatgacgagttagtgggtgcagcgcaccagcatggcacatgtatacatatgtaactaacctgcacaatgtgcacatgtaccctaaaacttaaagtataataataaaaaataaataaataaaagaaaaaaaaatattaaaaaaaaaaaaaaactcagagaagagacattccaaatttacaaagtgaagttctctagacatttggacaacatttagaaagaatttgaatcactaatactataaactattagactagtgggaatttaaataaaccccataactgtccatatgattacaattctaatttctagtatacttaccatacttttacttacatatagccaattgctatgtgtacatttcactatttaagtttatttttataatactcctttgtggttactattattcttcctattgtttccatttgggaaatttagactaatcaatattaagtagccttcctaaggctaccagctgggaatttgcagagctagaattcgaacccataactggaagattccaaagctgttactcttaaccacacaactgtagtttttgactaatttgaaaaaaaatgattacaagtgtctatttagaaatgagataattagtagattcagatgtagttcagataaagactttatgttgttaaaaactacaatgggaggaaaccaaacaggacacaaatgaattttctctgctcatacacgtactcaaaacctcattgtttacttaagacttccatcttgactattcaatttaaaacaaattcaacatttttaattgctttctgtatccaaggcaacattacaggtactcattcttgtgcctgggtcactggaaaaatttttaaaagtaaaataagcaccagtgaaattcaaacacacctagcagatggagaaggctaaaggatatgtaaatttatttgtaacaaacatttaatttatcttttaggaatgttagctaagagcacctattctgtgcaaaatgcatcactagaagaaaacaacaacaatcaagctcccatattccaaatgcttaaaggtagaaagaaggcactatgtccttattacaatccccggcaagtgaattaggaaataacattataaaatttcttagaactttcatcatatgtgttatttaattaaaaggtgaaactgcagcaaagtgtcacttcatccctcatgtcatgtgccagaaaagtattttcatggagtctataaattcattatttcaaccctccatacccataataaaaagagctcaattataattaaaatactatgtctactcacattcagtggtattccactttttaaaaaatgtttaacgtctttgttaaaacacagcaaacttacagaataagaccacagatcttaatagtattgtaagagtatttttagttgggacattttaaaataaaatttgtttcccaggcttgtatgtttgtgactcctttttctggcaattaattgtaaattttctctactgagttaaatacacaaaactgggtataaattgtctcttgtctaggtacagaccaacgaaaatatcgttttatgtctgtttatctgacataaacttctctggagtaggagacatttcttactgatctttgtagttccggcactaaatgaatttttaaaacaatgtgctttgtggtggttgtttcaagtaattcctcctagaacaatccatagtagttaggagcaatgatctcaaactactgaaatggggaatcagaaggaagagggtggcgagaaggtgaatggcagagatggaaacaatgcttaattcaatccattttgttgacagtaaattcaagaattaactgtttacatctctccaaatgttcctatctgccttctgagctctgttatacagctactaccagaggactaggtggactctagtattcacattttctacatgtcgaagaagtattattactacttagtttccagaaatttcatctcagtggcttaaaagtttatgagagaaaaagggaaaaattaaatgagcaaatcaagtcttttgaccaggctaatgaattttgcagtcttcaaagggttacctgaacttctgctagtacaacttgccagccttaaatgcagagagcaatggtggagagaacagtaaaactgtactataaaaataaattactgtcatgaatattaagcaacaagaatataataaacatgactgtttgcatgattctgatttattggtactgatatgcttataaattatgacactaagtgtttattctagttgtttcagaatatgggccaaacaaagctgggtggacacttcctgcagacctgaccatctgccaccaaattcctacttcatcgctcttgtcattgcgtttcttatgtcagtggcatcagggccatgtatgaacaaccattcccttttagttcactttgcagactgaagtaggttgcctttccaggacctggtgtgacaaccatcatcatgaagtttgtgatgtcttgcagtggaacaactgcagctgcaaagcatcctgaaggctgttccaacttacgctgttaaacagtactcacttttgacataagagggtccattactgtatttatgaacctcttggcaccagattggggatttcccaatgcgaagcagcactgcattttgcatacttgcttagcggtgggggctccataaaactggtgctgagaagttaaagacctaaaaacaaacaaacaacaacaaaaaaaaaacaaactgtgtattcatatagagtatttcaactgccataagataactacacaaatagcactgttgttctttctaatatccacaagtaaaagttattaagatttgctatcggtttttacattatttggaaccagatatttgttcaacagatggctagaataaggtatcacatgagaaaatagcattctcctgcttcaggtttttagctttcatgttacatctcatcaaaagttacttcaggagattaattattttaaaattttcttttctctaatgttggtggaaacctgcaaggaagacagccagtaaatttacagtaagcttaatgaaagatgcaattttcacacagtaaagtatgctataagggtataagttggtgctgcctgtaaagaactatttatgatataaacttagctgtagatgaaatgccaaagttcatgatgagacaaggcctgttactgctttgaatcagaactcttagaaaatttgtagaaggacttttggctatatttagcaaaagcctttaaaatgtgcatgcattgtactgacagttatatatctagaaatttaccttaggacattttcagagatatgcaccaggatgtatacaaacttgcccctcaaaacgttacttataatactgaaaaatgtagaagtatgtgtacaaacttaaggaaggttagataatggcccatttatattatgaaatactaagcaattggtaaattgtgatatagaaagcattatttcacaaggtaaaacaccagtaaatattaagagaatataagtatgatatggcatgtatagtataagcctattgtaaaatatgtttgtaaatatttatatgtagagaaaagaatgaaaggatttacttcaaaatattagcagggaatgattatacaggtttttttctcttttttgttttcctgtgttctgcaagtttctgcactaagtatatttgtagtgatttttttttatgtataagaagagggtgagtagataatgttgggggggatttcagaatcagttgtttgaaggcttctcaaacctggctttttgatccaactcacctttgtggaaacagattcctggacccacccaggtagatgttgattcattatgcctagggtaagtttccaaaatgttttctaaaaaaaatcatgaggaaaccctcaggtgatcctggcggcagtcacatttgggaaccattgattttggttctttttccttggtgaagccaaataagaggagagcagctcttcctactcgtagtatgttgacatcacagcaccttgtccaagccatgctatatgctcctcaaggagagtactgaagaagtaagaggtacattccctgaactagagaagaacatgtgagcacatgtgatctagcagcacaatgaatgatgaagacaataaatgttctacagaagggagagacaaaaatgcagtgtttgggaggccttcatgaaggaggcattaagagtatatggagtttggagagccagccagggaatgttggctccagccaagcactgactccagccctgagaccaggctgctgttttgtggaaagtgaggaattggggttgaaggcagcaatgattttggagacagcagtaggaaacaaaggagagcagatacagttaatccagtattgtgaatccctgaaagcaaagcagtaatttcttatcctcctgcctatcacagaactttccacagaaaagggactcagtaaattcttggtcaataaattaactaattaattgcggagaattcaatactgcagatgggttaaattttatgctgcaggcagggaaactccattaaagatttttgagaaaggtagtggaaagcagaaacccatgttttagagaagataatgtggtggtaattgtcaggatatgtttaagaggggaagggaagcaggaaaccccattgtgatttggcactacatttggctatcgcccaaatataaccttgggcaagtgacctgagtcctctgggacccatgcatggatatgcctcaagaggctcatgtgccactccccagaagattggccaaatttatgtacatgtgaatctgtgtattttctggagcaagattcctagatgtgtgacacctcccctccacccacccccccccaccaaaaaaaagttatagagtgttactgaaagtatactttaaagactggtagcatcagaatcacctcggatcatgttagactgtaaatttgaggtccccactccagacctcctttatgataaccagtgaatatagagtctaggaatctctttttacaagctctccaggttattaatatgcaggcaaaagtttaagaagcatctagtagcttggttacatctaaggtgttcaccaacttaaaaatatttcactattttgcaaaagaataaaaggaagaaatgaaggaaaagaagaaactttatgtaaaagattacaaaaaagaaaagttgcaatgatttaatgacatctcggttaaacggtcttggaagaaatagatgggttagggtttgaagctagataaccaagaggatagaaatgtacttgacagaaattgagaagctgtgttgatgagttgttttgcacacagtagaaaactgagtcaaacacaaattatcagtcagatgattattcttactggcattgctcctacagacagaatccggacagttgtaggggcaaaaaagtacaatacattttccttacccattttgagggccatggctgacacctctataacaaaagaaagattagtaaggggaaagcataacagatttatttaatcaaaagtgtgacacaggaactttcagaaatgaagatccgaagacctagggaaaactgtgcatttttatgttaaggtttgatagagaacgaacagccatgtagaaatgtggttggacaaaagtatgatctaatggtaatagactgggggtagggagtggaactcagcaaggcctgtttgctagattcttttctgtgtctctgtatgacattccttcctctgggtacagggcaggacacccatcacatcagggtcttcaggggagaagacagaaagttagagagtgacatttctaggttttatggcttgctttgaggaagagttctagtttatatgatcagcttccggggagaaatgagaggagaaaggagtgcaggcaaagatcagagagaacttcctgcttctgaggcccttctaatcttcttcagttcaaagcactcagcatgccaaaggaccatacttggaggtatcatgttctgagccccaacacaggtcagtgtacctttgtaaggaatttgttcaagattacccaactgaatttttacagtgactggaacgttgaatagccagtcagaagttgacagtgatcagaacgcaagttcggccagatcaatgataccaagatataagttgctgcgtgcaaaaaaaatcaagcctaaaacttggattctcacgtgaaaaatataaatgtgtatgcatgttaagccattttagttctagtcctcattttaaatgtctcgatggttcttgataaattatattcactttatagcacatacttttatctgagtatgtcaataacaactcagaccccttctatctgctatccaaatatagaacagaaagtatagaaaactgtatgttgggggacacccactgccatataattgcgacaccacttcgtacagtgagcatgtttggagtaaaagtaatatgattggatgaagatgtatgatgcaaaattcctattacataggtttgagattgttttacatctttaaacagagcattaagaaataatcaaaaatggttaattgaacaggcaaaaatgaactttggctaattttggcataagctctccagctctacaagccaaaagatatctttaaagtaaaatctttaaagtaaatgaaaccaactcccttgattcaagaaagagaaaagatctgcagattgaaaagaacttttaactctaagtctacactgtcattaagtgtacttagatttgtaccatataattattatgattgtagcaattaatcaactgattaacatgtagggtcagcaggatccagtgatcttatcttgaagcttgaattaattaattatactttcttcaacattattattttctatttgcatacccagtttgtacaagttgccccttattgacaaaatgtggtttagtctctgtacttatcacagcaggtatgagcactcactgaagtacttttgctcatataaagtcagaattataaggaaactgaaatgtcgtcaatactttctgaaataattgtcttttatttttcattatcaaatatataaattatacaaattaattagattcttttgaatggtagggaacataagatcaaataactcttgtctgagtaagtcaaattccgcgatactattgaagcatcacgtggtggctgtattattcaggaaattcagcttatattgcaagaaatgccccaacctgcaccttgcaaacacaagcttttttaaaaaatattttttaaatattttcaaatacataatctctcttgcagaatctctttggccaagtttttgcaaaatgttcaagatggcattattcccattcgttagatgaggaaactgaagcaaaacacatgaagtggtttgtccagagcctcccagatagctattctggcagtaatggaattgaaaagctctttcaccaaatatgtactgaaggatttcttcagcacgcactaatgttgaaagtagaaacagtaagatgagcagggcatggtgttgcactcaggaaattcacagtccagcaggggaaacagacatgtgatgagatatttacaagtgcagcaccataataaatgtatgaagggctgtgagagcagaagggtaagaatgtcagtgcattcttctattctgttgctcatggtgtttcagaatgacactcttgatggagttgtttcatatgaaagaagaaggtggaatgcaaaagaaaaaaaaagattgtgatatgagacctgttgcatatgctaaagcagcttttttctttttcctagaagccacttattagcagggcctgtctcagttggaggctctgccttttttgcttacagactgtctgacgcctttataaagtgggccactgcattgttgattactatacaccagggtggtctgtgagccactgttttctgccatcccacagtgagacagcatcttctgacgttctggtctcgtatgtccttagagaacggtttgtgtttcccaagaagcttaagtctggatgatttacatgtaacattttaaactccagttgtgtaatgccttgactgggatttatatatgctgaaaacagtttttcagttctgtatatgacagttagtatgtattgtattgtctaccctcatttatctatgagaccagagatgtgacccacagtaatgaggatctaaaaagtgtgtcctctactgcaaaataacatcatgcagtagatgctctgaccacatactataatctcataatcaaatgattaagtgcttgtcaatccaaataagacgtgtttaattttgacaaaaagaaaagaaaaccgagagtagcaattgggttaagacatgaaatggtcagtttctttctgcctgtgttgagtttcttttcacccacatactcttttgcttttttccaagagaaatggcacattttctggatgtgagagttggtcaaaagatcacaaaaaaagtcaaaaaataattctactctgtgaatgaaaaatggatatttgtacttaccctcataagcattaaaagaaaataatgcatgaaattccatagaaatgtgcctatcatgttatactgactcaaaccagaagacctagagtatgatattgctaatataatacatgtggtgggtatgagtggaagtatgtgtgtgagatttatcattgccatagtgtaaaagagttgaattagcttccacttgactagatgagagctcttagttcttattttgaaagcaatcaattgagcatggttaattaggatatcaccaagtagttaaaaaaaaaaaaaaaaagaacataaaaaaagcaaggcacttattagaaagtatactttgaatctgctcacattacagtgctgatcgaaggattatggaaagaatacaccaaagcaggagttgttaggtgctttctacatgaacacatttttcttcaatttcaacaaattattatagttattttatgtggtactgcaaggctgcctttatgtgaatcattgagttacaaacaaagaatacatttcagtcatccaagcagtaattgtaagaggacaagccaaaaagatctcatttggggaaaaaattaatctttaattctgtacttattctgtccgtcagagctcttttatctcaatttacaaacatacgtcgctttatataatgttaaattacaatgaaaattcaaaataactagcaacgttaactagctatccaagatttatatggtatcattgaaggtatgcctttcacttaaaatgtcccagtgtgagaaataaattaacttttctcattaatatggaaaataagaatggttttcatattttcacagacatgccctcttcattatattttgatgggtataagactcatttcaaagtaggtccagaaatctagcagcccaagagggctgagtattaatcctcggaatattagtccactcagaggattgatactgcagcacccagcttgttccctacatctactaataaactcaatgggagtcctcttaaccctgggcaaggttgaacacttgcatgatttgaggttttcaaacaaaagtacaaaaacaaaatgcacattctgccctaatgcttagctggtttcttgttactcgagttctataatttaaactttagccttcttgtatgcattaatttatgagttactgtgcggccaccactgaatgcagcaagtatcctgctatttgtgtgcttgaatgcagaaacatacaaatgttaaaattttacatgcatgccctaattgttcaagtaacagtattaggcagatctaagtgctagtagcctacagggtaattcagatttgaacatatattatttttccctgcagaagattgtttttatgtcaagaataagagccatttgttcctcttctcattcgtgaactcaagagaataaacttggatctacatgttgaagctggacatgtcaagtccttgactgttcatgtctactaaatccttgggctattttgggtttttccttccctccccacacctcctcctcacgctttgttataaaactacttcaatttacctgaaaataagtgtgaatccaggtaaaaacctaaataatcagaaataatggctttaaatttctaaatgaaaagagttaccttgtatccagtatggtagcagaggttttcaccacgccctgtagtcacaaataaaatgtcctatgattttcatataatcacagtttttccaaagaaaatcctttgctcataaagatgcagtgttaggtgcacatttctccatcttcatctatctttttgccattctgggagtgaacagtaaggtagtctttgcagttcaactatataaaagagggtcgtatctctatgaatataacaagacatagtgcaaaccacacttttagtctcagacctagtaatttataagcaagtcaaaagatttctctgacttcatttcataacccctagtcaatgtacgtgagtcttagcatagtcagggtcatagagagcaaggtatttcctaaaaattcctatatttatcaaatactgtaaaaaagcaaaacctctctctagcaacaagcttaattttcttctatcattcatcatcatcatcatcatcagtgtaaccagttgcataaccagcatgtggttctatatttcgatgtttgctgaagaagcaagacactgaaagtcagatctgttgttcatttcaaaacagtcctcaaattctcctttggacaaggaaagaaaactttggagaaactgacatctcagtccctggttaggaagtaaatatggaagtgcaaaatggcatttttaaacaaaactgctttcctgaccgtaactgaattttcacattgtcagcacttccattataaacattttttttagttgggagtttataacgcaaatgtaaagatttgctatgggctaaatctcaacccaagagcaaatgtttataccaattttgaaaacaatcagcttgcccatttgtagttatgcatgtgttcatcatctgttattgcttgtccaatgctctccaacttctgggagaaaaagcagacatctggagagaagaaacaatgtttgctctccagcagatgtagtctgttttccacaatcattgaataaggaaggtatcgaacaaatgtgtgccctttaatacaaggaaatgaaaatgacaagattctgcctgcatgccaatactgtggaaatgctaattggacagtctatgaattggccactttgaacaactagaactcagagctccacccattttacaggtggaaggaactagtatctaatatgaatgacaacagtgaaatactttcacctataaagtacattacactttagggattgccagagtaagtgaagaataaccatttcactaaaaactatttttaccacaaatatttaacattttccaaaattttataaattgtttcttgtcttccagtttcatgttgttggaggttttttttcttcttttaaattccgtcagtaaactaagtagtcaattttttccctggggaaaaaaatgataactctaaaaaatgttatctagctatggatcctgatgggctgagagatagatgctgggactatgcagatttgttttctccaaaatgatataacatttcagttttctttggtgaagtgtctatttttattacctacctgaggtggcactatcattattcaaacagcaagaatggtttaccaagaaaagagtgggttgggaagtgatttaaattctcctgcttcaggccctaatgagttccaccacatcaaacaagtcacgtgtccgctcagatctgtagtttgcttctttaaaatgggattattgaattaactaacctgtaatcatcttttctggttctaaaatgtgatggttttatggtgctataccttacagtaccttcctcggatgtttgcagttcttcagtgaaccaagtctttcatctgattttcccatagtattgggtactgcacccactaagtattctcaaggttaggagcagagccaaatgaaggagacaggaaagcacctttgccttgttttgaggaaggtaaaattgaaggtttttacacatggcaaatcctgattgtcaatacaattcatttggtattgctggggtttctgtggtacgtactgaagatgaaattaaattcttggtttaatttgttgtatctatatggtggcagttaacatacctcgctatttggtatataatgttattttattaccaaaatccttacagtaaaatatgatcttaaaattaactctagagtgtgattacatagcactcgtctcatgtttcattttcacccaaatcagcaccataggttgtgcatttttgctgtgctaaagttacattcccatgttgttctagaggactcctgcaggaaactcctgtatctctatgcactaagtacattgttcatacataagactgtcaattacttatatcttgtgatcagcagaaaaagtccactgcagtgaattcactgaaatacaggtttcctagtcttacccagaataaaaatcagggagcatttaaatttgtttgctattgttatgtgttcattttcaataaaagctatagtaatacaaaggtaaaattgttctgtattgaagtgattcatacagattttttcatcaaaattatgagcacaactttcacccctaaatgtttccccacgccctttcataatttccttcctccactccctggtccctgccccagagcaaataatttgcttttttatctggtttattttatgtagaacaatttattttaaatttcattaatgctgttgttgtgtatcaagtgattttattgctaagtagcattccactgtatggatacaacaaaatttgcttatgattttatttacttgttgatagacatttggagtggtcagtttgggcttattacaaataaagctgcaatgaatacttgtgtataagcctttatatgaacatacgctttcatttctcttgcataaatacctaggagtggaatgactgggtcatatggtagatgtatatttaactttaactgccaaactgtattgcagagtaactatatcatttttcattcctaccagcagtataggagatatgcatttcctccacatcctcattaacactcaggatggtcagttaattgtagccatttaagtaggtttgtacaggtattacattgtggtttgtatttccatttccctaatggtcagtaatattgggcatcttttcatgcttatttgccatcttcatgttttctttggtgaagtgtctattaaaatattttgcccagttttattaggattttacgttttctgattatagagttttgagagttatttttgtcttctggatacagtggaaataccatcctttctcttttttgtcatctctgcatttttatcagatgtctgttgtccatgtaagtagaggtttattttgagactgtccactttgggtcattgatctatacatctaactcaatgccagaaccacacttctttattagtgtaattttgatataagtttgagagtcagatagttctctacttttttcttattcaaacttgtttttgctactctaggtcaagggtcagcaattatatttttcctgtggagggacagagagttgatatttcagggcttgtaggccatatggtttcttttgtaagtactcagttctacacttgcagtgcaaaaaacagccataggcaatatgatatgactgtgtggctgtaaagctttatttacaaaagaaggcaacaagctggaagtataccgcaggtcatagtttgctggcatttgtgctaagtcctttgcatttccacattaactttagaatcatcttgctaacttatatatatttttaaaagcttgccaaaattttaattggctttccattaaacctgtagattaatttgggaggaattgacattttcacaatatagggttttccaaccaatgaacaagttatatctcattatttaatgaggtcttctttaatttttcacaacagtgttttacaattttacacatacctttggtcatatttatccccgagtatttcatattcttaattctattgtaaattgtatccttatttcatttcctgcttgtttgatgctactatacagaattgtaactggttttgtattttgttttgtactctgcaacattgcaatactcaattactggttctgatagttttttgggagagcatcagatgttctacatagaagattatgtgatccttggattaagacaataatattttttggctttctagctggatacattttttttcctgccttattgcattggctaaatctctagtaccatgttaagtagaaatgatgagagtggacatttctgtcctgttctcttctttagatggaaagcattcaatctttcattattaaatatgatgctagttttaggtttttccttcccatctgtcctgagtatgctaagagtttttaatcacaaatagatgctggattttctcagaagtttttctgcatctactgagatgaacataaggtttctcttttctagtctgttaatacaacaactacattgatagatttttaaaatgctaaatcaaaactacattcccagtacaaacccacttggtcatgatatattcatttttgagtttcattaaaattttctttagaattttcatatctatatttataaagcatattaatctgaatgatttttttccaccttatatctttgtatggttttggtaccaggacaatgctggccctaattgaatgagctacgaagtactccatcctcttcaattttgtgaaaaaattttaactagaaattcaatttctctaatagacacaggaacattcctaatttcaaggaatttctccatttcatctattttgctaaatatattggcataaatttgttcataatattttcttatcattcttttattgtctatggaatagtgatgtcatctccctcattcctgactttagcctcaaagggaaggagaatacaaatatttaaggaactgattaaaacttaagaaacatgaaataaaagagatgagaaataagtcttcctgaaggaatactacctgccccccatactgggtcggcattccttatcgcacttttcttaattgtgtttgtatagtctgggatgactagccatttaattcctgttttgtttccatagtgccagaacagggcacagtacctggcatataataggtgccaaaagttattcttctactgtgttactgtgttatgaatgaattagtgtagtcacttcccagattctggaagtttttctactattaagtttttatcctgaaggcaattaaaatccactgaggattttaaacaagtacatgacatgattagatttgaaatattacgtgtatatttagagaatgcaagggggtagacaaaaaaagactggggctagggagtcagtgaagaagctattggttatttaagcaatattcagggagtagaaattttagaatgggttggccaatgaccatcaacagtagagaataggggtattagatctagggattgagagaaaaatacagaacagattctcagaattatgatttggaagatttgttggagtgtggtgccattaagtaaattttaaaataatggtataatagaatgctttatatttcaaaatgacaggtgcccagtttgctacctatataaattggctctttgatgatttcatccctgcaatcatcctcagtgaggtcactataacttactcaaaaaggagttgagaaaagcataatatacttaggtttgtgataatgtttcattatcaggtatagcactgattcagccaaatcactacaattgatttatgtaagtgaattttgcaaaaagtgaaaaagccctttaaatatgaaatcttttggtattaatttttgtatagaaattgtgctaaaatgcatcacatacttccctaaagtattttcagattttgccagtcattctgagaatagatacaagcatcctcatttatccaattaataaattgagactcaaaaaggttgactgacatttctagtgtcaccgttttgaactgtcagtctgaaacccaagggtttttattctaaatctggcttctttcccccttgctaaactacctctatgtatattgtgatattatccagtaatgttctcttgaatatatggaaattaattataaagacaaaagaacaaccaaaagttaaaatatgacctgagaggctgaggaggcaagaggattgcttgggaccaggagtttaagattagcctaggcaacaaagcaagacccgtttctaaaatataaaacagaattggctgggtgtggtggcacacatctgtattcccagctactccagaggctgaggtgggaggactccttgagcccaggagtttgagaccagcctgggcgatatagcaagactctccatcaaaaaatgttaaaatacgaattctgataaactcatggcaaaggtaataacttatttccctggggcagcattttttcccataagttattggggtacaggtggtatttggttacatgagtaagtttagtggtttttggtgcacccatctcccgagcagtatacactgcaccatatttgtagtcttctatccctcgaccccctcccactcttccccccaagtccccaaagtccattgcatcattcttaagggcagcatttttcaatgaggaagtaaaacatggtgttatggagagaatatgagccttaaagtcaggtaaacttgggtttgaatttgggccctgctacatactgccagacacagtgtggtaatcaacaggatttcaacacatcaattttctcatctttagaatgaatctgttatctaactgataggattgttttaagtattaatatcttttgatgcataatttctagcatgaagcctggcactgttaaatgttagttttcctttcttccccatagtagagttgattttaggagcaaggattttagcttttgtatattacagccttactaaactaggtaactgcctggtggtatgaaggactttactaaccttggtaaaaataaaaaattaccatgcagtttggaagaactaagtacatagaccaaaaacaagaatcagtgttttcctgcttctacaaatccacagtttgactcttggcagtcagcctcaccaaggttgccccaccttaacaagtgatgccaaaaaaaaaaagttccaaaaggagaacaagacaactcagcattcggtacgtccattttccagatttatgtcaacaactagagaatatcatttggttttcttctaggatcaaaaagccattagcttctatgcagtatgtggtttttcactcactgcagatcttgtttaagcacattctcactctgaactgattaagtgctgcttgatttctggatggcagttgcttataagttataatatttcttagttataatagtttcttagttattgtgcagaatccacaatgatgcttaccttgcatacaagatgatgtttttatctgcagaagtcatctttgaccacactacccacagatctagagtaaaaagacaccacaaatggctgaaagtgtcaacataaataactatcaataaatgttaaggaatgtggcaaagcatttggcttcttgtgtcttcccaacctatcagagctaactatggctattattgtcaaaagtgatgctcccggtttagttatatacagtatttataaagtgcccatcaccatggtatctaaacacttgggcagtctaattaggctagtcaattacttgtgcaaaagtagaagaggtacccttccttatatcccactccactggaaccaatttgattgtgtttttaaaagcaagaaaagccttctgtgagaatagctttttaggccccttgttccaagatgaaaagactgtctgggtaaagaaatgactgtttcttattccttgaaggtgataatgttctgaatcaagcaactctccagtggtagaaaacaccacagcccagagatcttgattgagaacattttattcccttttcttttgaacttcactctgggggcaggtaacggaaaagtgctttctaaaagcagttcacctgcatgtgaattatttccaaagccttccttggtgagaaaactgtgttctctcctggcctcctgagtcagagaaagagtactcctcctcttcaggacatttaactgggtcagacctaaagcagaacttggtcacaaagacctcccttctgacttctattttggacagacatggacaaggtttctaagacaaagtttctggtgtgtgtgtgtgtgtgtgtgtgtgtgtgtgtgtgtgtgtaggagtgaggacatgttatccattagtaaaatcactaataaacatttttagaatttattgttgatcaaatactttaaaaaagctatttgtggccgagcgtggtggctcacgcctgtaatcccagcactttgggaggctgaggtgggcagatcgtgaggtcaggagatcgagaccatcctggctaacacggtgaaaccccctctctactaaaaatccaaaaaaattagccgggcgttgcggctggcgcttgtagtcccagctactccggaggctgaggcaggagaatagcgtgaaccctggaggcggagcttgcagtgagccgagatcgcgccactgcactccagcctgggcaacagagtgaggctccgcatcttaaaaacaaaacaaaacaaaaactgtttctgtacaaatgaaatactatgtttatgtgtttctgaggcaaactgaataccacgcttattcagaaaaatagtatgtcgctgatgtacacttcaggctaaagaacagttgtctttttgtactagcaagatttcttcctggaatttattatgaattcaatttgatatgaatctaatttacatgatatcttatttcataatgtttttcatagctatgcaaaaatcaagtcaacatggcctgtaatgtttcaaagtataatttaaaagttcagagaactagcattttaccttgaaaatgagtaaactattgttttgttctctagtcattccacctatgtctatcatatcgcttattgcttaattcagattttaaacagtcttattttcctgtcatttcttcatgtcacagtctctcccctcctgatttgatttgttgatttgtcattgatttgttcctattgtggccttgggacataatttcgagactttgttcagttcaaattatttcagtacctcagtccttctgattctgttccttcagtttggtgttcctgttttgtattcattccctgtcataacagttctctcctatctttcaatatacattttttgaaaacatccctatgcggccacatcagttccttcagtaactacttttctttctcatcagaatcatttgaaattgtaattcccagaatttcatcttttagagcactggattcctcttgagccatcttcctgtacagaaattcttaccaagggatcttaatttgttctctggccattaaaatgatggttgcaattattgaacatctacttcatgacaggaattttatgtgcattatcttgtttactctctaccactctcttataagctaggtttatcttcatcgtaccaatgtgaagactagagttcatagaagacatgtataggcagtaatggacagagcagggtagaacttcgggtgtatttgtatcaaaagcctatactcttaaccattatgttcatatcttgtatctcagaattaaactttcctaattattttctcctgtaaactactgagagacttccaattattcttatgttggtatcaagtactgtgtcagttggatagggtttagctgtaattgacagaaaatcaactcaaaagggtttaaggaaagaggcaattttttggctcatggaactagatatccagaggtagggtaaattacagggtttgttcatatggggattcaaagatggagatcacagactcaggcccatttttttttctgctctgccacctgtagagctggcttcatcctaatgctgattgcagcattgtggagaatgctcaccagtagcaacacaaaccatgtccttcctctgtcacttctggtaagagatagaggagggcatttttcaggaatctcaaacaaacacttcctttcacttaattgatttgacttctatcacgtgcccatttcttaatatagctaggaaatttccatttgagttaatcacagcttaatctcgaatcagggactgagttcggctaatgatgagtcctataatagatcactgaacaataccagaattctctttagaaagagaaggagaagaatagatgtaggatagacagtcaacagtatctcctgcccaactcactgactacctatcaagcacatgcacccttctgttcaacatttactttcacagccctcgtatctacttgaaaccactcactgctcatgcaacctcatacagctactcttccatatatgttccaaatatagctggcttcaaaaatcagaggtgtgatgtgacttttctatcttaacaatagctatccgccaccaaagcacttaaaatttgtaagtagggaaaaaagggataacaataactaaaatttctatttggtggggatctaatatgcggcatagggggtgatggacatgttaattactttacttgtggtaactattacacagtgtatacatttatcaaattatcacattgtgcagcttaaatatattcatctttattcattaaatttttttaaaaaaaattctatttggaaaagtgaggagcttatggtagtttgtgtgatattctgaccaagaagagtgtgtctttcatgccctggctgggtagtgatttcctgggtcagccagtctgatagctcttagttctactttctgaaagattcttaggtatccattgctttccacagtcacgggtgagaaaggaggacattctctagcagtatcccttccaagccactaccgccctaggggctagtggagacattaaggagttgtctgcccttcctaggcaggcatgggtttatgtggtaatacaggcccttttaaaaatttagaagacttctggtttgtttctagtctatttatcagctttcattagttctagaagtcttttgtgggaattctggaaatacccatgtcttagcaactagtttctgtgttctgcccatttctctggcacttggtttagtcaatgctttttatcttggagtttttttttcccccaagagaatttgaagtaataagtgggtgttcatcttaaggaaacatgctagaagtagccaccatgggccaacatcctgaattttgaatttttcctaccattgttcctaatctgtgggtagacacgtggtctgtgttccaaaatacaacagatgtgagtctcaaatgttttgctgccatgtgacaagaataattgcaaacttcatagactaggatgatggggtccttcatcccttccatgctaactcttccactcaaacttacctctctgtaaaacctattacttaaagtgtaccaatttgatctgttttttttaaattgtatcaatacattcctccttcctcctccacattctgtataattcttcaactgttgaatgtctttcctattctgtaatcccagaaattttaggagacaatgggaattccaattgcatttggggaaaagttgtttttgccgatactgctttcaagcagataccaacgttccatagtttttggcagaatttgggaaccaacaaagggaaatgtaccctaacagattaaagcagggttagtggtttaacctgtctaagaatcaaagggttggaaacaaggaagactttattttaaaatcgtaagaataagaatgaaccctaaaatgaacactttatgaattattaggagatcatttcaggaaattactcacttagcgacagacctgtgtaaaactcaatgaactgtacatgtgatggatctccactggggtcatcttgatttgagtaccagtatgataaattgaaaagtaagggctatgtgcttaaagaaaagattgggcttaccatacgtttccttgagataaatcttctcctaattaatgaccttttacctaggagtagaaacaacaaagagagtttgtgatggccagcaaataacacaaggctgtgtcctcattgtatctcatcccacgttctattagttttctattgctgttgtaacagattaccacaaacttagcaacttcttacagttctgtagtttagaagtctggcactggtctcactgggttaaaatcagagtgttcttagaactgtgtttctgtctgaaggctctagggagaacccatgttcttgccttttccagtttctagaggcctcccacattccctaaactgggaataaccagcttcctgcatcttcaaaaccagcaacgttgcatctctctgacattcttccattctcatgtctctcactgaccacaacaaggatttctttgcttttaaagaccaatgtgatcagatcaggcccaccccaataatccaggataatctcctcacctcaaagtccttaacttgatcacacttgcaaagtcccctttgccacgaagatagcattttcataggttccagagattaggatagggccatcatcattgaaggtctattattctgcctaccacgttaagtcgatataacattgcttacatgataaacacttgaaatgtgacattgtttttatatagattaataaaacaaagaatgttcaattaatgtcaattatgaatagagggagaaggaataaatgagagagacaagggtacaaaaaaagtatgtcttcttaaggagtatgtgttcttattaagaaaataagattttaaatgatgactccttgaaaataagtgctcgggaggagccaagatggccgaataggaacagctccagtctacagctcccagtgtgagcgacgcagaagacgggtgatttctgcatttccatctgaggtaccgggttcatctcactagggagtgccagacagtgggcacaggtcagtgggtgcgcacaccgtgcgtgagccgaagcagggtgaggcattgcctcacttgggaagcgcaaggggtcagggagttccctttccgagtcaaaggggtgacggacgcacctggaaaatcgggtcactcccacccgaatattacgcttttcggaccggcttaaaaaatggcgcaccacgagattatatcccgcacctggctcggagggtcctacgcccacagagtctcgctgattgctagcacagcagtctgagaccaaactgcaaggcggcagcgaggctgggggaggggcgcccgccattgcccaggcttgcttaggtaaacatagcagccgggaagctccaactgggtggagcccaccacagctcaagaaggcctgcctgcctctgtaggctccacctctgggggcagggcacagacaaacaaaaagcagtaacctctgcagacttaaatatgcctgtctgacagctttgaagagagcagtggttctcccagcatgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaagagaaaactggaaactctaaaacgcagagtgcctctcctcctccaaaggaacgcagttcctcaccagcaacggaacaaagctggatggagaatgactttgacgagccgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggaagtttagagaaaaaagaataaaaagaaatgagcaaagcctccaagaaatatgggactatgtgaaaagaccaactctacgtctgattggcgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatacccagccaaactaagcttcataagggaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaatgagcaaaatcaccagctaacatcataatgacaggatcaaattcacacataacaatattaactttaaatgtaaatggactaaattttccaattaaaagacacagactggcaaattggataaagagtcaagacccatcagtgtgctgtattcaggaaacccatctcatgtgcagagacacatataggctcaaaataaaaggatggaggaagatctaccaagcaaatggaaaacaaaaaaaggcaggggttgcaatcctagtctctgataaaacagactttaaaccaacaaagatcaaaagggacaaagaaggccattacataatggtaaagggatcaattcaacaagaagaactaacctaaatatatatgcacccaatacaggagcacccagattcataaagcaagtcctgagtgacctacaaagagatttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacaccacacctattccaaaattgaccacagagttggaagtaaagctctcctcagcaaacgtaaaagaacagagattacaacaaactatctctcagaccacagtgcaatcaaactagaactcaggattaggaatctcactcaaaaccgctcaactacatggaaactgaacaacctgctcctgaatgactactggatacataacgaaatgaaggcagaaataaagatgttctttgaaaccaacgagaacaaagacacaacataccagaatctctgggacacattcaaagcagtgtgtagagggaaatttatagcactaaatgcccacaagagaaagcagtaaagatccaaaattggcaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagacacaataaaaatgataaaggggatatcaccaccgatcccacagaaatacaaactaccatcagagaatactacaaacacctctactcaaataaaccagaaaatctagaagaaatggataaattcctcgacacatacaccatcccaagactaaaccaggaagaagttgaatctctgaatagaccaataacaggagctgaaattgtggcaataatcaatagtttaccaaccaaaaagagtccaggaccagatggattcacagccgaattctatcagaggtacaaggaggaactggtaccattccttctgaaactattccaatcaatagaaaaagagagaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcataaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaggcattcttatacaccaataacagacaaacagaaagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccaaccccatcaagctaccaatgactttcttcacagaattggaaaaaactactttaaagttcatatggaaccaaaaaagagcccacatccccaaggcaatcctaagccaaaagaacaaagctggaggcatcacactacctgacttcaaactatactacaagactacagtaaccaaaacagcatggtactggtaccaaaacagagatatagatcaatggaacagaacagagccctcagaaataatgccgcatgtctacaactatctgatctttgacaaacctgagaaaaacaagcaatggggaaaggattccctatttaataaatggtgctgggataactggctagccatatgtacaaagctgaaactgtatcgcttccttacaccttatacaaaaatcaattcaagatggattaaagccttaaaccttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcagaaagtgggctaaggacatgaacagagacttctcaaaagaagacatttatgcagccaaaaaacacatgaaaaaatgctcatcatcactggccatcagagaaatgcaaatctaaaccgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactatgaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtggtttgtagggacatggatgaaattggaaatcatcattctcagtaaactatctcaagaacaaaaaaccaaacaccgcatattctcactcataggtgggaattgaacaatgagatcacatggacacaggaaggggaatatcacactctggggactgtggtggggtcgggggaggggggagagatagcattgggagatatacctaatgctagatgacgagttagtgggtgcagcgcaccagcatggcacatgtatacacatgtaactaacctgaacaatgtgcacatgtaccctaaaacttaaagtataatttaaaaaaaattaaaaaaaaaaaaaaaaaaaaagaaaagaagtgctcaagggaagtttgttaatttaatctttgggaaaatgcaatttatcataatttgtgataacttattataaaatttcagaaaaaaaaatacactgatggcagggcacggtggctcccacctgtaatcccagcacttcaggaagccaaggtggattgcttgagctcaggagtttgaaaccagcctaggcaacgtggtgaaactctctctaccaaaaatacaaaaattagccaggcttggtggcatgtgcctgttgtgccatctactcaggaagctgagatggaaggatcacctgaacccaggaagttgaggctgcagcgagctatgtttgcaccactgcactccagcctgggtgacagagcaagaccctgtctcaaaaaatacatatataaaaatatattttttaaaaatacatatttttaaaaagagaaacatttaaaaaaaaaagttgaaggagaaagggttgaagcatgttttgtagatttagtaattttagaatgggaactaggtaacactgttcgcaaatctgaaatgaagtctaagtttcaaatctcataggatagaaagtactgtgtagatattcagatttatctggatcttgacaatatgttgatgtaacactcccatcacttcctaaagggttaccttactgccttgattctattttctttttttttttttcttttttgatcattgcattgttttcagcatacagagcaaagttaggcggcagctttcagctctgaatggctaatgaattgttcatctgtgtgtagaatctccctggtgcaagctctgtgtgagtctctattcctccctattcaaagatgacatcgtcaattgtggtgatcctacccatgtatgcagatccagctgaaaatacaaatgagagactagcattcctttctaaaacccatgctttaaactatgtcctttgtttgcaggtgcaattagctagtttgacaagcctgttatctgactcttcttttttatacagcctacatgaccatctcagtctaaataagtcaccccatttctttttctgcagttcatctgtcagttattttcttgtcttagagaagcctgaagttctgatatacttgtggttcaaatcactcttattgcaatcctttgatgagtaatttcagctttccatctgaagctaaatacatagacaattccaatgaaactcttcaagaattctccataaaatcaaggatctaggccacaaaattattctgatttataccacaaaatttggttccaataatatttcccaaagaggaaggatgggagaaaaattaaattcatttagaggtaaaatataatttaaaagaaatagtcttctctctataaaagaatcagaattttaattgttttttaacattggaattggtaaccaggttgaaagtctaaactatcaggcctcagacccctgagcttaaaccttaaaaccttaattatagctaacattgattgagcatttatggaccaggtgctaatctaagcacactaaaagtatccacttaaacttcacagcaaccctaggagatagatagtataattgtctctatttttcagataagaaaatttcaggtatagaaaacttatttaccttattcagctgcccagtagaaaggcttgtgttcaaacttcacctgtgtaatgtcaaagccagcttccttacccactgtactatattacctctcccatgtctcctattttgaggcatagttggacatgaatcacttacctataccaagatggaacccagtgaggaaagcacaaacttagatctaatgcctagaacagtgcctagagtacagcagattgaatgaattaatgaatgaacaaactaaacctcccatgttatggctcagacctttgaaggacagccacaagtataggtaccatgtggaaattttaaaaggtaatgatagcaacagccatggtttgttgaactacatttcctagttcacagatgacaccttctagctgtgtccccacaatgctggaaggggcaaggcagctctctggggcctctttcataaaggcactaatcccattacctaattaggtttcaacatacgaattttgaggaaacacaaacattcagatcctagaaaatatattttataatccagcaaaacacttgcctcagggtattctgctagtctgggaaaatgagagttctcagacctgaaggacagggagatggccacagggctccagtatggagggagccaggatatatctgatctgagaacaccaaaatggaggcaaaagggcaccaagtggaagtccagtgtatcatgctgaagttaagtttaggctgacacaagcaacaagggtagcatcctgttcaagctgtgtgtgcaaggcatgtagactagagtttcttaaatgcccattagtgcttaaggtaaaggcagacttcagacaccagggaggaattgagccccagtgtggcagtccatgaattaccatggaatagacagaagaggcttgaaaactctaagaatcagaccccatacagaaaagctcttgctgcttctcaacatcctctgagcaaacccacttctgctcccaaccacatttcagccacctttatttatatcttctacttttattcccctcataatgagaagacctcacctgtttctctgtatttctagtgctactgtattttttcctggtgtcaacgtattttctgtgtaaaacatgtatcttatattggaggttgagccaggccagatgacaaaatctgggtttgaagatcagcgagactgatgactcagacttttgcccagcaaaaaggcagtgcaaaggatgcggaagatcagggatctacctaagtgcactctgcccacccgtgccaattcttcacagcagcataccccatgttccagagtgttcgcagcctgacagagtaagggacccgataggtcactggagaccagaagcctctgttggcatcctgctctttgttcagccagtggtggtgaacacatcaccattcaaacccaccctaccaccttagaccaaatttctttttgtaccccagtaacatctacccaagtcctcattgtctcttattccatcatcaggtccactgcaggcaacagaacatgccctggcctgttaaatttacaggaaaactgtgttttatatgtaaaactatttctaagtatatattttaaggaaaataattgctttgcatattgtgggcttccaaacatgaacactttatctctgtttaatcagcaggtgaattgatgcactgaactgaggctaaacagcaggccaaggacaaagaaagctattggcagaaattactgaaaaagtactctcaggaatactcatttgttcttctggctttcattacactacacctcctttctatagttatattttctttaagaaaatctgctaatggcataccatctgagaaaatcatgtgtcagaaagctaaataacatagtctatgtaactagttgaacaacaattgaacattagtatgaacaaggttcatgcaatataatgcaatgaagacacagctttcggttttcttttgaaggggtccttttgcaaaattattattttgatttggtggttcaaaagttaggcttttttaattagttttttttttatatcgctgggggatttgcttctaggtatgcatgtatagtactctgagtatttctacttgagtggctgcctggaagagtagctccttagaatctgtcatgagcaatggctctttttgacacatcagaggagttagctaaagtgcatcattcttgatttaggagataattttgcctttggtgagaaaagtgaaggattattgatttgactaaagaacttcatctttatggacatcttagatgagattattttagatattgttttatctttgcaaaattttagtgtgattaagcaaataacacacttataggtgtccaattaaacaaatagtggcaaaaaaagtcattgcatttacttcaggaatgatctttagttgggtcattattattgaacatgaaaaatgacctacagctgtactgtaccttcagttcgttttgctggaggtactttcatgaaatccagttacccatcatttatccctatctatctctgtataatctttaaagatgtcattatgcagcatattcaactgtctcctaacacattatttgtaaagtttttgattgtctttatgtattcctttaaatataatgtagcatatccatataggtagcttcataacagttgcttaatgtgaattccagcctgcactatcctcttataagctgaagataagagaattgtcattcttgatctattcaggttccataataggaactttacagaaggttttatgtataaaacagacaaatagtgtgtacttggtgctatgaaatgcccattgttaataaattttagaaacatatcagtaattataacttaggtcctgtcatgcctgctttaataaaaagaatattttacctacataaaggtagatgaattacattatttggaacaaattggtagattttcacttcaagagaggtataaaatatagagagagtcattaaggtctggtaaaagtaaagcactgagatatagtattaggcagacttatctgaggtgggcttcagtgtaaactgaggttctcagatatgaaaaaaaatctaagtggaacataaaaacacacataaatgacagacaaaaacccataaagtggctcattgttagaatacaaagaactatcacaattcatggatgtaaagagcccaactatgagacaaatgcccataaacgcataatagaaaactcaaatgatgttaactaatggatgtcactacagatattttgtgatacattttatcacataatatctgtgataaattttgattccaaaatttagcaaaaccgcactcgagttaaactggttcaatttaataaaaagtggcagaaactaaactcaggtccactgatacatgtaaaatggaagtctggcccaaaaagacagtccagtatgagactgggccttcctccacttgccttggaaccttgtcacactctagtttgagaataagttaaataaaatgaatttccacattatttgctttgccgatggtagagatatccaaagacaatggtaaagcacataatttagagttgattgaaactatagtttgaataagcaagcaaatcaagaagttactgagacacaacaattttgcattcctgtactttcaagaattactgaaaagttgagttaaaaaaatatgtcagaaaggaagtatttacttctctccataatagagtgtctgctaataaactttccctcctattctaaagagctatgaaattggacacaatataagaggcattaagaattatacagaaaaattaagaaaagggaaccacacaatacgagccccatgattgtgccagctttccacctgggcacacttgatgctacagcatggggaagattcaatattggtaataaattaaaaaaaagaaaaccttgattcttactttacaacatatacagcgtttgagattacttaaaggtaatattcaattctatatagcatctagaaaacaaacagagtgtagactacctttgagacctaagaagtacgcagagacacagaaagcacgtttatgggcataacacaatcttttttttagacggagtctcactctgtcacccaggctagagtgcagtagcatgagctcggctcactgcaacctccgcctcctgggttcaagcaattctccttcctcagcctaccaagtagctgggattacaggagtgtgccaccacgcccagccaatttttatatttttagtagagacagggtttcatcatgttggccaggctggtctcgaacccctgacctccagtgatatacctgccttggcatcccaaagtgctgggattacaggtgtgagccaccacacccggcctaccacaatcttaatgtaaaaatataaattggattttacaaagtcaccattaaaaaaaatgaaaaggcaagccttaagttgggagaaaatgttcatagcacaaatatctgataaaggccttatattgtgtgtgtgtgtgtgtgtgtgtgtgtgtgtgtgtgtatatatatatatatatatatatataaacaactcctgcaaattcataagacaaagtcaaacaaccctatacaaatggggaaaagaataatagtccttcagaaagaagatacacaaatgatcgatgaacacatgaaaagtttcttgatattaaaagtcaccagtggataaaaattaaaatcccaatgggatatgagtttatacccaccaaaaaggctaaaattaaaaagactattaatgtgaaatattggtgaaaataatgagcaactggaactcttgtacattgctgatgagagtataaaatggtacaatcattttagaaaagcatttgtaagtgtcttaaaaattgaacatgctcctaatccatgaccccaaaatccttctcctaattgtatactcaagagcaatgaaaacatttgtcaaccaaaatgacttgtaccagaatccacaagcttttttcctcatagccaaaaactgaaaaatgactcataagctcatcaaaagggagatttgtcaacaaattacacagagcactcaaaaataaggaactgcctctattgactacaatatggatgaatcgttaaaattttttcttgagctaaagaatccagacacaaaagagtatatacctacattattccgtttataaaacattcaagaataagtgaaattaatctatgactaaaatcagaacaatagttgcatatgagggagatggagattgactggaaagatgtatgcaggaaatttcagggtgagaaaaatgtcctgtaactcgactactgttggttatgtgagggcctacatttatcaaaacttacaggcatacctcagagagattgtggggtcaatttcagactaccccaataaagtgaatattgcaacaaagtgagtcatacgaattttttggtttcccagtgcatataagaggtacgtttatactatactgtagtccattaagtatgcaatagcgttatgtttacgaaaacaatgtacaggccttgattttaaaatgcgttagtgctaaaaatgctaatggttatctgagacttcagtgagtcataatcttttcgctggtggagggtcttgcctccatgttaatggtcgctgactgatcagggtggggggttgctgaaggttggggtaattgtgacaattacttaaaataagacaacaaatagatttgccacatcatgggcccttcctttcacaaaaaattgctctagcgtgcagtgccgcttgatagcattttacccacagtagaactgctttcaaaatgggagtcaatcctctcaaactctgccactgctttatcaaccaagtgtatgtaatattctaaatcatttgttgttatttccacagttttcacagtatcttcaccaggggagattccatctcaagaaaccactttctttctcaaccattaaagttttgtcatgagatttgagcaaattagtcatttatcttcaggctctacttctagttttagttctcttgctagttccaccacatctacagtcacttcctccactgaagtcttaactcctcaaagtcatccatgagaattggaatcaacctcttccaagctcctgttaatgttgctattttgcccttctgcctatgaatcatgaatgttcttaatggcatctaggatggtaaatcctttcaataaggctttcaatttacttcgcccacattcatcagagggctcattctctatggcagccatagccttataaaatgtatttcttaaataatcagacttgaaagtgaaaattactccttgatccatgggctgcagaatgtatattgtgttagcaggcatgaaagcaacattggtctccttgtacacctccattagagcggtaatacattgacagtgatctgcttctctgagcagtaggactcaacagagggcttcaacattctgtaaaccatgctacgaacagatatgctgtcatccaggctttgttgttgaatttatggaacacaggcagattagatttaacataatttggaagggccctaggatttttggaatggtaaatgagcactggcttcaacttaaagtcaccagctgcattaacccctaacaaagagagccagcctgtcctttgaagctgtgaagctaggcattgacttctcttgtctagctatgagagttctcaatagtatcttctaacataacacgtttcatctccatttaaaatttattgtttagtgtaaccaccatcatcaagtatgttagctaggtcttctggataacttgctgcatcttctacatcagcacttgctgcttcaccttccacttttacattgtagagacagctttctttttaaaacctcatgaagcaacctctgctagcttcaaacttttcttctgcaactttctcacctctctcagcattcattgcaattgaagagagttagggtcctgctatggattatgctttggcttaagggaatgttgtggctgctttgatcttctatcgagcccactcaaattttcttcatatcatcaagaagtctgttttgctttcttatcattcatgtgttcactggagtagcacttttaatttccttcaagaacttttctcctttgcattcacaacttggctaattctttggcacaagcaacctagcttttggcccatcttggctttcaatatgccttcctcactaagctcaatcctgttctgcttttgatttgatttaaaggaaaagaggcatgcacctctttctttgacttgaaccacttagaggtcattgtaggttttttcattggcctaattttaatattgctatgctgcagggaacagggaggcctgagaagagagagagacaagagaatgacccattagtggagcagtcagaacacatgcatttattaagtttgctatctcatatgggcgcagtttgtggcatcccaaaacaattacaacagtaacatccaagatcactaaacacagatcactataacagataaaataataatgaaaaagtttgaaatactgcaagaattaccaaaatgtgacacagagacacaaaatgggcacatactactgggaaaaaggtgccaacagacttgctcaaccaaagttgtcacagaccttcaatttgaaaaacaaacaaacaaaaaaaccctcaatatctgcaaaatctgcaaagtgcaataaagcaaggtatagtcaaatgatgtgtgcctataattaaattgtatatttaagatttgtgcatttcagtgtctgattaccacctcaattttacttcaaaaaaaggaagtgattgaaagaccatttatggtatgtttcagtttgtgttattgtgttttgatcatacatggttccagtactcatcccattcattgtgaatcttcatggttccagtaattctaatattgacccagagtgccagttaattaggcttaaagcaaaagagatgaaatagggaattcagacctgatgagcttgctcagggatttatgtgtggtgaacagcaagtgttttggaatacatggttagtgtatctgttaactgaaccatgaatggaaccatggaatgtgtattgtttatcttttgacattggtgtagggaataaaacaagactccttggttgttggaaccctcacccctacttgcatacggcttttctggattttcccagaaagatatatttttcttcctcaagtacccacagaaatttgtaccatttttctgtgccttgcattttaattatatctgtgtcatatcacccctcctagttggtgtggctaaaaggctaaactctgctcactatctctgccacccatagcacctataacattctttaatttagatcaagtacttgttgaaagttttaaatatttgatggatttgatttgattggactggatgaaataacctttgtatttaatggaaccacagaccaggaatttgaggaattgaattcatttgtgccttcatataatgaagttattgagtacttatcacatgcaagacactgagctaagaaatcttaaaactcaaagatacataatatgtagtacctgcatgcaaaattctaccagtctgatagggaaaagacaatgtgtataactgatacacaataaaaggcagaaagtcatgtgaaaaaagagaggaagagaggctttcttatgaaaatccaaaagaggtcaggtgcggtagctcatgcctgtaatcccagtactttgggaggccaaggcgggcagatcacttgagcccaggagtccaagaccagcctgggccacatggcaaaaccctgtgtctattatacaaaaacataagaattagccaggcatggtggtgcatgactgtaatccagctacttgggaggctgagataggagaatcacctgagcctggggggatggaggctgcagtgagctgtgatcatgccactacattccagcctggctgacagagcaagaccccgtctccgaaagaaaaaggaaagaaagagagaagaaccaaaagaggaagaatatctttgcctctatttacactttgaaacccttactttcttttagaccaagcttaactcctatttggagtatgcatcttgagaaagccaaaataaatactagcaagtagtttttgaaattttcttgtcaataaaaagtcaagaaaaaacaaacattccttagaggggaatattcagtattccttctagaattataagtgaatgggaagtgatgccaacagttccaaccaagtttgttcctttcttcctcacaacagcgagcattagcctgtgagaagccctggtttctaatttcatctctgcccaaaactacataggtgtcctggtcaattcacttaattcctctgcatcatagtttttacatccataaaattagagaagagaacagaatgttttccaaggtctactccaactctaaaaatgtcatgattctatattctgtggctctgtgatcctaattacttttgataagatcatttatgtgattttggggattggaaagagattgtcaagtttcccaaacttcattgatccatatgctaacttcactgattgtattttcagtagtatcgatgttaattatttttcctaaaagcaaatgacttttatacttaaatatatttagctttatcctaagcaataatatctatgaaagcatacattttttagtgttacttatggttttttaaatatgcattaaactaaataaccattaaatttgtctcttatgccaccaataacatatatgtattctactttaagaaacactgctttgctgtagtaagtaggaaagtctgatccaatatctttgctagttgattagaaaagtcaatcataaatgctatcagaataggtcaacctatatgcaccagtatccacaaaggctaaaaaaaaaaaatatgctgcactcaaccagaatcttcaaaaatcctgggattcggctcttaagtgggtttgtgcattacctggaaaacaatttgcaaaacagatttttaaagttcagagtaaattggagaaagggctacattacatttgaaccttaataaatacttaataacccataagacaaatagccatgaattactagaatgatttcaagcacagtgcttctgcagagtcaacctgctcttatttttgctcattataaaacaggagttataatattgcaaagtttattagctctgttgatttgtgtgttttataaaacaagacatttgaataatatagaaccagagccattaggaaaatctatttcctttttcttctctatctagtctcctctgcccaagatagcttgaaaatgtctttctcgtagaaacagaaaagcatgaagattcctccaactctgtccttttttatagatgttgtttatttcttgaatgagggggtgcgtgtgtgcgtgtgtgtgtgtgtgtgtgtgtgtgtgtgtatgtgtgtgtgtgcaagcttaggtcctcaggtggaaccgtggttcctgtgctttcgtcctcgaagctgtttttctggaagggaatggaggcagctgtgtttacagctcaagtcttggcatacatttaccagaatctattattcatatcattcagtatcagggagagatctcaggccacctgtctatctgacaaattcacccttttgtgagctttctgttcatagcaaattatgttcacattgatgaattgagtttttatgagcattgctaactaacattctcacagaaggccaggggcaagagcctgcaagtgtttctggtccataagtaaatgattaaaaaaaaaaaaaaaaaaaaaaaaaaaaaaggaaaaaaatggtagtgtttaaagacaatttgccatggaggaatagttaaatcatttggcaatgccttaatatttataattccaagactttccataaattattgcaaatactcagcttataacaaacaaaaacatggaaaaaatccacacaatatttttctctgtagcacagaatattattgaaaaattgttctgcattttgacaggtaaccattgaccagggcaaaacatggggtagttgaagaatgcccagcattaataaatctagcaattttatacaataatgtggaaaacttgcagcaattgtagcttaaattccagcttggtatttccatagatacaaaatggatttccttttaatctctagtaaccctatactggttatggagctaagccatgtggcttgagttaaataaatgagagcaatctttcacaaaaggctaacagaaatccttctaaatggtgggtggggagatacccagtgttcatgacagaaataaaaattttctttggtttacatgtagaattggttcttctcttgggcctccatggcccttgcatttaccctgactcttagtctgcatttcatttaaaacagctgaaaaagagaaggtggtttcaccagagagacacgttctagttttcctgtacccacatttcaaagcgctaattccaaatctccttaaaatgataagcctgcataggtggcagagccactagtcagtatatatttacataaaaagcaacaaaacagaaattttacagggcagtgagtaatattatcaataaaaatccatgacttctcagttcactcaagaactgtgatcctatcctcccaaaagacagattactacctttgataagggacaatcctattctctgaaatcttagtgaaagtcagtagaaaattctaaatctcttcatagtagcctgccaaaatgtgtcagacacatcacctttcagtgcaaagacaccatagcacaaagaacacttggcattatcccttgaaaatgcacacctttcgaaggagcaaatgggaagtgtagtctgttaaacaccatatgtgatggagctgcaccagtctcatttccccttccaaacgctacaagctgctacctcattgtggtgtgtgtgactctagggggaaatcagtgacagctgagtgtctacctggtcccaatgtcagttggcttgttgaccacttaagtatgcagttcaatgtgatactatgctttagtgacctctgagaaatagaatccctgggcctttatgttaatttagtagcgtatgtgaaacttttgcaaactttccagtagctgcccttgccttcagatttgtgggtaaaatgaggagactggatttgcagtccttaaagtatggaaagatgcagacgggcaaatttctttgaaaatttgtcttgacatttccttccagtcctaaaactactatggataaatgcttctgttttattaaaaataaatttgtggagagtcatggccataaaagtcttcatcacaggtttgatcggaattttctgtggtaagcatagcgaccattcatccagattctctataaatagttcagtttccatatagttcttccttttatccaaccgtatgttcctatttttgttcagacaatatggtcaatgaggctttaaggcaacaggaccaatttacctgcaagaatttttcactctaagattacagaaattaacacaggagatagaaatcgaggtgttttgtctctaagcaagcaatttgagataaagaatgcattctttggtgccagaggcatggcaagcagcactctgcagcttggtgccctattcatagtgtcaagcagctacaggaccaccattttgctccttgaaactgctacagcattttaagtaatgctagaaggctaaaagttgactgcagctagtagagcattgttctttttttaacccatgtgataggtatcttcagcagtgtcaaacaaatttgtagagctggtgattagttgcccaaagagcataatgtatgcattattaattaaagaaggtaagtttggctaattgtcatttctatacagtagcagtgcactaagatacattttaacaatctataaataattgataattttttttctttcatcttccttcctagtttgcataaaactaatgacttggtaaatgttactctcttcaaaatattccaccgcttctatgaaaattaaactaacgctgtaaccttagcaaataaggagatttttttttttccttttattgcaggttaaaaaaagataggaattataacacttaaaacaaaaatgtgattctgtggaaagccaaatgagaatcataaataatataaaatcagcaatgaatgtgactttaagaaatagaattgactttaaaaatgtgaaaatgcaaaaacatgattacatatatacatatatacacatatgtatgtgtgtgcatgtgtatacacacacatgcacagatatatatatatgtacacgcacacacacattccagcagccccaaagtcttgcttgttcagctttcaaaagcctaaaactacaaccaaaagctttgctccaggatatcttccaagtctggtgctggtgtttcagtacttaccaatagctacatgaataatccttcaatctcattagcagaggacacaaaatttttctcagctgaagtatttgagtttacttcctatatactttgctaatttgatcatagcacctagatggatccttatgagaagagatttactgcagcaaacctacccacttctcctttttcgcaggagttctctgttattcttacgaatccacaatctgccagtctggtgtaatagcacaagagcttgcttactctctaattttcagtgcaactgaatacattcccggagttattgatggcactgtaattttacgtttattttgtttggaatacattgtggttaaaaaaagatttctttaagaagacccacaaactaaagtattgcctaagtgacatattgttatttaagccttcgtcgagtcttacatatgcttcattatgataaaaaacaggttgtaaggactgattctgtgacctttttttctcattttaaccctactgatatgtcacccatggcaaccttaaactgattttaatagagtcgatcctattattcatttaaattgaggtgcaagagcacttagaccagggaaatttgcattcagcaaatggggatttgatgagcaaaaatgataagatatatgttgtataacatggcctattttgctagcaaataaacagctcttgaaattgataaacttcagaatattttatcctcaaatgtttatacataaatgattaaaatgcattagcaattctgcttttgaaaaaaaaacatattgggaaaacaacacagttgtgttgcttaaatttgtaattaacaaatttattactaattctgttcagttctttaatatgctgcattcctgaagaagaacattaatacacaatggcagaaagaagctaattttaagactttggagaaatgaatgtcttttaatgctgtgtgtttctcttatctacatgccacattattgtaataagtacattcaggaataatttcttttcaaatatttttacaaatcttgctcttatttgcatgcaagtaagttgtcagcttaaatctttgaaatgcaaaatatatctcatttctatatttcatcaaggagcctttcatgtttaataaattacaacttagatcctccaagactttgtttttcattaactaaaagcaaaaggatacatttaaaatcttaatcacaacctgcaagggtatttgcatgttgctgatatttgtcttgatgggacttttaatatttgcaaactaatcaggatagcaaggttataccaataatttctgaagacaaaaaactttctgcattattttattatattgaagaagaaaacttaaaaaaaaattccagtgtcttagcctcaataatctgtacacttttttgcacacatttatctcctaaagattttaattggacaaatggccacatctcagaagcactattgaaaaatgtgtacaagaatgtcacatctgggttcagtctagtcttttattagtgcttgatcagcatgtattggacagaatcgttaacacaaaacaagcaaggtaaatcatccactacacactaccaccctgataaccaccttgtgccactgaataaaaatgtggatccaggagaaatcaaaggacatccttcactcatttgatttgattccagtttagacagggggttaagggtgtttctgcttttttggggttttagtggttctttttagtttaaccaaataccctagctgatcttgcagaaagtcttctggactctgaaataggatggatcatctcatctcagcaaaaacaaaaaaaaaaatcttgacagcataatatccttattggggggtcccatgggccacagcaatacaatgtcacagaagaggcaaacttctgctgaacttgctgcccagagaccttcagttaatctttctctctagaatggaagatcaaaaaaccccgagcagcttaaaaaatatgcagctaatgtcatgtagttaaactgatgtagcatgcatgttgttttgcaagctaaccggttaaatatggctttgctttaagattcccatcaaatttcgtttttatagagaaatctctgaaagcagtaggggttgagggaaggtgaggtaaaaagaaataaatcattgtagtctcaggaacagtaatccttgttgaggattttggctgattgatataaataacatcgtccccgccatctgtccgaagagagacctttccagtcagtgttaagctgcaacggcagaataattaatgaatggtgtcctttgtgctggtaataaagacaagacaaattatgttataatccaactgctgctcatttgtcacagccaaataaaatgtcaaataaaagtgaggggggcactgtgtttgtttaatggactgcaagctacctgtttctgttgttgacagacaactagaatgtaagttttgaatgttgcaggaaagcaaacctccacaccgaagtcgcatttgctcgggagaggggggtgggcttgtagggtgaccatgggggaggcctaacacatcaacattgaagtaagttttaattagagagctataataccaccggctcctctgagtaagttggttgtgattacagtgcagaagcactgcctggaaagtccaagttcaaaacacagtcgagctatttgcaaatctgtaagaatttggtagggctctcatcttgcattttcaggatagacacattcatccagttgctaggaaagccaaataatgaaaacatagctgggatttagcaagttccattgggaattacctatgatagagggcagggctgcacttcctcagaacatgctcctgctgtaaaaattcacaaacctggcattcatacaggcatctgtcgcttgctctaatgccagttcatagtatacatacaaacatctgcttccgtgcacaaagggatacagagcgcttgacaggtctgtgttagcagggttcgcaatgccagttctttatgcaaaaaccctaatgcttcccgtcaagccattagaagtgatacaatcagcccaggccccattaagccatcagtgtccacctgtgataaagatggccatttgttttcttaaagcccacttaatgtctgcttaactcaatttgtcaggaaatgtagaacaatttcctcacagcctgaaatttggtagtggttcaaagtcaaaaggccaggtctagtcctattcaaatgatataataaacagtcttcaaatcgaaatctctcttgagaagctgatgtttactttaaaaaaaaaattatgttagctggaaaagaataacatttgtgtccagtattattattttttatttctaaagtcctggaatatgtctaccagtgaaaaggtccattgcttgattgtatgagaaaataattttattctctttacaaattcagccagaaattggatgtagaaaaatgaaagagggcctggcgcggtagctcacgcctgtaatcccagcattttgggaggccgaggcaggcagatcacgaggtcaggagtttgagaccagcctgaccaacatggtgaaacccctctctactaaaaatacaaaaattagctgggtggaggctattcaggaggctgaggtggagaatcgcttgaaccctggaggtggaggttgcagggaaccaagattgcaccactgcactccaccctgggtgacagagcgagactctgtctcaaaaaaaaaaaaaaaaaaaaaaaaaaaaaaaaagcccttgcaaagcactactctcaatatagcaatcactcccaacccctaaggaatcccactgtaatatgcacacatttactttttagtctaattctatttaaaatatttcccaccttgcttacatttgttggagattagtattgtctttttatatcccttaaaagtgaaaattaaatgactgtttttgaacatattttattgtgaaaatggtataaatgccatatagaggcttactttgcccccatctcaaatcacttttaatcacagggccaatttcctgtgcttaaatgtgtctggtcagaaaggaatccgaagacacttctaagattaaccaacagggggctctcttaaatattccagatacactgacgtcctactgtttcaaattagtggtccatacaaatctaacaccaattttgacttaaaactgagccaaaaaccttaattcttgtttgtccaacaacttctgcattcaaaatatttaacttctggttccttgtgttcccgtggactagaactgggagctatcaatgttaattctaaagaatattttctcagctcattttgcacataaggtacactgaagaattgagtcaactgtctggactagttgatcgacagatattaaatgggcatctaatacttgtagaacaattgaggcaaaattaaagtttagggatatgaatcagctgggtaactatcttatttctctacttttctctgcaagtagagaaaactttaacggacctatttttcttaaagaaaagagggattgatatggcttaaaggctcaggtatgagaaaaaatgtgtgtttcaatacaaatattttgaaatgaacagctgactattttcttacttagaaatgttactgtgacttctcatccatgaactagtgttatgtgtataggttttattttccactctttggaggctcagtccaataagcaatacaattccctaagaaaggatttgattgaggaagagccagaaattagaatatgaaactagaatatatttacatacatggcactgcagggtccttagtcctccttcagactgcaaatatatagtctaaaggcattttatatcttctgtactctctctgcaagtgcccctacgcccaataacttcacccaggagaagatagtggcaaactcagactttgctttcttgattctagaatatattcactaaataaaaggttaactgcaacagaaatacctagaggaaagtctagcacacaattttccctgaagtgatttgatctgtgcaaatagtttatctttcttttggcatagaccaaactaaacgttatcattttaccaacacagagaattacttttattatcaaaataacacaaactcattattgaaaatgtggaaaataaattttaaaaatgaaaaaagaatccatactcctattatttaagcataacttatcagttaatattttggtatattcctaccagtctttttaattaactgcttagcaaaattatatggtatctaaacaattgtacaaaattatttttaaattgcttctttttacagattaaaaaataataaatatttattgaagttaacttgaaatttacagaaaagtgaaaagaaaaattactctaacaataaccatgttttggggctatttcctttgacatgttcattctgcatttgttttatcctagcctgcttaattttaaaacatgtgtaacataggaaaattcatatgtaatacctaattgcttgattttctagtttttatcactttaatagccctccactcagttttttcaataccattattatagatacaaagcaggtttaccaagtattcctacgaagagaagtaaacattatgccactctctgcagctttgatatttttgaaaggaataaaaaacttgtttagtatctctccagagcaatgttccaatgttgttttctagcaaactccagaatgaacagcaccagtcattgttttaaataatcatcaaatgcccccagagctttcacctgaaccatcaagggtggaccacaagaaaggcatttcctgtcaccaagagctaagtggaagccagagagaagtaatccaaggaggcctttggagttttagatccaaattaagtaaagaagatgcttagttttgtttacagtgtctctattcttgagttgtaaattttgattcatcacttagtagaattacataagccttcacgtaaacttttcaagaaagctgtcctattataaatctttgcatacatgagaatgtctttgttattttaacatgcaaaagacaattttgagtatgcacacaatttgagggccacaatttctttcctataaattcaaaagatactgccttgttttcttttaggatttagtgagaaaagtgttaggaaagactaaatgtttatttttttagtcttctttttctctgaatatttgtagaatgatgctctatccttgccatttgaaagttttgccagaatatatcaagatagtataccacctcgataatattttcttagaacctcactgtcattttcaatattgaggtagttttttaactcacaggagttttcttaattttgtgcttgacttgcatatttttcaaatgttctggtttcttcctcaagtatacttataagctgtagataatctcttcattctttgacttccaacatgtcttctttctcatcattttttatgtctccatattctgggaaaacttctctggtttgtcatccgtatcacaaacctaatttttctggagtaacaatttgaacttcagtgcaaaatttaattttgttttgcatttttagttttcacactgtccttcctcaaatcatctatataattgtcatcttattctagtgatcttttcatcttccctgtcctctcctatggcttgctgatccttctcattccactccctgtgtcaaattttattagagatactaagtagcttcttaattgtctagcagttactgtaagagttctaagctttttatgagcattgttctctgagttctttcataggtcaaacgttgttggaaattttgttatgtttactcatctcaaaatgtagaaatgtatgcaacattctatgcacactgatttttaccctctgcttcagctccagccttagcattttgtcttgaagctatactcaaatggcaaatttataatcacagctcttacattaattcttatctagcatacttgttctcttaaggcactagtatcctgacatcgaattttctcccaccctaattccttgactctgtggcactctaaaagataaagtgcataaagcattagaattccaagaatttcttcctaaagaattttgccagtctccaccctttcttccctttatgttttacatatgggactacacaattcctatggggatatgtgccattatcaggactttccttctgccttctacctacaatatcctcagttatacttcatggaaattgctatctttaaatgatcccagtatgaagagaagtcttgatgtgtagcttagaaaggaaggcgactggtgagaaggggcagaagggaagcattcacactacttctaaacagcattaactgtgtaggaaaaagctgcccagttttttggttggcataggcctggaggctttgattctaaaaatcagacacttgaagaaatataaggatgcttctatctgctttcaggaaggcagactctctggttcagtacttcaatagctcatgcaccactggcactttccaattaagaccaacatgtcttcgagtaagttattcttaaatttttgtcactatgttactctcagtccctgtttaaattattataagaattctattatgttttctttgctttgaagcaaatttagtgacaagtttcaagaggtggttaggtgttgccaaccagatgccatttaaaaccaaaagtcatgatttgcatcagctctttgcagagggcatcacactgaaagtttgcaatcaaattcttccttggggtgtgacctctgcctatggctacttctttacagttgctgttgcgtctttacctggaaatgataacgggccccagaggggaatgtttatttttagtcctgccatttacaagggcctttgagcttctaagaagatgcttagagttacaaaatgtaaatcaatcatttcattgtaatgatagatttcagagtattattttttccatttggggaaattttttttcactatctaaaccacaccttggttctttataaaaagaattttggattttacatcatagaaaaaaaagtttctcttggcttgacttgctggtaaggaggtgtgcgaatggtctcaagttatacatttgcagagaaaataccatccagatgctcaagtcagccttttttttggcagacagctaaaaaccataccaaaactgagtctcaagtctttaacaaaagaattccaaaagctcttacctttggaacggacattaattaaaagaagcagtcatatcccccgtgatcagagtttaactgctattaatcagagttcatcacacaattaacactttgaactgattagcaaatgaaattatagcaagaaatgttgaggttaggacagcggacggacgtactctcttgcccaactcacagtccctcatcttttaaaagaagggaaaaaaaatgaagcactctggtcataacgaattgtgcagattttgttttcagtgaggtgtttgccattacatattgcacataatgtatggcactgttaggaggaaaaaattggagtcaaagtggctggaaagttaggtctgctctgtagcactgtgagattgttgacatctgccgaggttggagcgctcagtaagcaggaaatggggtgtcactctgagtggtagtttaccattatcctggcatcctaatgaagtgtctgcagtgcacagagcttctggatggcatcttaacgcacggctaagcaaaagcacttctctccctgtcactgtcatccatctgcctgcaccctactgtagccaatgggatggaaccatgctacaatgtgctataagccatttagagttgcacattgcataatcagtcccatcaaatatgtaaaaaatggctattattggttattctcctcaaactggcacctggagtttgatacatgaaagttcaactttttcaagtactgtttctgctattaattccactccccccaacacattatctaaatgggaatgagttgcatcttcattgtcttaaggcttattaatggattgaaagtgttgtatgaatattcattaataatttcactgtacatcacacttggagaattcatcaatttacaatataatggaatggtcattttctttgtgataaccatttttaagaaaaggacaactcccattgcagattggctgttttcatcttagttggcagggagagtttgaggtcgttcaataggttttctttttaaagacatagagcacttcaccaagtacatttgaattttaagctattattgccaatgccagatgatggaatttggtgttttaatattacctccgatgaaattaaaatgcagtgcaaaagaggatatctgttgttaggtgacagaagtagagcagggtgtgtgtgtaatcctcccgaaacttctggataggttttgcaagcaaggctgcaaagcagctagactctcatggtaagaattgaagtagtaagatggtcacaaagttgaggaggagctttctgtaataggcaggggcaacaataatctgctaaattggggcaggggggcagggagggtagggttagataaataaaagggcataacataatttggttgcatcaggaattttttcacagacattaaaactatggtaaacataacagcggggaagcttgcactgccgcacagtgggaagcttaaagcgtctgcctgcactgtgcctggctcaactacagctagaagtctccgactttcattagcactcaacaattcacccagttccccagaaaaggaggaaacccaaggcagcaaagcccctcgctaattattgtaaatgctcccaggttacagtatttgggtgacaataatggcaagagggtgtgaaactagaaccaaagagtcattctgaaatgaaaaagaatgaaggagttgtttgttgcttgttatttttatttgttttaaaccagtgtagcccttcgtttgatgggtaaagcagtatgttggaatattaggccaccattttacaatgaaattttagaagactgcaccaaattgtgtgcaacttcttttgagcaacggaagtacaggttaatttcacaaatgacctcctccccttggcctccaaatttatgtgagtatatttcacaagtctctgcaacagaaactgtttcctttgaaggaaatttgtaataatacaaaaaattacatggaaccaaatgttgcaaggtaggcagactaacacacatcactgcaagatactgcacctcaggttaaagttgatatttttttccccttcaagaatggagtcatttgagaaaaatattggacttcttcaaaggaagaggggtctactttggatgcctgtaagcatttaaagtgatagtttttttttaatggaatgataggtgtttattcttgctaaatccagactcgggaatctggtttcttcattcatatccccccagctgctgtcagcaatgcagcacaccagcgttccttcatgtgcgaatatttctccagcactcatttgcaagagagtcgaagcaatattaaacaccacatctaaacctcttttaaacacacaaagcaatgggaaaacacatcagaactagaccattgagaaaatcctcctttcaaatttactgtttgcttcacatgctagtataaaatatcccacaaagtcccgtttgtgatccatttgaaacaatcttgatttgcttaaattgtcacattcttcttgcacatttctttctaaatgcaaaaatggcaaagaattctactccctcttcattataaaagtacagaatttctggcttgtttattcctaatggaacacttgagaaagaagaaaatatataaatatctttttcagaagattagttgtctcaatctttttaaaagggaggatttgttcattttttctccatggtaaacaacttgggctttgcactgtaattttccattgtcaaattaatgcatttcattttactgacttgaactcatggttttaaaacatcagaccttttaatatctttatttcttccatactacgtattaatgtatgtcattaggacgttgatagttagggatagaatccaagcatcttataaaagaaatttgttggaggaatcttctactccattataacttactaacagtctgaaagaactcactagcaaaataaaactggtttacttcttataagaacatatttccaagctaaggatttcaggcttggaatgagctgttttgagtatttcaaatcaagcataagaaattttgtctgatctactggtaaatattctattgacaaggtcaagaacagagaaagtctggacaccatgtcagaagagagaataattattttttttaagtagacagtctttcaacttcaatttctaaagtactgcgcaggctttatacagaatgtgcaggaaagtttcttaactataatgaaagaatgttcatatttacatctgccatatatgtggtacttcaaaaattaaaggcgtgaatttaaaaatggctaatattttcaagaaactataaaaagaaaggggtgggggagaagaatacaagctgtggcaaaaatctaggctcagcagctttctgggggaaatggtgaaatgtgactatgtgatttataatgagaaaaggtatctacaacatacaattttctacctagctgcaaataataattcatagtgatgtcccttccagataaaagacctttgctatgtaggacccatgtggtaaaatgatcatgataaatgtcagaccagtgcaggtaacggctttacaaaccattaagattagctggcagttttttttccgatgataacagtaaccatgctgtgactctatgtggtaataatatctcagtcctgataaatgccagagccaggcagaggtgtttatcactcccagttcagaaatgctgactaaagttgccacatgttgcctgtttttcttcttttacaatagtctcacaatttaaaaagctgaatcataaaattattttataacctatttttaaaggattttgatgtttgtttaattaataactctctctgctctcagcgtcactatgtgaccatgtcagatgaactagctggacagtttactatactaaccattatctcctcttcagaggtcttttgttcaaaatgaatggttaaggataaagtttaatatgccttcttcaaaaacaatatttttaacccaaagacaggaaaagtgtttcttaattcacatttttcttaattgtgatatagatcctagttgttttcaagtgagttttctaatcccttataaatttaattggtctaccaatggaaagacacacattgaaaacctcaaaccttgaaaagtatttgtaggatttccacccttatgaaaatgtacaaagataatgcttaatgtaaatagctagttgagtatttgaattactggcttatgatgaaaaagatttcaaatgactcaaaatagtaaagactttttttaattaaaaaaaaggttgtaaaaccagatataaatgaataaatatagtttcaagaaaatcttcacaggaaaattgaattagagaaattcagagaaataaacccatgagctttattttctcagcacagactatcgcctaaggatgaattagtatctttgtaggttacagaaatgtacttggccaccatgacacctccaaaattactttgaagagcaagaaattctaggaaggacaataggatcatgcttttcctgtgaagattgctgctggagtgtcagccactgccttacgctccaattcagacaaatagaggcatcactacaaaactgaggagtgcaagtttggtttaagaactggtttcagattggttagtctgaggaaatgttatcatcctaaaattgattggaccaaagcaatatcccctttattaaaagttacttaagcaggatatggtggctcatgtctgtatcccaacactttggaaggctgaggcgggtggatcgcttgagcccaggggttcaagatcagactgggcaacacggtgaaaccccacctctacaaaaaatacaaaaactagccagacatggcagtgagtgcctgtagtcccagctacttgggaggctgaggtgggagaattgcttgaacctgggaggctgcagtgagctgagatcatgccactgcactccagcctgggtgacagggacagaccttgtctaccaaaaaaaaaaaaaagttacttaaagactaagacttgaatacattttccaaactcgccccaatgtgagatcatagtgcatcataacatagatagatacagccacatgagaaagaaaagatattattactttcctgaatgtatttgtgaatgtatcaagaagttaagcataataattttgaagacttccagaaattgattaaatagaattttacactcgttgatttgtatcaattacacatctgaattattttggaatgagtaacatctcagaagctttttgagtttcacaattatcttagatgatcccttcagttagaagaaagacataaacttcactgacacctacataatgacatgccttatatttaaacatctattatgacaccttttgtaatttatctgcccctccagattgtaaaatgaaaagatagcaaccaactttgtatctgccacaggttgcacacaggcctgaataaatagggttttcttatttatatataagatagatatataatatatatataatttcttaagaaattatacctttatttttaataatttatggctagagagcagggatagaggtagaaggaaacagagattaccctttagaagatcattcttaacatccctcctaagagcatgctgtacatggtctaattccttcgggaccaggaccagaaatggttctggaaacagtgctaaaggggccagtgagttgaagcttccctcatttaacaaatccataaacttatgccaattaattggccagagtaatttttgatactgacaattattgactataaagagttgttcccattttttaaattcttcctaagagggcttgtttattcaaaaaaacagccaaaacatgaatatctcctggaaggagaaactgtgaatacaaggaaatctggtgtagaaaagaggtgatcagttccaactctcaggtgatcctccctagagaaagaaatgtcttatttgagtcagatagattcagttcctgcttggtctttcctgcaagtaatgtacctctcttctcaggttgaactgttttgacacagtttgtcaacatcaaaagccaaacttacaatgtatttgacattgccttccttttaattaaatataaatatggcttttctggggtttggggagaagggcacagaaccttgaaaaattgcaaattgccaactacgggctacgctcaaggcggtggtttttccttgtttatgatgcaatgacacttctatttatgatatactgtaactacttaggaattttaaccaaattctctgataattgacagcattccatatatttacaaagctacaacatactgtaccctgttcctacttttaggaaagcatactaaatagtaaaagtatgacttcatttgatttcagaaacaaccttgaaccaggagcagttatgtatcagggatgatagagaagacaatgagaaagaaatatgttttaagggaagaggacttacaggggacttacttaaatgatcacttactatgtgtacatttatgtgcactgaaatatttaattctacgaaaatccaataagatgtataatttttctgtattttcaagtaaagaactagaagcatcaatagttcaagcaacttgcccaaaatcatacagcatagcaaaaattctaacccagtcttttccagattcctgagaagtggtatgtcactggatataccgattttcttatttataatgtgagtttgaagcatgtgtatatttgtatctatttgtgagatttgaatttgcccccagagcatctcctcttaaagcaactatgagttactcaaagatatttatcaagcaattgttgtcatccctgagatgactcctcaatgggcaactcaagttttggcattaaaaagtgtatcctcagaggtttgtatccagttgtaaggcatgctgaaacaaataaaatgatctctggagatactccttcctcctgtaagcaagcacagtctctaactaaattcggaaatggccacagtacaaaaactataaattgaatagaaactagagaactgctattcttccaaatatagctctgacatatagggactaccatgtttttcatacagggtgcattagacatttcagaataactttcagaagcagaacagctgtggtaccactgacctctttaaaacaaaggaatacagttgtcctttaagaactgtagacaaatgagatgaatattactccctatacattgattactgggataaactggtcttttcttcctctgagtggacctatataacaaagcagaatttatttttaaatgtgatttaacatgaagctataagaacaataaaggcatggatgataaggacagaaaagtgtccagggacattggatccaaggttcttcactgtacagaactttttccatcatcatatacagctttatcttatctcttttctaaaaggcattgggttgtaaacgtgctttagtaacaacatttcatgcagatgaatgcaagtgtaactatcataaaccatattttgaaaaatgtgccctcaaaactataaagccacattcttatcataacattaaaggctatttcacatcacgtaggtgttacttctctgaacagcatggaatcattttttaaacttgtttacaacaatgagtttgatgtagtttgagaagatgggggcaggttggtgaggaatgggtattagtaagaaacagttgagaatcactattggatggaaaaaaacgaagcactataaaaagttgtgtgtgcaattgtgggttcacagcttagagattgaagaggctatttggatatgggtggagaactaaaatggaggtatttcatggaatagaggcaaaaataaatcataatagaataagggcaggagtaaatgcaaatgaaagagggaaagaattatggagttcattacttctggaaagattttgtataagtctcttcacatacagtttgcctaagagtacaaaaagttccttcctcctcccaccagtcataatgtaaaaagttagtgatatctcaaagtcttctcagaaccttcagcgcttcataatgagaaaaacatatgctgaaggagaaatattaatagaaaatgctgtctttcagatgctcactgaatcaattgaagacagttgacacatctttagtaagctgtttatgaatcttagctcattaaccactcctgtattatgtatgctgattccaattcctaatatgacacatcaataaaccagatctgaaaaggtgtcatttcgattttaatgtatccaattgtatttttagatgtttctccacttgaagtgtttgtgttatttcctgattttacaagctatggaagagtgggtgtggtattgatttgaatgaaaaaaaacactgctttactataaccttttcagaagattttgttctgattatgttgtaagaaaaataaattgttcctccttaatatttcagctctctctaagccatggtacacttccccatttagcacttaagtataacttggccacaaatatgcatgcaccaatatccaattgtctgattccccaagaatgtgtgaaagtggaaaaagagagaaaaatatttctataaaatattcttcatgtagaatgtttcttataggcaaacttggaaaccgacatgtacttttcataaggatacttatacataactgacctgctcaccaatcagaccatcaatttctcagcctatcacaaagtatttaggttgttgtgtaatgttgggctactatagcaattgtactttcaccaactggcaccaactcagttcatgaattagcaactacattttgaatgtccctgcaaccaaatagtatgctaactgctgggattaaaaggtgaacaagacccagtggcttgggcctcaaaagaggtgagaggggtgcaggggaaggtgaacatttatatagtactttgttttacttgtaattgtgcttggtacattacatactatcttgtttattcaacaaaactacacttttagatcttattcaaagagagtaagaaacttctccaagaccacacggctaataaaaagctgttacagaattcaaaccaaggtccacatattccagttcatggtcacaactttcattagttcactcactaattcctttttcattcatttaacccaccacatgctagcataaaaattgcctagctttaaaggaaaattccctatttaataggggaatttgacaagcattcaagcagtacaaataccatgtgaagtgttgtgtaagtagaatattctaaatgcaacagaactcaggagagggagagctgactctaagaaagctcacaattattttacctgttggcttaacggacttgactatgtcttaattcctgcccaaacaccatgaaagtgtccttgcaaatcagctctttctaattaagcaacggccaatcttttctaaccccaccctgactggatcatgttccctataagtaaagtttgctggttggaaccaacaagactactccccacttcttgcctgtaaagcttaatttatagctgctacttctgtagccctcaatgtcaactggtcccttttttggagactctggcattaacctgattattactttagtcagagacttcagtgaaattagaaaggtctcttctcctcctctctcctctcctctcatccccttcccagtttcatactgattgcttgcacctagtagttcaccagatcctcaggtaaactgtactggaatcatgccaaactgtacagaatgtatccacctcttgaatgaatatatatatatgagtgtgtgtgtgtgtgtatacacacgcatatatacacacacaattatggttgtgtggtattagcttcaaacggttggatagaaagcattcaagcatccccaatagctctgacctgggcatactatgccaatttcactctcatcttcattaacttgtactttttttctggtttatgatatttcataggccccagttggtcttgtgaagcatcacattttcttaccatcattaagctccaagagggctttttactatttggcagaaaagatgaggtctggtataggctatgatgttgcaactttcttttttttctctttctcgctcccctttgtttcttttttttgcagttgtccaagccatattatgttggaactcttctaagaataactgcaattttgaaagctttgactgtgggaggcattatttataggcctttgtggttttagaaggaaaaagaaaagcttccaagcagagttctactaggaagactgcccccatcccactttagccaaataccatcttctgcaggatattttcctgtaattccttataaaaaaattcttttgcgacaacatattaaagaacctgccagtttctaaactaactctttcttatcctactgtcataaagtttatatatctattgaattggacttttgtaagtacatcttattattaagaactgtatttggccttagtatcagagatccatcctcaaaggcttcagtacacagggcttattttcttatgtcaaagaaacccagtgggccaggcgtggtggcttatacctgtaatgccagcacttaaggaggccaaggcagaatgattgcttgagccctggagttcaagacctgcttgggcatcataaggagaccctttctctacaaaaaataaagtgagctgggcatggtggcatgcacccgtggtcctagctactcaggaggctgaggcaggaggatagcttgagcccaggagttgagactgcagtaagccatgttcacaccactgcactccaggctgcacagtagagcaagatcctgtctcaaaaaatacaaaagaaacccagaggcagacagtgcaggactagtatgactgctccacagattcgagaaagctctttctacctgtgtatttcactccacagagcttcagttccccagattagctcatagtacagccactccatctacattcaaagaaacagaaaggaggaaaggtacacaggctaaaagctaaatcagctcatacatgctctcccagaaggcctgaccaaccctgtcacttcagtctcattggccagacttggtcccatggccactccagctccaaggcagctgggtctattaccatcctcttaacagtgggattgtcttgctaaggaagaagagaatggttattgggtggatgtttgccttacatattagtcttttttatatcttattttccagctgtggcctgtttagaatcatcaagagccctgtgctagaagttaaagtatagaaaggaaagtgcatgaggtgtttaagttcaataaataattatacctctagatgataaggccctggttaaaactgtggaaagatgaattccctagtgtactaagtaaatcaatttttacttttccatctataaacaaaacaaaatgagagaaatcaatgtggtatgcagttttgaacaacttcctattttataaaatgtttatgaccaggaaatatgctatttcaatttttttttctgttttaccctcttattttaaagcaaaaacaaaatgtgtaagggaaaaaggataacatggaaataatttttaaaacaattttcccttctacaaaatcaagcaacaatagaatatttgtaatcaaatcacactatatgtccttgtttagtttcccattgctacttaacactcacacaaacttaaaacacaaacttatcctcttacagttatggagggtgcaagtctgaaatcagtttcagactgaaactgaagaggttggtaggcctgcggtatccctagaggctctgtctccttgcctttcccagcttttggagactgtggcaattccttagaaagcagcccctcatcgcataccctctcttttctgctcccgttgtcacatgagaactcatatcaccttttctgactctcattctcctgtttctccctaataaggatctttgtgattccactgggcccattgagataatccagaaaaatctccccatctcaaaatctctaactgatcatatctgcaaagtcccttttgccatgtgaggtaacatagtcacacattccagggattcagacacggacatctttggaaggcccttgttcaccctaccactccttgtaaaacaggacatttaagaaaaccaaatgttaagatcaggaagataatgtcaaagtcacattgttgttgctttcatgttaagattatctcacagtacagccattctatctacattcaaagaagcagaaaggagaaaaggtacaaaggctaaaagctaatcagttcatacacagcctcccagaaggcctgccactgtcaaattcagagtcaaaataaaaagaaactccttaataaccaggttgagtccacctattccctttgactactgactaggactcttagttgctagtctcagtccaaaattttctcaagaaaattttctcatgtacctgtacctatgaaatcttgttttttccctaaccttcctttttatttttttttccagaaaagcaagacaacaacacaagaattgaagctgtaaaatctcttgtacaaaaactccctccgccaaatcgtgacaccatgaaagtcctctttggacatctaactaagtaagttgtaaggatttctggatgtgtcattttatagtcatttcctaaatgggcaatattgaatttcacatctctaaggcaagagtttccaaatgcgtacatctcgtattttcccttgtagctgaactaggtctttctgcagaagctggagaatgtgttagggataggaaggacaatctacaaaaggaacttctgaaataacttatttttcaaggccctttcaactagtatatgtttgctgattgcttgtcagaaccatcgcctggaccctgggatgggtcatcttgactttgttatctaacataatgaaagaacatgaaatgattcagacatggattcaaaactcagccccaccatgtaccacgtgctggggccacaaataagttacttaaaccctctgcaaccaatttcctcatctgtaaaatgttggctcagattgataaggtgctatccatgtaaatagctaagagaggagtcttccaggaaaaaaaaaaaaaaaaggcaaatgtaaagccctagaagcccctaagagctggaagtatttgaaaagcagaaattaaacccgaactgctaggcccaaatgtggaggcaagatgggatcaggagctgaagtcccaagtatcacactagcatcagatcacataggttcttgtggtccacagtgagagatttggattctattctaaattcaaggaagaaccactgaagaatgctacaattgagggagtgtaaaagattgatctggctgctaagtggagaatgcattgcaaaggtgaagagaggaagacctaatggcagacaaccacagtagtacaggcaggagatattggtggcttgagtggagccctcagagagaaatgggtagagatattgtggagatggatcaggctggacttgctgctggttgggataccattgggaaaggaaaggagaaatcaagtgtgcaaattttgggtttcaacttgggcaagtgaagaagcgatagtatcgcagagatgggtaaaactgcagagaggaacaagttgagtaggaaaagcaggtttgagagctctattttggacatgttaagtctgaaatgactgttactcatttgccttctgttaacaccttcttcagataaggcagagtgcaacgcaagttatgaggttttagctttcatgatatatgcatagtaaaattgaagcctgacagaggttcaaatagattgagcagttttgcttttgtgagattaaatctccttaaacacctcaatcactcataatttgggatgagtcattcctacagattattcaactaatctattacatgatttttcattgtgaatgtaatacatgcaattgcaccccccaaaattaagcaacagtgatgcatttacatttaaaaactgaaatctgcctaccactcttagcctgctgaacagaagtaactaacatttttgtatgtatccttcctgacctgttcctaaacacatgcaaacatatgtgtgtatggttgcttctaatgttaaagtacatcatattgcacatattattatacaactattttgtaactcatatacagacttctatttcattaaacagacttatcttattatttctaatgatgtcaatagtatttcatggtatacacagtccataacttgctaaaccagttcattgcgttagggaacatgttttaatctgactcatcattttctgtcttattttactctcaaaaggggaactttatcttaaagttcagaaaatctcttactattagagtgttccttcttgtcactcccacatactggctacggtgagaaatccaatgtggtttagtgaaaggatcttgggctttaaagaaatagaaagagagacctagagtcaaatccttgctctatgctttactcccattatgatctcaggcaagtaaaatcggattaaatactatcaaccatatcttgtggttatgagaattaaatgagataatgcatataaaacgcctggcacaaggtaagcattcctcaaatgttaattcttttcccttaggatccagacacaccatgaaagcggtttcaagttacaagtaaatactggagtgcttatctcagtaactttaactggacaaagtcataaaacaaatggaaaagtataccctttaatgctatgcaataccttgtcttaaagttcttgagaaatatccgttactctgtcccaattattcccttttttttcaactgaagaaatagctataaaataaagaaactaagagtcagctaaatcctccttcaaataaaataaataaaacacacagaagagaatctatctagttaaaaaccttcaaaggatgacgatcgtccatgtccaggccacataatcccagttttaacaattaatgcctgatcctgttttttacatcccagttaatttcctaatcttgtcagaactttcatttagttcaatagagatggaaatagatgttttaaattaagatttaagatcagattattatatcacttcacagtattcacattttaagattgattattatacatgggaagaagtgttgtttgctagccaccaacctttcttgggtggtatgactatatttcaccctgtaccaatttataaactgggtttaattatgcacgagtgtgtgcacacaattatatcttgttaagcatttttttgctaagtttttgataaacagccaatcgtggcgtgtcatcaaagcctgagaagactaaataagaagattgtttaacaggaatttaaatatattcgtgtttgaaagaatcattagaatgttttccttagtcttaatgcatttggtagttcttcagaaaatctatcgtcaacccttgtatgtagtgtttattccaaattgttgcaaatatatatattttgaagtttgtttagtgagggtcagggaatgtaatgaagtgccaaaaattccacttgacctacgtactctacagtcaacagaaaagcactccatttttgcagagctctgagttaaatgcactcctcaaagcagatcagctatcaactgggaaagcttaatgcggcacagttggactagaaggtaaatgcaaatcctatccacaaaagccagaatttttaaaggattgtgattatattaagcataaggttgcacaatggctgcacaggctgactagtctcagagtccagagtcttcattcttaatcaaactcagggtcaagttctatgcatctgctatcatagcttaagaccaggaattcggaataagctatcatctcaagatcccgtcagccagaaacctttattaatagccattttcacaaactgacattacagtgataggccctggaaggtcctctggtaccttctgaatcatcatataaatggcaaaactgtctctataaaatacaagtgtcaaatgcattttcctatagcctgcttctttggaaaggcagagaggcagagtgaagatgaagttagtgggaaggaggacctagcaagatggtttacttgctgatggatagtagctggtggttgagagccagtaaaggggttaaataataactagggaatcgttaaccttttatgaaccagaaaattgcatgatgtgctcagtgttaatgtaagagtcatctgacagcagagtataggatgaaagaggtagaaagaggagagaacccaggaggtcccaggggagttgcaattggattggagtgatggacgtcaaaaggaaagaaatggccaaaatcttgagatttttcaaaggaaaagtccacacagttttcatttgtctcccatatccagtcagccatagagatacatctgagatttcaatgataagtacttatgaaaatagtccccctgatagcattatttttaaaagcaaaatgagatattgtttagaagggtgctcttttctctgttttccaaaaacagacatgggaaagaagatgacgaggttgtagcaaactaatgaaataggatgaatccgattttggcaggtgtgtattaatcaaggcctctatatgctgctggttgggatggacagctaacatatcggaaaacccgtatatgcaatgtatctcgagaatgcagacttttcaaagtttcatacctttaaaaccagtcacatagaggtgaaaagtttatgcagataaaattgtccatggtagcactgtttgcaacagtgagcatttggagacaatgtaagtgttcagtgataggggagggttatgtagaacaggatacatcatattgccttagtaaagtgtagttcatggtttttattttctttctgcttcaacttggagaaatgctgtgttaaatgttaaataaaatcagagatacagtcttttgcatattcaaagagagcataattataaatatgggggaaaaagttgtgaatgtagaaaagactataaaaatatttactaaaatgttgatatttctttgagttgttggattgtgagagtttcgttcctgtgtttctttttaccccctaataatggtataggaggagacattgaagttaagggaacaaagaaaccaggctttggagttaggctgatctgaatgcaagtcttggctctgccacttactggatgtataaccttggccaattcattcaactctaagcttccattttgtcatctgtcaaagggagattataaaagaacttatttctgtagtgagaagtatatgaataatgcttttgaagagtcttgcatagtacttagcacctaagtattaaataaacattttacatcaatgtattttttaaatgtattatattacatgtattattattacagtattttatagtgagggtaatataattattaatgaaataaatatagcaagaattaccaaggcagtgcaggctaaattactgctaaatttcatgatttccagaaaagtctttatcccatctcaggatctttttccaaaacttgagtttccttactgtcctgactcagccagtttcccagagtcccagtgagactatttcacatgtttgacaagctacatcacacccccattctcatacccaatccccactcttttctgtctcagacaccctgtcagcctggctggcatattgtcccctggtcttagttccaactcttttcaccctccaagtgatagtttgctaatgtgatcatctagtctgccggcctttggggcaggcataaggaaattggaaataggcacaggtctctctatgcctcttatgaagagcctcctctgttagaagagtctccctaatagacttctagttcccttgctttgttgtataacttctcagagtgattttcatgatcagaatttcctgccaagacaaacagaacaccagctttatgaaagcctgataagtaagagattttgaagccagcagggccatactctgtgtcccagtcaccaatataaacactcctagaatcttatcaactacatatccacctagaatcttatcaactacatattcacctggaatcttatcaactacttatccacctaggcctggtgctgccctttggaagtactagaacttttgttgtcatgactattagtatattctagatattgctgaagtctttttccatattttcatttccatgataaaaataatacataattatggaaaatttagaaaataaataaagtctttccacagagctaaatttaactagttgaccagatttcctttgtggcatgcattttgcaagccaaaacaatctcaaatttgtgaggggggtgtaaggactcaaaagaacttttatgtacacattatgcatgcacacattactcagagaaaataaaatgtcttagaaatgggcaacttttaataatgacttaggaagtaatgttatttgttgatttttaaaaatagctttggaagaatatatttgctgcagattttacgtgcaaataaacattattgtaggagacttgcactttgtaaaataggttgaaagttaaaatcttcccttttgcattgactctaaggaagttgtccagctgttcatagaattccaaggtgaaaaaatgatatggctgaatagacaaatctcatggactaatgccaattgaatgcctcattgaaagtagaaactgttgagccccagaaactgttgagctggggctattttgtgaaagtaaaccaatatttaaagcttctctgtggtcttcatggatattaaataaaatattctacaaaagcatgtcagaggcaacttaaatgataatgacctagaaatataagggttgtatcagaaaacaatggagacaaaataattcgtccaccctgtctttaaaatgacactgtaggtatttctgatgttttggtggggagaaattagatatgcttaaagaatggacttcaaagcccacagccatcacccttctctctggtcgtcaggggccatgctggtgacgctctctgcctcccatccaggcctctgaatgctcagctctgctgtgcttttgagcacgttatgtttttctgtgctgtcttctggcactccattctttttctgtacactttggtctttcacccaaccacaatacctgatatccaaagacttgcagacatggatatttttactggaaaatgaggaacctgtgcaaattattattttcttttactctctcttttctttttttttctcttttcctgtgggacacgggttgtgagttgtttgaaataagccagaagcttcatagctcctttgcttttgtatttgaaatggcaccctgatcactttaaagagctaatgtacttcctatgggcctgaaatttctcaactggactcccatagcagaatttggcctggtagttaagaaaattaattactctgatcgcgagggtgaagcaatagttcccaactccccatagtaatcattaaaatgtcatctacttaggagacatcttggcatgggatttataaggtttgtgagctgaggactaaggttcagtgatccttccagcagtgcctcctcgttctagaggaaggctgtgggagataaggttttaagacgggagtgaaattattactttagatctttagatttaacatttgaatggtaacattcaccactgaaaaataggaaacaacaaaacctaaagttgctaccatcccatctatcattgttgtctctattgttaagtgatggccaactgtatgagggtatttccctcatgagaggtaaaatttttaagttgccccacccttctctactatgaatcttggcctttaacctaatggaaagaatttggaatcagaagacatagtctcaggccccattctcagcccttagaaactgtacaacattgagaaaatctttcaaagtctgtaaccgtcccttttgttcaggtgttaattaagtcaaataaattcatatttgtgaaaatgtttggtaactgtaaaattctacctacaaattccttcaggaagtctcaaatgagtgcctgctatattccagacctgaacaaaatcaggggttggaaaagtgtggcccacaggccacactcagcctgcctcctgtttttgtcaataaagttttattgaaacacacatctatttgtttatgttttgcctatggctgctttcatgctacaaaggcaagaggtcacaataagtcataacaaggtacacaaggccaaaaatatttaccatctgacccttcacagaaaaaaattgctgacccttcaactcaatgttaaatgcataaagaggattcctaccctcacgtatcttatcgtctcctgaggcagataaattagtaaacaattataataaacatgatgcaatatctaaaatgctaggagaattctaggcagcagctgaaatttagcttagaaaaatcaaaggatgccccccagaggacatgaaacaagctatctttaaggatgttggcttggcagacaacagacctactgtagggagagagaatactctgtacaagaacatggaagagaactgcaatgtggtaaagaaatggtgagtcctctggaaggattagagaattaggaattataaagagaataaacagtggcagattatgagcctctaacgttgtaaacaagttaaattgtgaagaataccatacagtctgataaggagcttgaaattctttctgtaggctaagcactgtcgctcactcatttaatcctagcactttcagcggttgaggagggaggatagcttgagctcaggaattccagatcagcctgggcaacatagtgagaactcatctctacaaaacattaaaaaattagccagacattgtggcatgcatctgtagtcccagctactcaagtggctgagacaggaagatcacttgagcccaggagttcggaggctacagtgacctatgattttgccaatgcactctaggcaacaaagcaagatcgtgtcaaaaaacaaaaacaaaacaaaacaaaacctgtagacattaggaaaatcactgaaggatctcaagtggagaggtaaggtaatgaaatttgtattcataaagaccacagtttttataagagtgaaggacagcttgtagaagggcaacaccagaagtagggaaaacagtagaatgctggtatagtagtccaagctagagatccccagctaagggagtgatagggagaatgggggaaagtgatggatacaagaggcattgaagcagtagatgcaacagaacatgtgcaccaagtacatgcgagaggttaggaagacgaaggattccaggatggcacccagattttgaattagctgaatggtgatatccttaacttacatttcacataggaaaaggaccaaactggaggcatgaaaaaagcagaaattttgttaacataatgtgacttgctcattgttatattctattagcaaaatccagtcaaggataagatatatatgtttggaatgcaagaaaggtgattgagatctagggacaaattttggagttgttggtttaaagatggcaatggggtaaggtcatgaatgcctccaagggaccgtgtgaacccagaagagagtcaagggtgaacccagaagagaatcaaggacagattcctagagacttctaacattgaatggatggtcagagaaagagataacagaaaaggagtctgagaatggcacgcatattgatagaaaaaacatttggcaagagcaaaggtatattttgtgatgaaaactactcattacacaaggaacacctagaataacctcagcttaacaggacactgggcagaatttataacaatgaccagttactgttcttaccttcacccttcagctttaaaaaaaaaaaaacccacaggaataagtataatctagcaggaaaaaaaatgatattctatagcatagccaggtcctgaaaatataaagaactaacctggcttcttctgctcttagagcactggctccagaagggcagaaatttgtgtcattttgattcctgctatatcccctagcaccgtgtcctacatagatactcaataatttttgttgaacaaatggaatcgcgttacttcattgaacaagatgataatctaatagccagtgagtggttccaggtaacatcaactacgtaagcctagtgtattagtccattttcatgcttctgataaagacatacccaaggctgggaagaaaaagaagtttaattggacttacagttccacgtggctgaggtggagagacctcagaatcatggcgggaggcaaaagacacttcttatatggtggcagcaagagaaaacaaagaagaagcaaaaatggaaacccctgacaaacctgtcagatcttgtgagacttattcactatcacaagaatagcacgggaatgaccagcccccatgatccaattacctcccgctgggtccctcccatagcacgtggaaattctcagagatacaattaaagttgagttttgggtaagaacacagccaaacatatcattccatccctgaccctccaaatctcatgtcctcatatatcaaaaccaatcatgccttcccaacagtcccccaaagtcttaactcattccagcattaacccaaaagtccacagtccaaattctcatctgagacaaggcacgtcacttctgcctatgagcctataaaatcaaaagcaagctaattacttcctagatacaaagagggtacaggtattgagtaaatagagccattccaagtgggagaaatcagccaaaacaaaggggttacaggcccccatgcaagtccaaaatccagtggggcagtcaaattttaaagctccaaaatgatctcctttgactccaggtctcacattcaggtcatgctgatacaagaggtgggttcccatggtcttaggcagctctgcccctgtggctttgcagggtacagcctccatcctggctgctttcataggctggcatcgagtgtctgcagcttttctagacagacagtgtaagctgttggtggatctaccattctggggtctggaggatggtggccctcttttctcatagctctactaggcagtgccccagaagggactctgtgtggggactctgaccccacatttcccttccgcaatgccctagcagaagttctccatgaggaccctgcccctgcagcaaacttttgcctaggcatccaggtgtttctatacatcttaaatctaggcagaggttcccaaacctcaattcatgacttctgtgcatccacaggctcaacaccacatagctgccaaggcttggggcttccaccctctgaagccacagcccaaactctacgttggcccctttcagccatggctggagtggctgggatgcagggtaccacatccctaggctgcacacagcacagggaccctgggcccagcccatgaaaccactgtttcctcctgggcctctgggcctgtgatgggaggggctgccatgaaggtctctgacatggcctggagacatttttcccatggtcttggggattaacattaaactccttgctacttatgcaaatttctgcagctggcttgaatttctccccagaaaatgggtttttcttttctactcattatcaggctgcaaattttctgaacttttatgctctgtttcccttctaaaacagaatgcttttacagcacctaagtcaccttttgaatgctttgctgcttaagaatttcttccaccagataccctaaatcatctctctcaagttttaaaatttcacagatctctagggcaggggcagaatgccaccagtctctttgccaaaacataacaagagtcacctttgctccagttcccaagttcctcatctccatctgagaccacctcagcctgtatcttattgttcatatcactatcagcatttttctcgaagccattcaacaagtctttaggaggttccaaactttcccacattttcctgtcttcttctgagccctccaaactgctccaacctctgcctgttacccagttccaaagtcacatccacatttttggatatcttttcagcaacgccccactctattagtaccaatttactgtatcagtccattttcaagctgctgataaagacatactcaagactgggaaaaaaaaaagaggtttaattggacttacagttccacatggctggggaggcctcagaatcatggcaggaggtaaaaggtacttcttacattgtggaggcaagagaaaatgaggaagatgcaaacacagaaacccctgataaacccatcagatcttgtgagacttattcgctatcacgagaatagcatgggaaagaccagcccctgtgattcaattacctcccactgggttcctcccacaagacatgggaattctgggagatacaactaaagttgagatttcggtaggaacacagccaaaccatatcacctggaatcttagaaacttggtattttcagactagtactaggaaatattccatcttaagggtattggtaagcaagttcttcctctcaagtttatctcccctcacctgatatttttcttttcatcctgacaaacaagcagagctcttctgattataaaaataataatacttttaatggggctgtttgtttttcttgtaaattcgtttaagtaccttatagatgctgtatattagacctttgtcagatgcagagattgcaaaaactttctcccattctgtaggttttctgttcactctgatgatagattcttttgctgtgcagaagttctttagttcaatcagatccaatttatcaatttttgcttttgttgccattgcttttggcatcttcatcatgaaatctttacccgtgcctatgttctgaatggtattgcctaaattttcttctatggtttttatagtgtggggttttacatttaagtctttaatccatcttgagtttatttttaaatatggtataaagaaggggtccagtttcaattttctgcatatggctagctagcactatttattaaatagggaatcctttcaacacacattggggcctgttggaaggttgtgggggtgtgagatggtggatgggaggaaggagagcatcaggaagaatagctaatggctgttgggcttaatacataggtgataggaagatctgtgcagcaaaccaccatggcacacgtttaactatgtaacaaaccggcacatcctgcatagttactcctgaacttaaaggctggaaaaaagagatactcttaatattaagactgcatgttaaaagggtgcaagcactacaatgaatgagttctaaaagaggctggccacaccaagggagactcagtcagggaatctgtgaccacccatcagtgatgggtggagcctattagatcaattactgcagtacatagtaaaattgccagttcttctggtttcttatctgggattagtagcagatcttgaaatacaaaaatttatttctacatcttctgtcataattctcactactaaataacttctaccacttctagctcctatcaggtcaaccccaacttccttgtctatcatttgagatccaatattgccatactaccttgaattatttagcatcagctgaagaaaaaaaaaatcaccttgacttaaaaagcttgccctctgcttttaagtgtataaagaaatttggttcccttgttttatggagcaaacttcaaagtggaagggagaaaaaaatcaagcagacctcaagtcacctgatttccagtccactaaaccacactctgctttcttgccaataccaatactcgattgtgtttccagggaagaaggaatggtaaaacaaagagtgagaaagctgagccaactgtgatagaggcacaggccaatccctcagactccttttttctaattgaacaccagatataatcccagccctttaaataaaattacctaattaatcctaattaattagtgagcccttatatttatagaaggggttttcttagtgtctgtcttctcaccctccccacttccctgcctctactacatttctttccatctaaaaagaaaagtttcatttttaggggtcctttttaaaaacaatttccatgtcaacatttattaatgcttgtgtgtgtgcatgcatgcctgcatatatacacttagagcacgtttttttagaaggcagtaatggtgctgccttttatcaccttctttctcctctttaaatggaaagcactgaacccagatgcccaaccacggaagatattcttccagaagcagcatctggcttcctggcaagcccttcaggcaagttgtttggggagcattgctgttgtctctcggtctgtcacgtgtatcagataccgtggcctctctggctggcatgtcccggtagctgccaattcctttcagttcacctttaattctgagaaactagtttcctcattttcatttcttactggacttatttttctccccactgcccataggaattccaggacaaacctaagtcctcactgctttctgcctgtcaagctcctttccagacctccgtcttttgaacccaaatgaaaacctcagccatttactcctacattaaaataggttattttaaataatatttcttagccacttcttgtcagcaaagctccttgtaaactgtggagttgttccctgaaaagaaaaacaaaacattccatccgagtcatttattctggtctgtacacaagacatgaaagtgttcttgacatttgtgtattatttagttaaatcgtattggctccctacatccttgtcacaccatgaacaaaagagcatcacggggctgggaaagacgagaccatgctgcagttagtcaaggctgtgcagcctttacacatagcacccgctccaggaaactgcatttcttaaagtggcttttttttttttttacctgttaatatatattttttaattgtgaaggatcttctggggttttttatggataattgttaagaacacagagtccgatggtagcccacgcaacaggaagccgtgacaaggtgctgacaagtccggcagcagtacccagaatgcagaggagaaagcagaaattagagctgcagggtgacatccaggaatacttaacacagggtatctgcaaattttcatgtcgttggggtttttttttctcatgcaagaaaaaagtacatattatatatgagatttcagttctcaagactgtaatgtctaggctgagaaaaggctgaagttgagcaatggacaggaggaaatctcagccataaataatattttgtctgtagctagtagcagactcaacccacacttgactttgaagcagtacataactagaaccctaggcttcacttgaatgagagtccctagggggcaaagaaaggaggttaggggctgtcttggtcaggccattgggaaaaatcttttttggaagtagctacaaaacagtagagctcaaatttaaggttagcatttttgagcctattatgtttctgcctcaatgacattttttggtctataatttttccccagctccattcattaatatgtaaaaagaaagtttaaaaatacatgccaaactcacaagttttacactacattattgcccttggtatagaggttcctgtatcttatttctggtcatttcttctcctcttctatatcctacccatattctttttaactaaactgtttcctcatacatttttccactgttctctacctttcctcccaatattcatcatcctctgcagattctttctcttgtctgtactctgaaaactcacttcacattcaaaacattgttgcctacatcatctgtccacacatttattcatgaaacaaatacaggttgagtacttactgtgtggtagatgctgagctggaaatgaagacacttttaccaggaaagcaataaagctctaggatctggaagcttcccttcccatgtctgggagtgttcacatccctcaatctcattcttaatccccattttctggctctatatccttccacttctaacaggaatttgtaaaccagcctatttttaacaggcattaagtcagtccttccattggactaagtaaaccccttctcttctttctcatttcaaagagacaacaagtagaacacgttgggacagaaccgctgtaaggggtgggcaagacataggttggttctctggcactgaaaacacctcttttcctgctctccatgaactgatggtcaatagacgcctcttcatagtcttccctatatcaattttgtacattcatttctttacttcatttattgattttcatttacctcccatagagtttgtgatacgaaaagataaagaaatcactccaaatgaacttttgtctaattaatctgtgtatatgttgttgggcattaaaacagattaaatttgcttacatagtgaaaaggcatgtaaagtgatatgttatctaaatcagaatttttttccatctggacacttcatagcaatcatttcacatctcagaaagattccattctcaaacacatctcttctttgataacagcacaactctgcccttgcaactctgccctcttggcttcctgctcacccatcttttccacttttctttcatttccaactgccattccagagccacgtacttcccctggtgctaacttttaagtcaacagaagggaattccattctctctcctggtgccacatttcctatttagggccagatattccccacagagatattgaggcattttactgctagtttacatgtcctactatatttttctaactagtgggaaaaaagaaataaatgtacgccctgccctctctgacctcatcttcctttcatatcacatttaaaataaccaattcctggagtggcaagctcttaaagcaattcatacttccctggcaatcacagaaatgtacccttcatcttggcagaggaaggcctatttcttccacctgttgtcacattctttttattctctgcatgggtttcccacacatacaccctataataagttagataaggttagaagcaggtggctacatagagaatcaaaagaaatgttcattgtcatgtacgagaaatttctgatcccaaagcacttttttttccaagaaatggtaatatatagaaaattggcctgcagttagttgtatgtaggattgtggatactggggagagtgggggcggggaagatgatgaccagagagagcgttttgttcgtcatgaatgcagctacctgaaaaacactagctaattagcagtctgtagccacacaacacagcagtttagtataagaagtgaacaatactttacctaattgaaactacagagcagacttaggtaggctgaatgtaattacacagattggaagtcagccaggacgccgaggttaacaatcccttcactcacaaaaagcaccacgggaactttaatgaccacaagtggtaagggccgctatcctgcagcccagcgaaaggcctcacctctcgcaaccgagactccatcagaagagcctaatggcgtcaactaattgctagaaaaaaagactgccctctatcgacgcagatgcacctgtgccgtgtgactcattcaccaagcacagtaaacacttttaagtactagggcgaagggggattcgaatgaatgagggcatcgagggggtcaagtggtggacaataggaactgtgaagtctcctctgcctgccggtcctgtggccagcacttctgctgcactagcttccctaaaagaggcacacgacttcccaaacttcagtgtgctcacaaaccaaattacctagcaatcttgttaaaaaatgcagattctgggtcgggcacggtggctcacgcctgtaatcccagcacttttggaggccgaggcgggcggatcacaaggtcaggagatcaagaccatcctggctaacacggtgaaaccccatctctactaaacatacaaaaaattagccaggcgtggtggcgggcgcctgtagtcccagctactcgggaggctgaggcagaatggtgtgaacctgggaggtggagcttgcagtgagccgagagccactgcgctccagcctgggcgacagagcaagactccgtctcaaaaaaaaaaaaaaaaaaatgcagattctgattcaagaagtctgggatgaggcctgagattctgtacagagaacaagctcccaggtgccactgctgctgctggtctgcagaccacactttcagaacaggatctaaagacaagaaacaggaggaggaaagaggttctctgtggccaagaaatcaaagtctgggctaaaagaaagaggactttaacatggggtttgacacccagaattatcaggtttgcatcatttgtcctaggaactaaatgaagcagaaacatggagtgtccaaaataataatccaatccaaaacccactctcagaatggctttttccatggggagaagaaaaggtaaagaacatggtctctgaatgtgctttataaatgaggtgcctactctgcaaagtgtccagctgtagtgctgtggcagggggatatcagcagtggtctgtcaggacctgcaagagccaaaagtgtctgactctcaagatgaatcaagagaagacaagatggcagaatgcaaattgtcaaagcttaacctatgaacaaggatgggagtaataattttccttcaaatgtttgcaaaataaaatcaaagttgctgaaaaacgtggacctttttaaactttttttttttttggaaacggagtcttgctctgtcgcctaggctggagtgcagtggcgggatcttggctcactgcaagctccgcctcccgggttcaagcaattctcctgcctcagcctcctgagtagctggaactacaggcgcccaccactgcgcccagctaattttttgtattttagtagagacagggtttcactgtattgcgcaggctgttctcgaactcctgaactcaggcaatccaccggcctcggcctcggcctcccaaagtgctgggattacaggcttaaacttatgttatgcaaacatggtttactgctgtgctacctagacttccataataaagcctcagtatagcattaaaaacttaattgttggttagattaatttgtattctttagttatttcctcaatgctttttatactaatttctatgtattttgtgacttcttaatgacagaattcactttagatacttgaaaagaaacacacacacacacacactcacacacacacacacggcaagacccaattaatcactggttggtgcagtatggttttctacgtttagacatgctgcaaacatgttgtaaactagataaggctggagtttaaatatacatttatcctaatatatacctcatcagtatagctgtaaaaaatgccgttacttgccaacaatatataaatttaggatatccttcaaaatttatcatttgaagtgttcagctacctgaagctggcagggcaaagtacatatacaagcagaagcacataagcaccaatgaatgaagcatgcctatggagtgcctgctctgtgttccatactatacgcaggaaagtggagaagataaaagtgtgcaatcggaagtctaaggttttgcctttgcagtgctactaatgtaacaggaagggaacaaaacacttaagaaaaaacagaacagagactaattaactgttaaacagtatgtgcagcctgtaattcaaatgagaaatgggctgaaagagttgagaagtctccagtgaaaggtggagctggtgagatttggatgttccatggagtggctggagaaaaaccaagagggaaccaggatataggtgtgagcagcctgtcctgtggccagaggcaaaggagaaggagagacctgagtgcagggtggggccaggttatgggtggggctggcagaaacttttcttggaatctgacatctcaggctataggaaaccaaggcaggttactgagcagttgaaaaatttctgcttttgtatttaagtacagtcacacaccacataatgacacatccatcaataatggaccttacatatgatggtggtcccatgagattatgacactgaatttttgctgtatcttttctatatttcaatacacaaataccactgtgttaaaactgcctgcagtatttagtacagtaacatgctgtgcaggtttatagcctaggagcactagcctaggtatgtagtaggctataccatctaggcttgtgtaagtacaccctataatgttcacataactgtgaaattgcctgatgatgcatttatcagaatgtatccccctcgttaagtgacacactgccatctcaaacaacctatccattggtcctatgtgaaatggacttagggatggaggggctgaaggaggaggctggggctgaaggaggatgctggagcaaagccggaaagccaacagttctcttaacgtgactacggagcaattgttttggtgttggctgtggagctcattgggaagagaggaattcctagggcagctttgaagtaggtcaggagtattcgctggtatttttgatatgaatctccacaaaggactggaaagagtcccagacagtgccacagggtgcaatctatagattaaagagagtggtggtgccactgataaaaccaggtcatctgtgtactcttactgagcacctactgtatgccaggcactgttctaggagcttatcacacatcggtcaacttaacaaaaaccatccttgccctcatgcaggttaaaagggggagtcagttacagccttttgcgtaggaatgacatgaactgacttccgttttaaaggatcactgtgttgatagtacattctaggtgaacaagagtagacacagagaaaaactgtaaattatccagttgccaatttaattagaaagcagtatttgtgggtggacagtgctgtgtgcatctgcctctgataggttaagagaatctaaagaactgggctccagccccagcttcagtatgaggttccacagtgacttcaggcacgtcacttcacgtctcagccactgttttatcaccttatcatagaaataatacctaatttatccaccttcatgtgtgtgtgtgtgtgtgtgtgtatgtgtgtgatctaatgacataaagaaagtaaaatccaagagtacatactgttgcttcaagtttgccacaattggaaacccaagcagagaaattcgatcttacattaaatccagtagctggagtggagaggtcactggattcagaagcagaaaacccaagtttgcatcctaggtttatgactctaaccgtgtcaccttggataacagcttctctgagtgtcagtttcctcttcagttacaatacctaatacctcaaaggacttttagaaaattcagagttacatgtgaatgaaagcccactataaactctaaatcatcgaagagacaaagttgtttcttaccgccctgtcaggctctgactgcaaccatagagagctgtactactacccctggtgtaaaattgtaattaatccttcctcatatgtgggttaactttaatccttcagggcaggaatcattttttcctggaccttgtagtgttccattgaactggtagagagtcaagcaataggaggtatttaacaaatcattttagcaagtgggtaagtggaggtgtgatattaaaggaggaaatgtaggtttgggaattaggtttttagaggaatatttcaaaccatgaaagtgcgtgcatttaccaagcatgttcagagcccctgaaaaaaggatggagttaaacacaactttcggacaagcatagtaagaataactagccagcaaaggaaaaaaatgtagaaaataaaattcacaacgatcagcattataagagtctgaagagcatcatcaaatagtaatacacaacttctgctccaaaaggatcaaaaaacatttcaattcgctatttcacagaaatttcaatcagaaatgtctaataacctccacccacttatctaataaccacactctagcacagagataactcaagttcctcaggagagcttcaagattcagaagttctttctgaattaccaaaggataacaatgtggtgtccattgtaattttaatactaattttgttgttcgattattgttaatccacatatgataagtgtttttgaccagagcatttgcttaatcagaaccttctatactccatctaagtaaaagaagttttattgggaatgaaagaaaattgcacataaaaccttttttcatagcctgtttcttaaggacacagcagtcaatcttgtgacatacctagccaataatctccactgcctctccgaagcccacttctttgtgtctttttaactgacattttggaattcacctgaaaacaccaagaatttgccaagacaaatttggcctgtggagaagacaccatattcaacaccaatctggagaaaacaacgtactctgctcttttaattcattatgattttaacatttattatcacatcattatcacaatttgaggattataacttgttctcagaaaactggcccctaggcaataaagagttaagaccagaaagttcactccctgtgcccttccttttttcttatcacaacccctccttccctgtggttccacaaaatgaataatgccttagacatagttatggcaatgctaatatttgaacagtaaaagataccttaagaccttcctcaagattttttaaggactcatttaatgtcagtgtcaaggttctgtgaggaataattaatataacaaaacaaggtctatgtgcccatcgattgccagggaatttatgcaggtaactcattaatgccggtgggggttcagcatgtaaatcccgaagcctcgatgaggaaatgggaccaaatgatttttccccctataaaaaacacaaacaatgacaagtataaaagcagataacctgaatatctatacaaacagctatatggcttgtaaaagttttccatttacatcctgtcacctcttctttgtgcatgtataaaagatgggacaattatttcaacaaacctacccatataaatcaatgcagttttgctgtgggaagactgggtgtttaaggcatttaatatttcagcattgccagattatcaccaggatccatttcgcattgtggtcaagtgcatgattagcactgtgacagggtattggccattttcatatgaagatctgcaaatcctagtaaacaaataccagttggaaaaattaagaacaagtctgtggactggaatgcaccctacttgtaatgggaacaaaaagctggcaatcaattttaaagaaaaagctaaatcacagcagaatgacctactttaaggcatttgccaaagaggcagtgtttttagacagctcttctaaagtagcgtctttctgtctatgccatctgcagatttattactctgcctgaaaaaaacaaccaaaaaaaaaagaaaaaaaaaagctttatttgaatgatactgagagcctggtctataggaaagattccagtattgtgggtaccacacccacacctactgatgtggtccaaggttttgctttagaggcacctaattaagaaaccctgactcatttacatggagacgtttgatctaaattacactccaaaccacaccaaattgggagcatctgtgaatgtgaaatgtttgttccctgtgacggctagaacagggccagctctggacggcacatgttcaagtgacgaaaaatatttcacatgtaacgtacttctgagacccacttttccactaataattcatagtgaacctaaccaagtatctgtacctccacaattatttcaggctgtgaaaaattatgtcactatttttttcctgctgcaagaaagaagtagaagaccacctactttgtttgctgtcattgataaagggccttaactgcagccaatagcaaaaggcaaacctggatagcacaaaggctggtcactatatagatatataaatctcagcttgggatccacagacacagagcagtgatctaaagggctaagtctcagttaccccctccatcactgccctaacctcttccagcctttccactcggcttgctggttctcagcaaagctttgccttccaactccactgaggctgtacttgtatgcaaaagagccagcccttaggatgaggtgagaatattgatagggtagaggtagcatcaactgcaattagaggacatgtcatttccactgggtaaaatgtctaagaaagtaaaaagaaaacatttctgccattggatgtgatgaacagtactcagcctacagttcacacgaaagagtgttgtatttcaagtataataaacagagttttatagatacagtcaatcctgcactttggtacctgatggccgctttaccttattcggccatatatcacctatatttcagtgggagtccaaggaaaaagaaagaaacttttaaaaaaataacctcaggttcttttgtttaagaaagatattaatgcatttatctgatgtactgttttttgcagtagctagaatgagatttgaatatattaatattttcagcagcagagcccagggactccagttaataacttatggatggctacatagatatactttagacagaggtaaggttttcagctctcatgttggtaaggctcagacagatcgaatgaacggggctgttctccatgagtctttgttgtgggcatgcattgtaatggtatggagacagagttcttctggttgtctacacagcctggattcaataaactgttatatatgcatattatgacaatgtggtcaaggaaaccagattttttttactctaccttcaaatgcctatggagcctaaatctggtgcttatttttcttgtcctcattcaatatgttaacatattcataatttgacacaggttacgtttgttttataattaaagttatggagttagctggaaaagcattcagactatactgaattttttaaaaatgtgtatcttttttctatattatactgcagtgttcaatgtgaatctgaagtctggataatcccagactgtgttagtttgctagggcagccataacacaatacgacacaccaggcggcttaaaaagcagccatttatgttctcacacttctggaggctggaagtccaaggtcaagatatcagcaggtttgttttattctgaggtctctccccttggcttgcacatggccaccttcttgctgttttacccttcacgtggttttacttttgtgctttttttccctggtgtctctctgcgagtctaaatttcctctttctataaggacatcagtcaaattggattaaaatccaccctaatggccttatttttaacttaatgacctttttaaaggcccagtctccaaatgcagtcacattctgagctaacggtagctggtgccttatcatataaattggggtggggttaggtgggataactcagcccatatcacacacaaagggtatattcacatccaagctgttgacatgccccgtaccaatgatgtatttatttgagccccaaactaaaacctaaattaatatttgtaagtctggagtattcttctagtatgatttttcagtcacatcctctatgggaatgaaacaatgatgactttgtaaggtttaggggaacaagcagcagcatgactcttctcataccttcttgctagactggaaggaagcagttcctgtgtacagtaagtgttaccacagtgcccgaccgagccccaccccgccttcagggaccccggtctagaggcataagtgcctccctctccattactgccgccctccattaggagcagataatgcgtgagctaccactctcacaataaaacattgcacttacaccacacctttcaactcagcatttccaaatgcttgaaaaatcattattatttttattatttatttgtggaatcccagcagtctactcagcactgggaagtgcagtgaaagccacagagctatggtctcagttacgcagacttaaaccgacactcaagtttcctccgcgatgtaccagtaaaaagtctgaaggtggacgtttttgcatgtgcatgcatagcaagaaaaaaagtgaaaaggcaatttaggtctgagttacccctgcggctcacatacctgagaaaagagccatttgttagtattgttctgataaatgaaggacccaagcaagaacaaagcaagaaagcaaacacagttttagaccctacagctcagaaaatggaaatgcatttccctaatcaagggcatctacaataacacttttaaaaggattattaagcaatgcaggaagtagaaatcaatcaggctctgcttgttgttcactggtcattatttcctgggtcaaatctgcttgacattcaatttaatacagtctttcatcaagtcaaaaggccttagagagaaactttcactggccacccacattttcagcagggctgttgcctggtccgattcacttttgttttccaagtctttaccatcattgcatattacgcctacttctattgaaacagctactgcttttgatgatttccacagtggtgaacatatattgttcatccctgtaatgctagaagctggtccagtgcttggcatgtagtaggtgctcaataaatatgagatctgtgaaaaacaaattttcaccttacaaaggcattctcaaaatgaatttgacacatcctgctctctctacaaagttacaagctaagatagatcacagcaaagcagagatattgcagacacagattgaaaaccaagtgaaataatgatttagattgccttaaatcaaagtgactaaatgcatttttagaaagtacatgttgaaagttatcttgactagtcttccatttagccaggaagttttctggaagaagtataagtttagggattttttgtgaggtgagagggagaaatcataaataagtatgtgttctagaaagtggggtaagaccacagaggagtcctaaaggtattaatagaggtcaggaattggactttagaaaaacagaagaggcaaggaattgagaacagaggaaaatcagattacttggagtgttctaatgaatggctttcaaagaagataaagaccaccatatatagaaagctactttgaagatataaaagggtttgttagtaacatgactgggcatatactagagtagaaattccaaaataagagctgccacaacgcagccaaagtgagaagatatttctctggtcacctgtgcttggtgccagccaccatcctctactgttcttcattgtccctagagctggaggcttagaaaggcctagacacacactgtaatcgtatgtctctttcagtttgctggagagtgactcacaaaagggtgtttcccgtgctgacacaaaagtatgcaatatttctttgtctttcaaactggtaattcataaagactgtatactattccgtattggacaatgttgaggcttaaatatcctaagccccttataagaaggatgctgcaaacatgagaataaggggtgtcttctgaaaatgagtgaactaagccacttaggaagttgctggcctcatctcgaaacccaccaaataacagcagtacagctagaaatagagttcaaaagtcaaaagtgcctggctgccctaaaattttctcattgcatgacttggttcaaggggcttcattatattttgtatttagatttcacacgtttatattccacagtgcagtgtctctttaaaaatgtaactgttgagtctaaaaatcaggaagtagtaaagtggcttccagatacatatagaaggtttttgtttgggtggtgtgtgggaaggggttggttttgtttttaattttgtgcaatttcagtccagtcaacacctagagcactcctttaaaaaaaaaaaaaaaaaaaaaaaaaagggaaaaaggctttttttttttttttttgattcagtgtgcacagaatttattgcagacatctgggagtttaaccagagacatccaagaggccagtagaagtggagcagcaatagagagtaatagttgacttttatcctcatttttaagagggaaatggtctattggttttagaggtgaaacgctagaaaggaaactgctcaatcctctcatttcaaagatgagcaaacttgggactttcccaagtcatctagccactttgcatgttctataacccaaatttactttaaattgtggaaagaaaatggaaataaactaccttgaaggcatttgagctccaactgactaattattctaggtcgttaaatacagttagagttgttagattttctggtttccaatgggggtaattccatcacagagattccttttctatcaaattgttggtgcttcattttcttagctctgcctggtggtctctattacctccatataagaaggcttttcttttccaccaaatgaatgaattttctcatcaattccagtcatgcctcatacatctccctctctaggactttctccacactcgtccctccagttcaggttcctctgtgcgctctctgcctatcccagattctaccacttcttcagaggacctggctcaatatcctgctcttttagatctgctattcagagatctggtcctaactgcagagacttttccatactttgaattcatagcctttcttatgaatagctgtaaaggtgaatttgatgcttgcatatagcatagtgaatttagggcaaaggctatgcttattattttttgattcttgcagaatagcacgaatagacacaacttattgaatactaaccatatgtcccatatcttgctgaaaaattttaaatacatgttctcaattcaacaaccatgtaaagtcattattatcctcaatttatggaagcaaaatctagcatccagagagaaggtgttattttcctagatcaaccaactaaaagtgatggggtcagtatttaaaatgcaagtatgtctgaatccagagcccctgtggccagcttctatgcaaaattgccttccttctcagagttacttgcacataaaaatcactaaatatttgtgaattagacagatgaatgaatgaatgatttggaacctgttcctttcaccaatttgacttgcaaaagggaaaataataagaaattctgaatcttgttgcctctggacagatgtggtcagttagcacaagcaaagcagaaatgttctcacaagttaacagtaaaaatcactggacacctacatggaggtaaaatgactcacagggaatgaagcaagcctggaataaaatttggcccaaatccaacaagcatttggaacctcatagcatgcatttggaatactaccttcatcccttattttttcttcacctttattgtcttagtcattttaagtatattttaacttttttatattgaatgcatttttaaaatgcagtatattctttgtggaagtattaatcaggttaatatgaaataaaataagattgatgctcatatttacaaagtaagttcagaaacgtttactgacagggtagaagtaggtagctcacaacctcacatttaattttagccaagcatagaactataactgtgaagctgtatttcagggaagatctaaaatgtatggatttccaggaggtgtttaaataatacaggttgtcagtattaaaatcagaagtgtttaaaggccaatggaaaacatatgagattttcatagaattaaaaaaaaaaactcactaaacagtacacatagctcctggtttgaaaatgattttatctttaaataccccataaggtttgcaaactttaaaaaacagagatgagggttgactaaaagacatggttttcttgaagtttcttggtaaagtaatatcaagataataaggaaaccctccttccccatttttgtttttgggttttttttttttttttttttgagcacaccagatggcatttctctctgttgccatcactgacacacaattatgttttctaatagagagggaggctgggagccactgatctaccccagtcatgtcacatgaatatctccactttcataaagaaagtctttgtccaggatttctccagtggtggtaaaggagcagtaatgttgaggcaactctcagttcatgggaacaaacttaggtcaatggatgagccatggtcaggaggtcagttgggagaagagaaagagtacttattatcaaatcgtcattgtgccctctgctccatcagcgagcatcattgtctaagacaagttctcaaggacctctgaagaatctgagttgagccctttctaggaatgctgaaaaggatggagatctgattcattttaacggcaggcatgtgtgtgaccaaataaatcagatccctgaagagtctttttccagatgcatatgtagcatttgtacttcatctgagcccattttggagagtgaaggcccttcaaaagtaaaataatctgtgtggattgaggatttggtacccaagaacccagacttcaattcccagttacatccatcaactgtgccttcagttactgatttcatctctaagctagaaaaataaaaactgtcccaacttcgtttttcagaaaatacagtagcaagtttaacaaacttatttcccaactcgtgttgtaagacaagctaccatacattttcagtcagaagctataatttattcagagattaaaagaattcatttgcatttcttcatttgcttagtctatgagattatgaggaatttttctctgtttcaggacattgacccctacctaataagataaaaaagtgtgtgttttggggaggacttgggggaatatgtacaatacctaagatggaatttctagagtctttaaaatctttaagtccataatctataatatctacaaaattttcttaaaaaattatttaagaaatttcttatctacattttttactgaaaaactacttctgcaaaaaatttgttttaagaaatttctcttttatctaaatttgttttataaaaatcttaactataaccctgcccccattcatgttaatatttgatcttgatctttttgtgaagcatccagtctagtctagcaggtgagggccttccctaccttggtttagatgtgcatgaatgctaagttctcccttcgaacagtcacggtccttttctcatcagagatagccaggggcagcagcaaagggtgaatgagatccatcatgaaatgtccagtgtcaatgtgctctcccaatttacttactgaccttcagcttgcagccacactcctgaccctcatgagatggagcctaagggggaaatggcactgaggaccaattcctgtgtcctgttggtctgtggtctcaattaagtgctaattaattaccactggcatctttggcatcgcttgtcaaattgcatttaggagtatattttcactgtttaaacatcagtagtccaaaacccacgctaaaaatcccatgttctcataaatccccctttgttccctcgtaaaaaattgtgttttaaaaattcaacaaatacatctatagccactgcaggtagctttcaaatacaagaaacaggaattggtattgtcgattttgattaattgtacttcattaataaacatcctgttattctgtctccacctgcagttgctgatgttgcctggaatcaattaactcatataatttgatttattttacaaagacattttgggatgtgctgcgctgatgataaaggtcctattttagcagttcttgattgcaagttagattgtacctgaatggatttctgtttctacatggatatgtatacatgagtgtgtgatttgcaagtgagtaggaagaaaatactccttgaagaagtcttgaattaaagaattcattttaaacatggtggggggtattcctcctgaatattctgactttatctgaagactcctaagaaatacagatcctgaaatgtcgtgtcctctctcttaatcaagaccttttatttagcagattagcaaatattccttcaaattaaaaaacgaaatagtagtactaagcaccaaagttaaaacacccactagaactatgattttagagacagatattcgattcagcttcatgtataatttactttgctttgttttaaacgtaatttctttttctctcctaaatatttataagccatggtttctggatcaatctatttgataccattatttactatgtgaaaacctatcttaggcttccataggtatctaagaaatgctaagtttagtgcaagtgacaaaagcccaactcaaacagtttagacaaaaaagagaatttgctggatcacataactgaaaattccacaatcagacgtgactttgggcgtgactagattcaattgccaaagggtattgcatagaatttgtttctttccatttctaaactctgcttgcctctgggttagctttgacttaaaaatctttctccctggtagcaagatggcaacaccagaattgtatcgtatcagcttagcgtactcaggggcaagtaagcttctctctcactgtgtgaaaagaaaattctcaaaaaattattcttcttgtcctggattgagccccttattatttgttcgttcctgatccattctctatggcagaggactgcatggctctcattagtcaggcttgagacacaggcccactcaaccacacagactagaagtgagggagaagcagttttccccaaagatggtcttagcaagaagaagaagaatgactagaagtcaaaaaaaaatccacttatccacagtagtaaagtataactacaatattttttgtccaacaaaactatcctgtctctgcaacaatatttcaatcaatagacataaatgaaggctaactcacattaaggagcgctggtgcctataattagaaaaggttgcctatccctcattctcatttgctactactaaattgacaaggcttatgaagaatatcaaagtactatccatccatctgtgcatttcttcatccatgtaacactcatgagcacatgtgatgagacaggcactaaactgggcactgggactacaagaataagtaagccaggtccttaacctatatgtgtcaggcgcagtggctcacgtctgtaatcctagcactttgggaggccgaggtgggtatcaccggaggtcaggagtggatcacctgaggtcaggagttcgagaccagcctgaccaacatggtgaaaccttgtctctactaaatacaaaaaattagccgggcatggtggtgcatgctataacctcagctactcaggaggctgaggcaggagattcatttgaacccaggaggtggaggttgcagtgagcccagattgtaccactgcactccagcctgggcaacaagagcgaaactctgtcaaaaaaaaaaaaaagcaaaaaaacaaacaacacacctatatgtggagacagtagagtacagtgataggagataaggctttggaattaaatagagtagggttccaatcccagctcttttacttacacaaagtgtagagtgtatagttatagacaaagtgtagaatgtagacaaatttctcatttcttctaagcttcagttttcatatctacaaattattataagaattaagtgggtaatatatattaggtgtccagcatagagccaagcacataagttttcaaaaattaacagttactactctgtatatcaaatgagataatgcaagcaaattgctttacacaatgcctggcacacagtaagccctcaggaaatgatagctggaagctattgtcatatgaaatagaatgaaggactagatctaaaagaaagcaacatttcaaaacccaaccaacatctatcatgataaatttggaaaaggccttgagagttcacccagatctatccctaccctcagagaaaacactttagtaattttagacataatagaatatttttctctccaaagaaagtgtttgcaaagcaactctcttccttttgtgctcatatttcatcagtttacataatatttaattaaattacataattacaataataagtacaactggcataaacttgtttgggactctctcctgggactttcctctagtgggaacagatgagcgcagttgagagtcattaactagccgggaacattgaatatgttgtgggcattggtcaatatgttttacggaggagatagagagctgattaagtgggagtcagccaagagagtttctactgcattgcagcagtctcctgcattctcttcatttacatgaatgctcctggttcttaaaactttgtctcacatttgacctatttatgcattttctaaacatccttcagtagctgatatgcagaaagctttattactagaattgtaaacatgccttatagaattgttttgttattctatagtcataaccatgtattgggcagagaaagcaatgtaaactgaaaatgtagaacatgaggatgaatgctgggcactgccctttgtacatttcttctgccagtcataaacaataggttttaaattcattcctaagaagaaaatgatagaaacatgtctcgcacgtgaaaatgatactatcaattgagtagaaccaaaaagattcgaacatgcttatttaatgtcctctggctttctgactggccaaatgcatgaacataaggaaccattcttcccatccctaatggtaatctcatgaaaacttttgaaacctatttattttatttatttatttatttatttatttatttatttatttattttttgagatggagttttcactcttgttgcccaggctggagtgcaatggcacgatctcggctcactgcaagctccgcctcctgggttcaagtgattctcctgcctcagccttctgagtagctggaattacaggcatgcgccaccacacccggctaaatttttgtatttttaatagagccggggtttcaccatgccggtcaggttggtctcaaactcctgacctcaggtgatctgcccatctcagcctcccaaagttgaaacctgttcgtttactgcattgcaatcctcagaatcagagcaccacaaacctgagaagcatcggcagcatatatatattttttaacttgggctttggtgggggattcatgatgccattttcagttttaaataatattcactagcagatgaaatctattgaagttcttatttataaggtacttctgctgagacaagccttagaaacagctcaatctgtgcctcaggaagttaaatttttttttatcagagtagcaaataagctatcatatagaactggtcaaatccagaaggaatatgcctttcactagtagtctgtggagtcatttagcgttcttacgaataaaggcacatttcaatcctcaactgtggatttgaacatttggatttttcccaagtaatcactggccatcccagcagataccaatattgtataggttggttgactggttaaagcagacttgagccagatcaattcctttgacttgaacaacttccgggcctctcttcgaacatcatggagactaactgatcatcattatttatgtgagataggttctctgtagtcacgataatgtcaagcatttttggtgttaataacaatttaaagtttaataattacttttggtgagaaaaagatttgtgagcaaaagcatcatttttacttgtttctatttcttttcttaatccatgaattgactgagctctaaaatccgcaaatcacatgctttgctttgtaaagaacttacattcaccagcaattacacagactgatatgtccttaacgccaggttaaatgtccttaacgccaacaaaagacactctggttggtcccattccttggttcaagcctccgcccatgattcaaacagccgtaacgaaaacaaggtcaggtgtcctcaattgggagaaaaaggaatattctggtgaatgatcatggatcattttgaatgaagatcactggaaagagaggctagaaccaggttatcaaaggaataatgtgtcctattatggagctgagattttaccttatggacaatagaaccagctgctggtttttaagcagagaagactgacccagtgatgaggctaagagagcccatctgcatgcacactccatcttggaaggctctgtgacctgtgcttaggggcaaacagtgatcgcaggtgaagtatacttggaagaccagaaaaagacagcagccttagaagaagatgatagcaaaaacaacaagagggaatcaagctccctagcaatcctgctggggttcaaagctagattctggtcctcatgggaaatgaaaagtaaaaccgagaatcaatatcacaagcagaaaggccatttgggaaaactggccacatacagctcagtcctgctgcatcctgaaatcacaatcctgtgagctggcaaggtccataggctcttataagaaacttgagtgcagctgaagcaggcaagaaatagcgcccagagtccttgggaattttgcatcatcattccacttaaaattaaaatttgctcaaagctccaactcttctaaaattagaaccccagtatctttcaggttatcagaaagggttgatattttcttgaggtatttctggtctgatttcctgctacccttgaacccacaactcactcatgccttcccattggccaatgttctcttatcttgacaattccttttcattgttttccaaggctcactctaggccatagcattcagctgacttttactgaagattgacagaggatagagagatcacatcacacccagcctagctgataatttaaaatgcaaactatgtaaacttaaataataggtgcccctgttactaaaatgcaccttgatcattctccccacacccccaactaaggaattttcatagattgtcatttccatttggtctccaacttcccaccgtgtcattctgccccaacactctactttcataatctctctttttgcacacagctctcataagtccatttttgtgttttatgcagagaatttggttctctttttttctagctgtgtttgagagattatgtttccacaaccaaaatggtccatcaaaatgttttgctaagcaaaacagaaaaaaaaaatgattttctccactaggaggaattttgctgtcagatattaaaatagcattttccctcatatacatgaatctacaagatgagcgtaattatatctcttattagcttaggcaaggattgatagatctaaaccaatctgcagagaatctactgggctatatgtatatgtcctgaccgttgtggctaccactgtctgtctgcatattaggaacaacagatacatcagaatctacctcttgactttctgtgacaggtagaaatgtagtgtctccagcaaggcaattcccttgagccattacacatgcaaaatatttcctcaattgaaaaatgctactggaaattttcacagagaactctaggaaagaaattcctgaaattgcagtgtaaaaactcataaaagagctctgcaataagaagcaatattctcaccaggctgttgatactgtttgagaaatttacatcaaaacagcgtcagcggtggtgctaacaagcgcagtgtcaacgagatccgccaggtctgtcagttgatgtagtcccaggtacagcaggggcagtttgctgtcttattgtagaataaatgtgggccccaaaactgtcagtagcacagagctatttagtgccttaaaagacaatgaaattctctcaggaaatgagaaacacaggatctactcagcttccagtttgagggccatatttatgtgtttcagcatggatttacactgccttttgttttgcaaatgctaataccatcccatccatttttttccagaaatattgaagctgtggttaattgaaaaaaaaagaaaaagaaaggcgaggatttagcagctatattcaatgtactgtattgctataaaactacttcacatcctgtcactcatctccctcctccattcttgtcccacccaaaatcactgaaccaaacaatgacaaaaatataaaaggaccaaagcaactcacccgcattgcccagtagtggtcccttggcaaacacggtgaaaacatcactttggcagatgacagacacttgggccttggctagggcattagtgaacaatgttattaaggactaattagatggcttttgttgaaatatttccaaagaaatgagcaaaataaagctgacctaaagaaaatattttaaaacctcccactgagcatgctcagagaaagcattttgacttcttttatttttaaaatgctcaaccattttcttcaaaaacttggcttgatcttcctgattcagtgataactgaagtcatgccaactttgatgtttttagcttcagctgttttagagctatatgtgatccccccaaaaaggttggaatgaattttttttctgagtgaagaaggaagcatatgttttaaccctcatgtgccttttttgaaaaggatgaattaacatcctataatattttatctttgagcttaaaataaaagagtttagtttgaaagtcaaagagacatttttcagaaattgaaatggagacttgggccttcaagaattaagactatgaattgtatctgctttaccgaatacatttggagacttgcatgtctgctgctattgttttaaaatggcagcagagaccaggcagcctggagacttgagcaagatggaccacacacaaaccaaatttcaggacatcaaaaggacataaaactaatatgcagaaatgccggagcatcttgaatacattttttttccaaccagatatatgacatgaagaatgagaaataaaaatgaactcagaaagctttaatccacctgatgatcttattttcccttctaagttatagaaaaaggaagggaagaaaaaacaataagcagctagaaactgattggtaccaaatataattgatcccattaaagaaggagctacatagaggagacagttatcagttatcaggaagatttctgagagccaggtctatattcttttttattattgaccatgcccatgatttgtcagatttcccctgggaccaactggtctttggatctccttaggacacaccagaggcaataaaaaaaggaaatcacactaattatagcagatctgatcacaagctaggaaggtagacaacaattctagtcatgcacagagctatgtcaaatggctccatggttggtgcaaacctgaaatgagaagtggcttctgacttagggtgagacatttcccacgtgactgcagatggaaacacaggatatccgtgcttccagatcagacataggtcatttttgtggaagaccgtgcaacgccaagtctagaagtctaataatatcaagttaaatttcttcaagtcagaactcctactacattctggtacgtacccaaaacactggaaaaccaacaaaaggaaagaatcggtaaagaaatgacaaatgtctccctcttatgtcagaagaaatttgggcagaaaaattgaaaccagaatgaaagaaaggtttaaaaggaaattgagtctgtgtttacaaaacgattccaatctgaggtgaactgtccaactcaaccagttgctttggagaaacatgattaaagtgatgactgaggtgttttgcgtgctagcctcagtttcctttattcccctcacagtccagtgacagccaatcagaaaagaacctggcccggaggcttgtcagtgataataattgaaaacatctgtccatgcagcaagtgtgggaagcccatgcagctccctgacagagcgagttctcacacagcaaagccataaccacgactgctcatattctccttcacagacttttctcactgccagctgtctttattctcctgccaggaaagcaaggggcctggggctccaacccaggctggggttaagtgagctgggaccaggggaagaaaggggacaggctggctcccagctctgggtctagagacaagggatatctgattgggaactaaagagagcggcgactgaggaaaaagaatagcaaacagagaaaccaaacaaactgaagaggacagataggcagcgggataagaagcgttcagattctaaactcaggtgagccgggtttaaaccttggcacagcattttcactatgtcactgggcaacctccctgagcctcaggtttttcgtctctaaaatgggaataatagtacctgtctcacaatgttttcatgaaaaataagataatgcacttcagtagaacaaggcaaggactgaatacacattagctcctttagaagggggcttcccagacagtcattaaggtgtagaggtagaagacctctactgaggggcatgctacttcggtcatgtgtagggaaggccctactgatggtgttctattgacttggacagtctccatgtggttcccgcagatgttctttccctgcctgtggcctgtgttaagctgctttatcaacctgtgcctcttagtttcttgcgatctctgtactgactcctgtggcctctctctgccatgaaagccatgttcggggacagcactaggttgtacctggtctgtcttcccttgctcctcgtgtgccaatgcctcgttccccgtttcagcagtttgccagatctttcagcttggtataaaacatatcaaggggatatctggttagaagaatgccagcaaaacattatttcagccaactgaggagaaacttccagattgtaggttagagagtaatcaaaacacggaaagttggagtaaggggaagaaagaaaataaagtccttagtagcaaggtttggatgttctctctgccttccagaagaaaaaaaaaacattattaagaatataatgaaccaatagatttacaaaggaaatataaacaaaatgccataaaggacaatattttaaaatttcaaattatccagatcatttcattgtttaagataccctgtgtacataaattaatcacctttggaaactgcattaacagtcacatcacaattgtatttatagctaactcacaattatttgatgtatgatgttcacttggaagctggaaagaataaatccagcttgcaaagaagcagaacttacttttagggtggggcttaggtcctgagaaaatctagctcaacacatgggtggcaaggaataatacaaaaggagagacttggggaggccaactttgtatcattagttaagaacagttctgcattgtatatgtatccaacataaacacttggctaaggatgttattctactgacagtgtttggttttccttatggtcatcagctggatgactaccgctacttggctgagaagcacttcatccataaagaaaagcaccataagtaataatgagtgcgagtttgtgttagttgcagagcaagaattcagattcaacaagggatttttttaatccaattgaaatgaatcaaactgtttaacctaattgagcttctataaatcaggagtgttgtcatattagtaatccccctagataaggcactgcaaagaggcgccgcacaagagtgcgaatgtataaacacaaaatacagggaatctactgaagctcctttattcagcatccttgtacatctcccctctctttataatcactattgcaataaaattatcacttaaccaccaacattagtacatctttttaatcattgagagactattatagttttcctatgattctgtcttcaatatccacctacaaccatggaaaggcctgatcttttcatgactataaaatcaacaaaatatagggagggagaaaatgtacatccgttgggaactgggatttaaaaatacgtactatgaatattgtaaagttattgttttaaaaatgaagcagatctatatgtgctcacctgaagggatcaccaagacatatcccatttacatagatttctctaaaatccgcttcaaatatttatctttgtaaattacttctaatatattcctaaagtcactgtttgtctactttgatacctctattcctttaaattttcccttctttctatactcacttaagggcaacgtggctcaaaacccccaggagcttgcctctcaagttcgcagattccttctcatccaggaataccttttgttgcttccatagatgtatctggttaccttttgaaattacttttctgctgaatggcacattcctggcatacatgccaccattccccattcctgaacccatgttgacataactgagtgatcatatcacccttttacactgtgacttcaccttcagggtcctttctcacagagcaggcagccaccatcagccaggtgaagcaaatctgtgtgccatcccttctgccagagcaggtctctttgtccaatgccaccattcttttataagtgtaagaaaacaaaaactcagactatagacacaccctcatgcttccaagagatggagactcatgtctgtttccttaaaaatcttgtttctgcctttctatttcactcatcactttgataaataaatgtaaaggtacatataaacatcctataatatataaatgtatatttaaaatattcatatatatgcaagagattactacaaactttttacattttagggttcacttattttgcaattgatggctgtgcttgcaatgtgtttctgagcttgtcaactttccttgcaaagtatttcaagttacaggaaggaaaaggtgtttaaaattgttaataggatttgcagcacaaggaaattagaaattcttctgcccaactgtctgatattcaaaatgaggaaactgaagctgagcaaggctaagtgagtgcccagagtactacaggtagtaagaagcgaagccagaagagaaaaatcaggctttctgtttccttgttcaagttgatctttcgttccagtaattaaaactggtgtgcagtaatgaggcaaaagcagcttcgtcaaatcagcttttttctccaacttcctatggtattgtgggtcagttgacctcacgaatttccacacaattctatatgtcagtgaagtagattatttagacattctcttctgtatatattatttggattatgtagaaattacccgtaagaaaccaagacttttcaacacgaacctcatgacttccacattctatttttgataccttaacctaaagtaatttcacactctcataaaacctttgaaaatggagcatccacagatgatattttgcacttaccaaattcctttttcaaaaaaaaaccctctaaatgttacattatattgttgtatttgcaaattatatcctccagtcatcctctgtaattttttttcaaagaaagtaaaacacagaagataggaagaacatagggagaaatgacacagaaaaagcctcaacatctaacaaacatgaatgtctgttgacagcgttgttctgactgcagacagaaaaatattggggagtacctcacttctgttcagacagtcccttttgggtgagaaaaagcttaatctgtcagccaaacataaaacaaaaactatttgtaataagaagttactgaatgccctaacttttttaccacaaatgaaataggaggaaagctgaaggtaacatatcacctaaatgcaaagagtttgcaatctaattgagagagtaaaacatatgtgaatgaaataacttagcgataaaaataaaacatatcaacaacaatgtaatacaatctgaatgcttaaatgccaagaaagcaaataagcaagtgatcagaatatgattctaaaagtcttcctagtagagacatgcttaaatatgtttttgagtagcatgattggcataaatgtggcaataaaaatagtagtaatataagtgcaaaacaactcaaatgtgtgtggccataaggatacatgagcaggtaaattgacctctaagccctgaatggatgctatctgctttatcatcttttaactttttttttgttaatagatttttcaaaccagatttaggtttaaaaaactgatcagaatcaccactggggcctgtcagggggtggggagaaaggggaggaagagcattaggacaaatacctaatgcatgcagggcttaaaacctagatgatgggttgataggtgcagcaaaccaccatggcatatgtatacctatgtaacaaacctgcacgctcagcacgtgtattcatgtatcccagaacttaaaaaaaaagaaaaaaaaagatcggagacttcccatatacttcctctccacccaccacatacacacaatttctcctatcattaaaatcttgtgttggtgtggtatatttgttgtaacttatgagccaatattgagacattaattaaagtccatagtttacattaggcttcactctttacactgtacattctatggattttgaccaatgtgtaatgacatgtaaccaccattatagtgtcagagaatagttttttactaccctaaaaatctgctgtgttccaccttttcattcctccctccctccccaaaacctctgcaaccactgttctttttctgtctccaaagttttgccttttccaggatgtcaggtgcttggaatcatatagtatacagcgattttagattggcctctttcacctggcgatatgcatttaagattcttcttgttcttttatggtttgatagcttatttctttttattgctaaactatattccgttgtatggatataccacagctgtttatccattcattatccattcatttatcagaggacatctagaatctttaacttaaaaacaaaaatttttaaacttaagtttttaaccaacatatttctcaggtagaaaatatggttctcagaacacatatactttttaccttgagacttccttgtctgaggcaatacgttgtgattttttggaacacaatactaaactatcatttgtgttcttaaacttgaatcaaagtccacttcaccttcttgcttctgttcttaggcaacgtgagagcaattaattttagaatatagaacaaaaagatgagaattacaaaattaagttgtgaattttcaaatgaatgtggttactatcaaacatctactagaggtcatgtctttctttttctctgcaactacaacactatgttgtcttcacagtgaatcagaatataattccaaatttgaaattatgcctttttctctcttctttggttacactgttaattatgtccaaaaagcaattttatgatcttttcaaaagtgacatcctaagctgttgttgattctctaagtggaaacaaatgtcacctggcccacctatgtctttgtttttgatgtcaaataacattgataactaaatcactctaatatagggggaaagaaaagctgccctgccatttgaagggaatttgcaatgaaattttacttggccccacgattatgtatacctactggttttaagacagcacacaggaggctttgccaagaaaattttaaagttcaagcagaaaaaataatcacaatatctttcagtcatttgctgcgtgtatttgtttccttaaaatgcacagctaaatgctctctacacacagatatcacttggtaggcggagtatatcttattactgggttattttccagtacatttggcatagttaaggtaaagtgtattaactttctctcaaaataaagatgaaaacagagttgtagcggccgtgaatgcttcagccattgtcaggaagttaaaaactgacaggaggcccaaataatcaactcagcctgctgcatataccatagttttcccctgggatatctggtctaatccaacaatgtatctgactggcatgaatgtagaattactttcaataaagattttatttcaagcttggatgatttcccccaaaacatcttgtcactaaggcaaagtatatcatagaatatctgattttttttttccccctacaagtcagcttttgagagggggaaaaaaatacacattacaactcaagtactcaactcaggtcaattcactgtaaaaaatcacattttaacatatctacactgattaaagatttgctgtgttaaagaagtcagggtgctgtcaaagagagcttaccctaaagtctggaaatgtaaaaaataagtaccacacttgctccactccagtctgcattctgcctgcagtggcctccaatcgaagggcaggcaggacagatgagtccaccagctaacacccggctccgagaatatttgtctttttgcaagtaaggaacatttcaaggtcacatcttccaataagtatgaaattgtttccaggctataagagaaatatgaatggcctggtcatgatcacacgaaaacgatcttcatttctctatgcatccttctctctctctttattccattctcttccttcatgatgccacattaagtcagcatgttcaagataggggaacagtaggtaacagttcattactctattttgaattcccttaaacgtttcatttagtacttgcgtacattatttcagccttggtgtcacattgtttaatttatgcttggttcatataatcttaaaaatagcttgtgttacctacagagtttcaccccttactaaaagcacacaaatcatatgatttagtgctaatgggataggagtaattattttaacatttaataatcataacacattatatttatatgttttaaattcaaaatcccttttatctctattattatattttatgattaacatacaatgttacaataagtatgtacacgaaagagcactcagcatggataatagtagataaaactctagagaagcatggaaagggctagagttgagtccctggttctttgactttattagcactgtgtaacctttggacagatcattaaccaagaagtccctaaccctggctgcacaccaggctcatctgtgaagctttttagcaactctgagtcccgggtctcaaccctgaactaccaaatcagaatctctgtgcaattcctttcctttattaaaagcctgagccagagtggaaaaccagtgagttctaatctccctttccatgtttataaaacaattgacagaaagaaatgtaatcacatataataaaaattaatgtttctggctgggcgtggtggctcacacctatgatcccagcactttggaaggccgaggtaggcagatcacctgaggtcaggagttcgagaccagcctggccaacatggtgaaaccccatctctattaaaaatccaaagaattagtggggcatgatggcgcatgcctataatcccagccactcaggaggctaaggcaggagaactgcttgaaccagggaggcagaggttgcagtgagccgggacagtgccattgcactccggcacaggcagcaaaaacgtaaatcagtctcaagaaaaaaaaaatgtttctctagcttgcaaagggttttcacatacatttttaaatttaatcttcaaaacaacctatgagatcagttttgccattaacttcactttctaaatgaagaatctgaggctcagagaaatggtagggcccatctaagatcacagtcagtacctatagaactagcacttaagattttgagcttccagatcaagagcaatggttctttccctccagttagaagagaatcacatgcagagcgtttaaaatgtacccaggcctaactgcaagccgtttgcaacagattttatgtggatgggtcccagaggttaatatggttttgaatgttccacagatgatattaatatgcagtctggatagagaatttctgccctagaatgatcagaacaagtttggaaaatataaagtactatacagatatagcgtgatgattttatctcagttttgctgataattaagcatgaattcaaagggggagggaaatgatgcgtgaacacaaggctgttcagatctaggctccacattagatgtcaggtcttccctttcatgagccagctctatttctattggaacttctctgactccccagagctcatggttgctgtcacaggttagatttaacatggcgccagttacctattaacaccaacagaagtaaagatggagcagcatggggtagaaagagaagtcaaactatgacattgggccggacaaagcctggctacccacagaaggtctggggcatccagggcccatcacagttgtctccgggaggatgaagatggcttggccttgatacactcactgtgatcagtcattggccgtgggctgtctccaagagtcccctggggtgaggtggctctcttcagctgaggcaaaccctgcaggggctgacagctgaagctgcctgcggacttgacacttggaaactgggcaacaagtctttcctcaaagagagacctgggtagcacatcaagggtccagcacagtccaccctttgtggtgctcggagtgtgttcttcatgttcatttgagaagcagctcccccaggactctcagggagagaggagatctttgaaggggaatctttagaaggatgaactacaagctctgcagctacagctggacctgagcccagctcattgtctccatcctccactctctattcgagactcccctcatcctcaacaatggcgtctgctggtcgtggtggctgccctaatgtaatgtcccagaccctcatccatgggagatccaagctcctacataccatgtcttctcagacaagaatttctgccctgttaatgccccatcacaactgggcaacagagaacttggaagccctatgtggatcatctgggtgccactctgtccccctggtgtaacagcaaccttgcctccgccctttgatcacagttaattatacctgcctagatggtgactctttgccttgactgctggtgcctggacccaagaagctccacctggcaagaaagcaacagtagcttagaagacagtgatttgatatatcattcaaatacaatgatatacagagaatagcatccttcctgactgcccatttattttgttccagaggatgctatgttctagcgaccatctcataattctctgagtcgggcccccttggctgcccctcaaccctgccacttgttattaaaattgcatctacctggcttctagtaattaagccccaccagctggcctctattaccagtgtctcagcatccccattacaatcagtgagcctagttctgtaatggactctcctatagtcaaccctcatttacagagtaaaggcccctataatcacatacaacttttctgtagaatatcaacgatgcttagcaacagctcttcaattcattgaccttggagttactatccacaacctcccactattatttctaaatgcctcatactttacaccagctagtctcctccacagatctaatgtcctaattcaccaccagggtgagttttcacaattgggctgccaccttgtgccaggacccgcctgcattccacctgccaccatcgatggactcctcattgccagtcaggctgcgagtgacccagctccaaatctccatcttattgctggctttctgggaccactcatagaactaataatcatgggttcagttctccagaaggagcccctgaaacagagtttggcatccagggcattgttaaaggttaacccctgtggaaggaaggaggtgggcaacaggattgggcagaggaataagctgaactgaagtgcagacccaagaaagcttcagccagacccacaggaagctctggggcacatagagcctgtcaaagtcgtcccacagtgggcagaaatagtccaggctttatactgactgactgagtaggggccagagcagtggctcacacctgtaatcccagcacttcaggaggctgaggcaggaagatcacctgaggccaggagttcgagaccagcctgggaaacatagtgagaccccatctctacaaaacaaaaaaattttttttaattagccgggcatggtggcacacacctgtagtcctagctactcagcaggtcgaggcgggaagatcgcttgacccaaggagttagaggttacaatgagctatgattgtgccactgcactctagcctgggcgacagaataagctcgtctcttaaatacatacataacataaaatatatgttgacagatcagtcagtgtccttgagcaaggaggcttattgcaattgaggcaaaccgtgaagaagatagctggcagccatcagctatccctgcagctatgcaggtagtccttccttgaaaggagatctaagtggcccatctctgcaagcaaagcagccaccataattatcaaattgacaaatgtacgaatggccccttaacagactaagagccttctgttataaagcttaatataatgcttgatagtggtccctaaaagatgaggcatttcatgtagaaattcttagaacaggtgatcacagttctacgtaccggacgatagaatcatgagttagcccagcatccgtatttacagggacatatgcagaaactggcacaatccattccttcaacgtagtacagatgataaatttatatgtgtaaatgcaaaataaattattttctatctttgagcaaagtattacatacattttgaaagggtttatattcctgcagatgcatcgagcattttaccaaaaataaaattatatggtcaaattttagatggccaaaaaaatggcatcattatctttagcttcaatccaaccatagcataaaacagataaaaattactctctattctaaattcctctcaccagttttgttcaaattaggtacatgtttggaaactcattgtcagataatatatgcgaaggaaagacacactgaacaattacaggcccttaagttctcaaacagttgcgctttttatttttgccttcatcttcttgtcctctcatacattacaccaactagtctcctccacagatctaatgttctaattcaccatcagggtgaaatttaggtgtgcaggaaatgtaattattgtgccaacattaaaattaatttatttttcaggccctattcttctaaatgacttgaatttggtcagttaagactgtcttccagattttttctggtgatgttgttagttctggagggctatgtaaagccgaagcatttggtggaggggcagaaaggatatccattaatacagcgtttcaacaaatacttgttgagtacttaataccatgagccaaatactaatcttagtctatggatacagcactaagcaaaaacagataaagtccttgtgcttacggcatttatattctgctggagaaagataataaagcagattagcagcagagaaagtatctagtttttcccacctctgcaggctggtcttcattcccttttcatttgcagtcatcatccccaacttccaatcccaggtctggatctcagtcactcttcacagagtactctgtgagctatctttggccaccctgcctagatatacaaagcagcaatttctacttaactgctcctgatatactaggtgtaggcagctctggaatcctgccatactactaggtcttccccaaagagaagaatacagatctgtctgattctcaggatcctcaagccttctaacagcctgcactcccagggaacgggattagcaaggaccagggcctgggccacttacgtgggacctcatcaaagtctcacctttcctagaccctccctccccaagtccagaaaatctttctctagcctggcagcaaagcagcctggctctttatctaccttccaatctactgatcaggccatccatattttggctgcagctctgaggcctttggcacttaggcttttgaaactcaaaaacacagtcctttgcaactcaactgccttgccttgcaaaaattaaaaggacttctgcttttctgcatcacccctgaactgagggcacagtgttgctgactgaacattggggaaagacccaatgtacaaggaagggtagagaagaaggctcagtcattatctactatctcatcttatccccagatgatactttgactttcccagaatgctcactctttcatcattaatccggcagcccaaaccacacttcaaagattgttcaaccttccatccaatacaggaatctcaaacatcctgcctgaatacttctcttgatggggaactcatagccttttttggtataaaatctttaatatctttaataggtgctcccaatgctttgccagcatatatgggggggggggatctataccaaatatcaatagtggtaatatctaagtagtagaattatgagggattcttattgtatctttgtctgcattttctaaattttctgcagtacatgtaaatgcattactgttttgaagcagtcttttctatttttacaacactaattcttcatacaaaggtaaaatccatctctgggccaattccagtaactggattacaagaggaaagtttattctttctttcacatcatggctttttgcattgagtcatgacttccctaaatattctttcccccctgctaaccaaacaccttcagttcctgcgctcttccatttagaagccactctctgggcacattcaccttggtgctcactagttttactgtgtccctcttaaagtcactgcagaaagtgtctaaaactggccaggtgtggtggctcacacctgtaatcccagcactttggagggccaggcagattacctgaggtagggagtttgagatcagcctgaccaacatggtgaaaccctgtctaaaaatacaaaaactagctgggtgtggtagcgggtgcctgtaatcctagctacttgggaggctgaggcaggagaattacttgaaactgggaggcagaggttgcagcgagctgagatcttgccactgcactccagcctgggtaacagagtgagactccatctcaaaaaaaaaaactctaaaacttatttttcctcagaaagtaaaattaagcgcatacaaactgaatgatgatacccaaattgcaactgattctcctttgactatttttcagtcatttaaacaaggagacaattttcaagaaaactgctaaagattttatgtaggcgccctcaatgaaaagtaaagttgctcttctcttcacctatataaaaaggaaaaacaaaagagaagttgaggaatactttgcatactgaaaatattccttttatgtttatctaacgtcacaaggcaaatatttaagtactatatactccactaataacttataattaggtgcattattctgcttggcttaattaatgctgatccatgcacaacactcaaagttctgtctaaaatattactagcacatactagtttttaaatagctatattggactaattcaggtagaaaataatgacagtcttataatttttttattgcttaaagtactcccaacataatatatttgctagcctttctcccctaaatgcagagcgatgccttcccaggatgttgatattatcagtggttattggtgtatcagcagagctcagggaataaagattaagaattcttttactgctgagacagttaaatgcaaatggctaaaaccattttaaaagcatgaggaaaaacacctaaaaaaaaaaataactgaaataatcattgtgctaatagggcatttccatttacaatgagatatgaatgctttcagaagtttttaaatctgtgtgaatatggaaaaaaggtaatacatgttaatttggtttttcttccatctgaacacccttcttatctgtgcagatatatccttggatgtgaattaggtgattaaaaaatcaaaatatgtcacccaagacttcttgttgactctgactcacttttttcccaagtcttcctcaggtctcaggcctctccattaagaagtctcttgatgtcaaattcaaaattcttggatcttagctacttgcagaaaatacatttatatcacagagtaataaagatctgcatcttaatctaggctctgccacttactgcctgtgtggcttggatcaaattttcagtctttctcagggtcattttgttcatctgaaaaagttcacctgaaaattttctcttacgtctaaacaaaagaaaaaaaaaatgggaagagaaatatcccaatatacagtaaagttacagtgatttaaacagcagagtactgaatcaaaatacacacagaggctgggcacagtggctcacgcctgtaatcccggcactgtgggaggctgagatgggcagatcactttagatcaggagtttgagaccagcctggccaatatagggaaaccccgtctctactaaaaatacaaaaaattagccaggcatggtaacgcgtgactgtaatcccagctacttgggaggctgaggcatgagagtcgcttcaacttggcaggtggagatttcattgagccgagacaatgcgactacattccagcctgggtgacagagtgagactctgtctcaaaaagaaaatatatatatatatacacatacatacatacatagagattatcagcacagtaccgtataccagggtgtgtggctgactgcaggcaatctgcacaaaaaaggcagtaccacaaatcaatggagagtggtggtttattcaacaaatgtcatagggaaaatcagctggtttccagaaaaaaagtaaattcagagtaccatcaaatttcacacaacaaaaatatttacaatgaattagatgatatgcttttaaaatctaaaatcatttttaaaaacaagactttgataatagttatctgatctctttaaatggttggattttataataataaaaacaaagataaaatccaaaagaaatagtactagatatgactacataagaacttaagtaaataaaattaagaaacacaagaattgggagaatgtatgtgccacaaaagtaatgaaaagttactcttaagacataaagaaacttagaaatctacatatgcaaggatttcactgtagcattgtctgtaatagcaaagaattagaagaagcaacctaaaaaccaaccagcagagaaatggttagataaattaaggtatttccatactatgaaatataacaacttttttaaaagaatgaggtatttttatatgtactgacttggaaacatgcccgtgatatatagttaaggggggaaaagcaaattatagcacattatgtattttttatttcatcttttctaaaaaggaaaaaaattatttatatacaagtgtgtgtgtatatatatataaatatatataaaataggtagatggatagatgagtagaaaaacatccagaaggaacacccatctgttaattatagttatgaagaaatttgactaggaaacaggggaggtttttactttttacttttcaatagttctgattagtactttttttttcccaaaagaccatgtattagttttgctgtacaaaataaaatgggttaaacaaacaaacataaaagtatacactctaaataggaaagagggcaggagatattcacaggagaggaaacacacgactgcttgtttgctttattaacttcttccccatttcctaaattcaaagaatcctaagttcaaagaatgacagactatttttcatgtatggcagttatttttaaaaagaataataccaaattataatactgctaacaggactaataggccctcccacatgttatgttttaaggaaaaaagagccataacttgataatctggtgctggttctcaagatgtggttcccaaccagaccagcagtactgttaccacttgggaacttgacaggaatgctgtttatcaagcctctccccagacttgctgaatcagaaatctggaggtggagcccagcaacctgccttttaataccttccaaattatcttcatgaagggtaaagtttgagaaccacggatcgaattgttacatttctattattttacactaaggcagaggtcttcatctgcagctttattgccatttggggctagataattctttgtcatcagagctgcctgtgcattacaaaatgtttagcaggatcctttgcctctacccattagacaccagtagcaatttcccaccccacctgctcatgacaatcaaaactgtctccagatattgccaaatctctcataggtggaggggtggggcttgggacagggtacaatattgctcctaaatggggaaccactgcctaaaaaaatactccaaaatgtggaggaagagtacatgggaaggttttatttatttatctcacttataccacgaaagcatatggcacaattcattctcttccatataaggtaatgatgaagtgatatatattacatatataagtcataggaattattcctgttagaagtgaaaaatgccagatacagaattatataaagtgcattttctcaaagttgtatgtagatacattatacaaacatttctatcatctctaaatgccaacagtgtcattctcctgctcgaacccaaagaaatgatttccatcacccttagaaataagtcccagatttttaccatgacccctaagtccctccgcagcatttcctacctctttccctttgctccctggcctccagccagactatgctctgcattcctcaccaccagggtattgtacctaccattccccgcccagaacacttgttcccctgatatgtgcacctcgacaggactctgctcaaatctcccttccttagagagggcttccctgagcactccgtctaatacacgtagcacttcttaccactctctgctcattagtattacctgggggctattcaaaaatgaaggcagcctggccttgcccaatattcaataaaagagaatctctgggaatggattccaagccatcagggtttttttaaagttccctagggtcagtggaagaaccattacttctctttttcttagcttttcttgaagtacttcagggcctgaagtcacattgtatattgcttagtgtatggtttgttgtctgttttccccactagattttaagcttcatctgagcagggattttgtctgttttactcattgcactatccctaatatccagaatagtgtcaaacacatagtaagtacgcaatagatttttatgaactaataaatggttacatcgagttcccagtgtttattatactcttctaaacttttcaaattttctctaatagaatgcgtttatcatcaaaaaaagaaattaaagctgattttaaaatctgcctttaaaatttgtgatatatttgaagcacagtgattagcacatagaaggtattaatagtaacaaacagtaactactgtaaatgtttctttttggtattatctactatgtcagggttttggttctgatattccattttatctgtggttgttatcaccttacagaacatatattctaataagaaataaattataaattgaagcctgtgggccattcatttttttactttttagttctcacatcttattaaatattctaaatattgctttagagatactttagaatatcactgtaatgcccaatcaataaaaatatgaaacaagtgaattgaaaatgtttcaatcttctgcattgaaattcatgcagaggttcaataaatgcaaataatctggccatgttagctatcaaaattcaactgccatataacgctcctttgctataatgtactaagaattatatacacctaactttaaagctaattttttgcttttattcaaaagcaaaaatgtcagaatatagcaataattcctatttaggatgatagttgttttggaaaataagaatgacatgatgtttagatataaaattgaagacttttcaatttgtttaagctaatggatatgtaaactggcatataaaaaatggctgaattatctttgagtgaccacctcgaaacacactaatgttaaatgcaaaaacacttgtgaatgctcccctgcttttccaatacttgagaatgtttctggcatacaactataactttaaagaagaaggtggaatttctgctaagtcctcaatcttataaaaaggccagtgtagatagcagtacagtttgtgcaaattgagggtaggcaagcatatggttagcatagatcccccccgaaatagttatagcacataggaaacataagttgagcatattgaaaatttattctatttttaacagcctctctttagttaagtggtcaaagtcacaattaacatttcacatgcagtggctgagctatattttgcaagccaggtgtgacctgatggcaggaatacatttaccaccacactctccttactccgtaaaactatcctaaagttatgtgtgttggaaaatcatggcattccacagatagagaagggaacatttctaatacaccttcataactggagagttgtcctccaggcaattatgtgactttcaacacactttgcaagtcactatagtaacagcaaagcacaaacttaaaagaaagttcacatccataaatctgtttggagctgaactattattaaaggctttggtcttcttaattcagcattaatttttggttgtatattaaagttttctttcagttcgagtcatttggctgtgattttatgtgactaagaaatttctttgaattagcaattcagctcattttgggaaaaacttacccagcataaggcttttttgagaggatttcttttccgggggtccaacatctgtagcactggattataaattatttctaaaataaacttaagttgatggatcattgttcttcccatttgggcctgacaaaaggtagcactcacatttcctttttttaatgctgtaaactgtgtatcacttctcagctcctgttagaaaactgaattcttactcattctaagattttataaacttgaattttacttagtggtataagaaatgcttttactaggaatacatacaaagtgctatttcatgaacaaattcataaaatcatatttttgtcaggctatttaaaactaagcagtataaataaatagcctttttcaagaattgcagtttggggcctttttttctgttagttaagcattcagaggcactaaactttgagctcttcatgttgcttagaatcaggtatctttgctatgatttcttgggagtaaattaatgatgagtcaacatacatcaagaggaattcccaaatattgacataaggtctaaatattttggggcctccttgcccactatcatgctaatgtctcaaccacgtgttttccttacctttctcattcagattagttcttttgccttttggcctttgttttgtcataaaaggggagtttctttcatttctttgctaaaaacaggttaaatggtagctcaaactttacaacacagttaaggaatttaagggcctaatgaaacctaagccctaccagaggggtggaactagccggaatgaccagaatctgacttctgagttagctgctacagagctgtgaagccagggtggcataggaggataaaattcctaacattttcagacttgtatatggtaggtccttagcaaaacacatagaacagcatttcttcatatacactcttcagtgttactcaaaaaagagaacctatgtacaagattcaagtaatttagggaggacacaagttaaagattggcaaggattttttttttctgcaggacttttcagagcctttattatgcttttatgcattgtgaatatccaagaagaaaaagtggcactcaattttctccaaaacttttactttggaatgccatttttcgtgaagcatatcagagaaatggtgttttacagaacccactttattgaaagatattgccaaatccatggtaaaaatgtatatggtttctggatcagatccacccctccaacaatacaactcaactaaagctcaagctacttgaagtacacctgactgtttttgagagttttccatctaagatactaaattgagttatattattccatgaaagccttttatttcttccagcagcctatatttcttttctacatatgttttactagttgaaaccttcagaaataatctctagctggtccccacagtaggagtgaaattatggtttctattgatgtgaggttaaaaaaaaataggtaataattagatgtaaaaagagagacatataataatataattttgcaggatagtattctaactgtatatttgaaattgtggttgatttcctctgtaatcctaaatcaaccacttaactatttaggagtccagcatggtagggaatacgtaagcttccatttgaatcatgacatttataacagcattaatacattttcccagacattcccagtttgggggccttctttgctggaaatgtctatccccacataatttaaactttaatatgagaatgtattagtcaacatgaattatatagttcagtatttgatgacttctaccccaaattgatctttaccttcaccttttctaacctaaagacagtgatttcttcacacatgaactactgtttggttgatatttggaaaataaattgcatatatatatcttaataaattgcatatatataaataataaattgcatatatatgcaaattgcatatatataaattgcatatatatgcaaattgcatatgtatatgtatgtgtatgtatatgtgtatgtatatgtatgtatatgtatatgtatgtatatgtatatgtatgtatataaatatatttatatacatataaattttatgtatatatttatatagattacatatatacacatacatacatattttgaaatagtaaataagccagatagcctgtgttctatataatactatatctaactttctttcttaatgactcttaattttttttaaagttactacaagtaacttgattttcctaactcaggaaaaaaatttcaagctgctgaaaaaatttaacctgcaataatgcaaatataacaggaatacaaaactatgtgttattttttaaatttattttaaaaatttattttttaaatgagattatttaaaacgtgcataagttttattaaaagcaaatggaaaacgtgcagggaaatggacataaaggatagaggtttgaggcagaatgaatattttatattgacacatgcataaaagcacaaaatgaacatttttccacaggaaatttaggtaatttgcattcgcagaaattcattacaggagtcccccacggtggcccagtggctgagaagccttctcccaagggagactcagacatgcaggcacatggctttccccaaggaggtactcagacacgcagctctagcctccaactcttccttctataactgtatcttcaatcgtctacttttacataatctctttcccctttcaaacttccttggttcactcccccacatttggccctgctctggtttccaagaccaggtcttttgctgagcagggaaaataaaaagaatgctgcagaaatagtaaatagtccagccccgtttcagttttcctgctctcccttcaatgcctgagtcccctttgagagctgagttatccctccacccacccaagctcctccaaagctatagaccccttccagcttccactcccatagcctcagactatccctccactaatgagctctttcatctcccttgatttttagcctcacctttgtgggtctcagttttggctcccagataccttaatctcactgtctctgcaccaactaaaactatagccataattaaataggtaactctatcttcaatcctgtcaatgtttacatcatccttttgccctttcagatttcctggactccaagtcctaatgttctactaccctgttggccaagatgccccattcacctttgtaccttcaatacagtcttgcttttgcttctaccttctccatggcccatgacctctgagccctgttctctgctagataaatcttatcaatttaggcatttgctaccaatgggtaaagttattaaaagaacttttacctaataagtactcaattgattatttatcttatctatctccatatttgcctctaaaatatgtgtgtgtgtgtgtgtgtgtgtgtgtgtgtgtgtgtggtaaaattaatgaaggagttcccatcataaaaaggtattaatttaaaaccaaattgggaaaaacctgcattgcctgtattgtgagtcttactaatggcttttataataggcatatctgggagaggctcaggagagatcttaaactgaggtagatgggcatgttaaagagaagcaaaggtccattccacttgccctctacagacaggaggatgcttaattcactcaataggattttggcaaatgaaataacaaagtggcatagcttcttatgttccaaaagaaactttaaatttgaagtctcagataactcacactctaaaaatatgaggatcccttccagaaatgtagccatgccaacagtgctcacaggtacaaatgctatctgcttaaagcagaagaaaagggaaaatgggaagcagaatatcctgaatattcagtctaaatttgagtgattttggccacaagaaatctactatcaccaggctgtccattacaattctaagagtaaaaaacgaaaattcagaccttcttacgatggatcgtatagtcaggtggaaggtggcagagtgaaaagccggcccagttactagggccaggagtcattacagacactgacagtgatgcttccacaggtactggacccagactgcctgggcagtctgggtcagtgtcagcttgtgtgacactggctgtcacaccactctatgcctcagtcttctcatttgttgaacaagcttaatagaagctacttcatgggcttgttatgatgatgaaatgagacaataaaattgcttagaacagtagttgattattattaatattggtcaggtcaaatatgctttgctggccacagtatgtgccatgagcttgcttggtggtgggcaagtaccaggcagtacacacatggcttaggccctgctcaaactctttcaagagatggacggcatggcctcttggtcacaaaagtggttcttcagagaatcaggtttgtgaagggaaaaaaaaaatgcagcagtcccccttatctgtggtttcactttccacggtttcagttatccaaagtcaaccatagtctgaaagtatgaaatggaaaattccagaaatatgcaattaataagtggcacaccattctgagtagcatgatgagttctcccaaccaggacgtaactcctccctttgtccagagtctccaagctgtctcctctggtgccattattcagagagtagccttcctagttatcagatcaatgttgtggcatcacagtgcttgtgtttgaggattccttattttacttcacaatggcccccaacgtgcaagagtaggtgatgctggcaattcacacatgccaaagagaagccataacgtgcttccattcagtggaaaggtggaaggtctcaacttaataaggaaagaataaaaactgtatgctgaggttgctatgatttatgttaagaatgaatcttccatctgtgaaattgtcaagtaggaaaaataaatttgtgctagttttgctgttgtgcctcagactgcaaaagttatggccgcagtgcatgatgagtgctgagttaagatggaaaaggcattacatctgtggatggaagagaaacatgttccaatagatggcaatctggttcggtactatccaaggtctcaggcatccactggcggcgggatggggtttctggagaatatcccccgaagataagcagggactactataataccagtctttctgccacctgtaattcagagatatgtaggcccacttaggccaaacaaagagaggcctctaaagtccaaccacctcaacaatgttccacacggagctctgaagccagagaccccactgtcctgtaaaaaagtgttcctttgctttgctttattttctacactcttatttcccttgggtttggatgtctggtagaatgaagagtttgatatttcttagcactctttctttccatatgctttccttatttccttatcactaaaaccccactcttctgaattttaatataaaatcaagtaggcttcagctgtcagaatagcattacttttttaattatcagtttctaggatggggctttattttctttttaggagtcctgtgttggaacaggcaagtcattaccattaataaaaccaaatcctagtgtttcattggtattccagctctccatagggtcctcacacaagcaaatacatatttgattccaatggggctcttttcctgtgcaaatgctacaggattctgcattttattgtggcattaagctaaattggctgtccaaatgaatggagacacttagaattttaccatataccaaactgtctcagagcttatctcctctacaaaacatattccagttagcatttgccaggaatactttactcaacactaatcaggaaaaacttaatttttttcaggctactaattgtgcagacattgttctggttatttcatttgggttcttatatatatatttttttgcatgcctctcacctgtttcctcaattgtctctaagcattttaaaggctgaatcttattaatttcacagtcatttttgctgtttaatatactcattcatttcacaaatatttgttgagtacccacaatgctcagctattatgggggtaaaaagttggacaaggcaatgtatcctttccccaaaactcataggttctacttccatacagtaaagtatgtagggtagaagattaaataatgttataatgcagttacttttcctgaatgagaaaccttttttaatcactccaaagtagccataacttcacttcaaactccagtgaaattatttttttttctctctctccacaggatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 528 - DNA, 20351 bp, Homo sapiens
gggcgggctcctagacggccgcgcgcccgggaacccggcgcccacagagccgcggcaccatggcacctgctggacgcccgggggccaagaaggtgagtttcgtcccctcgatcctcgcggagctcctggccgctgggctgcgagcgactccgttcacacccggcgtccatccctagccaagccctggggcctcggcaaaacacttggacgggatggccctgagcctcaattttcccctgtcacgggttggttagcgtttatggagcccttactcggtgcctggcgctgcacagagtgctgtgctcaagttatctcctcatcttcacaattatccccatttcacaggtgaggaaactgaggctcggcgagtcaggcgactagctcagggtcacgggtccagccccgcggggagcgaggatcagaagtctagctttcggacgcatgtcgcgcacacattttcttccctcaaccgaccctcgcccgcagctctttgggctaatccgtccgggaactcttcggactgtcccctcgcgttttggaaaagtcagcagcctggccaagcagcctggccttgcgagtcgccggctggtctgaaactagtcctgggcaaggacgcccccagagctgcggtgcagggtggagggtaggtgggattcgctagcacccctcaacctcctctcacccggtggtccccagctcctggcccctttcctggtctggtcaccagatgttggctttatgcccagccatttctacgtcgagtatgtgtgggggtgggatgaaggagtgactaagcaaaattaggaagggcatgagcttggacgaaagacatccccaggacccttcagagacccccacccgctccagccctgtcattcagaatgggaggaagggaggaggggcagtttatgcgtggaaatgtgcaccaccgagctatttatactaaaaagttagaaacgaccaagatactctgcaatacgggattctaaataaattaaggttcatctacttaagttattagacagttaaataacttagtatgagaaccagctaagtgccttggcaatgttaagttgcaaaaggaaatatatcacaaactgatcccaaccatatacaaatatttatatacacactgtaaggaaggacacaataatggtaatagttacacaagatgtggaatattggtttaaaaagcatgttttaggatattttttcaggttataaaagcaaaatgtgagcattgaaagaatacagttaataaaaataatcaaagaacattgtgcttttttctctcaactttctctaatgctatgttcatctttacagttcatatttttaaacgtttttaaaatgccctgtttttgttcagtgtctttggggcctctactgttacaacaccaagattatcacacactaatccatgtgaatgtgtacctgggagttaaggtgttaatgggaaggaactaatctcacctctctcctcagctagcaggtacattttaagaattcatttaattgccacagacaagacctccaattaggtcttaaatccaaaagagcagttctgctggcaaatctaggaaaaggggaagttattttagacagactgggtttttctgatcacctcctactacacagtgaagttgatccccactgagtatgaatagagatgtcttgaagccagatcttaaacccagaggtcttacgtagtgatatctgcaaaaagggggcataaatgcaccctagagctcgctgtcagatgcaaggcaggttcactgccaaactgatggggaggagggaatgaaaatataaatgtactgcaaaattaatttacagggttccttattttacatgttcctgtctttataattttacagttgactttagatcgtactagtataatggtgaggaacaacacacactggggcctatcgaagggtggagggtggaaggagggagaggatcaggaaaaataactaatggatactaggcttaatacctgggtgaggaaataacccatatagcaaacctccaatgatgcacatttacctgtgtaacaaacctgcacatcctgcacatgtacccctgaacttaaaagtaaaaaaaaaaaaaaaaaaaaaaactaaagaagggatcatactggtatagtaattaattgaggtagttagaatagcagtgaaggaagggctaaaagatgctctgatctcaaatcttgataacttagttattttgctaatggctatgtagaaaaatggcaaattggccgggcacagtggctcacacctgtaatcctagcactttgggaggccgaggcaggcagatcatctaaggtcaggagttcgagaccacactggacaacatggtgaaaccctgtctctactaaaaaatacaaaattagctgggcatggtggcatgcacctataatcccagctacttgcgaggctgaggcaggagaattgcttgaaccctggaggtggaggttgcagtgagctgagatcgcgctactgcactccagcctgggcgacaagagtgaaactctgtctcaaaaaaaaaaagaaagaaaagaaaagaaaaatggcaaatttaaaatggtggacaaacatccagataacaaatgaaaatgtcctccctttacttggtttcataaagacacagtcaaaatatatactacaattttcttaaaacctacctaattgtctgctaaagagtaacattttttcttcttcaggacaaaaattctagcatatgcaatacatctgacattttcaaaacagtcctgtttatttgctaattcttggcatagtttcttaagtgtctactcattttagttgttatatgtggtggtagggatatagaccaataagatatgtcacctgcccccaagcctcttacagtcaaactgaggtgacaagtaagtaaccagatactgctgtacagggggatgcatgaatgaaggatctgtgaagttaagcaggacacaaaaggggtataatcacaggtgagactgggtcagtgagcctgtgctctggtagcaatggaagacagttcagagtagggctggagagaactggagaccatttcaataatcaaatgcagtgaggatggtggggcatttgagaaatgtgtaatacacttggcataaccctgtgataggttggatgtgggaggtgagaagctaacctacaacatctgaattctgtgccaatgttttccctcgacaattgtttgagtaaatttgattcttttttttttttttttgagacagagtctcactctgttgcccaggctggaatgcagtggcacaatctcaactcactgtaacttccaactcccaggttcaagctattctcctgcctccacctcacaagtagctgggattacaggcacctgccaccatgcccagttaatttttgtatttttagtagagatggagtttcaccatgttggccaagctagtctcaaactcctgacctcaagtgatctgcctgcctcagcctcccaaagtgctgggattacaggcgtgagccaccgcgcctggcctaaatttgattcttaacatggtgaacctaatgaagtgtatgggattttcaggaaaacagtttgtacacagtaactgtacctctgactttctcttctgtattcctgtgtagcatttattggtcacattctgctgtgattatttgttgatttattggccttccccaaagtagccagactttgagcttgtggagggcagagaccttgtcttattctgatgtttatcccacttgcccacaactatacctgacatgtggaaggtctcaataaacgtccaaaatttaaggccttttttatatttcaaaagtacaaattgaaaagagtgaattgcatttgatgcagggaggagaaagaaagagatgagaatcagtaaatattaacatttcttctgcattcagctaaaattcagctttagatataaaatatggaaaaataaccagagttgagagctctctctgccaaaatagtgtttatgtttaacatagttcacacagctgggctccatttgcctgccctccaagtgcacagtaaaaagatgctgtaggtagagtgacctggtatttacctctagttaaaccccttctgatggaccttcttgcactgcagaggaaagaaaactaaccactttgccagactcctttgcagctaggatctggataagaactagcatccccaatcagatgcaccagtatgagtctgggaaggtggaagcatagcaaatgtggccatagtgcagcattccagggtcacgtgaggggcagctgaggtcgctggagcagcctccttctccctatatgacagctgtgtcctgaagccaacagttcaatagtggcttctcttagttgtggcagagggtgcagccccagccggccaattcagtcatgtttttctaggggtcatttctggaagcccagtgtaaattttttatgtacccatttctcaatattaaactcctttctgcttagtcagagtggtttgtacttctgcagctaaactgaacatggggagaaagctagaataagccccctctctagtcatgccattcgatggagattaagagattattcaagccatatttgacctctcatgtttggttccatactgttaacaggactgtcctgggaggctctgtgggaagatcctcacgtctgctttaatttctggttgcttttattagatccaggattgacccagctaaggacaaagactcctgtaaccaagatcaaattagcttccctcttattctttattgcctttatggccttccagcctcctgggaaaagattgaagaaaatagtatatcaagcaatatggccaaaatgtgtttgggatctctttgttccttggtatccaaggaagctcgctcctgacacctgggtgggtcactttgtgtggggagtaagcaaaggagaaatagcagatgccagacactagaacagaagcagtttctctccaaaatctgttccccctccttccgaaggattagcgttggagctggacacatggacattcactgatgatacttcctggcttcccttgcagcaaggtagagccatgtggctaaactctcacgcaggaaatgtaaatgtcaatgagatgagtcacttctaggtctgagctaaaaactttaggatgagctttgccacactgtttcctcatcgtttgagacagagtatgaacgtgactctgatccagtttcccccatgctgaggaggacagtaccctagggctgggttggcaaacgctttctgtaaagggtcagatagtaattatttttagccttgggggccatacagtctcagtggtaactactcaactctgctactgtagtggaaaagtggccattagacaatatgtaaatcaatgggcagggttttacctaagactgtttttacaaaaacaggtgatgtgccagatttggtctgtgggctgtcatgtgctgacccctgccgtagggaatggcaaagcaataagataaaaggactgtgcaatttggtgcacactctgtaaaaaagagtcccccacaaacagtggctttcctcttacagaggaaaaagaaactacttttatttaaagccactgttgtgggggcctcttttttacacagcttagttttaccctacacccaacacgtaggccagtaagctgcctatgtaccctgcttgatgtctcccttggattcaggaactgagggggtttatgttgatttcatagaacagataagactagttaaaagaggcatctgaggcttttctccctgatccattcattgctttgtgtccagctatgggcaggcctgaaatgaactggcctattatcaataaaaggttgcatcttccactgatgcagcctacaaaagagggatcaggattgctgtggggagttgggaggagtgggtggtttgcattgctcagggaaggcatctctgaaaaggtgacacttgaccaaagaccagaaagcagtgaggggatgaccctgcaggcacctggggagatgtgctttagaccaagtgaaatgggaaaagttcccttatgccccttgcagggtgtgtgatggaggcgtggatcacttcttcagcaccccacagcttaaacccctagggggagcatgcaggtaccccatggcagcatctaggggtgaatgtttacagctcctgaagccccagtgggtgtgtgttacagtgtgctctttcagcttagctgtccactggcagcttgtgttaatcagctcaattagaccctccgccttatcgaaaggacagagggctttctgtatcctggggttcttgccagtgtactggaaaaattggatcacacatgggcttggagaatgagtgcaaggttttatcgaatggtggaagtagctctcagcagatggatggggagccagaagggggatggagtgggaaggcggtcttcccctggagtcaggccgctcagcagccagactctcctctgattacccctggctgaattccacttcgtctgtgtcattctgccaccgatggcctgccagagtctgtgtgttcttctgccagtgtgttcctctcaacgtccagctgcttgtgtttgtgtttgctagggtcttgaggtttttataggcacaggatggaggtgtggcgggccagggtggtcttggaaaatgcaacatttgggcgcaaaaacaggagtgcctatcctcaccagggtctgtgggcacaggcctgaggcctttctgtatcaaaaggaaactgcaccccatggctaactgctctgaatggaaccttttaaataagttatgagtgggctaaataggaaggtggtaaaatagaaggaaaagagagtaggaatttagaagctagtctgattttttacttacttagctctgtgatcttgggcaagtcaaccattctgagcctcagtttcctcatctacacctgagaataaaaactgtgtcctgcctcactggcagagttgctgggagtgccaaatgataagacacgtgtgaacacactgcatgactacaaagcgttgtgtccactaccgttctgttcagtggctgacacgaagaaaaattatttttctcacctaacaagaggtccaggggtaacagcccatggctgccgcagccacccaaggatgtcttaagaaatctgcctcatatggctgtcagatgactgctgtattcccaggcattatgttggcattccagccaggaaggaggaaaatagacaaaagggaagggagtgggcgtctatgtcaggaaagcaaaacttttccagaaatcctccaccagcttccgtatgtgtctcactggccagcactgtgtcacagggctgctcccagaggcaaaggaacctgggaattttttgaaagttaggggcattgtccccccacacaaaaacaggggagagaatgcacactaggtagacaactagctgtgttgtcacaaacatgttgaaaagccaaaataactatcgtggaatcagtgctataatttgactcagattaaatgttatttaagaataaatagtctcagccctttcattgtacaaaataggaacctggatcggccaagaaatatggtatgctcaatctttctgaaatattattagagcacatgattttaacaaaactacagctctaagaacgtaataccacttcacctaaaattagaaaatgcttttaggaaaaaaaaaaaaagtagagcggagcttaggtgctttttttctcttcttcaggggattttggagcgcctggagagtggggaggttgtgattggagatggcagctttctcattactctggagaagagaggctatgtgaaggctgggctctggactccagaggcagtgatagaacacccagacgcaggttggtgtccacatccccaagagtgtctacctgagtggtattttatttaaatctgattgagagaagatcaagaaaaaaataacaactgtttcaaaggggtgttttgcttgctaagattgccaagatgtggagataatggcagtatacaggcggaagtatatggaagaaaatgacctctctctctctcatacacacacctacccacatcacacacccacccatccacacgcccacacacactcccacacacacacatccatgcactcacaccccaaccccacatccacacacaccccacatccacacccacatacaccacaaacacacatacacacccacacaacacactctcacacacacacacactctcatacacacacacatctgcatcttaatgtacaggcagtgctaaaatagacatcttaatatttgttccatgaatatttaccttgtagatatacagagtttccttaaaacagcaaaactgttcctgcttctgattcaccctgctgacaatgtgcatggttaagtgtaacagcgtttatagtgagggtgattaatggtagtcacagtgtaacagagcacagacagccaggttccagggttgggagggcaaggaagtcaacacagttttatatcatcctcctggctgggaaaaaaaaaaaaaaaaaagagctagaggtaaagaactatgatgggattagatagttacctgaaatgaaaactttaattctcttctaactctttttttgtgtgtttgttctcctaaattaaagtgagaaaataaagccaaagaatgaaatgggtgtaagagaacactagctgagactggaacttttgattcactctgattttatgtatattcacacagcgtatcagataaacctagggtcctgtcttgattcttccactgaccagctgtgtgaccttggacaagtcacttgacctctccaaggatccatatcttaatctgtttcatgggggcacaacatgggctaggtgtgaggactcacaagttaacccgtgtgaagtgcccgtatcatcagtacgatggccgttatgattggtgcatcggacacccagagttctgtggtagagcaggaccaagttttgttcctttggtgcttaacaggatgttttcatctggcccaagaagaacttgttcttaatgttaaaagacctttttgctaaactgggaagaaagtgctggaataacaagagtaaggataagggaggaggggcgaaagtggtgaaggagaggaaggaatgactttcagatagccaggaaaagcttccagactgctttctgatgttcccaaactgcttgctctgactctgatatgggtgccacccacatgcattctgctttctatgagaagctcctcactttactttaagggctgccaatgctgactatagtagaccagctctgtcctttacaacacaggtatagaataaacctctctagaccaagagaccaagggttaattggccagtcaggccttaatctctgcatgtgactgcaccaagtcattgaggcccatcaccagaacaatacaaggctgctctaaacagtacatcctgcctatgaattctactgaccttaatctataattttttgttactactaggtttgaactgaggtatgattgaaagagatgggagtcagtgagctactgctgcttttgaaaatgatagcttctgtaatatttctttattcatttatttcaatgtttaaaacccaactactttgtagttcgtcaacttcacatggaattcttgagagcaggatcaaatgtcatgcagacttttaccttttctgccagtgaggacaatatggaaagcaaggtaaacggcaatggctgggtgtgggggagggagtcatctattaaaaaataacctcttcatgggaagctatggaattgattatgtgttactatactttattacaaagtccatataaatatgtattaattttcacgtgaagatatatactaaataggtcgggcacagtggcttacacctgtaatcccagcactctgagaggccgaggtggacagaccacttgagcccaggagttccagatcagcctggacaacatggtgaaaccctgtctctactgaaaatgcaaaaattagctgggtgtggtggcaggcgccagtaatcccagctacgcaggaggttgaggcatgagaatggcttcaacctgggagatagcattgagccgagatcacaccactgcactccagcctgggtgacagagcaagaccccatgtcagcaaaaaaaaagaagttaatatatactaaatgaattagctttctcttcccatttaggtagaggaggggtcaggactaggggtaaaataaaccattggaagggcatggctgtcttcttgtgctattttttagagagaaagcacttcatagatgctcttttcaccttctcatttcacacttttctcttctggagacagggaggccctaaaaaacaatactggagtagaaatgagaaaaaacgggtttgatatccagcattgccacctattggctgtgtggctttgtgtaagacacctacctgcattgagcattggttttctctctgtaaaatggagacaacagtagtgcttaaattcatagacctgttgagaagagtaagtaagaccaaggatgtgaaagtattgtgaaatattctgcaaatgtaaaatgttaatacgtgtaaatgttaatgcccattaattcattcaaccaaccaacatgtactgagtatctgttacagtccattctctatgttagactcaaagttgatacaaaggcatagaccctatctggaggtgcaaggtcaagtatgggaggcaaacaaatagttattaaaatccaatgtggtaagtacaataatggaaatataaggtcatggtaacagaggagattgtacccaactctgctggtcttttctgcttgcattgaagagagtggcttatactcatcttacttgtttattgtccctttagttatcttttatattttaccttcaaactgctaggctcactatctgaactcttgctctctaacctcagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagaggtgaggctagtattggaggaaaaggattgaacctattttgcaagcataactgcagagtcttcacatttcatgagggtattggacaacattctgccctcatttcttccatgtggatggtcaaaggtttatttaaatgcatggtagtcaaggccaacattccctcattggtatgctaggttctcttagagccaaaggacagacccaagagaggcctgaccatagccttttatcttctaaggtctgggtggctgcagaagctgacttgggggactctacaacctataaggaagcatagggcacagtgcctccgggagcaccctctccagagggagaatccacacaggagggcactgcatgtgtgggctggggactgagagagcaaggcctggaaggtggtggctatccaggctcgtctaggccccaccaataatgctcagcacccagtagtttccatagccttctccatccatgtcttgctcttcttgcctctctgctttcactcaagctatgacatgtgaattacattttgaagaaagaatcagtaagaattggtcattgattggacatgaaggcccagaacattctctttcctccacttccaaaacgaaagtcctcattccccatttcccaacataactgctactgcctggggtcatgccttcaacccacaactttactccaaacaagagaatatcccctggcttggcgcggtagctcacacctgtaatcccagcactttgggaggccaaggcaggtggatggcatgaggtcaggaatttgagactaccctggtgaacaaggtgaaagcccatctctactaaaaatacaaaaattagctgggcatgttggtgggagcctgtagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgaaccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactattaaaaaaaaagaataaacaaataaataataaaatgtaagtgttatttctttgcacaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgaaaatgagaacagtaacagaaatgctgttaactattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaaggtaagcatttttaaattaacattcttattattttcctttaatctcattttatttattgttgtaaatgtcatgcatgcacatgacaaaaagtatagaaatgtataaagtgaaaagtaaaaattatccccttcctgataccagctccattcccaaaattgtctttagtccatttgggctgttagaacaataccataaactgggtggcttatacacaacagaaatttctttctcagttctggagactgcaaagtccaagatcaaggtgtcagcagattcaatttctggtgaaggccttagagatgataaaggccatctataaggaagcaggcattccttatagatgataccttcttgctgtgtcctcacatggtagatggggcaccacagctccctggggcctcttgtcttttttgtttgtttgtttgtttgtttgtttctgagatggagtctggctctgttgtccaggctgcagtgcaatgacacaatctcggttcactgcaacctctgccccccaggttcaagtaattctgcctctgcctcccgagtagctgggattacaggcgcccaccaccacatccggctaatttttgtatttttagtagagacggggtttcactatgttacccaggctggtctcgaactcctgacctcgtaatccgcctgccttggcctcccaaagttagagtggggcctcttttctaagggcactagtcccattcatcagggatgcatcctcatgacccaatcacctcccagtggctccaccccctaatatcatcacactggtgactaggtttcaacatgtgcattgtggggacacagacaatcagaccatggcacagaggaaacctgtttgtcatttgtgttttgaaatcttgtacctctatttcttttgtcatcagttttaagtggtaactattgataaccctttatgaaagctgagggatttaaatcacataggcttccccttttccccgttctcctttttccagttttgattcgttacacttttatttcttctgttggatatctttttaagttaaaattatatatttaaccacctgtttcttagttcatcaatataaggcaggaatctcttgactccactctctgtaaaataagaatagattcccctctgcttctttccaccttccctctctcatctaccccttggtgtctttaagttttaccatactttactatcatcaaggtttataaccattttgttctattctatagttataattgtctttcaagctttctctgtaggttgatcctaaaaatataaaatcagtgaataacatttacaatattattataattgttatattaaacaagcaggactcatgagacataattagaattcacttttatttttgtctccctctatccctttaaacctactcaatgaattccttcgtttgttcctacttgaaaatactgaccagctctagaacttctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaacttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtcctccccggtaattctcttgggccagattttagatagttcaggctggctctctcactctcattaggctcaaaacagctttcaccctttctgcagacaagccatgagagtgtggtctgaccccaatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaaataatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttcttggggcctcaagaaaattactgttctgttatggatcattgtatttcacacacacacactcatactctgtctctctctatctttccatatagataatcttttgtgtatgtatgtgtgtgtgtgtgtgtatatatatatatatatatatatatatacatatgtatgtatatctgttgatataattccatcccccttccatcttctagaactagtcacaatctctgctgtcttctctctgttcagtactctcatgtacttcacccattttgtgcttatttattcatttcagtgggatttgaaagtcttcatttttgaactggaaaaatttgcctaatgcaaatttacttaggttgtaaaagtaggcaagaatcacttagccaaagctttcttctaggagatatggatatttaccagagaagatgttttgtatatgtgtcatactttttaaaaagtattaaatataaatataattaaaaggtgaggaaaacatactttggtgatgattaaaatagtttaaataagtgagtagtttatttaattatcatctgctaggaatccttaaaattcattagctattagaattaaaacattattctgtagaccaaagcaagaagacaccctttttaccctgactcccaaacctactgatattcacagaaatttatgattacacaataaacactagatttctgacatctcatcatccaaaaatattgatttattcattgttttgtaagtaaagtggaaaaaacaataaaaatatattcatcagaaagggctacgaccagggacctttgtactcttcttcctttgtctaacaacaagaaacaaatattggtaaagtaatttgtattattttcttagttactttttggagaattatactttgactcattacattaaaaactgttctcgtattcttctcattacattaaaatattgatagagttagaaggactctgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctggtgtggtggtgcacgccagtagtcccagctacctggggggctgaggcaggaggattgcttgaatccaggaggtctaggctgcagtgagccaagattgtgccactgcactccagcctgggcaacagagcaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttaccttttatagtg

SEQ ID NO: 529 - DNA, 20351 bp, Homo sapiens; identical to SEQ ID NO: 528

SEQ ID NO: 530 - DNA, 21767 bp, Homo sapiens
agagagtgaaaagaccgcttacccaatttgaaattggtgagatgttccttgggctggttggtctgaggacctgaggtcataggtggatctcttcacggagtgaaggtgaggacaagggactggtctcctgaaggagtccctctgacccaggtctttggcaccaaatgtctcacgcattcgtgtgaagagaccaccaaacaggctttgtgtgagcaacaaggctgtttatttcacctgggtgcaggcgggctgagtctgaaaagagagtctgcaaagggcggtgggattatcattggttcttagaggttttgggatgggcggtggagttaggagcaatgttttgtgggcagggggtggatctcacaaagaacattctcaagggtggggagaattacaaagaaccttcttaagggtcggggagattataaagaaccttcttaagggtgggggagattacaaagtacattgatcagttagggtggggcagaaacaaatcacaattttggaatgtcatcagttaaggctattttcacctcttttgtggatcttcagttgcttcaggccatctggatgtatacgtgcaggtggcaggggatatgatggcttagcttgggctcagaggcctgacaggtgggtgcagtggctcatgcctataatcccagcagtttgggaggctgaggcggtcagatcacctgaggtctggagttcgagaccagcctggtcaacgtggcaaaaccctgtctctactaaaaatgcaaaaaatagctgggtgtagtggcacgcacctgtagtcccagccagtcaggaggctgaggcaggagaattgcttgaacctgggaggcggaggttgtagtgagctgagatcgtgccactgcacaccagactgggtgacagagtgaaactccgtctcaaaaaagaaaaaaaaaaaaaaaaattggccgggcgcggtgactcaaaactgtaatcctagcactttgggaggccaaggcgagtggatcacaaggtcagaagatcgagaccatcctggccaacatggtgaaattccatctctacttaaaatacaaaaattagctgggcatggtggctatggtctcttttggtaaataccaaatttaggaagcatgtattaggtgaaatattctacaaatatcaatcagattaattggttatgatatttttagttctgtatctttgctgattttctgttctattgattactgagaggagggttaagctctccacttataattgtggatttatccatttctcatttcagttttatcagtttgtcttcagattttttatttttatttttatttaagtttttgctctgtcactcaggctggagtgcagtggtgtgatcacgactcactgtagccctgacctctggggctcaagccatcctcttacctcagcttcctgagtagctgggaccacaggtgtctgccaccatgcctggctaattttttttattatttgtagagacagagtctcactatgctgcccaggttggtctcgaactcctaggctcaagcaatcctcctgccttggcctcctaaattgctggattacagttgtgagccactgtccccggccttcttcagatgttttgaagctctgttaagtgcacacacatttaggatggctttgtcatcttggtgacccttttatcatttgcatgaacagtgaagggtgtggcattttaccctgcttgtaagctaataagtcagtctgccagtttcatagatgctaacaaaagacatagattgcgggaacaatgacacaggaccttatcacctacaagagcagtggccatggtagtcacgtctgcatcagctccttgagcttcattttcaaaaggatgatgtgaaagggaccagatggcacctgcacatgtcggaggatgcactgtgggaccgtgggagaggatctctgaggttaggaatccacatctttaagaatgggagatgggccgggtgcagtggctcacgcctgtaatcccagcactttgggagtccaaggtgggtggattacgaggtcaggagttcaagatcatcctggccaacagggtgaaaccccgtctctactaaaaaatacaaaaaattagccaggtgtggtggcgcatgcctgtagtcctagctactcaggaggctgaggcaggagaatcgcttgaacctgggaggcggaggttgcagtgacccgagatcatgccactactgtactccagcctagtgacagagcaagaccccgtctcaaaaaaaaaagggagctgagccttcctgagtttttccccaaagggagaagttgtctttattatgctggatggaaaacaaacccgcccttcgctccagagagaggcctatttctatttccagtgctgttgactatatagatatccttgaaaagatactctagatccaaggcagtcattgcctctgctcataaaacatttagaaatgtgagaacttttggagaatatctttcaacaataacatctctctttatcactggtcatttcttttgctctgaagtctcctttgtctgatattaacatagctactccactttctcttggttagtgtttgtatgacatgtctgtttccatcctattttatttatttatttatttatttatttatttatttattttgagacggagtctcgctctgtcgccaaggctggagtgcagtggcgcggtctcagctcactgcaacttccgcctcccaggttcatgccattctcctgcctcagcctcccgagtagctgggactacaggcgcccgccgccacatccggctaattttgtttttgtatttttagtagagacggggtttcaccgtgttagccaggatggtctggatctcctgacctcgtgatacgcccgcctcggccttccaaagtgctgggataccaggcgtgagccaccgcgcccagcctccatccttttatttttaaactccctgtataattatatttaaggtggattgtgtgtgtattgtttggttttgtagacagcatatagttcggtacttttttttttaattcactctgaaaatctctttcacttggtatgtttagatcagggtcagcaaactatgtgggtcgaatctggccagctgcctgtcttgtaaataaagttttattaaaacatagccatgctcatttatctattttcttttttgagacggagtctcactttgttgcccaggctggagtgcagtggctcgatctcggctcactacaccctccgcctcctggattcaggtgattctcctgcctcagcctcctaagtagctggaattacaggtgcccaccaccatgcctggctaatttttgtatttttagtagagatagggtttgaccatgttggccaggctggtcttggactactgacctcaagtgatcggcctgcctcggcctcccaaagtgttgggattacagacaccatgcccggctcatttatgtattttctgtggctacttttctgctccaaaagcagagttgtgtggttgcaacagagaccatatggctgacaagttcaaaaatatttactacctggacttttactgacccctggtttatatcatttacgttgaatgtagttattgataggtttggattcagatttttatttccttttcagatttttattttatttcttttcggtttatttcctctagtctttatttctttattatccctttcctgccgtggtttagattatttgaacatttttagttttccatctgaattgaactctagagttttagttatgtatgtatgttttagtggttgctctagagattacaatgtacatacttaacatttcccagtctaattagaattagtattttgtcatgtcaagtggaatgtagaaaccttatcaccacgtagatctttttattcttcctcctttgtgtttgaatatctctattcatttagggctttcatttctctcagaaatgttttgcaatgtttagcatagggattgggcacatttttttcttaggttttttttttttaaggtattataatttgttcctagatatttatatgtttgatattatacgtggtattaaaatttttttcatttaaaaaattttttgaggccaggcactatggatcatgcctgtaatcccggtactttgggaggccgaggcaggtggatcatctgaagtcaggagttcgagactagcctggccaacatggtgaaaccccttctctactgaaaatacaaaaattagccgggcgtggtggtgggcacctgtaatcccagctacttgggaggctgaggcaggagaatcgcttgaactcgggaggcggaggttgcagtgagctaagatcgtgccattgcactctagcctggatgacaagagcaaaactatgtctcaaaaaaaattttttttgttgatatatggtaatattattgatgtttgtgtactgaccttgtagcctatgactttgctgaatatatttattaattctcattgtggtttattttatattttctaagtttgtagtcacgttatttacaaataaatatacttcttcctgtccaatctttagacctttcttttgtacaggaggaaaaattgcttccttcttcatttctaggttctgtggctggtctaagaattaattattattattattattttttgagatggagtctcgctctgtcgcccaggctggagtgcagtggcagcaatctcggctcactgcaagctccgcctcccaggttcacgccattctccttcctcagcctcccgaatagctgggactacaggcgcctgccaccatgcccggctaatttttttttttgtatttttagtagagacagggtttcaccatgttggccaggatggtctcgatctcctgacctcgtgatctgcctgcctcggcctcccaaagtgctgggattacaggtgtgagccaccgtgcctggcctcctgtttttttgtttgtttgtttgtttgtttttgagacagagtttcactctcgttgcccaggctggagtgcaatggcgctatcccagctcaccgcaacctccacctcccgggttcaagcaattctcctgcctcagcctccccactagctgggattacaggcatgtgccaccatgcccggctaattttgtatttttagtagagacgaggtttctccatgttggtcaggctggcctcaaactcccgacctcaggtgatccgcctgcctcggcctcccaaagtgctgggattacaggtatgagccactgtgccccgcaattttttttttttcttaatggataagaggttttttttcccctattaacatcaatgtaattcctgtgtgtgtgtgagagatctcagaaagggagagagagtgccaaggtcttgctctgtcacccaggatggagtgcagtggcacgatctcagctcactgcaacctctgcctcctgggctcaagtgatcctcccaactcagccgcctgtgtagctgggactacaggcatatgcctaattaatttttatatttttagtagagacaaggttttgccatattgtccaggctggtctcgaactcctagactcaagtaatctgcccacctcggcctcccaaggtgctgggattacaggcatgagccaccacacccagcctggttcctccccttttaaaccatataaagtaacttctgggtttgccatggcatttgtaaactgtcatggtgccagtgagagtgtcttttagcatgctagtgcattataattaatgtataacaagcactgagagcaactagaggttttgcagtttctttacggcatcctcagaaaacaagtcctgctgacctcataccttaggaatgccatctctgcatttccaaaggcgtcagtgtagtcttttgtaggctgcagtcttttgtaggcaagggataggcagatgctcctaaactataaatgcctgtgcgcgtattaaaaacagatacttctttggtgagactactgaaaaaacagtgctctttgatctggactattgtagaccttctcttacctaatacactccacctggggagatacattccttcatctgttttttgttaaaggcttttaataacttttagtaaaactacccaatatatgcatggaagaaacctgcaatttcacccctaaatacataaaaataaattttttaaaaaagttattgaggccaggtgtggtagctcatgcctgtaattgtagcactttgggaggccaagacaggagaattgcttgagcccaggagcttgagagcagcttgggcaacatgatgagacccccgtctctacaaaaaaaaaaaaaaaaaaaaaattagccaggcatggtggcacgtgtctgtggtcctagctactcaggaggctaaggtgggaggatcacttgagcccaggaggtcaaggctgcagtgagctgtgatcatgtcactgcattccagcttgagtgaaagagcaagacccccatctcaaaaacaaaacaaaaaacttttggtaatgaactataaacgaccctaataggaaaaacacattaagtcattaccagcttgtaacaccattctgtgacttcattgacacgttattatgtatttgtcacttagctttctaatgaccctgcacaattttgttggcagaacaggtggagaggtatgaagaacgaggaacactgcccggggagtttcttcctctgcaaaataagggagtgtgtactgaattaccgtttccagctccaacatccaggatttcagcactacctgcagagtagtgggaggagagataggtaagaagttaaaaagagacctgatggaatacgtggcatcctggtactgctggggtccatccccacacctcatgctcatgagagggagacaagcttcttggagctcctcctcatctacagggctctcctcacagggcctggaagttctgccccagccctgtggggattttctagagtcatttgcctctctttaaagccttggcagagggagccggtgtggggaaggggtggtaacgtagatggcaatgcttgtcagaacatattagagccctcttccacgctctgcagcccctgggcctagggctagcattattctccccttttatagccatctgttgatttcaccttatctcgcactaagcaatgggcttcttgtgggcaggtgctctctctcacccatcttatttctctctggctctttcacggggcctgctgcatggtaagcgctcagtgttcagtgagtgaatggacaggaaggggcagggaagtgaatcaaatctcctcaggttgagacatcagcaccatctgtgatcctttcctcatttggaccttcacatgcaattaggctctaaaatccagtgagtttttttttttttctttttgacggagtcttgctgttgcccaggttggagtgcagtggcgtgatcccagctcactgcaacttccacctcccaagttcaagtgattctcctgcctcagcctcccgaggagctgtgattacaggcgcccaccaccatgcctggctcctttttatagttttagtagagatggggtttcgtcatgttgcccaggatggtctcgatctcctgacctcaggtgatctgcctgcctcagcctcccaaagtgctgggattacaggcgtgagccactgcgcccggtcctaaaatctggtgatttttatttccctgtgtctgtttctacggctgcctccctaagttctttctctgttgggtagtgggcttcggcctagctttctcatcaccgccacacccttccttacccatcctgtacagacagatagatttttctaatgtacattttcagcatatctctgggctgctcagaccatttcctcaactcgacacccaaattaatcagctcactcttccatgttttaccatcctatccgtccttctaataaatacatcctgagcttctggggaggaggtctcatctcagattctctgcccaagccagatggtttcaacatagtcctgcctctgagcccttatgcaagccatctccctgcctgtcccaactacttgcttctatccagagcttggtaagcccacttctcccagagaagcctcctggggtcatcccaggccacttcgaattttctctttggtagcacttggtcacagcaaccttgggcaccaagctgagtatagaatggagtccaatcaatgttgatatgatttttaaatggtggcgacagtcatgtgccatctgaagcaggaatagggaaagagaagcagtgactagcctatacaaattagccaggcgtggtggcaggcgcctgtaatcccagctactcaggaggctgaggcaggagaatcgcttgaacctgggaggtggcggttgcagtgaggcgagattgagccactgcactccagcctgggtgacacagcaagactccatctcagaaaaaaaaaccactctgggaggccaaggcaggtggatcacgaggtcagtagttcaagaccaacctggccaacatggtgaaaccccgtcgctactaaaaatacaaaaattagccgggcacggtggcgggcgcctgtaatcccagctactcgggaagctgaggcagagaattgcatgaacccgggaggcggaggccgcaatgagctgagatcacgtcactgcactctagcctaggcagcagagccagactccgactgaaaaaaaaagagtctacagagcctttcttggaaactagtgtggaaagagaagagcagcatgaaaagccgaggccctgacagcctgatgtcccgctccctccttcacagctctgtgcccagggcctgcctgatgtgcagtgctgcagagaatccagcacactctgctcatgtatgtgcccgggcatgttttctttcttggctacctctttagtcatttgttatgtgttatgaagaaataaactcccagcaaaataatgtcttttgcacagtcttaaagtgatccattacctaagatcatcatagatgattgtgaattgggttgacctgaaatcacctaagaccagggcaggttgaccagagatgaagatggaacatggtatgttgggaactgttgagtactgtgcccttcttactagggcatgtagtttaagtactgtgaaactcaaaacattttatttttcttattgcaaaagtgatacagaattgttctaaagcgtttagaaaatacagacaagcaaaaataaaaatctgccataattccaccatattctagagtatatcttttattcttatttatttatttatttatttgagatggagtttcatttttgtcacccaggctggagtgcaatggcatgatctcggctcactgcaacctccacctcctgggctcaagcgattctcctgcctcagcctcctgagtagctgggattacaggcacctgccaccatgcccggctaattttttgtattttttttaagtagagatgggggtttcgccatgttggccaggctggtctccaactcctgacctcaggtaatccaaccgcctcaaaaaaaaaaaaaattcaatattattattgataagtagggatttactcctaccattttgttatttgttttctggttgttttgccatcttctcttccttctttccttcctgtctttcttttagtgcaggtgattttctctggtgatgtgcttcatttttttgctttttactttttgtatatccattgtatgttttttgatttgaagttaccatgaggcttgcaaatactatcttatagcccattattttaaactgatgacaacacttactgcataaacaaacatgcaaataaatactaatataaactctacagtttaggctgggcacggtggctcacgcctgtaatcccatcactttgggaggctgaggtgggtggatcacgaggtcaggagttcaagaccatcctggccaacatggtgaaacttcgtctctactaaaaatacaaaaattagccaggtgtggtggcatgtgcctgtaatcccagctactcaggaggctgaggctggagaatcgcttgaacctgggaggtggaggttgcagtgagccgagatcatgccactgcattccagcctgggtgacagagcgagactccatctcaaaaaaaaaaaaagaaaaactctacagtttaacttcatccccctgctttttttttttttttttttttgagacagagtcttgcacggttgcccaggctggtgtgcggtgctgcgatcttggcttgctgcaacttctgccttctgggttcaaatgattctcctgcctcagcctcctgagtaactaggattacaggtgcccgccaccatacctggctactttttgtatttttagtagagatggggtttcactgtgttgtccaggctggtctcgacctcctgacatcgagatctgcctgcctcggcctcccaaagtgctgggattacaggtgtgagcccccatgcctggccatccccctgctttttaactttttgttattttcctttatggcttattgtactgtctatgccttgaaaagttgtagttatttttgattggttcatcatttggtctttctacttaagatgagtagtttatgcatcacaatttcagcgttatattattctgtttttctatgtgcctactattcccagtgagttttgtaccttcagatgattccttttgctcattaatgtcttttttgattgaagaaatccctttagcatttgttacaggacaagtatggtgttgatgtaatccctcagcttttgtttgtctgtgaatgtctttacttctccttcatgctcgaaggatattttcactggatatactattataaaaaatttttcctggccaggtgcagtggctcatgcctgtaatcccagcactttgggaggccgaggtgggcagatcacgaggtcaggagattgagaccatcctggctaacatggcgaaaccccgtctctactaaaaaaaaatacaaaaaaaaaattagccgggcgtggtggcgggtgtctgtagtctcagctactcgggaggctgaggcaggagaatggcgtgaacctgggaggtggagctggcagtgagccgagatcgcaccactgcactccagcctgggcaacacagtgagactccatctcaaaaaaaaaaatttttttttcctttagcactttaaatatgtcatgccattctcccctgacctgtaatgtttccactgaaaagtctgctgccagactggagctccactgtatgttactgtttttttttttgtagttgttgtttgtttgtttttcttgcttcttttaggatcctttctttatccttgatctttgggagttagattattaaataccttgaagtagtcttcttttggttaaatctgcttggtgttctgtaaccttcttgtatttgaatgttctttctgtaggtttgggaagttctctgatactatccctttgaataaacattctaccactagctcttcctctacctcctcttcaaggcctataacagatttgcccttttgaggctattttctagatctggtaggcatgcctcattgtttttattcttttttttttttttgagacagagtctcactctgtcacccaggctggagtgcagtggcacgatctcagctcactgcaacctccgcctcccaggttcaagcgatccccctgcctcagcctccggagtagctggaactacaggcatgtgccaccatgcccccggctaatttttgtatttttagtagagatggagtttcaccatgttggccaggctagtctcaaactcttgacctcatgatccgcccacctcggcctcccaaagtgctgggattacaggcaggagccactgcaactggccttttattctgttttcttttgtctctgtgttatctgactgtgtattttcaaatagcctgtcttcaagctcactaattcttctgcttgatcaattctgctattaagagacggacgcattcttcagcatgtcaattgcatttttcaactctagaatttctcgattcttttaaattatttcattctctttgttaaatttatctgatagaattctgaattccttctctgtgttattttgaatttctttgtttcctcaaaacagctattttgaattctgtctttaaggtcatatttctctgtttattcaggattggtccctgctgacttacatagttcatgtggggaggttgtgttttcctggatggtgcagatgcttgcagatgttcgttggtgtctgcattggagaattaggtatttattgtagtcttcacaatctgggcttgtttgtgcccatcctccttgggaaggcttcccagttatttgaagggacttaggccccaagcccaataatgtagttgtttttgcagactcagaaagatcccaccttggtggtcctggataaaatccagaaaaattctctggattaccaggcagagactcttcttcttttcccttattttttgccaaacacatgggtttctcactctgtgatgagccacttggaattgggagtgtggtgatgcaagcacccccgtggccatcaccactgggactgcactgggtcagacctgaagtcagcacagcaccgggccttcccaagacccttcccttcagggcagcgagttcccccaggccctgggcatgtccagagatgctgtctgggagccagggatagcaataaaaaaccttagcaatttacttgatgttctagtctactgtggctaagctggcactcaaaccacaatacaaagtccttctcacgtttccctgccctttccacagggagaggagcctctccatgtggccaccaccaccactggtccacagtgggttctgccaggcaaccgctgatgttcacctaaagcccaaggactcatctgtcagcttgtggtgaatgttaccaggcctgggactcacccttcagggcagtgggtacccctctggcccagggcaggtccagaaatgtccaagcgcctaggcttggacttggagactccaggagcctgcttgttgctctacctcactgtggcctaggtggtacctaggagcacagagcacttcagcccacggtggtggagcctgccgagaaactcaggttccagccgttgggatgggcagttcccccctggctagggctggtgcaaatgttccctccatgcacaggcactggctgagtccagcgcagctttattctcttctgtgacatggcagcactgagttcagtgtgaagtcccctagttgctgtgctctccctttcccaaagtgcacagatcatctctctgttccatatggctgctgccgggggtgggagaggggtggcgtcagtgattcaagactgtctctctgagcctcttcaatggcccttttagcgatatgaggttaaaaccaggtactgtgatcgcttacctgacttttggttcttgtgacggtgcttttttgcaagcagacagttgttaaaatttgatgttccagcaagggcatgaattgtgctctaccttctctactatagattttttaaagtctgcataattttgcattttatgcatgtgccatactgtatttgaccagccttcagctgttcaatgtgaggggctatggtttgaatgtttgtgtccctccaaagttgatacactaaaagctaatacccaatgggataggtttaagaggtggggcttttggggaagtgattaagtcatgagtgctctgctctcatgagtgggattagtgcccttatcaaagaagctcaagggcccctttgccctttttccctttacaccatatgaagatacagcctttgtcccttcaaccatgtgaggacgcagcagcaaggtgccatcttggcatctgctggtgccttgatcttagacttcccagacaccagaactatgagaagtcaacttatattattattttttcttttttctttttttgagacagagttttgctctttttgcccaggctggagtgcaatggcgcaatcttggctcactgcagtctctgcctcatgggttcaagtgattctcctgcctcagcctcctgagtagctgggattacaggcacgtgccactacacctggctaattttgtatttttagtagagatggagtttcatcatgttggtcaggctggtctcaaactcctgacctcaagtgatccgcctgccttggcctctcaaagtgctgggattacaggtgtgagccatcatgccctgccaatttatattatttataatgtaccctgcctgtgatattttgttataccagcaggcacaagtaagacatgagttaacttcattaaaaaaattatagacagtaattcactgaacattcttaccattaagtcttactacacacccttgattattcctttagaataaacttttgggaatagaatcactaggtcaaaggtcgtatgcctatttaaaactttgttattgagaaagcttgtgctaattttattgacagcagtggatgagagtgtctctgcttcctcaagtttttaccatcactggttattttatgtgtgtgtgtgtgtgtgtgtgtgtgtgtgtgtatacatatatatatatatatttttttgagatggattttcgctcctgttgcccaggctggagtgcgatgccatgatcttggctcactgaaacctccgcctccggggttcaagcaattctcctgcctcagcttcccaagtagctaggattacaggcacccaccaccacccctggctaatttttgtatttttagtagcgatgaggtttcaccatgttggtcaggctggtctcgaactcctgacctcaggtgatccgtccacctaggcctcccaaagtgctgggattacaggtgtgaaccagtgctcccggcctggttattatattttgaattttgcaaatgttataagtggaaatatctcttctaaaaataacagatggaaaaactttaaaaaaatcttgttgtaatttgtatttattccatgacaaatttggttaaaacctgtcatatttattaatcatttcttttgtctttagacttttgatgtctgtgtaaggcagggtttagttggaggtaacagaaaccactcttcttattttaaggagaaggagctttgtcaaaggaaattagctttttacaaaatcactgaaagggccggaggaacaggatctatgctgggcttccaagaatgactctgagaacaacaccctagaactagtggctcaggaaagctgctacttctgctccaggcagcttcattctagatattagactgttccttgctaggtctgctagagcttcacagcaaaaaccagtgctctgtgcctgctcccaagacacactaagctactaactgttatggaatctctgctaccatcacaacagacaaacaacaacaaaagtgaaaataaaccaaatgtaaaatacctcaaaatcctagcttaaatgtaacaaatacgtttttacatacttaaagcagatcagaagaataccaaggaaattcccagtggtcacaatggaacgaaactggagttgtaaactaatactgaagccactgctgtgcctaggatatttgtcagtcttgatgacctggatgcttaactggccatctgtgcctggtagataatgccttggcggcagtgaaggggttgcaaattagggatttgaaactgagaactccacatagtaccaagacactcaaaaagctacatcctcaggaaaagaatggattgaataaaagaaacaaaatctgacttttagcaaagagaaataacaaaaaaacttatctttgcctgtgccctgggtggagaaaaaaagcagcttccatggatgtgtaactccacatctttactcttaggggttttggatctgggatttgagtctacaccaagtggttttagaagttaattctatgatcccgagttggttgcaattctggacgtctgacagaagcaatgcagatccttcctggagggacatagtctcaacctaggccttatagaattcccacagataagccctagctgaacataaactttcactccaaattaaaaaagaatacatgaagaaacaagctaccataagagtcagcaagaactcctaagaacttaagataatggatttatcaaatgtgttatataaaacaaatatacctaaaatgtttgattacatttaaaaatacaagaaaagagcaagagatattatataatgtaatcatatacatgcaaaaaatatacaaattataagcatatagcttgatggattttcacaattggaacacatctaactagcacccataaaaaaacccaaaacattactagcatccccaagtcccctgcccccatgtttccttccagtcatgacccatacccttcacaagagtaagtactatcctaacctctaataatagcacagaccagttttaggcagattttaaaaagcactaaatagaacttctacgaaaaaaaaaattttaaaaccccaacaaaccaatgaatgaatagtagatttgacatagctaaagaaagaattgatatggaattaactggattaaagctgaaaaaattttctagaacacagcatggagagacaaaatgatgggaaaatagcaggagttaagagacatggaagatagaatgagggaatctaacctgcttctaataaaaatttcataaggagagaacagaaagaacaggtaaaaggtgattttcagcaagataatgtcagagagtttttcagaattgctgaaagttacatatccttagattcagaagtaatagcgaatcccaagctgaataagtaaaacaaatgaacaccttaacacattatagggataccgaggtcactgaagtaaaagagaactatgggcaatcacaaggaagagacaaatgacttatgaaggcacaacagtaagattaacagcagatttctcaacattaacaatggaagcaagaagtcagtggaagagtaacatctgcaaaatgctgagatgaagagattttcaggttgatttttgacaagtctacctgtatgctatttataagagataacaaaatgatgaaagaggatgaaaaaatatataccaggcaagtagataggaagacacaatttcataaagatatcagttctctaaatcaatctgaattcaattgcaattgaattgcaattctaattaaaattcaaacaggatttttcttggaccttgacaagctggttttacatttcagtagaaaaacataggcaagaatacctagtttcgaagaagcacaacgtttgggtttactctaccaggtgtaactacttattataaaggtctaataattcagagtggtactgatgaaggcacagaaaaatagataaaaggtttagagcagaaagcacagaaaagtgcccatgcctgtatagaaattgacaaacatcagagggtcatggaagatcagtggggaaagaatggtgtccagattattggtttttcatctgggaaaaaaaataaggctgaatgttcacattataaacaaaaatcaattccagggtcggctgaagatctaaacaggaaagagaaaagtttccaacttttagaagaaaatgcttatgaccttaggttagggaaagatttcttataagtcacaaaaagtataaataacaattagattgataacctcactgatattaaattttaaaactgtgctcaaaagacacaaagagtaaaaaaataagctatcgactccgagaaggtatcatatagtttgaatgtctttttcccaccaaatctcaggttgaaatgcgattcctatgttggaggtggggcctggtgggaggtgactggatcatgggggcggttctctcgtgaatggtttagcatcatcctcttggtgataagtgagttctcactctgagttcatgtgagatctggttgtttaagagtgttgaacccacccccaccatttttcttgctcctgctcttgccatgtgatattgcctgctcctccttcaccttccgccatgactgtaagcttcctgaggcctcaccagaagctgagcagatgttggtgccatgcatgtatagcctgcaaaaccattggcccagacacacttcttttctttataaatcacccagtctcaggtgttcttaaaagaacaaatggactaacacaagatatatgcaacatattttgcccattaaatattagtagtagattttataaagtatccaaaatatatggagacctactattaaaaagacaaacaacccgataggaaagacaggcaattcgctaaaggaaaaaccaaaatagtaaatcaacatagaaaaagttactagtaatcaggaaaatggacattaaaaccatagtgaaataccgtttcacacccttcagcttggctaaaattttaaatctgatgataataaatataatttacaagctgttggaatcccagaacactttaagcattgagagagatgtgactgtgatctgagtcatatatgattacaacgtctgtttctcagattatagattaacttactttcttatttttcttgttctgtacaataactagagagaattaaataacaccagggacaacaacctcctgtcttcctaattaatggcctttgttattgattaacatcccctttgttgtcctgccttgctgatcgcagatgacaaaacccatcgctattataccctttattttaaaaaatgctaaatgtagccttcccacaaacactgcctatcatcagtcaaattgctataactatgtaccaaccttgtatgaaaaatgttctaatcttgctaaaagctaccctgtctctccctgtataaatgaaaccttaacttccctactttgaactgccaactccattccttggagttggtttcctggtggactattctcaaactttgcatttgaatacactcctttaaaattagattctgacccttttgattatttcaggttgacagtaccaacaattgatgtggctatgaagcaatttacagtaatgataatataaattggtaatcacttggtagaataagttgaaaatatctaataaagttgacaatacacatacgataagatgcagtaattcccttttaggtacgcactgcagacaagcccttgcacatggcaggagatatgtcaaagaatatttaatgtatcattctgatacaggagctaaaaagaaattatttaggcagatagtgaggctaaaggagtccttggcaaggctgccttttaaacaaaaagcagcccccaaatcatttcttttctaacaaagagcagcctataaaatcaagctgcaaacatagataagcaagctggaagcttgcatgggtgaatgctggcagctgtgccaacaggaaaaggctacctggggaccaggtatattcaatatggagactccatcttcccttttctttgtcaccacgtgtgcagtaaagaagcaggcaacatggcaccggccaggtggagaccccacctgcatagtaaaagattagggtggggcggccagcttctttgcacgctatgcaaatggcacacccagtcctaaccagttcttcgtgctgtatgcaaatggcacaactggtttgaccaatctttcgtgccctagctaaatcagacactgcctcctcaagcttatctataaaacctcctgcgcttcactgtggacctgaagacccgctcaggaccccctctatctgcccgagagagcatttctctttctttcgcctattaaaccaccactgttaacttcactccttgtgtgtctgcatccttgatttccttggcgtgggacaacgaagcctcgggtattaccccagatgaatgacaccacgtgaattcttttatagtaggaaattggaaacaaaatgtccattatcaggagaatgaataaataaattgttgtctatataatggaatgctaaatagcaatgaaagtgaatgagctagagctgtggttgtcaacatggataattcacacaatgttgaatggtaaatgtgaacttcagaagtacacatgtggtatacttgtactggtcctagactggtgcaaatggggcccctgtcatgggtcccacatctcaggagctagggcagagcttggacagagacccagatgactagctttcctctccaccctttgcacagctcctgaggttgaccagatgcccctagcagctctgggctgcacctttgtgtccaagtcttggttccaggaagaactctgagcagattgctcctgttggctggtgcagttggctggtgttcctgttggcaggtggcatagcacaagattgggctgccagaatggtactaatatgctggtttgggcaactcaaattgtttatatagacagacgcccccacaaaaaatacttgcttatgattccacacacctttgggcatataaagcttaaaaatgtgcagtataggccaggcatggtggctcacacctgtactcccagcactttgggaggccgaggtgggcagattgtgaggtcaagagatcgagaccaggccaggtgtggtggctcacccctgtaatcccagccctttgggaggccaaaacgggcggatcacaaggtcaggagatcgagaccatcctggctaacacagtgaaacctgtctccactaaaaaaatacaaaaattagccaggtgtggtggtgggtgcctgtagtcccagctactcaggaggctgaggcaggagaagggcatgaacccaggaggcggagcttgcagtgagccgagatggagccactgtactccagcctgggcaacaaagcgagactccatctcaaaaaaaaaaaaaaaaaaaaaaaaagtccaggcgcggtggctcatgcctgtaatcccagcactttgggaggccgagacaggtggatcacaaggtcaggagttcaagaccagcctggctaagatggtgaaaccccatctctactaaaaatacaaaaattagccaggcatggcggcaggcgcctataatccagctactcaggaggcagagacaggagaattgcttgaacccgggcagcagaggtttcagtgagccgagattgcgccactgcactccagcctgggtgacagagtgagcctcccgagtagctgggactacaggcacccgccaccacaccgggctaatgtgtttttgtatttttagtagagacggggtttcaccgtgttagccaggatggtctcgatctcctgacctcctgatccgcccgccttggcatcccaaagtgctgggattccaggcgtgagccaccgcgcccggcctatcatgttttatttcttaagctgggtagtgggggagtaaaaggtgctgattgtgttattttttatgcctttgtgtattatttgatttttttttcttttttttttaagaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttctggtgttactcagcaacgcttttgttagcgcctttaccagcaagtacttgttaaacacttaaatcttacaagtggaaagaaaattccgtggtaaatttaagtacaaaagtcaaccaaaattctgagtctcggacaagactggttaaaaatcgttctacaatgaaactaataaattaaatcatataaaactttta

SEQ ID NO: 531 - DNA, 120731 bp, Homo sapiens
tactagaaaatttaaaatttttaataaatgtgctttgttcacaaaatgtgaaaaaatacaacaaacacacacgtacattttcaggtatgctacctcccaccacttggcaactatggtaaaaccacatgatctagtcatgatactgaagaatccaaccaaatgattaccatttgtttttgaaacaaccaaattattttggagaaccagctgtgaatgtgacaggaggcctcataacttctttatatccaaaatgaaataattcttaggagtacccatacagtattagaaggccctattaacttccacttgttattacatacatgatctggcatcaagctgcaatgactgcttatacttcaatacttatacactgaattggtttttgtggaatgtgtatcagtttaaatctgtgccaacctaattggaataagctgaatttacagtaacaaatgatataaattcaaacaaatttatactaagtggtagtaggttttataaagagacttcctcagagtactacgtaaaatacatcatgcacactttggagcataagcagaatcaacatctgtaaacaatcagaatttatagcaccaacattttcgctgtaacacaaaggctgactccagggtcatactataccagcctttcaaaagcgctgttttcatttactttcaaagcattttcatttggtgtattgttttctttgctcttaagatatttacccaaatcaaaaagcaaacagtatggtaaaaggtactaccaaaatagttcaaaagagttctgtattatccttaacatagtgcttttttttccttccccttctcttggggaagctacaagacataatccttcagtgcttaactggaaagaacagtcaatcctaaatattaaagaatcttatgctgttgaaagtaaatgaaaaatttcgagttatttgtggcatatttgagcaaccaatatttattgcatttaatcaactgactttaaaaaattacaatcttgttactttcattaatttagcatgtgaaatttaattagaaatactgggtacatacactcaaccatttatatcataaaggataagttttatatttctaaataaagtttgacattcaaaggtactacggcaattcacaataagcacaaaaacatcagctttaccagagtaaagaagtgcagtttatgaaatttaggatcaactattgaaaatgcaagtttcctttaaaaacatacaaacatacgcacaacattaaccatgaaatctgaaactgtgatatttcagtgcaaaaacctcagtatgaggtaattttaatgtaataaccacttgaaaaaaaaatccacacagtggcactcttaaaaatgatagcttccatgacaattgctggctgacaagacaatgtggactaaatgttcttaactgtttaaactaatcttgtcttgtttggacatatatttttccctaatcatttgcttctgattcagaaacacagaaaggcatttattaatgtggaaagggaaaattcccacagccaactaattgatatattcaaagaaaattttctgataaagtttagatagaaattaagataccaaaaggtcaaaaccattttatgagatcaccaacagagggttaattttaggtttttccatataatttgaaacttgtagtgcggcacctccttaacggaaaggtgaggaccctatcaaagttggtttcaacagaacataaactctcttccaagtgcaaaccctttcaaaaaggtgttttaggtcattattgagtattacattgttccttgcttaaataaaacattttgtaaatgaagcctaagtttaagaaaagtaaaagtgaactctcaggtaaatatacttcacaccaaggcccaaatcaacaagaaagttatgaaaatactactttggcaatggtgtttattggatagggctaataaaattagaatacacactttgggggacatctctcccccaatgtctgatgctgtcaaatgagcttttaatataaggaagaaataaaaagaattatcaccaattacaaaaagttcagtaaatattggatcatcagacaaaaaaggaacataaaatgactttctgtaacatcacaattttagttagaaaaaagaaaaagataagtgcatcacaaaacaactaaccgatctatttttctgtatcacatttaacttgtgagtcatcaaagtgcaatctacagctttctacatcttaaagttttccattcaatggtttatagtcaacactgaaaagttgaaaaggaaaacatatagcaaattatgcttgttttcacaatagcactaaagagaaaaaggtacctttctatgatagtgctaaatgctaaagtaacagtagtttctgctatgacatgagtcactctgcatgaaactttaagctttctatataagaataaattttaaaattgagaagtagaaaaaaatagcaaactctgtaaacctctgcatttcttttatgcaaaccaggttttcagtactgagttcatgttagtatttccaattggtgtaagcaattagtttaggagcctggactgaaaggggctttttgcttctatattaacttaaaagtaatatggggtcttctagctcatagaaaggaatagagctggcttgactttctccagaatctgagtcatatggcgcatcagggagttctgtgaaaccatatgctagttgttcatcttctatatctgatcgaacatagcaggaagggttagaatattcctcatcttctatactgttgaaatcttgaggaatatataacattcctgggtagttcctactaaccaagtcacttgtggtttttagagagattttcctaaatgccatcagatgcatatgtgaaaattttgagtacttgaagcgtttaaagcccagggactctatagcaatcttccagcttttcatcatcatagcatgacggttctgatgggaggaatcaggtgtgatgattagtaataaaccatttaacactaacagttcatgggctttcttgcagcaaatccatcgctggtaaggagatggaaaataagaaagaaggagagagaaaacaaccacatggaaaagctctccaggaagagaatcaatagggtttttcagctgcttcaaaaaagcatctatagcatcctgtgcaagctggagtggttgctgaagctgtaagttcaggaaatcacatttatagacactctgcagaaacagaaaacaaggcatattaagaacttcaagattatttccactttagtacatagacttttcagcaaaccatttcacatatcatagtaattccagcattgattatacatttttccttttaaattattaaacttgaacagatgtattcaaccacaacttttacaaaaatctcaaagtaattaagtccaaagacctgctaatcatcatttaaatatatgttttttgcctaacaatttaaaatgggaaataatttgtgtattttgggttgggacttacatgaattttaatttgggtaggagtttacaggaatgacatttctatttacattcactttaacatttacagttaccaaaaacaaactaatataaaaatgctaaacaagaaataccatgaaataaagatgaatcaaataaagaggataatgaaagaggcattataaaatttgtacaagcagaatgattccaaaactttagttctttgaaactgttaactttaaccatttaaaaagtaaccctcaacattacttttattctattaaaaagttaatccctagtttggaacaaactagatttagttagacaaatgaccatgggaaacaatacaacagaggaatgaataacattatataatttgctaaatcttaaaactatggaaatgaatcagaataagcaattttaaaattagacaaaaataactctatcatataccaatagttattaacaaagatatgacctaataccttaatccctcactcatgttagtgtatatacaagccggccacatagtcatctggactgtttattaggaaaagtgatatgcaatgttctagtacctgaaaaaaagatgcttttcttcttccctttttcttaaaggcagctttattgatgtataagtgacaaaaagcataagtctgataagttgtgaggtatttttacactcatgaaaccactggcatggtcgaattaatgaacagatccaacaccccataattttccttattcccctttatagtcccttccttctcttcccctgccagcaggcaaccattgaagtttgtatttcctagaattttatataaataatcattttgagatttttcttgcaggtattaatagtttattcctttttaaattgcagaatggtatcccattgtatcaaggatgtaccacagttggtttatccatatacacctgtttatggatatctgggttgtttctagttttggttattacatttcaagctgctgtgagtattcccatacatgtgtttgaatcaacattctttaatttgtcttggggaaatatcttgggtggctagatcatacagtaggtggtgtagtaggtttaatttttaaataactcccaactgatttcaaaagtggttatgtagtttcatgttcccaccaggagtatgtgagagttccagttcctccaaatccttatcaactcttggtatagctagtctatttcattttagtaattgtaatagatgtgtagtggtatttcagttttaatctgcattttcctaatgagttagtgacatttatcatcttttcccggacttatttgccatccagatatcttctatgttaaagtgtctgttcaaatattttgcccatttaaaaataattgggttgctttaaataaagttttaagtattttctttctgggttttgagagttctttattcttgatgcaagtcctttatgatatatgacttgaaaatattttctcagtatcatgtggcttatcttttcattcttttaacagtgtcctttgaagagctgaagttttaaattttgatgaagactaatttatcaatttgttctttcttagatgttgctttcaaagtcaggtctaaaaagtcttttcctatcccaaggtcataaagactttttttcaaaatgttttcctttagtagttttatagtttatggctttttcatttaggtctatgatacattttgagttttttttgtttgtttgtttttttgtttttttgagatggagtctcactctgttgcccagactggagtgcagtagcgtgatcttggctcaccgcaacctccgcctcctgggttcaagtgattctcctgcctcagactctcctgagtagctgggactacaggcacgcaccaccatgcctggctaatttttgtattttttgtagagacagggtttcaccatattggccaggctggtctcgaactgctgatcttgtgatccgcccaccttggcctcccaaagtgctgggattacaggcatgatccaccacacccagccaaggtctttttttttatatggagtgtggtatggtttgaagtttcttcttttgtatatggatacccctttgtttcaacaccattgtggaaaagactatgctttccatcttgggcaaaaatcacgtacgtaagtttgggcttatttgtgaaccatctattatatttcactgatattcctgaacatcaataccatgctgtcttgaatactgtagctttataattttgaaatcaggtagtgttactctccaacactgtccttcaaagttgttttgagctattattctaggtcctttgaatttccacacagattttagagtaagtttttcaatttctacaaaaaagcccacaagagttttgatgaggactgcactgactctatacagacagggtctcactctgtcacctaggctggagtacagtggtgtgatcttagctcactgcaacctccaccctctgggctcaagcaatcttcccacctcaggctcctgagtagctgggaccacaggcgagtgccaccacatctggctaatttttctatttttttttttgtagagacaggtttttgccacattgcccaggatggtctcgaacttttggactccaacaatccacttgcctaggcctcccaaaatgctgcggttacaggtgtgagccactgcacccaccttaggtcatctttactttctcctaatttgtggtttgcagcatgtggatttttctacttttgtcagatttatgagctacatatttcatatatactcacatataaaataaacatttcatatttttgatgccagagtatggtactgtttttagttaaaatttctgattggttgctgctagtatatacacacaaatttctgtatattgatcttgtctcttgcaaccttgctaaactcatttgttagttttaggagcttctttgaagattacacagaaaaatcaaatagatgatcgatgacacctgtgaatacagttttacttctttccaatgtgcatgctgcttattgctttttcttgctttactgaattgttagaacctctagtacaaatgctaaatagaagctgtaagagtaaacatccttatcttgtttttgtgagaaaagcatttttctttcaccattaaggatgatgttagctggagatttttcagataccctttatcaggttcaagaaattcccttaaattctgagttttttttttttttttaaatcaggaaagtccagatgttgaattttgtcaaagctttgtcaaatgccttttctgtgcctactgaaatgatcaaatgactttttctttttgagttcatacgatagattgtttttgaattttaaaccaagcttgcattcctgagataaaccaaacttggccattatatattatccttttaaaataccttgttggattcaatttgctgaaattttgtatagaacatctgtatctatattcataagggatatggatctgtagttttgttttataacatttgtctgattttgataccagagtaatggcctcatagaatgagttgggaagtattccatccatttcaattttatggaagagaatatatataattggtattatttcttctgtaaatatttggtaaattttaacatgcaggcgttagtgcctggaattttctttgtgggaaggttttaaactgccaattcataatttcttcaatagatttagggccattcatcttatctgtttcttcatgaataagctttggtggttatgtctttcaaggaattggtccatttgaattgtcgaatttattggcataaagttgttcaaaatattttcttatacttttaatgttggtaaaatctgtcatgatgttacctttttctctttacttctgatcagtaggctagagtttataaattttattcatctactcaaagaactagcttttgctttcattaattttccctatttttctgaaagttttctatttcatttgatttctgctctgatcattatttccttttggatttactgctcttcttttttcttctagttgaaaagttgatgtcattgctttgagactgttacctaataaaggtgtttagtgctataattttcccctaagtactacttttgtgactttagtgacatctatgcattttgatatcttgtatttttatttcaaaaaagttctaatttccattgtgaattcttcgccaagtgttcagtatacctgttctaggaattatttagaggggtgctgaaatctctataattttatcaatgtttatgtttccttgacagtttatcagtttttggtttacatatttggaagctttgttattaggtgcatagaccaagtttggtttaggattgttatgtactcttgatgaactgaccctttaatcattatggaatgtcatttttatccctgatcatattctttgctctgaaatatactttgtctaattttaatgtagccatgccagctttcttttctccatcttattgctttcactctatttgtgtcttaataattgaagtacatttcttatgggcaacatatatttgggtcttggcttttttcccccaatctgccagtctttgcctttcaattggggcatttaggccatttctatttaatgtgttgattgatgtgattaggttttaaatctataatcttgctatttattttctacttgtctcacttgattgttgttcccttcccctcttccttcatcttttgaattaactaaattttttatgattttattagccttgttggctgattaggtataactcttttatttcagcagttgctttaacttatcagtctaccttcaagtgatattacaccacttaatgtataagaacctcaaagtactaatattatcacagtggactggttccaggaaccactgtacatacccaaatccacgttcaagtcctttatataaaatggtatatttgcatacaccctatgcatatcctcccatatattttaagtcatctctagattacttataatatgtaatgcaatgtaatgttatgtaaatagttgttatgctatattatttttattgttgtattgttatttttatttattgagacagggtctccctctgttgcccaggctggagtgcagtggcacaatcttggatcactgcagcctcaacctccagggctcaagcgatcctcccatctgtctcctgagcagctgggactacaagtgcaccatgcgtggctaacttttttattttttgtagagatggggtcttgctgtgttgcataggctggtctcaagctcctgggctcaagcagtccttctgcattggcctcccaaagtgctgggatattacaggtgtaagccaccatgccctgccgcaaatatttttgatctgtggttgactgcatccacagatgtggaatccaagtatatggagggccaagtatatttctgattctctcatgtcaccctttatgctactgtcataaatgttcattttatctatattaaaaaccccactctatatcattatttttgcttaagttgttgtattagtttgctagtgctgttgtaacaaagtaccatgaactgggtggcttaaacaatataaattttctcatagttctggaggcttagaagtctgaggtcaagattgtgggaagatttcttccttttgagggctgtgagggagaatctaatcaatgcctcttgccttgcctctagtggtttgctggcaatctttggtggtctttggtttatagatgcatctctccaatctctgtgttcatcttcatgtgacgttctccctgtgtgcttgtttctgagttaaaatttctcctttttataagtataccagagtcttattggactaggggccactgtaatcacccctgtttaatttgattacctctgtaaagctcctatcttcaaataaagtcacatctttagagttagaactccaacatatctgttttaggttgacataattcaacccgaaacaatggtaaattatctttaaagagtttaaacaacaagagaaaatctttttagctgtatagttatcacttctagtattcttcattcctttgtgtagagccatatttctaactggctaaagcacttccaccttaacatttcttataatacaagcttgctaatattgaatttcagcttttacacatctgaagaaaatcgatttcatcttcatttttgaaagacattttggctgggtataaaattctaggtgactttttccttcagtactttaaggtgtctttacaatttctgggagcttttaagattttatcactagttttagaagtttgatttgatgttccttggtgtaattttcttgatgtttcttttgtttggggtttgttgggcttctttgaatttgtgagtttaaagctttaattaaattggaaagtttttggccattttttcaaatcccccaccttttgggggattccaattatgcttatatttagttgcttagatttgtatcactgatgctcttctatttaaaaaattttctgtttcattttggatagctgctattgttgtatcttcaatttccctttccttctgcaacatctaatatgcattaatcctatccagtatgcatcttcacatcacacattatagtatctgtctttagaagatagatttgggtattttaaaatatcttcctatttctacttagctttttatacagttttgatttttttaaataataaaactgtattgaagcataacacatataaggaaagaatataaactgtgtaaaagtttagcttaagtaattttcccaaactggtattatctctattttaatgtccctgtttctgtgtcagttcagggttggtcattgttggctgatttatctcctcactgtgggtcctattttcttgctgctttgcatggctgtaattttttttggatgctagacatggtgaattttaccttggtgggttctacataactatggattgctataaatattcctgaactgtgttctgggatgtagttaagaaacctggagacaatctgaagtttttgggtcttacttttaagatttgttacatgggactagagcactagtatttagtctaaggcaaattattctccattattgaggtaagacccttctctgtgtactctattaaatgtctgtgaatcttgaatgctccagtatggctgatgggaacaggtacaatattaatacttctctgtgtgactgctggccactgtaatctctaagccttttggacagtaccttatctagtctcatgtagttttctcatatacatgtgtgctgatttgtactcagctgagtattcaaaggggaccttttgcaggcctctggagttttccctctatggctttcttattttcagtagaccattctagaaactctagctgcctcggtctcctaggactctcaactccctaggactcttcacaactcacagaatcacctgaactctgcttgggtttctccctgtgctatatcctggaaactctctcaaggcaatatcctagagtaattgtagggcttgtctcatttgttttccatctctcagagattactgtccttcattacctgatgtgcagtgtcaaaattatttcgaatattttgttgcttcaagtggaagaggataaagctggtctatcttatcccatcttggctggaagagtaagtccctttactctgttttaaaattagttataggattctgaactgtgaaactctgattctactacttaagttatgtatagccgtcttttgtcttccctggtgactatacaattcagtgtttataaacctatccataaatagatttaatattaagcttaaggatcagatcaaatggtcatggtgtctcagcagtccctgaagaacatctctcatgtatatcttgaggaaggaagggaagataatccatgcatgaagccacttgggctttaaaactagttcctgatggcacagaacttctctgcagtggtaagctaagaacagtgattttataatagagaaaacgaaagtagaaataacagtaatggttttaggacttgcttgttccttgatgttatacagatttaatcatgctcatcaaaatgattcataatcaaagtttcatatgaaagttaaatcttcatgcaggaatttaccagtagtaacaacaaacatttatttagcaggcactgtataagagctactatgcttgatgctttaaatacttttttttttttttcaagaaaacattacaacaacctatgaaatgtggtctactactaaccccattatacagatgagaaaactgaggatcagagactagaaaatggtgatggagaggttcaaacctaggctggaaacatgattctattcttttatttaaaaaagtattaaatatactaggcactcttctaggtactgggaatacagcaatagagggaaaaaaatccctaataactaatatattaatactctaatccatactttaaaaataacattaaaatgcattttgtaactatttaaatgcattttgtaaaaatttttatgtctagagttctatcaagagtaaaatggtaaacataatgaattaatgttattctggaaaaaagtctttttctgatataaataatgtgcctactttagagttatctatctttaaaaaatgcctttaacacaaactcttggcatcacatgattaaggtaaaagaaagttcaaggtggctgggtgcagtagctcatgcctgcaatcccagcactttgggaggttgaggcaggtggatcacctgaggtcaggagttcgagaccagcctgaccaacatggtgaaaccctgtctctaccaaaaatacaaagttagctgggcgtggtggtacatgcctgtaatccagctatttaggaggctgaggccggagaatcactggaacccgggaggcataagttgcagtgagtgatcatgccactgcactcaagcctgggcaacaagagcaaaactccatcttaaaaaaaagttcaagctgataaggtgatcctgcttcactgaattgaaatgatagtgtcataataactgacccataggaaatgttctcaaaagaaaggatagtatctatcatttattgagttcccataatgtaccaggccaagtgttaagtagtttcatcgactcaagtacaaacaagctggatttaataaagttctggctgatgccaaagcccttgcctctttctactattccataatggctctacaacactgtatatttcagaaagagatgcattaaaagaaaataataaaccaaatataacaaaatgcaaaacccaaacactacagctatgtggaattctgtaatctactgaagtttcttttttttttttttttttagacggagtctcactgtgtcacccaggctggagtgcagtggcgcgatctcgactcactgccacctccgcctcccgggttcaagcgattctcctgcctcagcctcctgagtagctgggattatgggcgcttgccaccacgcccagctacattttttttattttttagtagagacggggtttcaccatgttggccaggctggtctcaaactcctgacctcaggtgatccacccatcttggcctcctaaagtgttgggattacaggagtgatccaccatgcccagttgaagtttcttaattgcaatgattttgctctaacatagttttagattatggctatttagatgataaagaaaataaagacaatatttggttaaatgctcaattattcacaaaatgtatttagttttgaaatctctcctcaatgggtacacaggaaatacatttgctattttagggatgcaaagacagtgcttttcttttgtaaatatacatgtaaaatattaaagtccaaaaacaaaactatgcatacctctacagcaggtacaatatctatgccaacagttagaaattcttcaaacttcagaaatgggttaaagcagctgccaacatcaagtaatctgatttttcctgaggcttgtagcaacctaaaaacagatattttataagaacaaaatcaaatatgagaatgtaagaaatcacatagattatcagttctttaactttttggtctcaggacccttttacacatataaaaattactgacggccccaatgagctttcatttctgtgagttatatctattaataatgatcatatttgaagttaagatgaacaagtcttaaaaatattcatttattagacttaaaaaggatagtaaaaaagtacagccttgttttatatatatttacttatttaattttttaaaaattgagacaaggtcttgctgtattgcccaggctggtcttgaactcctgagctcaagtgatcctccagcctcagctcccaaagtattgggattagaggcgtgagccactgagcctggctcccccacccccaacccccatttttaaaaaatatattttttcaagtctctaatgtctggcttaattgaagatgaatgaattctaatatctgcttttgcattcaggctgttgcaacatcacatgctatgtagtctctggaaaactccactctacactcagagtgagagtaaaaaacaaatgagaatctgtaacaatacgtaatactatacacactactagtcattcttacccttattgggctatggttaaggagttctcgaatcagaaaggctaagaccataaactgactctgacccttaacatgtaatacggggataatagtggtatttacccttagactttttcccagaattaataagataatacattaatacttgaccctatgcctagtacatggtaagtgctcaaaaagtggtacatatcattgctcactattaccatgttttataaaaaatttgtatttcttccactaatgatcttccctagtaaaagcagaatttgctatatgctaaattctgtagtatagattctagtaaactgagtagcaaaacatttctgagagtcttaaaaaaatatacttcttataaattgaattttctttctcaatgaagtatcctaaaccattcaagttacttcaacattatggaacaatcaccaataacttaatcatatcatggattagcttaataactgatcaattgtcagcaatatactaagcctatttcaaattatttggcttcgctccttaattttttatttgcataaaatatacactcagtgagtgaccatgtaattaccactcaggtcaagacataatgactgcatcctggaaacatgaccctccctgatgacatcccccacacctttattttaggtagtcactatccctattttagtcacttatccttatttattcccttgatttccttttatagtcttaagtacctacgactgaatgtctacagtttagttttacactacattttgtaacttgctgctttcatttgctgttgtttttgagttgtttgtgcttctataattcacttttactgctgtacagtagtacacttaagacttttattagcatggcattaagtctaaagatcacttaaggagaattaacatctttacaatattcaatcttcaaattcatgaacatgaatagttatccatttacttaaaaaactgtcaatagttttgatcattttctctaaaaagttccctcacatcttttgttggagttatattccttggtatttcctagtttttgatgcttttattatcttttttcccatggatacactttacttttttttttttcaatttcattttttattgttggttacacagatgcaattgacttggatacaatagtccccccttatctggtgtttcaccttttgtggtttcagttacccgcagttaaccatggtctgaaaatgctcaacagaaaattccagaaataaaccaattcatgagatttaaattgcgtgacattctgagtagcatggtaaattctcacaccgtcagacccaggacacgaatcacatccatttgtccaaagtatccacgctttttgcattagtcattaacaggatatcttatgatcctgatatctaacaattcacataggcatggcttcatgatctaggattactgaaagcaggtgatcctcctcctcctgatgtacggtcagaaggtcaacagtagcctaacgctaagtcacaatacctatgtgattcacctcactccatcccattgtatgggcattttatcatctcacatcataagggtaagtgaagtaccataagacactttgagataccatactcaaatactttaaaaattatgtgagtaaatgaagtacaataagatactttgagataccatactcacgtaatttttatagcattttgttataattgttctattttattgttattcttcttgtgcctaacttataaattaaactttatcatgggtatgtatatataaaaacatagtatgtataggattcagtaatgtctgtggttttaggcctccatgggggtgtcagcatgtactctctgtgaagaaggggtggctactatgcattattttttttagatccagcagctttactaaatttatctcgattgtttatctgtatattattttgtgtactccaggtacataagttcctaatctgtgaaaaatgacatttgtgtttcatcctctcctatcacccacctacccatccattttttacctccttaccactctgctgaggacttccaatatgttggtagatagaagtgggcaagtggatggacactattaatcttacatcagaaggaacattccagtgtttcaccattaaatgtaataactggtataggttttagatactacccttaataaagttgaagttcttttataaacttttattttaggtccaggggtacatgtacaggttacacaggtaaactacgtgtctcaggagtttggtgtactgattattttgtcacccaggtaataaagatagttcccaataggtagttttttttattctctcccttctctgtctccacccttaagtaatccccagtgtatgttgtttccctctttgggtccatgtgttctcatcacttagctcccactaacaagtgagaacatgaagtatgtggttttctgttcctgaattagtttgcttaggataatgacctccagctccatccatgttgctaaaaaggacatgatttcattcttttttatggctgcatagtattctatggtgtatatgtaccatgttttctttatccagtctactgctgttgggcatttaggttgattccatgtctttgctattgtgaactgtgccgtgatgaacgtatgtgtgcatgtgtctttattgtagaatgatttatagtcccttgggtgtatacccaataatgggggattgctgagtctagtggtaattttgttttaagttctttgaggaattgctacactgctttccacaatggctgaactcatttacattcccaccagcactgtattagcattcccctttctctgcaaccttgccagcagctgttattttttgactttttaataatagccattctgatgcctgtgagatggtatctcactgtggttttgatttgcatttctctaacgtttagtgatgttgagcattttttcatatgcttgttggacacgtttgtcttcttttgagaagtgtctgttcatgtcctttgcctactttttaatggggttgttttctacctgcaaatttgtttaagttccttatagatgctggatattggacctttgtcagatgcatggttatattttctcccattctgtaggttgtctgtttattctgttgatagtttctgttgctgtgcagaagctctttagtttaagtaggtcccacttgtcaatgtttttgttaaaattacttttggcatctttgtcataatctttcccaggttttatgtccagaatggtatttcctaggttatcttccaaggtttttctagtttaacatttaagtctttttaactgatcttgagtttatttttgtgtatggtgtaagaaagaggtccagtttcaatcttctgcatatggctagttatcccagcaaatagcgagtcctgtccccattgcttttgtcaactttatcgaagatcagatggttgtaggttttatttctgggttctctattctgtccattggtctgtgtgtctgttttggtaccagtaccatgctgttttgtttactgtagccctatagtatcgtttgaagttgggtaacatgtgatgcctccagctttgttatttttgcttagaattgccttggtgatttgggctcttttctggttccatatgaattttaaactagtttttcttaattctgtgaagaatgtcattggtagtttgatgaaaatagcactggatctgtaaattgctttgacagtatggccatttcaacaataatgattcttcctatccatgagcatgaaatgttttccatttgtttgtgtcatctctgattcgagcattgttttgcaattcttgttgcagagatttttcacctccctgattagctgtattctaggtattttattctttttgtggcaattgtggatggggttgtgttcttgatttggctctcagcttgaatgttcttgatgtataggaatgctgctgatttttgtacatttattttgtatcctgaaactctgctgaagttgatcatcagatctgggagcttttagcagagactatggggttttctagatatagaatcatgtcatctgcaaacagagatagttggacttctctgcttctatttgttccttttatttctcttgcctggttgctctggccaggacttcaggaaatcattttatgcttagctagggtggtttttccttttttgacacaaatccatgtggaattttatcaaatgcattctatatatttgtgcagatatgactaatctatgtggtagaaaaaaattcattaattgtatagtgtcaaatcaatcttgcattctttggaaggtcctaatttggtttctatatattattcttttcataatctgaggatttgttttatatgtctgtgtgtatatacagtaaattctggctacttgtggtcatttggttctataaagtgaccatgaatgttgaattagtgaatgctaaacaatggctcttatggaaactacaggattaggtctctggtcataacattttcatcaatacataccttgaatttatatgtttctgtttaaaagcactgtatttaatacgtattgttgatgcattaacattgaactcgtggccaacagcactataactcatgcctgaaggaagcttacataacacatgtatttttcttcgttaaggcacaatacagcattcttgtgctcaggaacactagacttcaacaccatatgtgggggttgttttaaaagcaaagacatcaacaaaaagcacaaacaaaaaatgtaacaccaaataggctgtgaaaagggtgtttgtgtgagagagcggaaacaaggcatagctcaccttgttggacctcagttgggaggtttatgtgtagaatgagtcaaattttttgccacaagtattgattgtagggttacaagtaagtaagttttagtaagttaggtaattcacagacagggaatttacaaatgagaatcgactgtgtgtaggtattttcaggattttacatctatgtttataagtgggcaagtttgttaatcatgttgttcaaatattgatagtcttactttttgaatgtttcctcaatcttccaccattaagaaaacagaataatctctgcaaattgatttaaaggtattttgttattttcatatatgtttatttttgcaaaaaagaaatctagaaaggataacccagaaactaataaaacctcagaagatctggaacaaggtggatgctttaagtatgagatgggatgtctgagtataccgttcattgtagttttgacttttggaagttgttaatgttttacatattcaaaaaataaaaccactataaactaatgaatctagttaaatgtcaaataacacagaaggaaaaccaataattcaataccatttgagcatactattctaaagacaataatcttgatgggtaatattctaaggacaaaaaaaaagaactgcaaaaatatcctgaattttaatgtttgttgttgtggtagtgctgatatagtcatcttgaaattattttgtgtgtcttgaagagctgagcaaatagcaaataaactaaagttgctgagagatacaaactcagaatgagggaacggagggaaaaaaccctgcagtgatggattagaattagaggtttcataagaaaggatgtcaaagcagtgacaccacagtaacaaaaagcatatctaatactcagaatttggtttctaaataccgttctctcactaaaaggaacctgtactacttagaggaacagcttatgccagggttgaagcagagaaagtacatggttaagcctcgatgatcttattgtacaagaaagtaaagcactgctcaaacactatgacaaggtaaaagaaactactttaaaggcatttccattggcctaatttgggatgatttcaccatcataagaatgaactttaacacaatgatttaaaatctgagactacaggtacttaaataagaaagggggagaaaggaaagatgtttttacaaaagaatgccaaccaatatatttgagcaagatagaaattaatcaccattttgcaaccactgtaataaaaacaacttgatttaggcaagaccactaatggatgctaaagccactggtgaaaacagaaacttcacttggtgtttatgtatataattcactccacaaattacagactaaaggtacttgggaggaatctggcagacatcaccttagtcaaaagatcaaacatcactgaaaatctgagtgatgccctgagaacccaatatcacctatgtagcatgcttaccagaaacattaatgtaatcacagggagttttctgtattaatgcagtccaagagatatttaactagatactatatgtaatctttgatgaatcctggatcaaacaaccatcaaaaataaatctccccaaaacaactatagatttgtcaattttcattatatatatgaagtgttaataaatttcattatttattcaatatttgtttcatatatgcatacgatactattaggcacaaattaaaaattgttatattttcctactaaatcacaccttttatcacaaaaaatgtctcctttatctctagcaatgatactctaaagcctcatgttttggatatctctcataagagcataaattggatttttatattcagagtctgacaatctatgttttaattggaatattttgatctgttatattacttttgcactttctatctgctctacctattctatgtttcttttctcacactctgtactttctttggaatcacactggaagttttaacaacacccagagattctgatttaattgaggggtacgatggagtctgggcattatgattttcaaaagctccctaggtgaatgtatggtatagctaaagttgagaactggttttagatttttcctttttaaatcttagtaattccatgtttttgattttgctaatttgaaaattttacattgcctttgtcttcacccagaccatacaaaaccttgagaacacttaaaattctgttaaccacataaattagtcattttgtgtatttcaattctattattattactggtgtatatctgtttagactttccatttgggatcactttttttctgcctgaaagatagctttagaatttcttttaagtgaggtttggctttcccattctcgcctctccttctgcaactccaataaagatgaaagttatacttcatttttaacttctgtctttaaccattttattttttttattttacattttcttgtctgtgtgaggcaagacaagataataatgttatctggatgataatgtttcctagtttgataattcctcttcaattcattccatatactgagtttattttaaataattttggctttccaaatggctagtctttaaagtttctatttcccgtagaaattttcaagcaattcttttctctaaaatagcatcatccctgggatgcaaggctggctcaacatacgcaaatcaataaatgtaatccatcacattaacagaaccacatgattatttcaatagatgcagaaaaggccttcgataaaattcaacaccccttcatgctaaaaactctcaataaactaggtattggtggaacatatctcaaaatcataagagctatttatgacaaacccacagccaatatcatactgaataggcaaaaactggaagcattccctctgaaaactggcacatgacaaggatgccccctctcacgactcctattcaacaaagtactggaagttctggccaaggcaatccggcaagagaaagaaataaagggtattcaaataggaaaagaggaagctaaattgtctctttgcagatgacatgattgtatatttagaaaaccccatcgtctcagaccaaaatctccttaagctgataagcaacttcagcaaactctcaggatacaaaatcaatgggcaaaaatcacaagcattcgtatacaccaataatagacaaacagaaagccaaatcatgagtgaactcccattcacaattgctacaaagaaaataaaatacctagcaatacaacttacaagggatgtgaaggacctcttcaaggagaactacaaaccactgctcaaggaaataagaggacacaaacaaatggaaaaacattctatcctaatggataggaagaatcaatttcatgaaaatggccatactgcccaaatttatagatttaatgctatccccatcaagctactattgactttcttcacagaattagaaaaaaactactttaaatttcatatggaaccaaaaaaggagcccgtatagccaagacaatcctaaacaaaaagaacaaagctggaggcatcacactacctgacttcaaactatactagaaggctacagtaaccaaaacagcatggtagtggtaccaaaacagagatacagaccaatggaacagaacagaggcctcagaaacaacaccacacatctacaaccatctgatctttgacaaacctgacaaaaacaagcaatggggaaaggatttcctacttaataaatggtgttgggaaaactggctagccatatgcgaagaactgaaactggacaccttccttacaccttatacaaaaattaactcaagatggattaaagacttaaacttaagacctaaaaccataaaatagcttgttttataaattgtgattcataattctaatatacaaagcctttataggtctgttcttgctgcctctgctgactttaggtcgtaccttgttttcatacatgcttagtaatgatttttactataagcaatttacatttcctgaaaaattatttatgaaaattctttgagtagaagtctctttgctgtgtcaagctacctggagtaccaccagtttagggccactttcaactaaataaatacaaggtttaaagttttgtggacccactttgcagatatgaatttgtgcttgggatattctatggtttcaacctgttcagggtctgtctgctttggatgaaggaatagatttacttctggttcaccaaattgagaaagcagctgtttggagattcaattctataagaggagtgtaaaagccaacactcaagtttgccagtttggaccaatgctctcagctcaacagaagctttgtgctttgcttacttttctggcttcccgtcatcatttggattttggccttatcagttcttacctaagaagatttatccatcattttaaaaaagttttcagtttgggagattggttagaatacctagataatcatattccagtttaacttttaaagtaaaataagtaaacagataaaattatcttagtctaactagtcagcataaaatcagtttgtgacaacatagtcaacagttatgaaagtgtatgtaaataaacagtagtagtgttttgttactgttcattgatgtgaaagtactgtattacatgaatatgttaagtatgctaaagacaatagactttgagtatctattaaaagactgtactttcttcatcaaaaaaggctagagggccaatcttaagtgatcttaactgatacactttacttccacattaatatatgcaatgcacatagcaggagaacctaacttgagaatcaatacctcattaaattattaaaaaactaaaactacagaaaagtgcttgttataacacaagaggaactacctgaaaatgcatgttcagttgcttaaatgttttcaaacaaataaaacttctttgccaattataacttaaattcagcaaatatttaaatcatctaatgaataaatttgagtcttgaaagattgtatcatacaaccatgtgtaccttcttcctctaagtcaaaggttttaaaataatttttggaccctcaaacccctttaagcagtctaaagacagatcccttttcaaaatgctttcagaaatgcatgaataaatcaaatcacaaaattagttatcctgaaatagttatcatactattacaagaaaaacaaagctatgatatagtaacaagtgtttctttagtaacacattaaataatgaggattcagcaatataatgactaccacaatttctaagtagtgatgagaataagtattctgatatatataactacaatatgatacaaacatctgtaatttctctaagtaataaagtcatagatactagttttgctgcctacattcataaaagaaggaattgctaaattttaattggagtgaaactagaaaactagaagagaccgataaattcctgaacacatatccccttccaagactgaaccaggaagaaattcattccctgaacagaccaataatgagctctacagttgaatcagtaataagtagcctaccaaacaaaaaatgcccaggaccagatggattcacagaattctacagctgtagaattctacaaagagctggtaccactcctactgaaactattccaaaagactgaggaggagggactcctccccacctcattctatgaagccagcatcattctgataccaaacctggcaaagaaaacaaaaaaagaaatatccttgatgaacactcatgcaaaaatcctcaacaaaatacttgcaaaccaaatccagcagcacattgaaaagccaatccaccacagtcaagtaggctttatccctgggaagccaggttggttcaacatatgcaaatcaataaatgtgactcatcacataaacagaactaaagacaaaaaccacatgatcatctcaataggtgcagaaaaggcttctgataaagtccaacatcccttcatgttaaaaactctcaataaactaggcactgaaggaatatacctcaaaataatgagtcatctatgagatactcacagccaacattatactgaataggcaaaagctggaagcactccctttgaaaaccagcacatgacaaggatgccctctcaccactcctattcaacatagtactgggagtcctgtccagagcaatcggataagagaaagaaataaagggcatccaaatataatagaaaggaagtcaaaccatccctatttgctgatgacatgatgatcctgtatttagaaaacatcatggtcttggcccaaaagcaccttctgctgataaacaactcaagcaaagtttcaggacacaaaactcaatgtacaggaatcactagcatttctatacaccagtaaggcaatcccattcacaattggcataaaaagaatgaaatacctaggaatatggctaacccggaaggtggatgatctctagaatgagaactactgctcaaagaaatcagagacaacacaaaaaaatggaaaaacattccatgttcatgcataggaagaatcaatattgttaaaatggccatattgcccaaagcaatttacagagtcaatgctatacctatcaaactaccaattacattcttcacagaactagaaaaactattttaaaattcatatgaaaccctagaaaagtacccaaattgccaaggcaatcctaagcaaaaagaacaaagctggagtcatcacattatccaacttcaaatgatactacaaagctgctacagtaaacaaaacagcatggtactggtagacagacgcatagaccaatgggacagaatagagagcccagaataaagctgcacacctatgaccatctgatttttgacaaagctgacaaaaacaagcaatggggaaaggacactgaataaatggtgctgggatcagtggctggccctatgcagaagattgaaactagaccccttcttgacaccatatacaaaaatcaactcaagatggactgaagacttaaatgtaaaacttaaaacgataaaaactttggaagacaacctgggcaacaccattctggacataggaatatgcaaaggtttcatgactaagatgtgaaaagcaatcacaacaaaagcaaaatttgacaaatgggatctaattaaacttaaaagcttctgcacagcaaaagaaactaccaacagagtaaacagactagctatagaatgggagaaaatatttacaaactatgcattgacaaaggtccaatatccagcatctataaagaacctaaacaaatttacaagaaaaaacaaccccattataaaaagtgggcaaaggacataaacagacacttctcaacagaatacatacacgtggccaacaagtatattaaaaaaagctcaatatcactgatcattagagaagtgcaaataaaaactacaatgagataccatctcacacaagtcataatggttattattaaaaagtcaataacagatgctggtgagtttgtgtagaaaagaaaatgcttatacactgctagtgggagtgtaaattagttcaaccgttatggaaagcagtgtggcgattcctcaaatagctaaagcagaaataccatttgacctagcaatcctatcactggctgtatacccaaaggaatacaaatcattttaccataaagacacatgcacatgtatgttcactgcagcactattgacagtagcaaagacgtggaatcaacctaaatgcccatcaatggtagactggataaagaaaatggaatagtattgcagtcataaaaaagaacaatataatgtccattgcaggaacatggatggagctggaggccatcatacttagcaaactactgcagaacagaaaaccaaatagtgcatgttttcacttataagtgatgagaacacaaggacataaagagaaaaacaacagacactggggcctactttaagggcagaggtcaggaggagggagaaggtcagaaaaaataactgttgggtactaggtttagcacctgggtaacaaaacaatctgtacaacttttttttttttttttgcatgagagaaacaattcttttacattaatgctaggtatagctatcctggtttctctccaatttacaagttcttacaggatttgtaatcatacttagcaaactaatgcagaaacagaaaaccaaatagtgcatgttctcacttataagtgatgaggacgtatggatataaagagggaaacaacagacactggggcctacttgagggtagaggatgggaggaggaagaagatcagaaaaaataactattggatattaggcttagtacccgggtggcaaagtcatctgtgacatgaatttatctatataacaaacctgcacgtgttctcctgagcctaaaatgtaagttaaaaagaggtgaatgaaaaagatttttctcttgctgttcatggaccccataaagggttaagtgtcaaatgaagtaaacctggacaggttcatttcacacagaaaaggctgtcaaataaaaatcattttaaaggaatggagcaactttctagggaacctacggtgatgagctaaatatgtggccaacttctaacgagtacaccagcattttcactggtttatattaatctcacttctggttccatattcatacattttattttcctcatttaaaaaattgtatctgtttttataagccactgtatgctttttggaatatgagcattctagaaattttctgcaaattaaatagttaatacctaatataaatatgaataaaattaaactgaattactcatttttcccattttaattactgcttataattgtttctcaagagagaattcttttacattaatgctatgtatagctaccctggtttctcttagatttactcttggtaagttcttacaggatttgtaatcatgtagtccaaaataaatcattctataagaactactttcacatcaagataacttttatgtatggaatcaacaacattgataaagactaaattccagcactaatccttatgcaaattctcacagcataattttacttaggggaaaaatcttatttgcaagttaaatggcaaagtttgtggttagatatctggatttcaaaaaaattgccttagcaaattaagaataaatgatttaacagcagaaatactcaaatggtacaacaggatctttatttttcttgataatcctaattgaactattctttcttactacaattaaaggacctggaaattccagtattttgttatccaaactctatttcagattaccttttattcacagagtactacccaccaaacatacataagataaacctgtgtcagatcataatttgtaatttttgatgtggaaaatattacaactataggccaggcatggtggctcatgcctgtaatcccagcattttgagaagccgaggcgggcggatcacctgaggttggaagtttgagaccagcctgaccaatgtggagaaaccctgtctctactaaaaatacaaaattagctgggcatggtggcacatgcctgtaatcctagctactcaggaggctgaggcgggagaattgcttgaacgcgggaggcggaggttgcggtgagccaagattgcgccactgcactccagcttggggaacaagagtgaaactctgtctcaaaagaaaagaaaatattacaactacaaggactgtcaacctagaagcccaagttctaaaaacagaaatatgagtataggccaggtgctgtggctcatgcctgtaaccctagtgcttttgggaggctagggcaggaggactgcttgagaccagaagttcaagaccagcacagaccacatagctagtcactgtctcttcaaaaaatttaaaaaattaaaaaattagcattacaggtcatggtagtgcatgcctgtagccctagctactcaagaggctgaggtgggaggatcgcttgagctcaggaattagaggctatactgagctatgatcatgctactgagctccagcctgggcaacagagtgagactctgtatcttaaaaaaattttcttctgaaagacaataaataatagaggcttatattaagtaactataattataaatatatagctattgaaactttctcagtttagaaatcattttcatttgaaatttagtgaaaaagtatttcaaatctataaaaattcaagtacctttagcatcattaaaaatactttacatgtatacatacctataatttgacaaacattattgaatacctattctatctgttagcctgtttcagagcttgagatataaagttgagtaagagagtccagatactcaagaaattagtccagtgaagaagacacaagtgtaaacagtgcaatgtttgcattaggtagacgagtatacaaaatcttacgggagtagaacactcagagaagggaagggaaactcagagcgctggagcctgcagaataagcaaggttttcccaggatcaaatggagggggatggtggagagtaaaggagaagactattgaggtgggtgactatcattctagtcagaaatcatagttaactgaaaaggtgtatgtttccaatcaggtatggactttccacagactctctgaatctcattataaaagtgccttttgaaatgttgtgcagtcacttatttcactatatttctttaaaaattctccaatgcgggaggccgaggtgggcgatcacgaggtcaggagttcgagaccagcctgatcaacaaggtgaaaccctgtctctactaaaaataccaaaaattagctgggcgtggtggtacacgcctgtaatccccgctactcgggatgctgaggcaagagaattgctttaacccgggaggcagaggttgcagtgatccaagattgtgccactgcactccagcctgggtgacagagcaagactccatctaaaaaaaaaaaaaaacaaagaaaaaattatttagtactacttttttcccctacccttaacattgctttaaaactcactttgattttaaaagtattttaaaaaaagaaaatatcttaaatggttctttcattggtttctgcaagattattaaatccaattctgctaccacaaataaacacacatatgtatatggcagtagttttcaaaccaacttatgctttaatataaaaaaatcacaatgtaatttcccttcacagaaatagaaaatagtttggtacagtaaaaaaaggctctggagacagataatcaacagagctctctctatctttacctacactttactagtatgtgaccttagaaattttacttatcttctttaggtctcagtttcttcatccatgaaatgagggggtagaagtagatgacctccaaagaccattctaactatacaattttagaggactctttagggttttctagatataatttcatcagcaaacagagaaaatttgacttcttttccaatttggatgccctttatttctttctgttgctcgactgctctggctaggacttcccgtactatgttgaatagtagtggtgaaagtgggcatctttgtcttgttccagttcttagggggagtgttttcaacttttctccatttagcatgatattggtggtgggtttgttatagatggcttttattattctgaggtatgttcctgcaatgcctagtttgttgaggggttttatgaaagaatgctggattttataaaatgctttttctgtgtctattgaagtgatcatatggtttttgtttttaattctttttatatgaatgacatttattgattgcatatgttaaaccatctttgcagttgggcatggtggctcatgcctgtaatcccagcactttgggaagccaagatgggtggatcacctgaggtcaggagttcgagaccagcctgaccaatgtggagaaactccgtttctactaaaaatacaaaattagccgggtgtggtggtgcatgcctgtaatcccagctacttgggaggctgagggaatcgcttggacccgggaggcggaggttgtggtgagccaatattgcgccattgcactccagcctgggtaacaagagtgaaactccgtctcaaaacaacaacaacaacaaaaaaaaccatctttgcatccctggaataaaactcagttattcatggtatattatatttttgacatgtgttggatttggtgtgctagtattttgttaaggatttctgcgtctatgttcaccatggatactggcctgcagtctttttttgtgtgtgttcttgcctggctttggaattcgggtgatattggcttcacagaaattagttagaaagaattcactacacctcaatttttgggaacagtatcagtaagattggtaccagttcttctttgtgcatctggtagagctggctgtgaacttggtccttggctttttgttattttgttgggagagtttttactactgattcaatttcactattagttattgttctgttgaggatttctgattcttcctggttcaatgttgcagggcgctggatgtttccaagaatttacccatttcctctagggtttctagtctgtgcatgtagtttgtgcaagactcaaggcatctctgatgattttttgtatttctgcagtatcagttgtaatgtcacctttgtcatttctaactgttgcttatgtgaatcaccttttttccctcagttaatccagctagcagtctatcaattttgtttatcttttcaaagaaacttttgtttaataagtgacttcagtaaagtcaaaatcaacatacaaaagtcagtagcaattctatccaccaataatgatctgacggagaaccaaatcaagaactcaatcccatttccaatagttacaaaatataaaatatctgggagtacatttaaccaaggaggtgaaaagtctctacaaggagaactacaaaacaccgatgaaagaaaatgtagatgatgacacaaacaaatggaaaaacatcccatgcttatggattggaagaatcaatattgttaaaatgactatacagcccaaagcaatctcaatcactattaaattatcaacaacatttttcaccaagtctaaaattcatatggaacccaaaaggagctcaactagccaaagcaatcctaagcaaaaagaaccaagctggaatcatcatattattcgacttcaaattacaccacaaggctataataacaaaaacagtgtggtattagtatgaaatagatatatagatcagcggaacaaagcagaacccagaaataaagctacatacctacaaccaactgatgtttgacaaagtcaacaaaaatatacaatggggaaaaaagcctactcagtcaataatgctgggaaaactggatagccatatacaaaagaatgacattgaactcatatctcttgccatatacaaaaattaactgaagattgattaaagatttaaatgtaagacctgaaactataaaaatccagggaaaactcttctggagattggtctaggcatgaattcaaaagcacgagaacaaaaacaaacagacaaatgggacttaaaagcttctgcacagcaaaagaagtaatcaacagagtaaacacacaacctacggaatgggagaaaatatttgcaaactgtgcatcctacatagggctaatatgcagaatttaaagggaattcaaacaacctaacaagaaaaataacaatcccatttaaaaagtgggcaaaggacatgaacagacattcttccaaagaagacatacaagtttccaacaaatatatgaaaaaatgttcaacaactctaatcatgtgaaatcacaatgagatatcatctaacaccagttagaaaggccattattaaaaagtcaaataacaacagatgttggcaaggattcccaccacacaattggtaggaatgtaaattagtgccacctctatggaaaatggtgaactaaaaatgtaactaccattcaatctagcaatcccactactaggtatctacccaaaggaaaagaaattatatataaagacacctgcccttgtatgttgatcacagcactatctacaatagcaaagtcatggaatcaacttgtatccatcaataaatggctaaatacagaaaatgtggtgtatatatgtacatacacatcatggaattctacgcagccataaaaaatgaaattacgtcttttgcagcagtatgaatggaactggaggccatgaccttaagtataatgactcagaaagccaaatacatgttctaacctgtaagtgggagctaagcaatgtgacaaacacattgacattgtttgtcaatgtggcaaacagagtgaaataatagacattggagaatccaaaaggtgggaggggagtgggggatgggaaactacttactgggtaccatttacactaaaagcccagacatcactacgcaatgtatccatgtaacaaaaatgcatttgtactccccaaatctattcaaataataaaaaagtaaaaaataattataaaatttttggtcagcccttgacagaataaaatatcactctcttgcccaattctagtttttctatatcaacttgcagcggtaaattatttaaaaaatcactctctagtaaattaggaaccacatttcatgaaaatctaatttgtcatgttaatatacatctaacagcagcaaagctctaacaagaacctttcttagtgtgtcatatattgaataaaaactggtgtaatcctggcactgtcagatccaatgataatgaaccagagtttctttcactgcctcaacatggaatcaagagtgtaaagagactctgtcaccgagaagcaaaagactctctaaaggacaacgaactaaaatgctgttaggctggtttctcttttcagcatatctgccctacatttcatttgcattttgtaaagtgataaaacacactaattggaaaacaaagcttggctaaaaagtttatttctgttatgctgcctctacattttaatgctactttgaaatgttcatttatattccttaaattttcacttctgattctttagacaaatttatgcagataatcttaaaactgcattatttaaaaatatttttataacttaacttataacttcatttgacattttttcctttattcagcggaaaagaattgaggaaatacccttggtatatataatgatgtatataagctattcaaattataattttctacttaaatttaaatttcatatacagtttttaactcaatattgtcttttcttttccaaaacagagttcaagatcgtatttctttactctcgcccccttgattcccaccctgctggttatgtattttaataaggaaatataggatttttatttcctacataattttgtttggtgtgtggccagtgctgacaacagcattttgaactactcaagacatgttaagaaagagctgtaattctaagtaagctttttttgcttattgagtaagaaaacctggcaatatttacccaagtatgtagtttacagtagcttttttgttgttttttcaaagtgctctctacagagccagaggcattctctagagtcagtgaagggccagcaaaggcagatatgggagataacagtaggctataacttttataaccttcaaccagaacagcaattttgattcatatggtgggcttccataaaaggtttcttctgaataaagattctatggttaaaatactttgaaatcaatgatctaggccttatttatcatctctgctgctttgaagtaggggaatgagaaaaataggtttctatttcgtatcttttagagcagggaaaattcaaaaagaaaatgcgttgagagtcagtttgtacacagcattgtcacttcttgaattgatgacagtcatacacatgagaaatttttctaatgtccacttttggggctgttagatgagaagtgggtaaaatttattactagatacctgagatgacataaaatcattagttcctcttgtctcagtcatttaaggaacagcagaaaaaaatagttagaaaatatctgactctgcatgagactaggcttattctcatttatttggcaacttacccttagcatttttcatataatccatttcatttctgtatgcataaaaaaatccctgaaatactgactggttaaagattattggttttgattgcaatgtgtaagccagaaaacagcttctcctctgtgttttggtgattaggaaataaaaaattcattgcaagaggtaagtgtggtgatcaaaggttacttatgggctaaacaacctgcacaaagtagatgaaaaaaattctgcctatcataccatacttaagctttaacaagaaaagaagggaaccagatattggctcatagaattaatgatttatatctgaaaaaagtttttctcaaagagcatttcatgaaatagtcttgcaagaagctctttagtcaataggtcaatgaatgtaggaaatgtattctctttttgaaaagctacacaaagaatgtaaccgtctaatagctgtatggttaaggaacttaatttctttagtccaatgtttccccaaatttattttgctgacaaactcccttttcaagaacatattactatcttacagaccttttctggaaaattgagaccagagatctgagaatagaggcttcttaacaaaggcaagtatatctggtttctaagtaaaatatctggaaaaaacaaaaggataacccagaaactccatatacagagctcagagaaaggtataaagaattaagtaaaaagatcttagctatggcttttttcccgtagatgtccagattcctgctcttattgagaatattctttgtgttgctatcatcatgaatatcattaccatataacaatgacagcggccactgcagcagcaatgcaaagttcttatcagtaggtactactactctcattttatagatgaggagactaagtcttaatacaccaaaggtcatatggctaataagtgatttcagatgggattaaaatatttagcagcctgagcttttaatacttatgctttctatatctaatatagaaggaaatggcagtttggatacatcttaatcgttttccatgcataagattaatatacaatggaaatatatactatgaatgttatacttcactttgaaaacaaccctaggtattaggtttttattgctgggtaacaaactaccacaaacttaactttaaaacgacacccaattccataggtcaaaagtgcaggcaggcatggctggtactctttttagactctaataaagctgaaaccaaggtgtcagctggtctgggctcttatctagggactatgtggtatagaatctatttcaagcctcattcaggtttttggcagaatctagtttagcgtggatgtaggactgaggtccctgtttccttgctggctggctgctgggagtcattctcagcttctggaggccacccatatttcttagatcactgccccctccgttttcaaagccaatagcacattaaatccttcttatgtttcaaatctccctgacaccctcttttcccctcctcttctgctaaatctgaagaaagttcttggtttttaaggacttaggtgattaggttaagtttacccagataatctattttaagtaaattgattctgtaaaatcatttcggcagtacctagattagcatttgactgaattaacaaggaataacaattttggaagcgggggcatcttcagaatcttgcctacctcaccatgcttgggggagattaaaaaaaaaaaacttttactttctattagccactaatagttttagaagtttattcagaatttttacttttgtggttagagagtgacatggaaatactgagacttaagtgtttcgtgtgtgtatatgtgcgcacatttgctaataaaaacccagaactttatgttgtttctttgaagccatgaatataaacgagtatacaactaactcagaaattcagttaaatgaatgtcattttgattggactgttacaaaatgaagaaaaatcacaatggcagtagaaattaatacccgaattatagactttttaaaaaagaaaagtgtattatttttatttactttttttttcttttttttttttcgagaccgagtgtcactctgttgcccaggctggggtgcagtggcgtgattttggctcattgcaacctctgcctcccaggttcaagcagttgtcatgcctcagccacctgagtagccaggactactggcgtgagccaccacgcccagctaatttttgtatttttagtagagatggggtttcaccttattggccaggctggtctcgaactcctgagctcagatgatctacctgcctcggcctcccaaagtgctgggattacttatttacttctttgaggatgtaaagaagcaaataccagcttagcagcactgacctctgcatatcttttttgctatagttttgaagtatttgaaaaagttgcattcaaaattaacaacttttgcaaataacagaaaacataagggaatattaatattttgattatctcaaataatgttcctgtacaagaaaactacgtgatgtaaaaatatttattgtccaaatgtatttacatatttaattcaatttaaatgagtatctcctaaaacaattctttttgaactaaaagaaatgaggaaaaatcagaaattaaacaatattcaaaactatatagtaaataaaactgaacaaaggaacagaatacagatagcttcagctccatctataaacttatctgataagttaggttcattcattccctaaatcacatatacacataaacctcaggtaaattggtattgagttacatataatctgaacacaaagtatttaatatacagagtttatgctaaagaaaaaaaataatgaagtcagcagtaaaatgttcttttaatcttttttttttttttttttttttttgagacggagtctcgcctgtcgcccaggccggactgcggactgcagtggcgcaatctcggctcactgcaagctccgcttcccgggttcacgccattctcctgcctcagcctcccgagtagctgggactacaggcgcccaccaccgcgcccggctaattttttgtatttttagtagagacggggtttcaccttgttagccaggatggtctcaatctcctgacctcatgatccacccgcctcggcctcccaaagtgctgggattacaggcgtgagccaccgcgcccggccatgttcttttaatctttacagcactaaaataaaaccacaaaacaatggtttgaataaaaatataaacaaacccaataagaaagtaaaaaacaaactgaaagccattaatactaatctatattagaaatcacaaaacaaatacaaacatgtatctaaagtcataaattgcaaaaactataaaatttacatatacacaatcatcacacaccagtgacaaaatgaaaaagtttcagagctgtgctgatctatattgtgtctttgcatcacagaagaagaatttagaagaaaaggtacccccagcttcttcaaataaaaatgttaagttagtctattctgtataaactaaagaactgtatgcaatggcccaagttgcctgcccagagaggctttccagagcccatgaagaagcaacctggctgtgcaaatgtgtgtcacacataccctgaacctgtaagtgcacacactgccagcaacctatgacatcccagtaagatgagcttgtcagggtcagagtaggaggtgagcaaacactgggcatcctagagcagcaagtaggtcagggagatgtcccctgggatgcacaatatggctgggaaagaggaagcaatgctatgagtatttgggtaataaatgatgatggtcttttttgttgctccagggctgggttaggaggcaggaccaccatttgttcttatttaagtcagtataaacatctacccatgtgaatggcttactccttggatgtggctaacttgtgtggtgtggagtctgaatactattagtggcaaccttttaaattacttttaaatcaaaatgaaaatatttagtaagaactatgaaacattcatagtctttgaactgcaatgttactataaattttctcttaaggataacatgatagaaacaaagacatgaagcatgaacttgattatacagccattaaaaataaacatgaagaccacactagatacagaatgtttaccctgacagtaaaaacagaatataaatatacagattttgaaagcagcaatgtaaaaacatataagaaaatagaagataatagtaattctgagatagtaaaatcattacagaatattttttaaattctataatttttaaaataaaaatcaagttgttattcttaaatgcttaaatacttcttatttatttgttaaaaatcctttttccagttagcaaagataaatttttgattagatgttaatcataaattcaaactaatgtgattttaatatatgtcagtgatttacttgtgaaagtgtatatacttaatgaaacatttggctttcaagttttaacaaggctatttgtacagggtgtccactcctatgttcctaaaagtagagaatatataatattacttacaagtgtgggaagccagtatcagaacttctatttatctgtgattttaatttctgaaagaaatgaagctgtactgatatttaatacatgaaatgacacttcagaccctgtgatgattaatattatgcatcaacctgactaggccatagtacctagatatttgatcaaatacctgtttagatgtcgttgtgaaggcacttagatgaaattaactttaaattagcagactttgagtaaagcagactactctctacaatgtgggtgggcctcatccaatcagttgaaggccttaatagaaaaagactgagtttgctcccagaaaggaaattcagcctccagattcaagctgcaatatcaacttttccatgggtgtccagcctactagcctgccctgcagattttggacctgccagcccccacgattcatgtgcatcagttccttaaaataagtttctatctctatatatacagttatgagccacataacaacgttttcagtcaataatggatggcatatatgatggtggtctcataaacataatggagctgaaaacttcctattgcctagtgatgatttagtgcaatgcattactaacatttgcggagttgctggtataaacaattctgcattgccagtcttggaaaagtaaagcacacagaattatgtacagtatataatacctgatactgataataattattggttatgtatttactacacttttgttatattagtgtattccttcaggcaggtccctcaggaggtattccataagtattgttgccatgggagatgagagctcctttgccagtaatgacctgccagtgggacaaaatttggaagtggaagacagtgatattaatggtcccgaccctgtgtaggtctagactaacaaatgtgtttgtgtcttagcttttaccaaaaaagtttaaaaagtaaaaaaaacaaaatttaaaagcttatagaataagaatataaaggaagaaattattttttacaatgtgtgttttcagctaagtgttactgcaaaggagtcaaaaagttaaaaatattaaaaaatttataaagcaaaacagagtaagctacgattgattttactgaaaatgaaacttaaaaagtaaatatagtatagcttaagtgcacagtgtttataaagtctatagtagtatacagtaatgttataggccttcacattcactcaccactcattcactctcacccagagcaacttctagtcccgtaagttccattcgtggtaagtgcactatacaggtataccatttttaatcttttataatcatatttctatggtgccttttctatgtttagatacacaaataccattgttacaactgccttcagtattcagtacaaaacatgctttgcaggtttgtagcctaggagcaaatgactataccatatagcctacaggtatgtataggctataccatctaggtttgtgaaagtacactctatgttcacacaacgattgactaatgacacatttctcagaatgcatccctgttgttaagtgacacatggctatatatatatacccattctattctgttctgttcctctggagaaccctaatacacaaccctacacagacaaccctgttatctgatggttgagctttctgtttgttaaggaggaataacaatggcatccctgctattcgttcccttattgcatcctgcgactgtattgagttttcttgctcttagttaagtgcatacagtgaattattgacttaattaaactaagtctcacaaaggagtagctcatcaagattctttgcaaaaaaaactaaaactaatacaaatgcaagaaaaaaagtcaacagatttgccaggcgccgtggctcacgcctgtaatcccagcactttgggaggccgaggcgggtggatcacgaggtcaggggtcaggagatcgagaccatccaggctaacacggtgaaaccccatctctactaaaaaaatacaaaaaaattagccgggcatggtggcgggcgcttgtagtcccagctactcgggaggctgggacaggagaatggcgtgaaccggggaggcggagcttgcagtgagccgagattatgccactgcactccagcctggggtgacagagcaagactctgtctcaaaaaaaaaaaaaaaaaaaaaaagtcaacagatttgatacttctcttcctagtaaaaacactctttgcaatagtgaggcaaaaagtgactaaatcagatcctgacaaaagctggaaaaaactataaaaaaggctaacgtaaatacagatttacatttgctcatatcattgccctaagtgattatgtcttgagatatgggtgtacaacacaggtgagttataataatattttaaaatattatttccttcaattatttcatctcttatttatagcacaaataacttgctggcaacctatactgcagtagtttttgacaactaaattttgtggtaggacatgtttctttaacaaaggggaagtatctagtgcttaagaatacattttatatttcatagaaatttcttatgatttaatacacttatcagtcttcttaaaaatgacttagtgagctgagtgtggtggcatgcacctgtagtcccagttacttgagaggctgaggtgggaagattgtttgagcccagcctggtcaatactgtcagaccccatctcaagacaacagaatttcttgataataggagtatacatcatgaccgttagtgatttttatagacatataggagttggcttctacaataaatatggctgtttttggaattatttattgcttttctctaaaacagttggtcccttgactcactgtcacattttcttattaataaatctgatccttctgtcttcttgaggtttctaatctgctatgcttgaaaaattctctcctcttcattaaatataagtcagctaaaagtggacctactgtctgatgcaaactagggtaaggaactaaatagtacagccattagattacgaacatcttctgaagatataaagtcccctttttaaaaaaaccttttcccgaatagtctactccctaacattttaatcctttgtttttctccttgggatcatccataatgttttcatctgttgtatttatgattccatcctattctaaatactttgggtcacatcgttgtactaaatggtaaacaattgaaaagaggccaggtacagcggctcaggcctttaatccaagaacgttgggaggctgaggcagggtggatcatttgagctcaggagttccagaccaggctgggcaacattggtgaagccctgtctctacaaaaaataaaaaattaggtgggcatggtggcacatgcctgtagttcaagatacttgggaggctgaggcaggagaattgtttgagcccagcaggtggaggttgtggtaagctaggatcacgccactgcactccagcctgggcgacaggaatgagactgttttttgttttgagacaaacaaaacatggaaaacatggaagagatcttctaggggtaaaaagaaaacagaggattattaattttccctgtttcaaacctcaatgttgtcatctccatattataacgttagagttaacttaatcatgagattggcactattgggcattcggaaattaactctatggtcccttctcacagagaatttattcattcactcaattattggattgcattatatacaaggctactggtgccaggccttgagacgtagaaaataatatagttctaacatgttttcatggagctttacaatctaatacaatggtatggaaaattaaaatgctccttgggccagttattaagtgaagaattaatggttttagaattctctaacctgggctggatatggtggctcatgcctgtaatctcagcactttgggaggccaaggtgggtggatcacctgaggtcaggaatttgagaccagcctggccaacatggggaaaccctgtctctactaaagatacaaaaattagcagggtgtggtggaagacacctgtaatcccagctactctggaggctgaggcaggagaatcgcttgaacccaggacgtggaggttgtagtgagctgagatcatgccactgtactccagcctgggcgacagcgtgagactccaaaaaaaaaaagggggtgggggctagaattctctaaccctttcttaagttctcagccactatgacagctgatgaaactctggcatcacactacttgacttcaaactatactacagggctacagtatccaaaacagcatggcactggtttaaaaaaatacatatatataggccaatggaacagaatagagaatcccgaaataagatcacacacctacaagcatctgatcttcgacaaaactcaaagaaacaagcaatggagaaagaattctctattcaataaatggtgccaggataactggttagttatagtcagaagtttgaaactggatcccttccttaagccatacacaaaaataaaatcaagatggattaaagacttacagatacaactcaaaagtataaatccctgaaagacaacctcggcaataccattcaggacataagcaaaggcaaatacttcgtgatgaagatgctaaaagcagttgcacaaaagcaaaaattgacaaatgaaatctaattaaaataaagagcttctgcatagcaaaagaaactgtcaacagagtgaacagacaacgtacagaatgggagaaaatttttgtaagttatgtatctgacaaaggtctagtatccagcatctacaacgaacttaaacaaatttacaagaaaaaaaacaactccattaaaaagtgggcaaaggacatgaacacttttctaaagatgacatacacacagccaagaatcatatgaagaaaagcttgatatcacttatcattagagaaatgcaaatgaaaaccgcaatgagataccatctcacgtcggtcagatgtcaaaaaataacagatgctagcaaggttgtggggaaaaaggaatgcttacacactcctggtgggagcgtaaactagttcaaccattgtggaagacagtgtggtgattcctcaatgaacaaaagaaataactttccatcccattactgggcatatacccaaagaaatataaatcattctattataaagacacatgcacatgtatgttcactgcagcactattcacaatagcaaagacatggaatcaacctaaatgcccgtcaacagtagactggataaagaaaatgtggtacatatacaccacggaatactatgcagctataaaaaaatgagatcatatcctttgcagggacaatggccatggtggccattatcctcagcaaactaacgcaggaacagaaaaccagataccacatgttctcacttataggtgggagctaaatgagaaaacatggacacagagggggacaacccacattgaaacctattggagggtgggaaaatggagaggatcaagaaaaataactaatgggtactaggcttaatacctgggtgatgaaataatctgtacaacaaacccccatgacacaagtttacctatgtaacaaacctacacttgtacccctgaatttaaaagttaaaaaaaaaatctggcatttggacatgggttctcctgtgtttttatgataaagtttaatgataggatactgtgaattctatttgtattcaacctggagttaatccataacagtacaaagatctttggggggtaggcttttcctcaagaatgattcttaaacaaatactgcttaaaggcttagagagtgactgagtacttcactctgaagtacttgaccactctacactcatatttacagctgaaagttctgtgttttaaccactatcaaattaacacaggtaacaatatttctttggagtccaaaaccactgctttggagaactgaggtgggaaaataatccagatggctaaagttcttcaaaaatttatatatttttcttttttgagacagggtctctctctgtcacctaggctcgagtgcagtggcacaatcacagctgactgcaaccttgacctctcgggcttaagtgatcctcccgcctcagtctcccaagtagctaggacagaggtgcgtagcaccgtgccccactaatttttatatttattgtagagatggggttttgccatgttgtccaggctggtctcaaactcctggactcaagtgatccgcttgccttgacctctaaaactgctgggattacaggtgtgagccaccagccctggcctaaaaatttctgtatttcaaagatggcttccacctgtagttcacatttcatctttggttagatttaaaattaacgctatactcttaattttaaaattttaaaattggcattctcagtcgggcacagtggcttatgccttaaacccagcactttgggtggctaatatgggaggatcacttgaggccaggagttcgagaccaacctaggcaacacagcaagaccccccatctctctcttttttttgagatagagtctctctctgtcaccaggctggagtgcagtggtgcaatctcagctcactgcaacctctgcctcctgggttcaagggattctcgtgcctcagcctcccaagtagctgggattacaggcacacgccaccatacccagctaatttttgtatttttagtgaagacagggtttcgccatgttggccaggatggtctcaatctcctgaacttgtgatccgcccgcctaggcctcccaaagtgctgggattgcaggcgtgagcctccatgcctggtgtcccgtctcattcatatatatatatatttcatatatatacatatattcatatatatatcatatatacatatattcatatatatatttcatacatacatatattcatatatatttcatatatacatatattcatatatatttcatatatacatatattcatatatatttcatatatacatatattcatatatatatttcatatatattcattcatatatatacttatttatatatttattcatatatatatatttatctatatacatatatttgctacttgggaggttgaggggaaggactgcatgagcccaggagtccactatgatgagctatgattgcaccacttcactccagcctgggcaacacagcaagaccctgtctcttaaaacaaaatacctaaaaaactcatgatattctccagaaataaagcaattaccctctaacattctatattagattattcaactatatactaactatttacatgccaggcattccacaggtttcaataatacagtgataaagaagacaaagctattatccttaaatacacacagctaaaatataatttaggtaattgctatataaataaaatgctttatgaattatttttacatgcttttctgtatagagagctgaactgaggaagaatgtgaaccatacacaatataataaatgtataatactactgaggactgtaatttaaaaaacaaagaataagatttgagattaaatgtctatatatttttccatatacagttgctcaataccaggaatttggctattatccacatagtaagaataagcttacaatggaatatattataaaacttggaatagggaaacatctcagaattctgtgcaacattacaactaaagaagccacctctgcctttggccgacccacagctaggtaatctccccaggccaagtgaaacagggagagtgaaaaagagccagggaaggaagggcgtgagttctagtggccacctgcctgcggctacacagcagttgcctggtaaaatgaaagaagtcaggaagggagttgggtgcaacccaagaagagggctcttctacagagtttcagtttctgttgtacctctttaaatagcagctgccccataaacttcatggtagaaggtttagaaagccaaagactcaacctccattctccactataggtcccaaacatagactctgcccaggcctgaatactacatctcgaaagtgtttaaaaatttcctttgttttccaattagcagcagacttcatactaatccctgcttttcttacctgctttttttcctcctctcaagatgctttcaaacaatgttactgctatactttctcaaaagaatgcgattgtaaacaaactggggaagacattaaataccagatgaaggaatttaaaaattgggctctgttttcccctgcatatgccattgtcaattatacgtttttgtaatgtccatcatttgatacaaattactggaaaactgaaacacaatacagccaaaatgtttcaacatctccaaaggactgcactagctccctagcaatggatcctaacctgaatgaaatgaaaattaaaatagtgtcagggataagaagcttagttgtcaatcttaatacaattgagacaaagataaaattcattcagcttgcttaaaacagtgaattttcaacctctcaattttgtaatcactggacacgtaattgaaaagctaaaaattcaatcgtgtactcaattttatgaatattaaagaacatgtataactactgaaaatatattgttactaattctgttcaaagcatgaggcataattaataattttctatttctcaaggaaatggaattaaaagtcttcttataactgtccaacttctgaatttcatattactcttataaaaattttcaggaattctttatgatacaaaactacccatacgtgaagaagttatggtgtctataggtacaatgccacttagtatgctgacagtctaagtaaaattattttcttactatagtaataggataggattttgcatgtgtcaaaacttttggataatgttcctgaatggataaatcataaaacatggaataatattctaaaaagcacaagacttttctaaactctgcagaaaagaactatatttaaataaaatgcctatcagttagcttgtttaccaaatacagttaatatttaaaagcaaaacatgaaaaattatggctttgctttagaacaggggtccccaacctctgggctgcaaactggtattggtccgtggcctgttaggaaccgggctgcatagcaggaggtgagcggccagtaagcattaccacctgagctctgccttctgttagatcagcagcagcattagattctcataggagcatgaaccctactgtgaaatgcacatgcaaaggatctaggtggagtgctccttatgagaatctaatgcctgatgatctgaggtggaaaagtttcattccgaaaccacccttcacccctgtccatggaaaaattgtcttccacgaaactggtctctggtgccaaaagggttggggactgctgctcaagaacaccttacacttgcaaactactatgtctactattaagcaaccaagagttttgtcttttttccccaaaaatggtggattagaggctttcagcattacccatccacttggaaatagcaaaaatagtgcgtaaagatcaatatgtaactttaattcaagaaggaaaatgggaattcaccagactagtaaaggataccctagaccctggggaggagaaggcaagccagcaatcctcgtgaaggtgtttggctggttacatgaatgaaagccccagtatgtgaaaggggcagtctgtcttcctgtgtgtctcacttttctgctagttatctgtataacccaggcaaagggagagcgccctgtttctcccaaaactgggaggtagtgtggggaaaggctaagagatagtgagggaaagacaccaggaagctgcaggcattttcccagacctaggactgagaggaggacaccatttcaaattcaggctcacacaaagtcagtcactgtttggccacctggcaacagcagccactgcagacattttagtatcagtcagagactggagtgcttgctctggagcagggaaaaggcccccacagccagaatcaggcagtgagtgtggagagtgccccagcagtagttgctggaattaggctgtctcctgttgcaagaccggagtggaaggagagttgctgaagctggtatttctcctacgtggtttgacttgcagccagggacagctttgtgacctggaacaagtctgcatgggtcactgctgggtgtcccgggctgcttccttggttggttgcgggacagtagcccaccagtccaaagacagggagggaagcagtctccagtcccctggagatttaaccttcagtgtggactgccccaacagaaggaggaacgtggcctgccaaagccttccttgggtcaaaggaaacaaaagtgaagcacaagccactgaagggggcaacagcaaagccaaggaatgaattcggagagtgggggtaatctctcgcccccagccccgctcattagtgcactgggacgaatgcggcagcagctctacatgctggggaccagagcgtgtgggctgagagaggtgctgtgcaggcctctccagcagctccactcccgctgaagaccagtggcactggcgggataaggatgcttcttttgcctctgtcgcctcctgctggctcttactcataagcgccatctactggacggcagcctgaattacaccaccaaacaagaatacatctctacaccaagcaacatccgagaaagccactgtagaaactatctgcaaccaaggaacccataacacatgaatacacccagaaatgaaatcaaatgatcatattcaacatacaccagtcatatcaacgaaataaagcataaaaattaaaaaaaaaaaccatcccaatgatagcaaattcaaaaaaagcagcaccagtttcctcggatgagaaggaacaagcacaagaacttcggcaattatagaaatccagtgttccatcacctccaaaggatcacatgagctccctagcaatggatcctaatcagaataaaatgactgaaatgatacagaattcagaatatggatggcaagaaaactcaacaagattcaagagaaagttgaaattcaacagaaaacagaaaaatgatccaggagttgaaagataatataaccatattaagaaagaaccaaccagaacatctggaattaaaaaattcactagaggaatttcaaaatacagttggaagccttaacagactagacaaagcagaagaaagaatttcagagctcaaagactggttcttcaaatcaaccctgtcaaataaaaataagaagaagaaaagaacacaaagccttggggaaataagggattatgtaaagcgatcaaatctacaacttactggcattcctgagagagaagagaaaacaagccacttggaaaacatacatgaggacataattcatgaaaatttcccccatcttggtagagaggttgacatacagatgcagaaatccagagaagtcctgtgagatactagacaaaatgaccatccccaaggcacatagtcactagactatccaaggtcaaagcaaaagaaaaaatctcaaagattacctataaagggaaacccatctggctaacaatagatttctgaggagaaatcttacaagccataagagattgggctcccgctccctgcctttttaaaacaacattcttaaaagaaaagaaatgccagcgaagaatttcatatcccaccaaactaagcttcatatatgaaggagaaataaagtatttttcagacaagcagtcgctaagagaattcactgccatcacaggccctacaagagatacttaagggagttctaaacaaggaaaaagaacaatattccctactacaaaagcatacataaacacacagctcacagatcctataaagcaactacgtaattgagactacaaagcaactaataacactatgaaagaaacacaacctctcatatcaatattaaccttgaatgtaactgacctaaatgctccattagaaagacataagttggaaattggattaaaaaaaaaaaaaaacccacccatcttctgtctttgagagacccatctcacatgtaatacacagtctcaaagtaaagggatagagaaagatctattgcataaatggaatataaaaaaaaacaggggtcactattcttttatcagataaaacacaatttaaaccaatagtaacaaagcacagagaagggcactacataatgataaagagctcaattccatgagaagactgaactaccctaaataatatagcacccaatgttggagcatgcagattcataaaataattacttctatagtcaggaaaagactcagacagccacagggtaatagtgggggacttcacctcattcacagcttagatcattgaggcaaaaaactaaaattctggacttaaatttgacacttgaccaactggacctaacagacatccacagacaacttcacccaacaaccacataaaacacattcttctgtcatctacacacagaacgtagtctaagatggaccacatgctcagttataaagcaagtctcaataaattttaaaaaggtcaaagtcatatcaagcatattctcatatcacagaggaataaaaatagaaatcaatatcaagaggaactctcaataccacacaattacatggaaactaaattaacttgctcctgaatgacttttgggtaaacaatgaaattaaggcataaatcaaaaactatttgaaacaaatgaaaatataaacacaacataccaaaacctctacaatgcagcaaaagcagcattaagagaaaagtttgtagtgctaaatgccacaccaagataggaaggtctcaaattaacaatctactattgtacctaaagaaactggaaaaacacaaactgattgcaatgctagcagaagaaaaaagtaactaaaattagagcagaagtaaatgaaatcaagaacaaaaaaccatacaaatgatcaatgttaatagcataaacaagattgacagaccactagttaaacaaagaccactagttaaacaaacaaccagaatattcaaataagcaaaatcagaaatgacaaggtgacatgataccaatcccaaagaaatacaagagatccctagagactactacgaacacctctatgctcacaaaatagaaattctagaggaaattcctaaaaacacacaatgtccaaagattaaattgggaagaaattgaaaccctgaagagaccaatgtgttccgaaattgaatcagtaattaataaaatccagaccagaggaattcatagccgaattctaccagaagcacaaaaaataactggtatcaatcctattggaactatccccccaaaaaaatcgaggaggaggaattcgttcctaactcattctatgaaaccagtatcaccctgatgccaaatctagcaaagacacaatgaaaaaacaacaataaactacagccaatatacttgatgaacatggatgaaaaaatccacagtaaaatactagcaaaccaaatccagcagcacatcagaaagttaattcatgattaagtaggccttattcctaggttgcaagattgattcaacacatacaaatcaataaagtcattcaccacataaacagaattaaaaaccatatgatcatctcactagatacagaaaaagcaatagaaaaatccagcattccttcatgataaaaatcctcaacaaactaggcatctaaagaatatacttcaaaataataagagccaccgatgacaaacccacatccaacatcatgctgaactggcaaaagctggtagcattctacctaagaattgcaacaagacaaaatgtccactctcatcactcctattcaacatagttgaacataaaatgataatgaagtcctagccagagcaatcaagaaagagaaataaaaggcatccaaataggaagagaggaagtcaattatctctcttcactgatggtatgattctgttcttcagaaaattctagagactccaccaaaagtctcctaaacagtcagtgaagtttcaggatacaaaatcaatgtataaaaatcagtagtaaaaaaaaaaaaaagaaatttaaaaaatcagtagcatttctatactatttataatggccattctacaccagtaacactcaagctaagaaccaaatcaagaatgcagtcccctttacagtagctgtgtgcgtgtgtgcacgtgcgtgcacacacccacacacccacacacacacacaaatacctaggaatatatccaaccaaggaggtgaaagatctctgacaaagagaactataaaactctgctaaaaaaaaaattacaggtgacataaacaaatggaaaaacatcccatgctcatgaactggatgaatcagtattgttaaaatgtccatactgcccaaggcaatgtacagattcaatgctcttcctatcaaatcaccaatgttatttttcacagaattaaaaaaaaaactattctaaaattcacatggaaccaaaaaagagcccaaatagccaaagcaatcctcagccaaagttaaaaagctggagacatcacattacccaattgcaaactacaatacaaggctacagtatgcaaaatagcatggcactggtacaaacacagatacatacactaatggaacagaataaagaacccagaaataaagccacacacaaggagctgattttcaaacaagtcaataaaaataagcaatggggaaagaagtccctatttaataaatggtgctggggaatctggctacccacatgcagaagaatgaaactggacccttacctctcagcatatagaaaaattaatgcaagatgggttaaaggcttacgtgaagaccacaaactataaaaatgctagaataaaatctaggaaacactgtagtggacattggcctaggcaaagaatatatgactaaatcctacaaagcaattgctacaaaaacaaaaactgacaagtggaacctaattaaactaaagagcttctgcaccgcaaaagaaactatcaataaacagacaacctagagaataggagaaaatatttgcaaactatggatctgacaaagctgtagtatctagaatctataagaaacttatatcaacaagcaaaaaacaaattaccctattaaaaagtgggctaaggacatgaacagatatttaatagaagacatacctgtggctaacaaacgttgaaaaaaatgttccacgtcactaatcatcagaaatgcaaatcaaaaccacaatgagacaccgtctcatatcagtcagaatggctattatcaaaaagccaaaaaacagatgttggcagggatacagagaaaagggaacacatacattgttggtgggaatgtaaattagtttagcccacatgaaaagtggtttggagtttctcagaaaactaaaactagaactaccatttgacccatcaatcccattactgagtatatacccaaaggaaaataaaaaataccaaaaagacagctgtacccttatgtttatcacagcactatctacaatagcaaagacacaaaatcaacctaggtgtccatcaatagtggactaaagaaaatgtgatacatgtgtaccacagaatactatgcagccataaaaaagaagaaaatcatgtcctctgcagcaacatgatgcagctggaggcatgttctcacttccaagtgggaactaaacactgggtacatagggacataaagatgagaacaaggcactggggactccaaacgtagaggagggaggtaggagggtaagggataaaaaacttcccattaggtactctattcactatctgagtgatggtatcaagagaagcccaaacctcagtatcacgcaacatatccttgtaacaagtaccccttgaatctaaaaataaagcaaccaagagtaataatacagaaatatgttgaattaaatataaacttagccatctgtaactttacatatatttatctgtcttaatcttgatgtttaaaaaaaccttacccttcttttattactttccatgttacctagctagaaatacagtaacactcagcaaatatttttttgaatgactgaaaatatatcattctatgtgctgtcataaccacataaaaccagtctggttcaacttttatgtaaaaaagctgtgagctatttttcagttcccatggacccttaggtcacataacctgataagcccagatcaactaagcatgcaatcacagggggaatctaagtgctaagcgcttagactaaggaaagaagtggatgctgcatggcagtatccgtgatccaatccgattgaggtctggtatcacccatcacaggattcagtcagatgatgcctctggtgtcacctgactgcaagatccaatcacatctcacctcattaccctgtgcttataaaacctgacccagcccccagctcagaggggcactgctttgggaactcttcctgctgttctccttacttgtaataagtaacaaaattcccttgatctttagttgtggtcactgggttgataaccagcaagtgatcaaacccacgggttgtgtgagtaacattctggttgcttgaggctacttggtactgtcatggataaagcagaaaatttttctgcttttcaattatagcttttcagactgaataacttttcaattccaatagtctctaccttttctcttcttctaagctctctccatcccctaattttgttaatactgtgtattagcattaaaaatgaatttaccttagatattcaaaagattaatatttttcactatagatttacaggtacagaataatatgtgctatagtcaagttaggtagaactgatctgaatttccctcaaggcattaccccttaacctttccctatcacactcctcttaagagtatcattactctataaacatcccacttgaacttcaaatcattgaaatttagatgtcacccttaacattgcacaaatccctctcaaggtcaatgatgacttaatcattaaatccaagaacatcctcttaatctgtatcccactgatgactgactttctgaactgttacgttcactgtggcttcatcattgttatacgtaagccttctctaaagttccacagttgaagtttctctctttctattttatcatctttctccagactgattcaggttatgttccagatgacatgtggttccaccaatcaaaataatgccaaatgtagtagagacttttttttgaaacagggtctcgctctgtcactcaggctggagtgcagtggtgcaatcttagctcaccacagcctccgcctcctgagctcaagtgatcctcccacctcagcgtcccaagtaactgggactacaggcacatgccaccatgcttggctattttttgtatcttttttaaaggtgaggttttgcatgctgtcctagctggtctcaaactcccggcctcaagcgatctgcctgtctcaaccttccaaagtgctagaattacaggcatgcaccactgcacctggactgcagttgagacttctgtaactattttctgatttttgaacgtgtttcttaggtccaggctcatattttcaacaacatgcaagataaatattttggcaaaggagtcctggaaatacgtacaaattcaatttatcccaaaccatactaaacttcccattccttaactctttttctcattttttaccccataatatgttctctaccccacaatatatcttctactctgtgaaataacgctaagttcagcacaacctttgtatttccctacctcaaccaggtattacaactccgtaaaatctcttgtacttatcttctttctggatctacccagagttcacagtctcatctattattactgtaattggtttctccattaaagagtatctttcaacccatataacagtgtatggatgcagagacctcctcttaaaaatatattgtttcttaagatgttaagatggcttcacctgtactgcagaaacacaggatgaattgcttggcataatattcaaagctctttattatctaaaactcagtcagctgtactagtcactgttttctgaaaatacaatgtatttatgtacttatacgtctttgttaatcttttctttctcactgttaagccctcattcctttgcgagtcatccttcaaggttcacaccaaatattagctctgagataaattcatcaaatcttcccataaaaattatcattaattcctctgccttcacagcacattcccttttactccatttataacactctcttgctagttgcattcatggtccactggactatgagatcactgtaaatgtaagagggtgcaaaagaggaagaaacatgctctatttatctttgtaaccctttatgactaacctatgttaacagcacatgcttgctgaacttaacaagtatttactgagggcctagtatgtgctgccagttttctaggagctaagttatccacaaggcagatgtggactttacttccagagtttacaatgtgttctaacaggaaagacagaccataaataattatagtaaaatctaagaaaagttagaataaaaataaaatgtgttacagcaggggttttcaaatgttttggtctcagaactcttttgtactcttaaaaattaccaaatacccaaaaagagcatttgtttatgcgggctaaatgtattgctatttaccatattagaacgtataggtgaaatacttttaaaaaatgtattaactcattgaaaatagcaatgataaaaccatcatatacgaacataaataatttctgtaaaagaactatggttttcaaaacaaaaaatttatcaataagaatggcattcatatttttgtaaatttctagtgtatggctggtatagtttggatatttgtccccattcaaatctcacgttgaattgtaatccccaatgctggaggtggggcctggtaggaggtgtctagatcatgggggcagacccctcatgaattaatgctatcactgcaacagtgagttcttgtgagaccttgtgagaccttgtgagttcttgtgtgtggcaactccccgaagtcccccaaacttgctcctgcttttaccatgtgacacgcaagttcctgcttcgccttccgctgtgaataatagcttcctgaggccttcccagaagctgagcaatgttgatgttatgcttcttatatagcctgcagaaccataagccaattaaacctcttttcttgtaaattatccggtctcaggttatagatagcaatgtgagaacagcttaacacaatggctaaaccgaaaatggctggataactgtcataccatcatgttttagcatgtagcagaagtactttttctgcgcttcccatttcatcatgtaacacaaacacaattactcaagagtttagtttaataaaattaatttttactgcttcatccatgacatttttaagtaaaactggctttaaaagaaattgctaatgtatgaagaatgcaatgactattactatagtttggtgcaactgccttgatttgtgccaaggtgccagcagttttatccactgttgcttttgaactatcagtacaaattgcaacacaataaaaaaggcaaataatgttttagtatgaatataaaaattctttgcattcacagaccattctcttcctcccccaactctatgaaagggcttctgagactcctagggatccacagagcacactgagatttgctgtgctagagaagtatgcaccctgttgataacaactctaggagtaaaggaagttatctatcagaaagtttaatatttgacactatatctaaggacaaacaggaaattatcctggtgaagggaataagtaatgggttgtaaaaggatgttctaggcagaagggaaacactaggcatgagctggaattttgcaggagcaaaatgaagttcaatattactgagttatacagttaaaaatgtactgagaaatgagggaggcatatttatgttatattaaggaacttgaattttatctcaaaggcaaagtgacatcactaaaaagttttagtaaaagagctggcattattgggtttgtatttcaaagaaactctcaagttgaattgtgaaaaacagattggagtaaaactggaaaaagagactacttagtaagagatgagatagaggtagacagactaacacaaaattgagaatttagaattgatagtaggacttggtgattaaccagatgtgcgaagtaaaacagcggaaggggtcaaaaataaatcttaaaagtttctggcttggatatgtgtatggatttaattagaaatagggaactctggaagaggaatcaatctgagtggttcaggaggtaggaaaggagagaaaattagctcgcttatgacacaaggatatttcactggcacaaaaacaaacagagaggtctagtgggcaactagatatatggaggtcaagtcagaggtctgaactgaagacagagatttggaataatcagcatatatgtggaaacaaagctataagagttaatcaagccgccatgtgcagctgccatacgctgagtgtgaagagtagagaatccaggaccaacaattaagagagacacagagaaagggaaaatactgttattatgaaacaagtagatggacttatttttaaaaaacaggtttttatagcacaagaattaagatgaggatttttaaaagaagataacatcgcagtgacagaagaaagataggaaggagaatacagaagttgattgtcattaactactaaattgccactattgccacaaaataagctaatacaggctcagtactaatctgaaatgcttaggaccagaagtgttttgggttttggaatacttgcattatatttatctgaagtgctccaatgaacacttccttcaagtaacatattggagcttcaacagtttgagattttggggcaattttgattctgaattttcagatttggagtgctcaacctgtagaacatacatctgccatgcccataaaatgagtaatattcacagatatttgctctggtaagggttttagcttaaaactcatttgaaaatagtcatttgttagttaaaactaaacagtgaagactcaattctctaaattatctttctataattttacatataagtctagttaaccttttaaattaaattagattcaattctagttactaaaataataagtaaatctttactagttagggacataatatacagaactacattaagaatcttataaacaggttaacagaataaattttttgaatgctgtacctctgactaaggaaacacatttactttatgaattcctccagacaatttctttcagtagaaaatattccgcaatcatcattttcatttatacagtcacattatagaaacctggatcatgacattcttctaaaaaatttgccaattgagctgttactcaaatgatttgaaccttataatcatcactattttcattctcaatgcctagagctttgggtcatgatcagaaaatgtagagctttagggtttttaaacatagtaattccccccaaaaaaccagctagacgatcatacagtatttcttttatagaagaaaaagagactcagaatgttagatatttccccaaagttattccctgagccagtgctaaaaattaggtaagtaactgtaaagaagcaactgataagcacagatcatttgcactccatttattaataaacttcaatataattttttaagtctagaaaatctaaggagggaaacttaattttgaaattgataataagcattctttctgcataaatagctttaaaaactagattatgcattttttacagaggacttaatatcttaatattaaatactaagcctccagagacatctggtatttgtaattataaacttatccaattaagatttcagcaaaatacatgtaggatttaactttcaggtttcaatatatttgtatatatatttgattaatatacaacggatttcaaactagaagcaaaactattaaaaaccatcactgaaatacttacaattttgtatgtgtatattattgatggcagcggtagcctgtctggagtggctgctgcaaagacactggctgcagcaggggaggtgtggccagagctacacactccatgaagctggcaggatccgggaacaggtggaagacccttcctctcccaagttggaagggaaagagccccaccctcctgggcgcagctgttcagctgcggctgcagacccgggcatccctgcgctcttgggggcctgggaagctccactgccccgcaggctcagaagtgcctgctcctgccgcccactccaatttcagagcaaagttgtgggccgagtccaggcattgttgtaacctggctgggtatgcatgtatagtgctgacactccagccccctgccaccttggccccctccagactttgggcactgacgagcataggagggaggccaagggcagcataagggtagcctggtgcaggcaccccttggcatgaatagcctgggtgccatggatgacatgaagccccaccttcaagccagggacagcttgaagactcaactcagccagggggctgacttgtcagttccagatggagtctaccacccagaatgagaggttatggtgctttttctgggcctgccaatggcccagtcagcacacacttcctcccttctgagtccataaaaacccttgactcagccagactcaaacagacattgggactaccagctgcggtaaggagctacccaattcaggtctcctcgactcattgggatgacatgcctgcaaataagagctactcactccgggtctcccctccatggagggttacactcaggactgcctgcctacagaaacaagttaccaactctgggtctcctctccgctgagagctggacacttgtcaggacaacctgcctgcagagaagctaccacttgggtctcctgagagctgttctgtcactcaataaagctcttctccaccttgcccaccctccagctgtctgtgtacatttttcctggatacgggaaaagaactagggacccacccaatgacaggactgaaagagctgaacaaaacaggaggctgaaatggccccctaccccgcttgacacattgcgggcaacaaggagagaagagctgcggcccttggggagcccagaccaattggctccctgagccaaggctgtgaaaccctctttggggctctgtggtttctggtgtctccatgcttccaggcaccactgcattccccttgttcagacatggatgcccacagcggaagctgcttgtggtacactggatccagcagcaggcttgtctggagctgcatgccccgccacagcagctggcacgcctggctgtgtgcagtggccggaccccatgttcactcacacaccccttgccactctgcacctggcttgcccttggcaggcatgggatctgggctggtagcacaagctgataacaacctgccaggctgagtcagcagaatgagcccagtgggctcaagcaaaacttggacaaaggcaccaccagccataggaatttctggctggaaaagtgacagcctaaggatccaaagacattatgttaaaaagacatttccaggtgtagtagctcacgcctgtaatcccagcactttgggaggccgaggcaggaggatcatgaggtcaggagatcgagatcatcctggccaacatggtgaaaccccatctctactaaatataaaaaaattagctgggtgtggtggcacgtgcctgtaatcccagctactcaggaggctgaggcaggagaatagcctgaatcagggagtcggaggttgcagtgagctgagatcaagccactgcactccagcctgccaacagagcaagactctgtcttgaaaaacaaccaacgaaccaaccaaccaacaacaacaaaaaatttaacttcctcctttactactgtaacatctttttttaaaaaaaaaaaaaaaaaaaagaaaaggacatttaacttcctcctttactagtgtaacatcttttgctcactaggatcacctccaatattaaaaagtccaagaaaataaaaagaatgtgaaaactgaacagaaatgaactgctaacttaaaacaaaaactcctaaaccagagagcattaaagaggatattaaaaaatcacgtttaaactgttataaactgaactagcaaaaaaagcattaatatctaattcagtcctttttattagataatttcctattgtcatgcagtatattactctttgtcacaaatcttttaagaatatgtccaatattttatatcttaaggcagaatggagataaggcctatagtaagactcttggattggcagtgaccatctaatatgttttgtactctttcctttggctgactgccactactccttcccctcttccttttttccagttaacaatctcaagtagattgttataaaaacatgaccctgctattctaaatatgtccttccatcctttccatccttctttccttttgtctgtctcttccattctttcacctgagaagcatgtgttaaagcccctccttcaataactacatatatcaagtatatcttgagtactaaagaactcaaattggtaaatacttaatatccccaaacagataattctaaaaaacaatagcaaaaaaggaaataaagaaatgattctattcacagctatgtcttagttgccaagaagcttaaagtcaaaactgtattcctatttatagcaagggtaatggacataaatggcagatgaggatgagtttcttttctcaaactgactactggtaatgcttcttagagcactgtgcataaagcattcttaggccaagcccaggctctgtaggaatgatcctatgataaattacctatatttatcatagattttggaaagtatgatgatgacatgcatgccatacttctgccatggcaagtactagaatttcgcagaatgcattttacttttctgacttcccactattttccttctattttacaaattcgcttttccttgttgtattttatgtatccattagaaatgcacactaatacaatggtgtattagtctgttctcatgctgctgataaagacataccccagatgggtcaatttataaaggaaataggtttaattgactcacaattcagcatggctggggaggcctcaggaaacacaatcatagcagaaggagaagcaaacacgtccttcctcacatggtggcagcaaggagaagtgcagagcaaggagttttataagcccattaataaaaccatcagatcttgtgagaactcactcactatcctgagaacagcagcatgggggtaattgccccattattcaattaccttccaccgggtccttcccacaacatgtggggattataggaactagaattcaagatgagatttgggtggggacaatgccagatcacatcattttaccccagcccctcccaaatgtcatgtcctcacatttcaagacaccatcatgccttccctacagttcctcgaagtcttaactcattctgttattaacccaaaagtccaagtccaaggtctcatctgagacaaggcaagtcccttctgcctacgagcttgtaaaataaatgcaagttagttacttcctagatacaatgggggtacaggcactgggtaaatacacccattccaaatgggagaaattggccaaaacaaaggggctacaggttccatataagtccgaaatccaatagggcagtcattaaacctccaagttccaaaatgatctccttggactccatgtctcacatccaggtcatgctgctgcaagaggtagcctcccacagccttgggcagctccacccctgtggctttgcagggtacagcccctctcctggctgctttcacaggctggtgttgagtgtctgtggcttttccaggtgcacaatgcaagctgctggtggatctaaccattctaggatctggaggatggtggctctcttcctaaaactctgctaggcagtgccccagtagggactctgtgtggaggttccaagaccacatttcccttccacactgccctagcagaggttctccatgagggttccacccctgcagaaaacttctgcctggacattcagatgtttcatacatcctctgaaatctaggcagaggttcccaaacctcaattcttctattcacacactttgtatgcacccacaggctcaacaccatgtggaagccttcaagtcttgggacttgcaccctctgaagcaatggcctgagctgtaccttggccccttttagccacagctggagctgaagcagctgggatgcagggcaccatgtctcaaggctgcacagggcagggggggccctgggatcagcccatgaaaccatttttcctccctaggcttctaggcctgtgatgagaggggctgctgtgaagatctctgatgtgccctggaggcattttccccactgtcttggtgattcacatttggctcctcgttacctatgcaaatttctgtagccagcttgaatttctccccagaaaacgggtttttcttttctatcatatcatcaggctgcaaattttccaaacttttatgctctgcttcctcttgagcactttgccacttagaaatttcttccaccagataccttaaatcatctctctcaagttcaaagttccacagatctctggggcaggagcaaaatgctgccagtctctttgcataggatgagtgacccttactccagttcccaactagttccccatctccatctgaggccacctcagcctcagcctggacttcattgtccatatcaccaccagcattttggtcaaaaccatttgacaagtctttaggaagttccaaactttcccacatcttcctatcttctgagcccttcaagtctcttggaagttccaagcattcccacattttactgtcttcttctgagccctccaaactgttctgacgtctgcctgttacccagttccaaagttgctcccacatttttgggtatctttatagcaacaccccactttctgtggtaccaatttactgtattagtccattatcatactactaataaagacatacccgagactgggtaacttataaaggaaagaggtttaattgactcacagttcagcatggctgggaaagcctcaggaaacttacaatcatggtggaagggaaagcaaacatgtccttcctcacctggtggcagcaaggagaagtgctgagcaaaagggggaaaagccccttataaaactatgagatcttgtgaaaactcacttggtatcatgagaacaacggcatgggggtaaccacccccatgatttaattacctcccaccaggtcccttctatgacatgtggggattatgggaactacaatataagatgacatttgggtgaggacacggccaaaccatatcagatgggatgccattttattccatcatgttaataaagagtgaaaaaatgaaaatacttaatgctagtgagttttggcaaaatgggcatttatattgctagagataatggaattagtattatctttctggaaaggaattcagtaatatgtacaagagcccatttatactcttcaacctaaaactccacttctgggaatccatcccaaagacatgaaaactcaagcacaaagatttattgctgaaataaaacagctgtgagaaaggaaacaacctaaatgtccaatgaaagaacaattcatataaagcaagattctttctaccatactgtccttcaaaaaagagagcatcagcttatgtttgagccgtacaaagtctctatgctattcagccctctcaatttttttactttgaacaataaagactattttggggaaaactaacactggcctgaaaggacttcatacagtgtagcttggttacttacctggtaagaaatcacttgataaacttggttccaccatatctccctgcccccacacagaggcaaagaaatttagtaccaatttggtaattatacattgaagtacagctttccaatggcaattattggatgttttctttaaaagatcatactgggccaggcacagcggctcactcctgtaatcccagcactttggaggccgaggaaggcagatcacgaggtcagaagttcaagaccagcctgggccaacatggtgaaaccccatctctactaaaaatacaaaaaattagctgagcatggtggcatgcacctgtaatcccagctacttgggaggctgaggcagaagaattgcttgaaccaggacctgggaggcagaggctgcagtaagcctagaatgtgccactctactccagcctgggctacagagcgagactccatctcaaaataaataaataaataaaaaatataagatcatattattcgtttttaaaaagatcgtattaaacagccgtatcatcaggcaactagataaattctccaatgtcctactggccttaggtttgtttccatcaccagcaaccaaagtgtaacttaacccccaaatacagattcagtcattatctaataatcatgtttatacaatcagtcaggaacaagaaaatgttaattcacatttggaaatgggaaaactggttcagtgtcttaaacttcattctcctggcctcacagaatgagttagaaagtgttccctctgattctgttttcaggaacagattgtagagaactggtattcttccttccttaaatgtctggtatatttcaccagtgaaaacatctgagcctggtgcttcctgttttaaaaggcagttaattatttcttcaatttctgtaatagatataggctttccatattatctatatctccttgtctgagttttagtagattgtatctttcaaggaaccagtctatttcatccaagttatcaaatatgtagtcgtagaattgttcataatattcctttttattcttttactattgatggaatcagtaatggtgggctctctttcatttttggtatttattagtaatttgtatcctatctcttttcgttggttagcttggctacaggtctattaattttgttgatcttttcaaatgaaaccttttggtttcactgattttctctattgtttttctgttttcaatttcattaatttctgttctaatttttcttttcttctgcttagatttaatttgctcttacttttctagtttccaaagatagatgcttatattattgattttgcaccttcttttctaacgtgcattcaatgctacatatttccctctaagtactgctgtcagaacatactacaaatttgatgaggtatgttttcattttcagttagttcaaaaacattttctaattcttctgagacttacttatctgacccttgtgctatttagaggtgtgatgttagatctacaaatattttgggactcttcagttctctgttactgatttctagtttaattctgttgtagtgtgagagaaggcatactctgtataatgatctatctttttaaattggttaagatgtgttttatggccaaatatggtagcatacttggtgaatattttgaaaaattataaatgtttttaaaaagtcagcaaagtaagtattttgtgataattacaaatatatgtgtacacaatgaaggagaggtagacacacagctttcctagtgttagggaaatgggtaattggggtttgggataaaatttccagtaatcatgttatacacatattcaaaaagtgccatatctaaattctgagatatagatgacttaaaggtgactccagtagtaacaaaaattgggtatgcatgaaatctaagtgcaaaaaagtatatctttactatgtgaacccttgctatctgaacccagatatcaaatggcttgaaagatatttggagataagccttagaaaaagataactcttgatatccgaacttgctatctaaactaaaaagttgaatagtttttgatagtaaaggatacatatcttcctatataatatctgtgactaaaccagtaaatatctgacctttatttcatctacatatttaaaagtggtatgtgaggtatgtatgtttgagagagagaaagatttctctttgggaaactggagtattatttggtatttcggatcattttatatttagacacaaacagtggtagattttcatgatgaaatattatgcaaaacagcattctagtggcatgggaagagaagtttacaaaatactttatgcaacatagcctcttttgtttaaataacaatgcctagtaaaaagactagaaagaagtgtacctaaatgtaaccaggattgagtgatcttttttctatgtctataatatctgttctatggcaaatttttcatacctcaatttcatttgtagttagaaaaatgttcaacagtgaattttaacacaatataaataccacaacagagttataaagaaagttcaatactggtatcaaagagtatcaattcttttgggaagttctgagaaagttctggaagagaacatgcttcaaatatagtctaacataaaatacaccaatagtttatcagaattagaacgtatcccatttgcaattgccagaaagtgagaacaagcatgtaccacactagaggaatttaaaataggtccatgtgaccagaatacaagctgcaagaatagtggcaggagaaggaagaatgagaatacacacacacacaatggggactgatgctatattaaggagttcagagtttttagaatgaacaaaatctaaaccaagccatccagggctaaatcattttaatgctaaatttcaatactaagttaatcccttccacgattcaagaaacaactataaaactatcctggataagatcatcaaaaacaactactttagggctcaaacaaaggcaaataagatgaaaagtgtttattcataaaaaccaggtgaacctagcttaggaacagtgaggatctgtcctatctttgcctggagctgctctcaccacccccaacccctgcttagctagtatgaaacttcctccaggacaggactcgttaaaaaatagcagcttcactgctagaggcggctaacttgatttggagcaaagggtaaaaaacctacacagagcagtgtcagtaaaagcagcaaacttggaagaaacaagcatggaaagtcagcagctacgctagtctcaggctgtagttgtggttgggttgagctgcagaatggaggactagtcagaaatttaacaaagatcctggaaatgagatagatatagaggagttagataagctccccacaaagccatggctgatggggaggctatgtgaatatgcagagaaaacccaagagggcctagaagaaagtaaaaggtgaggcagatttgaaaagcgcctaaatgtttaatgcactccccaatcaagacgcactctactggaagagggtggaagccttactgactgaggtgtttgagcgcaacctctaacctatcattgtttggctactaaattatgcagatactggtgcaacccctaggaaatcagcctaaaaaataacaaccccccccacctctgaaaaaaacactaaacataataagggagacagattccacagattaagtctaagcaaattactgagaaacactactactaacgcttgtaggggaaaaaaatccatgacagtttctatactttttaaccaaaaattatgagacatgcaaagaaacccggaaaagcatagtccatactcaggggaaaaaaagtagtaaatggactcttgagtgagcccaaatgttgggttaaacagacaaaaactttaaggcagtgattacaaaatatatatatattataaaaataaaaaagtatacatatatacatatatatgaatacttttttttttttaagacagggtatcactctgtcactcaggctggagtacagtgagaggtgtgatctctactcactgcaacctccaccttccaggctcaagtgatcctttcgctttagcctcccgagtagctaggaccacaggcacatgccactacacctggcttttttgttatttttttgtagagacaggttttgtcatgttgtccaggctggtcctgaactcctggactcaagcaatccacctgtcttggcctctcaaagtgctgggattacaggcatgagccaatgtgcccagccataaaaatatttaacaaatttaaggaaatcatgcttaaagaatcaaaggaaaatgcagtaacaatgactcaataaataagggaatctcaacaatataacagagctataaaaaatatatagaaatctaaagttgatattttccatacatatctgtgtttgatagaagtataactatataatttctttaactggccaacacttaaaatattaatatttaagaatgtccataacacatgagttaaaggatgtttagtaagtcgttatgcattataagctttgtagtaacctttgaataaaggtaaagatggcttatggttccctactgaagtaatcaaagatattttgatttttaaacgtaattgcttaaaactaggtaatattttcaacatgatttaaaatcaaagcaaccaaaagtaatgcttgttattatctatagttttggaactgcttaagagtatcttactttcataattattttctgtgtctatcaagaatatttctataactattcaagtttagcatttttaagtaattaacaaaatacacttgataccacaaaccaacagggtaaaagggtataggaacaattttaatattacagcgaaatacctcagagatactacagctttggttccagactactgcaataaagcaagttacaaaatttttttggttttccagtgcatataagttatgttccactacaccatagtctatgaagtgtgcaatagcattgtctaaaaaacaatgtacagatcttaattttaaaatactttatggctaaaaaatgctagtcatcatttgagcctccagcaagttgtaatctttttactggtggaagctttgccttgatactcatggctgctgactgattagcatgatggttgctgaaagctggggtgctatcagaatttctaaaaataagacaacactaaagtttgccacatacattggctgtacctatcatgaatgatttctctgaagcatcagcatgtgatgctgcttgacagcattttactcacagaatttcttttaaaattggtcagtcctctcaaacccaaccactgctttatcaattaaattttatataatattctaaatcctttgtcattctaacaatgttcacagcatcttcaccagtagatgccatctcaaaaagacacttcctttgctcatccataagaaacgactcctcatccattcaagttttatcatgaaattgcagcaattcagtcccatcttcaggctccacttctaattctagtttttcccaccacatctgcagttatttcatccatgaggcttggaataaactcctccaaactcatattcatgttaatattctgatctgctcccatgaatcacaaatgttcttaatggcatctagaatggtgagtcctttccagaaggttttaatggactttgcccagatccatcagagaaatcgccatgacaactacagccttacaaaatgtatttcttaaataacatgacttgagccaggctcagtgactcatgcctgtaatcctagcacttccagaggctgagacgggaggattgcttgagtccagaaatttgagacctgcctgggcaatatagggagattctctctctataaaaaattttaaaaaagttagctgggcatggtggtgcatgcttgtggtgccagctactggggaggctgaggtgggagggtcacttgagcccaggaggtcaaggctcctgtgagctgtgatcatgccactccactccagcctgggcaacagaatgagacccatctccaaaaaaaaaaaaataataataatatgacctgaaagtctaaattactccttgatccatgggctgcagaatggacgttgtattagcaggcacgaaaacaacattcatctcctcgtacatatatatcagagctcttgggtgacctggtacattatcaatgggcagtaatattttgaaaggaatatttttttctgaacggcaggtctcaacactaggctttaaatattccgtaaactattctttaaacagatgtgctgtcatctaggctttgttccatttacagagcacagccagagtagattcagcataattcttaagggtcctaggattttcaaatggtaaattaacactggcttcaacgtaaagtcaccagctgcattagcccctaacaagagaggctgcctgtcctctgaagctctgaagccaggtattgacttctgatctctagccaagaaactcctaaaaggcgccttcttcttccaatagaaggcttttaaatctacattaaaaatcagttgtttactgtagccactttcatgaatggtctttggtagatcttctggataacctgctgcagcttctaaatcatcacttgctgcttcaccttgcactttatgtcatggagatggtttcttagacctcatgaaccaacctctgttaagcttcaaactttcttctgaagcttcctcacctctcttagccttcaattgaagagagttagacccttgctctggattaggtattggcttgagggaatgctgtggttggtttcatcttgtatccagaccactcaaactttctccacatccacaatcaagttgttttactttcttctcattcccgtgttcactgaatagcactttcaattttaaaaataatttttccttcactttgggaggccgaggtaggtggatcacgaggtcaagagatccagaccgtcctggccaacatggtgaaaccccgtctctactaaaaacacaaaaattggcttggcacagtggcacgcacctgtagtcccagctactcaggaggctgaggcaggagaatggcgtgaacctgggaggcggagcttgcagtgagctgagatcatgccactgcacgccagcctgggcgacagagcgagactccgtctcaaaaataaaataaaatacaataaaataaatgacttttcctttgaattcacaactcagttaattctttggtagaaaaggcctagctttcagcctatatcagcttttgacatgcctacctaactaagtttaatcacttctagcttttgatttagtcagaggagtgcctctttttacttgtatacttaaaggccattgtaggtttattaactggccaaatttccctagtgtcttatggaatagagaggcctgggggtgaagggaaagagagagagaagagggggagggggagagggaagagtggggagagaggagaggggagagagactggggaacagtggatccgtggagcagttagaacatacatgacatttattgaataagttcactgtcttatatggttgataataagttcactgtcttatatggtgcccctaaacaatcttaatagtaacatcaaagatcactgatcacagatcaccaaaacagacatcataataatgaaaaagtttgaaatattgtgagaattactaaaatgtgacagtgtattagtgcgttttcatgctgctgataaagacatctctgagcctgggtaatttataaagaaaaagaggtttaatggactcacagctccatgttgctggggaggcctcacaatcatgatggaaggcgaaaggcatatcttacttacatggtggcaggcaagagagaatgagagccaagctaaaggggaaactccttataaaaccatcagatctcgtgagacttactcactaccacgagaacagtatgggggaaaccgcccccatgattcaattatttcccacagggtccttcccacaacacatgagaattattggagctacaactcaagatgagatttgggtggggacacaattaaaccatatcacagagccacagtgagtacatgctattgggaaaatggtgccaatcgacttgcttgactcagggttgccacaaaccttcaatttgtaaaaaatgtaatatctgtgaagtacaataaagcaagcgcaataaataagttatgcctgtactaataattaattggattataatagtcatgtacttataaaatttatgcctatatgcatataatcttactagcaggcagattttcttaccaacaataaaacaatggtaattggttctattaataacctttcattatttttccttatttgtaaattcttagtggatagccactttaattgtattttgctgttttgattctttgttttgataattacataagaattacatattgttatataattacatattacattgtacattataactatataatactattatataacaattatatgttatatacacacatatagccataacatatatgtaatatatataattatgtaacaatgtataattatataatcgtatttaatgaaccattctttctcattttcagttagaacaacacatgctacagaaccactagttttccagatagctcttacaattttctgctagtttttaatctaataatattacctatctgcatttctcagtctatcatgtaactactggaggagcaagtaaactgctcactgtttagtatgaaccactgcattatttcacattaatacagttatccaggataatcaaagtagaaaaagtatacttactcagttataaattcagggtttgtaaagctgaggttggttaaatgaccttcaagttgagaagactcatgcatatttaaggctggagtggtcttagtggcaagtacagctcttttttcatctttctcaagtgcttttctcttcccaccattttggaaatattctctgcatacactacaagtaaaaataaagttgtattttaacatactgtgtacgactacaaaataagacggaaaaaattggcttttattaatcaagatgggaaactttcaaatttaagatttctgctttgaaaatgtcaaactgagataaatttgagcaccttgtagcactttcaaatttttaaaaattactatacaataaagaatgatcacaaattatgtttagtaaataaaaaatatgttttttcaggattacagatgtgtttgtatatactttactgaacttctctcgactaaaacttctccagcaaagcttacataactctactatgcagtgacaacatccagaaggaatagtagttgcagttaattttgagctggctttactagtagtagacagataacccaacagctgttcttgaggtccctctgggtttatgataacaaagtcagggtgagtgtgcgtgcacgcgcgcacgcgcgtgtgtgtgtttgtatgtatgtgtatatatatgtgtatatatgtatatatggagagcgagcgagctcatttttcttcttatttgcacttaatttactacatatagctcatactttacacaaagctattttatcattctccacagacattgcttggtgaagttccaaaaatacatggcaagagaagaattgaagagcaaagaattcatgcaaaactggtttcagcaagtacaactatggtccaagggaactatgcccatttctccttcatgcttacaggatcccattagttcaacttcagtttttcttagttcctattactaagacttctttaacttatactatgtagatttagttttaactctatacgcagaagttgaaacttattcagcatgaattaaacatttattaagtacgcatcatgtgtagaggtgcataatgatggccaaattgcagaaggcatagttgttaccctcaagaagctactgttacctcagtaaaggacacaaataattactatatataacaataaaaaacatgattgataaacagataaacaaagatagttatttctataaataaagtacctaacccaatctaaaatcagcaatataaatggattttagaaagataagtaggaataaaccaggaaagtaaagtagagtggaaactttctaggcagaaaggacagcataagcaaagacatgaaagagaaaagcagaatgagtcttcagagatgtacctcagttcaagatacatgaagtttaaagtactgggcagaagatgagtggacctattcacaaatgaaaaaaccctgagcctagtgcacacataaagaggaaggagagccaaggtatgcaagcttcaaatcacacaagatccacaggccaattttaaaatgcagtctttacaaatctaatctaatgacagagagcagtttagaggttgcctgggatagggtgtggggacgagtgcaaaggggtacaagggagctttctggagaaaaatgttctatatcttgatagtggtggtggttacataagtgtaaacaactgtaaatacccactaactgtacactagatgggtgcattttattgtatataaattatacctcagtaaagctgataaaaatgtagactttatcaacttgaaattaatactaaaaagcttgcttatgtttctatcaggtagaaccatataaaactggtgatattcaaaagttcttgagctacaaaaattgcaattttatgtggtctaacctaacagctactaaggcagtaaaatacttaaagggctaaaattctaggttctcatagaataatgacaatcatctaaattccaatatccccatataccctcaaaaaacatacagatcaataaagagagcaaataaaagcacttaccatttatacctatggcataacaaggaaataaaaaataacacttcattttacttgttattgaaaaaataaaaatctgaaaccgagttggctttggaggccactcaaagtacagagtcagatgacgactgcataaaagagagaaatgtatgaaaaggtggccaaacagaatcttccagcaatcaccccctagacctgcaagaatatcaaattgagtaactatccatgcaaaaaagcaccttcataagaactaagtcagttaagagatcacagttcctacaagaaaagatgcattgaagatgataggaactccatagacagtcttgaactgtctataccatcctctcccaagccccggcagtacaccccagagagataatctttgtgctttgcagagggagtgtgaaataactacgggactttgcactggaactccatgttgccctgtcacagtggaacacagcactgggcagaaatctactggtgcccacagggggcatttagaccatccttgaacagacagaaagaagtctgctgccctagtgggaggaatcttagtcctagtctgctttgctactggctgaataaagtggccctgggctcccaataaatgtcagtggcagccagaccatggcaactgtagtctttgggtgagccccagtgctgtgctggtctcagcagaggctgtgagcccagggtactacaaccaagtgtgacaccagctgtggtggccatgggaatgcctccatcacccctcccctcattctaggcagtacagtgtagagacttcttccacttggggcaaggagaggaagagtataggagactttgccttgcaacccaggtaccagcccagccacagtaaaacaaagcaccaggcagaatcctaaagcccctgattccaggctgttgttcccacatggcacttctagacccaccctgggacagaagggaatcctctgccctggggggatggaccccaagtccctgcaggattcattacctgctgactaaagtggccttggaccttcagtaaacatcaatgacagttcaaatatgacccagcatgaggccagctgtggtggccacaagagtgtctgtgtcacttcttccccaactctggtcagaccagcataaacagacactcattccacctgggggaagaagagggattttgcctgggaacccagcaacttctcccttatcttcaagtccattagggctgggaattcagcaatctgcagaagttgcagtgtacctgggcttagagtgccctctagtgctgaaatggttacagtgaccacaggcttaggtaatactttagataaactctgaatgcttagaaggccctctgaaaaaggatggatactaacaagtccagattacaaagactggaataaatatctaactcttctatgcccagacactgaaaaacatccacaagcatcaagaacagtcaggaaaatgtgacctcaccaaacagactaaatgaggcaccagtgaccaatcctggagtagtacagatatatgacttctcagggaattccaaatagctttttgaggaatctcaatgaacttcaaaaaaacagagaaggaattcataaatctttcagggaaatttaacaaagagattaaaataatttaaagaatccaacaaaaatcctggagctgaaatattcaattaatgaacaaaaatatgtattactatctaaacagaattgatcaagcagaagaaagaattagcttaaagacaggctatttcaaaatacagaatcaggggagaaaaagaaaaaaggagtgaaaaagaaagaagaatgcttacaagtctggaaaatagcctcaaaagggcaaatctaagagttattggccttaaagaggaagtacagagactggggtagaacgtttattcaaaggaataataacagttttccaaacctagagaaagatacaaatatgcagttataagatcaaagaacaccaagcagcttcaccccaaataagactaccttcaaggcataaaatcaaactcttataggttaaggacaaagaaagaatcctaaaagcagtaagagaaaagaaacaggtaacaaatgaaggaactccaatacatctggcagcacacttctcagtggaaaccttacaggccaagagggaatgagatgacatattcaatgtgctgaaggaaaaaaaaaaaaaaaggaaacaactttcaactgagaatactgtaccccgcaaagctattcttcaaacacaaaggagaaatatgtagataaacaaagatgaaggacttcacaccagacctaccttaccagaaatgctaaagagaatttttcaacttgaaagaaaaggatgctaacacacaataagaaatcatctgaaagtataatataaaactcactggtaaaggtacatacatagttaaattcagaatactctaaaactgtaattgtagtgcataaactattcatatattcagaggaaaaaacccaatgggataaatttattatatctgtacatatatatatatataaacagatatctaagaagagatttgtaataaggaattggcttatgtgattatgcagactgaaatgtcccacaatctgctatgcctaagctgtaaaaccaggaaagctccaatccaagtccaaaggcttgagaactattttataagttctggtccaagtacaaaaaggcttgagaaccattttataagttgtagtctaagttcaaaggcctaagaaccagaagtgtcaatggtgtaggttccagctagatggaaggcctcaaaagaggcctactcacccacaatagagagggcaatctgctttactcagtctacagattcaaatatcaatctcatttggaaacaccctcgcagacacacccagaaataatgttcggccaaatatctgcgtaccttttgaatcagtaaagttgtgaataatattccataatacctaaaattaacataggcaacacaatattgacagaaaaacaaactgaaggactactaccaacttcaagacttactataaagctacagtaatcaagacagtgtggtaatggtgaaagaaaagacaaatacatcaatggaacacaatagagagtgcaaaaatatacctacaaaaatatggtcaacagatctttgaaaaaggagcaaaggcaatacaatggagaaaaaagaaaattttttcaacaagtcatgctagaactagacatccacatgcaaaaaaagaaaaaaagtaaatctagatatagaccttacacctttgacaaaaattatcttgaaatgcatcataaatgcaaaatgcaaaactataaactgtctaaaaggtaacataggagaaaacctagatggcattgggtatggtgatgactttttagacatgacaccaaaggcatgatctgtaaaagaaaaaattgataagctgaacgtcactaaattaaaattttttgctttgtgaaagacattgtcaagagaatgaaaagaaaagccacagacactgagaaaatatttgcaaatcatacatatcaggggtccccaacccccagtactggtccgtgacctgttaggaactgggctgcacagcaggaggtaagtggcaggtgagtgagtgaagcttcgtctgtatttacagctgttccccattgctcgcattactgcctaagctttgcaccttgtcagatcagtgacagcactagattctcatagaagcacgaacccttattgtgaaatgtgcatgtgagggatctaggctgcacgctccttatgagaatctaaagcctgatgatctgtcactgtatcccatataacccccagatgggactggctaattgcaggaaaacaagctcagggctctcactgattctacattatgatgagttgtacaattatttcattatatattacaatgtactaataatagaaataaagtgcacaataaatgtaatgcacttgaatcaccccgaaaccacctgcttccactccagtcaatggaaaaattgtcttccacaaaaccagtccctagtgccaaaaaagttgaggactgctgacatatacaatgaagaactgttatctaaaatatagaaagaactcttaaaactctgtaagaatgcaaataaatttaaaaaccaggtaaaagacctgaacagacatctcatcaaagaagatacacagagtggaagcaacaagaatgcttatcaagtgctgatgagaatgcaaaatgttacactttttacagcagctttattcataattatcaaaacttggaagcaaccaagatacccttccataggtggatggataaactgtgatacatctagacaacagagtattattcagcagtataaagaaatgagatatcaagccataaaaagacacagaagaaccttaaatgctaattactaagtaaaagaagccaatcagaaaaagctacaaactttataattccaactatatgacattctggaaaaggcaatctatgaagtcagtaaaaaaggtggtggttgcaggccgggcgtggtggctcatgcctgtaatcccagcactttgggaggccgaggtgggtggatcacctgaggtcaggagtttgagaccagcctgacctacatggagaaatccgtgtctactaaatatacaaaattagccaggcatggtggcgcatgcctgtaatcccagctacttgggaggctgaggcaggaaaattgcttgaaccgggaggcggaggctgcagtggacggaggttgcggtgagctgagatcgcggcattgcactccagcctgggcaacaagagcaaaactccgtctcaaaaaaaaaaaacaaaaaaaaacaaaaaaaaacaaaaaaaaaaaccaaaaaagttggtggttgcagatgggtgaaaaggccggcacaaaggatttttagggcagttaaactattctgtataatactataatggaggatacatgtcattatacatttttcaaaaaccatagaatgtacaacatcaagaatgaaccctatggtaaactatggactttgggtgataatgatctatcagtataagtttaacaactctaacaaatgtaccactctagtgctggatgttgacagtgggggaggctatgcatgtttgggatggagtggttgtatatgggaactttctgtactttctggtcaattttattgtgggtttctggtcaattgtgttgtaaacccactgctctaaaaaataaagtctacttaaaagagaaaacaaaccaaccttgggataaatatatcatgtatctcctgatgtattaaactgagagggacacaacatcacctatgcaaaactcttgctaacaatacacttaacttatatctaatcacaaataaactacacatatccaaattgagaggcaatctataaaatgttgacttttaaaaaatggccgcataggccaggcacagtggctcatgcctgtaatcccagcactttgggaggccgaggcaggcagatcacctgaggtcaggagttcaagacccgcctgaccaacatagtaaaaccccgcctcttctaaaatataaaaattagctgggtgtagtggcaggtgcctgtaatcccagctactcgggaggctgaggcaggagaattgcttaaccctggaagtggaggctgcagtgagcccagatcgtatcactgcactccagcctgggtaacaacagcgaaactgtctcaaaacaaaaaaaaaaagtcgtatcataaaaagacaaaaaagaaaagaaaaaaatgatgaatttttctagattaaagaccaaaaaggcttcacaactaagtgcaatgagttatccctgatgggatcctggattgaaaaaaaaaaaaatacaggtataaaggacactattgtgaaaattggggaaatttgattatggattacattattagttagcatcacattaatgctaaatttctggagtgtgatagttgtattatgattacgtagaagaatgttcttacatgatacacactgaagtattcaggaataaaagtctggtaatttctgtaactgactctcaaaaggttcagcagagagcaagagagaaaaaggacccagaggagaaagaggaacaagatacaaaagtaagactaagtagagtaacattttttcagaagctgaaggaaagaaagtgtgagtcaaggattttctatccatccaaactacgtatcttgtaacaaaattatacaaaaccagtttgtaagatgggtgaactcagagaacatcataattccaagttgtttttaaaaaatctactggaagataaacttcatctatgagatgattaagaaatgttggtgaagaagtagggaataaaaagcattaaatcacttaaaaaaaaaagcgggtactttaaaatgctaaaggcattcaattcacttcaattcccagtgaagatataactattataaatagttatgtatcacttatcatagcagccatctttacaaagaagaaattccatgagatgtatggagaaacagacaaacaccaacaacagggactttccactttcaatcaagagaatgaaaaggttacagaagccctaaaaaacataataaagtttaccttattgctagaagatgaactctgcattcagagagaatagcttctttttaattatacatggaatagtcacaaaaattaccatatatgtgtattaagtcatgaagaaaaccatagtaaaaaccataatgaaaaaatacagacaaaattatacaattgcaatgcaataaaatgagaattaaccaaaaacaagaaatccattctatctgctattttttaaaaaagtaaaaaagtaaataacttgggtcagagggcaaatactaataaaatcacagaatatctaaaaataattaatgaaagcattacaagtcagaagctaaggaatgcaactaaaatagcaatctgatgaaaactgagatgctttaatgcttatatcaatacaaacaaaagaagaaaatcaaatgaaataaacatggaactcaagggattagaaaatgaagcaaaagaaaggaagagtgccaacaaatacacaaaaacttgtgcaacttttttctagaaaaatacaccaaatatatagaatagaaaaatttcttaaacttgactcggtagaaataaaaagtttaaacaaaacaaaaatccaaagatgaaatagttatcagagttaatcttaccaaaaagcaccagtacaagccttcaaaaaccagataacccctgtattaatcatgttttttactttatctttcatattttgatattttgggaggggtgttggagggtgtgcttatacatccagagagagactgcccctctcaggaccagctaattccttaaggtggtaaacttacttgggaaaacatttctcatatgcaagccaaccgctatctaacttttacacatagaccattaattccccactactaaatcaactcaagaccatataccagacaacaacggacagcctctagtccccaaagcctactgaaattattcaacctagccaatcctaaaccgtttactctgccctgccttggcttttccataaaaaggtcaataacagctctggtctaggatttcctttagctcctgcttctgactcctgacaaaatctggtgcttcctttatagccctgcatggtgcagtatgtccccttctctcaggaaatataagtaataaataattatttcaatggcattgatcactccatgttttccctcagtcacctctataaattaaaattccactgatacatgtgagacaaccccaaaagtacttaaactgttccaaaccatagaaacaaaaacatttttccaaattcattttcagggagcaaaattacaataatacttatctgatctcataaagactacaaaaataaaggccaatatcacttataaatatgaataaaaatatgaaattaaattttaacaaacagaattaaatatgaccaagtgatatgtatttcaggaatgcaaggatggttcagcataagaaaatccactaatataattcactatattcataaatctaagaagaaaacacatttattcttctccatagatgttgaaaggtcattcaacaaaattcaaacccattcctaatataaacactcaataaaatacaagttggcaaacacttccttaatattagaaatatatatatatacacacatcagccaaaaagccagcaacttaatgaaaatacaccacatacattactgcaaaatgaataaagcacagctacgtaatagacaagagaaaaagatttagtcaaatgaataagagaggaagaaataaaactttgtgtatttatagatgacataacagatacaccttgacaacccaagagaatcaatcataaactcatataaacagaaagaaaattcattaaaatggtaggatgtaaaacattaaaaaatgaaaatcatccatatatatatgtacacacacaacaatatcctgttagaatatagtcatgtgttgcttaacaatggggatatgtcccaagaagtgcatcattaaggtgacttcattattgtgaaatcacccaagtatacttaaatctagatggtatagcctactacacatctacagcatgttaccatactgaatactgtaggccactgtaacacaattgttaagtatttgtgtatctaaacatagaaaaggtatagtaaaagtacaatattataatcttatgggactaccattgtatgtagtccatatatttccactgttgatggagatgtcattatgcagtgcatagctgtataaacagaagggaaggggacatttacaacagcaataaaaatgacaaaatacctaggagtaagcacaacaagaaatgtgcataatcactatacagaaaaccttaaaacactactttgcaaagtagtctgctacttttgactaaagtagactagaacaaatggaaagacatatcttttttttttttttgagacagagtcttgctctgtcaccaggctggagtgcagtggtgcgatcttggctcactgcaacctcctccgcctcctgggttcaagtgattctcctgcctcagcctcccaagtagctgggactacaggtgcacaccaccatgcccagctaatttttgtatttttagtagggacagggattcaccatgttggccaggatggtctcaatcccttgaccttgtgatctgcccacctcggcctcccaaagtgctgggattataggcatgagccaccatgcccggccgacgtatctttttaatggataggatgactcaacattattgagatatctgttgttcccaatttatgaaaaattaatgtaatctcaataaaagtaatttttaaaatgtagttggaccagttgatcctaaagtacatgtggaaaaaagcaaaagcaagaaaaaccaagaaaaccctgaaaaagaatagtgtgagatgggggtatggagagaagacactacagaacagcattgtaagtctttatgattaaaatagtgatagtaggcatggatcaatgatatacacaatggaatatgacagaaaagctaaaacaaaaccaactatatgggaaaacttagtacatcatgtaagtgtcatatcaaattactgaagaaaaggtaaagtttttaataaatgttggggaaatggataactttggtagaaaaaaaattagatcaatacttcacaagaaagaccaaatttgacttttaaacaggtcagagatttaatgtaataaatgagaaatcccctaagtactagaagaaaacacgagtgaataacaaattgttatttgaattcctacagtctggtaattaggaaagcttttctaagacaataaaaatctggaagcaataaaacagaagactgatacatctaactacacaaaagcaaaaactttctgtatggcaaaagatatagtcaaagacaaagggcacaaatatttataaatgatataaagagctccaaaaaaatcaagaaaaattagagaccaaaagtcaacagaaaaaaaaaactatcaaaaacatgatcacataattcacaggaaaaaaaggcaaatgactcctaaatatataaaaaggtactttacctcattcataagagaaatgtaaaataaactcaagctagagataccaattccaatctatcggagaaaaattcaatagctgagccacatactatgttggtgaagttatagagaaatgggtattcttacttacttatttatttatttatttatttatttatttatttgctggtgaaactgcaaaatgatataacctctacacagggcaatttggcagcacatctaataaaatcacatatgcatttaatctccattcctgcaattccacacctaggaatctacaaatatacaatgacaaaaatacaaaatgcacacacacaaggttattcattacagcactatttgtagtagcaaaagcttgtaaacaagtcatgaaaatgaggaatatatctgtatacctgtgatggttaattttaggtatcaattgtcaaacattatcttaggtgtttctttgagggtgtttttggatgatattaacatttacattggtagactaaataaagcagactgcctttccttaatgtgagtgggcctcattcagtcagttgatgcctgaatagaacaaaaaagctgactctctcatgaataattaaagagaattcctcctgcctgactgcctttgaactgggacaccagctttttcctgccttcagactcgaagtgggtctagaggctgctggcctttagactggatctataccttcagcactcatggattgccaccttgcccactcaccttgcagatcttaggagttgtcaaactcgataatcatatgcattaattctttataacaaatcttactatacacacaaacagacacatcctattgcttctgtttctctgaagactcctgaccaataccaaatacagtaattctcatattaagtaaaaaagaaaggtacagagtatataacagtatacaacacactaccacctacagggataagaaagggtggatatatgtacatatgcatatgtacatggatatgaatttgtttatttttgcaaaaacaaacactggtaggataaaaacaaaacaaatgaaaatggttacccataggaggtgttacccggtgtaatgcctatatgacagttgaattctgatcctgccccaactctgcttacctttaagaaacaggatacctgtaataaaaagttccctttgaaataacgagaccgggtgagactggttagaaccaagatagctgacataatgaaaagacctcacgtttcattataatctcatttccatgctaaatgaaatggtactcccaccagttccatgacagttggcaaatgaccgtaacaactgcaagaagccataaaaggacaaaaaggatggtggcactccagttctagaaagttcactgcccatttctagaaaagacatgaatattaatcctcttgcttttaatgtccaatgccttcattagaaaaccctatattttaaccccccagcctatcactagtggagaagttgaattatgagccatgctcctgcttctcaattccatggccatcaaataaagcctgcactgcttgatactcacttctggttttgtgtactggttttgtgacaatgaacagggaaagaccccatcttttgggaaaccagctttgttggtaacagaggcaggtgtaaatgaagaaaataaaagggagtcttttttgagtatatctttttataaggtttgacttttgaaccatgtaaatgttttatattctccaaaattaaaataacaataaaaaacgccccaaactgaaaattaagtgaaatcaactgtatagcaaattggtattacaaccatacagaaaataactgtttcaagcaacttttaagcatatattctgatccttggtgggatatgttctaaagacaaaagaactgcaaagaaatcttacatttcagttattttatttttagaaaatcagtattgcaatttttaaatcattttatgtaaattgtaggaaaaggctaatgtattaatgtaattcagaaccaagtccttcggtgtaacagaagagaaataaaaaacagataagttaagcaaaaataaatataaatataaaacaaagttgttaagcaaaaatcttataatattaaactggagtggaaaatatcaattaggaatttgattgaatatttatatataacactatataatattatattatatatttttctaattctctttaccaaaaagatgcagaataaagcacaccctgtgcacatctagtatccacatgttacttttcaaatgccatttcccactaaatgaaactaggactccctgaagaaacagtctgatgccaggtctcgacgaggggaagcaaagactcatctttgtactacagagcaagaaagtgctcacaggtgacgtaaaacacagaagtaaactttgactgggctcctgctgcctaatatgaaattatttgaacaccccaccccccaaaaaaagactaataatgaaaaatggaataaataaaaatccaagatgttactgtgacagtccaaaaaaataaaccccacaaccccgttgtcctaactgtaattgactattataccaattgctttcgtgaaaattggtaattaaacagaattacatattttttaatctgattttctggataacatgtaatcatcattcaccatttataaaggaaaattcttttatttacaaaagaatgccagctaataaatgtcaagaaataatacaattttaaaaataattgttttgtaaccccaaatattatttaataaatggaagtaaaactgtttgttgaaagactgttaggaaagaggattgatccacaagccaaaatatcactgtacatattacttaattataaagggataacataagtttacaatggaaagattgagtagataccaccttaaccaaatgataacatttagtatctctaatggcggtacacctcacaacaaaaacctactaatatgacacaaaatgatgtatgaagcttcatctaatagatatttttgcaaaaatatctgacctgaatcaatcctttagacccaactttcagtttacaggaaataaatgagattgaggaaataaataattggtaccatgagaaaacaatcagataatcctgcatgtagaacacaaaactagtttggaattaggatacagattatcagaacagctcatatgatacaatttaaaaaacaacgtattaaaaagaaatcatgagagatgagaatgcaaaggggtctaaaggaaataaattacagacaagcacaagtccttccaaaatgagaagggatcacaggcactggggaatttgctgaaatggtacctgggctgcagagaatcaagccttccagggtagaaatactctgctggattaaagggaaatggcagagcttttaacaactgcttggctgtgtgacagattgatatctttaagaaactcaaatgtagagataattctccccattctcctcctgattccctccacaggtctatttatgagtatgtgaaggcagcaacagcactggtggctgcgagtggaactaaaaagcagaaaaacattaggcttatgtcctgcaagagagttgcacctgtaatactcacagaacaggattcattcactatcaaagcacttgagaccagaagtgaattgaaaccacctaaagaggtcatccagctccaatacagctcaactcctgatggtatcaaagtgttcagtctttcattctagctgcctttcagagcaaaaaaagcatgtctctctggagaaaaagggtatttatgccaatctcttctaaacacaatgccagtataaaaacagaattatcacacataaagcaggaaaaaatgacccataaccaaaagaaaaaatagccaaaagaaacagacccacagataagacatgttagaataagcagacaaaaactttaaaataactattttaaatttatttttttaaaatagagaaaaagacaacccaaatggacaaaaacagagaacttcaacagaaaaattaaatctctaaaaagccaagtaactattatagaaaaactgggaaaaatggtatcttaaaaacatctttactggttaatgatagataaaaaagccaagaaagaaaaatcagtaaagatatatagaatacttgaacaacactattaaccagcttgaaccaacaattgcaaaatgcagaatgtgggatattctacaaattaactgacatttgtctaaaaactcaatgttatgaaacaaacaaacaaaaaaaccaagaacctaaagaattgtaaccaccaaatgcaatgtatgagacttgattggatttagaaaaaaatacatatatatataaattttaaaatatattttgaagacagaaaaatctgaacttatgaactaagtattttagaaaattagattactgttaactgtcttaatatgatgacggtgttgtggttatgtagaaaaatttcctaattcttaggagatgtgtgctaatagatttagggataaaatgtaatgttatctgtaatttaccttcaaatagttcaggaaatagtgtgtttatagtatatatttctctgtatttaaagagctaaaaaaggcaaattcctttattgaaggtatagctatacctgtatattgcatttttttctctggcttttaatgattcatattacatataaaattttattattctgtccttggcaggataatgtcagtaaggcttacctcatataacatattcccataagttttaagtataacaagaagcaaacttttgtccaaccctttttaaagcccactttagctttcaaactgacatgcttttagaattatcaaaaagagaaaaaaactgcatatagctcataattatatataactcaagtttcaaaacacaatattgtttcaaagtcttttccccaaacctagttttatgtttaaagatgttacataacttctcttagtattacttctgatagtaaaaaaaaaaataaagaaatttaaccatatcttgccactgttctttttttaacagtatgacctaaattcctaatgatttttcatcagtttacataaaaaatgacctcatgtgataatataacgattgataaaacaaaaatccaaggaaaaaggaagaagactgaagtttgaggcagattcattgttcaagtagaaggtgaaagcaattgctccaataagaatactacctatcaaagttcatttaagagatacagtttgagggcctgcctgctgtactgtaatagtaatttaaaagcactacgctaaaatccaacaatgatggtcttaaacagcaatagtactgatttcctgactttctgttacaggggaactatttggttcagtagtatgcctcattttgtgtttcttaacttgagggagaaaatgtatattctgtaaaacagtcagatttataaccatcttctctctagaaatgcaaataaaaacatttaaccccaaccatcccatctcctattattttggcacctttctttagttccttaactccattattctttgactccacaatccactgatggtaccactttctaactataccttatattttcaattcccttacatatcataatcactaaaatgtgtgccccatcacctccctggctcctctgagtcattacacttatttgagcattaatcctagtacactgtcctgtcaactcactatctcattcaccaactgtttaactataatttcgtgccatgattattgaagtagttttctaactgggttcccttactgacacccttgcccttcctatagtctgttcttaacacagaaattaattcttaagaattcttgacatcttgcaaaaggttaataaaatcctgtcacttcttttgtcaaaacagccatatgacttcccatgtcagagtaaaaatcaatgtcttaaaatggcccacaagaccctacaaaatctagctgttcattgccttattttctacctctctccctctgtcattttgctctggccacactggtctcctggctgtttctgaaacatgccagcatgcctcttcttcaaggtcttcagacttggtagggctggcttactgtctcatttcctttatatcattggcacacatcacaacagtgaaaccctcttcccctaccttacttaaaattgttttagttttccttgctttatttttctcatggtgctcaccactgtctgcactagtgtaaatttaaccaacatattgtttccggccactcaccccaactagcacgtaagctctatgagagcaaggattttgtgagttttattgtactcctagtgcctataatatgactggtacaaagtagacaatcactaaatattatttattaaataaaagaactaagttaaatacatatttttctctgaattatttgttgaatgaatgaaatatgcattattacagttttaaaatgagatgtaaaaatttttgaataaaaatggaaagaaaatgtaaaccagaagttatcataaacttactgtccatgagaaagacaatgctttatttttgggaattcatgtttatttatttagcctctagttttttttttttttttttggtccagggttacttttgcaggtttgttatataggtaaattgcacgtcacaggggtttggtatatagattatttcaccaccggggcaataagcatagtacccaatcgggagtttttcagggaattcatgtttaagtttagtcaatatacttatcctttcttataattttaccacattaagagaactagtataagcattatttcattttctgatatttttagcattagaatcaatatcatgagaaaataaacattatccaaagtcaatataaatgctggaataccctgaaccgtacatcaaaaattcaagatttaaaaaattttaagatgttttaagactttatagaactcacttttacttgaatctaaataattatctaaagaaatttttataccataatttattaatgagtcaagtattaaatcattatatttaaatgtattgtatgtattaaatgcatttaaagccatattttttaaaagttaaaacaaaacaagtgtgtcaaaagcatttttatttaaaaaggtgaatgaaacagacctagggaaagtgaagcaaaagggagaaaagttgttttaaaagacatgatctctttcacagtatttctggtattctattttggcactatgaattatacacagcatcacttagatttaagagttttggccaggtgcggtggctcacgtctgtaatccaagcactttgggaggctgaggcgggcaggtcacgaggtcaggagtttgagaccagcctggccaagatggtgaaaccccatctctactaaaaatacaaaaatagctgggcacagtggtgggtgcctataatcccagctacttgggaggctgaggcagaagaactgattgaacccgggaggtggaggttgcagtgagccgagatcacgccatgcactccagcctgggtgacagagcaagactccgtctcaggaaaaaaaaaaaagaagttacaacaatacatttgaaaccaaaaacgttaattcataaaagtacttacctacaacaccattcaatacgaccttcgccctcacaagtttttgcccaatgattatctgccaaatttttcattgcaacggcatattcacaaagagtttcttcatcctcacagtgttctcgccagatcttatcaaaatctcccactaaaaacaaagtgataaatgaattaagtttacactgaaacatgtcagactcttgaaataagttttagcacaatctgaaattatttaaagataaatacaagcaaaattataaagtaaaaccataaaattttaaacatttaaaatgtttaaataaatgtttacacatttaaataaatacatttaaataaaaataaaaatgtttaaataaaagttcctttatgtaaagggatgcatcattttaattatttttaataaataaatgaatgataacagatttgtgaagctggaaaaattgacaacatatacgcagatactgtatatatgagttatcagttaataatccaaagacatgctggtaagaaacaattacagctgagtactcaagaattaattttcctgttactgttgggcaatataactttgcaggagctgagtacaaacactaaacctgcttcttgactgttattttcttgtgtctctattgactgttatcttcttgtatttctacatttattaaaaaggggttggtaggtaagatgacaatgtaaattaagcaatgaagtaaatatttctatttacacacttggacttgctctaggcataatgtagtttaaaaatttataattctaggtcaaaaaagtcaaaaactgccttgaaggaaattactttggaagcctctccaaagtttgtaagccttaaaaaatgtcctatataaaaactataagctgactacattatccattcagctactaccttttatttaaataaaattaaatcagtcatcacaatatgaaattgaaaacatcactgtgatgactaataaaggtaggagaatgctattgctaaataaaggacattaatgcaactgtaatggtaatagagtaaacaaaatttacagggtagtttcattcactgtccttggacataggagttaggttcttacaccccataaggaaatgtaggccattaattggggacagaataaacttaaaactataaatagagggggttggagccaagatggccgaacaggaacagctccggtctacagctcccagcgtgactgaagcagaagacaggtgatttctgcatttccatctgaggtaccgggttcatctcactggggagtgccagacagtgggtgcaggacggtgggtgcagtgcaccgtgtgggagccgaagtggggcgaggcactgcctcacttgggaagcgcaaggggtcagggagttccctttcctagtcaaagaaaggggtgacggatggcacctggaaaatcgggtcactcccaccctaatactgcgcttttccgacgggcttgggaaacggcgcaacaggagattatatcccacacctgactcggagggtcctacgcccacagagtctcgctgattgctagcacagcagtctgagatcaaactgcaaggcggcagcgagactgggggaggggcgcccgccattgcccaggcttgcttaggtaaacaaagcagcagggaagctcgaactgggtggagcccaccacagctcaaggaggcctgcctgcctgcctctgtaggctccacctctgggggcagggcacagacaaacaaaaagacagcagtaacctctgcagacttaaatgtccctgtctgacggctttgaagaagagagcagtggttctcccagcacgcagctggagatctgagaacaggcagactgcctcctcaagtgggtccctgacccctgacccccgagcagcctacctgggaggcaccccccagtaggggcagactgacacctcacacggccgggtactcctctgagacaaaacttccagaggaacgatcagacagcagcattcgcggttcacgaaaatctgctggtctgcagccaccgctgctccaggcaaacagggtctggagtggacctctggcaaactccaacagacctgcagctgagggtcctgtctgttagaaagaaaactaacaaacagaaaggacatccacaccaaaaacccatctgtacatcaccatcatcacagaccaaaagtagataaaaccacaaagatggggaaaaaacagagcagaaaaactggaaactctaaaaagcagagcgcctctcctcctccaaaggaatgcagttcctcaccagcaacggaataaagcttggcagagaatgactttgacaagctgagagaagaaggcttcagacgatcaaactactccgagctaaaggagaaaattcaaaccaaaggcaaagaagttaaaaactttgaaaaaaatttagacaaatgtataactagaataaccaatacagagaagtgcttaaaggagctgatggagctgaaagccaaggctcgagaactacgtgaagaatgcagaagcctcaggagctgatgcgatcaactggaagaaagggtatcagtgatggaagatgaaatgaatgaaatgaagcgagaagggaagtttagagaaaaaagaataaaaagaaatgaacaaagcctccaagaaatatgagactatgtgaaaagaccaaatctatgtctgattggtgtacctgaaagtgatggggagaatggaaccaagttggaaaacactctgcaggatatatccaggagaacttccccaatctagcaaggcaggccaacgttcagattcaggaaatacagagaacgccacaaagatactcctaaagaagagcaactccaagacacatagttgtcagattcgccaaagttgaaatgaaggaaaaaatgttaaaggcagccagagagaaaggtcgggttacccacaaagggaagcccatcagactaacagcggatctctcggcagaaactctacaagccagaagagagtgggggcctatattcaacattcttaaagaaaagaattttcaacccagaatttcatatgcagccaaactaagcttcataagtgaaggagaaataaaatactttacagacaagcaaatgctgagagattttgtcaccatcaggcctgccctaaaagagctcctgaaggaagcactaaacatggaaaggaacaaccactaccagccactgcaaaatcatgccaaattgtaaagaccctcaaggctaggaagaaactgcatcaactaacgagcaaaataaccagctaacatcataatgacgggatcaaattcacacataacaatatcaactttaaatgtaaatggactaaatgctccaattaaaagacacagactggcaaattggataaagagtcaagacccatcagtgtgctgtattcaggaaacccatctcacgtgcagagacacacataggctcaaaataaagggatggaggaagatctaccaagcaaatggaaaactaaaaaaggcagcaggtgcaatcctagtctctgataaaacagactttaaaccaacaaagatcaaaagagacaaagaaggccattacataatggtaaagggatgaattcaacaagaagagctaactgtcctaaatgtatatgcacccaagacaggagcacccagattcataaagcaagtcctgagtgacctacaaagagacttagactcccacacaataataatgggagactttaacaccccactgtcaacattaaacagatcaacgagacagaaagttaacaaaggtatccaggaactgaactcagctctgcaccaagtggacctaatagacatctacagaactctccaccccaaatcaacagaatatacatttttttcagcaccacaccacacctattccaaaattgaccacatacttggaagtaaagctctcctcagcaaatgtaaaagaacagaaattacaacaaactgtctctcagagcacagtgcaatcaaactagaactcaggattaagaaactcactcaaaaccactcaactacatggaaactgaacaacctgctcctgaatgactactgggtacataatgaaatgaaggcagaaataaagatgttctttgaaaccaacgagaacaaagatacaacataccagaatctctgggacacattcaaagcagtgtgtagagggaaatttatagcactaaatgcccacaagagaaagcaggaaagatccaaaattgacaccctaacatcacaattaaaagaactagaaaagctagagcaaacacattcaaaagctagcagaaggcaagaaataactaaaatcagagcagaactgaagaaaatagagacacaaaaaacccttcaaaaaattaatgaatccaggagctggttttttgaaaggatcaacaaaattgatagaccgctagcaagactaataaagaagaaaagagagaagaatcaaatagacgcaataaaaaatgataaaggggatatcaccaccgatcccacagaaatacaaactaccatgagagaatactacaaacacctctacgcaaataaactagaaaatctagaagaaatggataaattcctggacacatacaccctcccaagactaaaccaggaagaagttgaaactccaaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaacagaaaaagagggaatcctccctaactcattttatgaggccagcatcatcctgataccaaagactggcagagacacaaccaaaaaagagaattttagaccaatatccttgatgaacattgatgcaaaaatcctcaataaaatactggcaaactgaatccagcagtgcatcaaaaagcttatccgccatgatcaagtgggcttcatccctgggatgcaaggctggttcaatacacgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcttattcaacatagtgttggaagttctggccagggcaattaggcaggagaaggaaataaagggtattcaattaggaaaagaggaagtcaaattgtccctgtttgcagatgacatgattgtatatctagaaaaccccactgtctcagcccaaaatctccttaagctgataagcaacttccgcaaagtctcaggatacaaaatcaatgtacaaaaatcacaagcattcttatacaccaataacagacaaacagccaaatcatgagtgaactcccattcacaattgcttcaaagagaataaaatacctaggaatccaacttacaagggacatgaaggacctcttcaaggagaactacaaaccactgctcaaggaaataaaagaggatacaaacaaatggaagaacattccatgctcatggataggaagaatcaatatggtgaaaatggccatattgcccaaggtaatttatagattcaatgccatccccatcaagctaccaatgacttccttcacagaattggaaaaaactactttaaagttcatatggaaccaaaaaagagcccgcatcaccaagtcaaccctaagccaaaagaacaaagctggaggcatcacgctacctgacttcaaactatactacaaggctacagtaaccaaaacagcatggtaatggtaccaaaacagagatatagatcaatggaacagaacagacgcctcagaaataacgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctaaaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatggaagaaaattttcgcaacctactcatctgacaaagggctaatatccagaatctacaatgaactcaaacaaatttacaagaaaaaaacaaacaaccccatcaacaaggacattaacagacacttctcaaaagaagacatttatgcagccaaaaaacacatgaaaaaatgctcaccatcactggccatcagagaaatgcaaatcaaaaccacaatgagataccatctcacaccacttagaatggttatcattaaaaagtcaggaaagcccctccccctctccctctccctctccctctcccgctcccgctccccacggtctccctctgatgccgagccgaagctggactgtactgctgccatctcggctcactgcaacctccctgcctgattctcctgcatcagcctgccgagtgcctgcgattacaggcgcgcgccgccacgcctgactggttttcgtatttttttggtggagacggggtttcgctgtgttggccgggctggtctccagctcctaaccgcgagtgatccgtcagcctcggcctcccgaggtgccgggattgcagacggagtctcattcactcagtgctcaatggtgcccaggctggagtgcagtggcatgatctcggcttgctacaacctccacctcccagctgcctgccttggcctcccaaagtgccgagattgcagcctctgcccagccgccaccctgtctgggaagtgaggagcgtctctgcctggccgcccatcgtctgggatgtgaggagcccctctgcctggctgctcagtctggaaagtgaggagcgtctctgcccggccgccatcccatctaggaagtgaggagcgcctcttcccggccgccatcccatctaggaagtgaggagtgtctctacccagccgcccatcgtctgagatgtggggagcgcctctgccccgccgccccgtctgggatgtgaggagcacctctgcccggccatgaccccatctgggaggtgaggagcgtctctgcccggccgccccgtctgagaagtgaggagcccctccgcccggcagccgccctgtctgagaagtgaggagcccctccacctggcagccaccctgtctgggagggaggtgggggtcagcccccgccaggccagccgccccgtccgggagggaggtggggggtcagacccccgcccggccagccaccccgtccgggagggaggtgggggggtcagccccccccccccgggccagccgccccatccgtccctactgggaagtgaggagcccctctgcccggccaccaccccatctgggaggtgtacccaacagctcactgagaacaggccatgatgacaatagcggttttgtggaatagaaaagggggaaaggtggggaaaagattgagaaatcggatggttgctatgtctgtgtagaaagaagtagacatgggagacttttcattttgttctgtactaagaaaaattcttctgccttgggatcctgttgatctatgaccttacccctaaccctgtgctctctgaaacatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggctgcagggtcctctgcctaggaaaaccagagacctttgttcacttgtttatctgctgaccttccctccactattgtcctatgaccctgccaaatccccctctgggagaaacacccaagaatgatcaataaaaaataaataaataaataaataaatactcaaaaacaaaaaataaaaaaaaattaagtcaggaaacaacaggtgctggagaggatgtggagaaataggaacacttttacactattggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgacagactggattaagaaaatgtggcacatatacaccatggaatactatgccgccataaaaaatgatgagttcatgtcctttgtagggatatggatgaaactggaaatcatcattctcagtaaactatcacaagaacaaaaaaccaaacaccgcatattctcactcataggtgggaattgaataatgagaacacttggacacaggaaggggaagatcacactctggggtctgttgtggggtggcgggaggggggagggatagcattaggagatatacctaatgctaaaggacgagttaatgggtgcagcacaccagcatggcacatgtatacatatgtaactaacctgcacattgtgcatatgtaccctaaaacttaaagtataataataataaaaaaaagaaaaaaaactataaatagaacagccaaatgtgggagataattatactaaaattcttcctccacttaaggttattgaattcttacatctaagaggttttttttaaacagaaaaggaattataatagtccaaatgtaacaaccaatatttaactattcaaatttgaaaatctttccattaatcccagttactgggtattttagggtctacagtctaataagtactgagttgaaaaccaaactattagccctctaatttgatcaagaaagaagagtaaggatacaaacaaaccctctcacacattgttaagatgactatatatcagtctgagtcttggcctgaatactgattttaaacctgagagaattatttttgagggggctatgtactcatatacaaatatttccattaatcactaacatttgggtagtgactggcctctcaatttgttacatatcagactggcaataactattaacttaaaaaaagcagggaaaagttttctagattctcaaataaaaattcctcagttttagaaatgttaaggtattcgagttcaatcatgttaaatcataataaattatgatttattttaatataatggccaatgttcttttttttttagcagtttgacttgaattcctattaatgtttttttccagcagtttcatttgaaaatgaccttctgtgataaaataactattcataaaacacaagtccaaggaaaaagaaaaaagggtgaagtttgaggcagattcaatgttcaagttgaaggtatacacaaatgctcctgtgagaataccacataccgaagttcatttaagacatacagtttgagggcctgcctgctgtattggaatattaatttaaacacactactgctttcctcagttttagcaacatctttcagatgtagttatttatcaagtctctaaatagaacttcagaaagtgaggcgtttgaaacaatactttaattaatgacactttcataaacccatgatggtacataacactatttctgactttatccatcaaatttgaaactaaatcattcattaaggtattgtataattttaaaggtgaatcatcaagtctagaaggcctttttttgaacttttaagtttcactgccctatagaatctatacattataagtaaatacataaatgtattatatgtgctgttaataggagtcattcaaacaaaagttctatgataacatatacctgggaaaagctatgcttaaaacaaacatattttcttttcctttctgcaagacttagcgtctaaagaatgtacaacttggttgggtgtggtagctcttgcctgtaatcccagcactttgggaggccaaggccggcagattacctgaggtcaggagtttgagaccatcctgacaaacatggtaaaaccctgcgtctactacaaaatacaaaattagccaggtgtggtggcgcatgcctgtaatcccaactattcgggaggctgaggcaggagaatcgcttgaacctgggaggtggaggttgcagtgagctgagatcatgccattgcactccaacctgggtgacaagagccaagctctgtctcaaaaaaaaaaaaaaaaaagtacaacttaagacaaagacctgggtccatgtagtttaattgggtgagaatcctaggaaacaggagtaaggaagtagagagaaagatgggaaggagaaaaaactaatacaaggttgctttactgaggttgctgctgttggcaaactgaaaagcataccgaatgtgtccagaattgtgcacctaaagaatgggaggccacggcatttatctctaagttcttatccccattaactgagaattattaacaatctgcactgctagtctgcacttagccactgaataaggggacaatctcagtgggctccagcagtgtgggagaaaggcagaacacaaaaaagcagcactcatttaaagtgggtctatgtaagggctagtgaatctgagctcaaagtgtctatctaccatgggtgaggacaaagggtgtgctatgtgaggcaacacaggcatctgttagaaattcttagagtccttgccatgtcactatatactttgaaactcaatttactctataattattctactagctataagatgcaaagaactgaaaatacacagaaacctactaccctacaactttttagaagacctctagtttttcatactcaacaaaattctctgaaataccacctaatgaaattttatggctatctacctcactgaagtcctaaggaagaattcaaactttgtaggctaatgcaactcagattaaccaaacaacttcaatttaacgatttcattaacattgaggagtctgcagactctcacaaagtgtgttgacactgaaaattgatgtgattcataaagtgaagtatacttaaatatataactgacagtagaagatgcacctgtatatatttttccttctttcaacagattttcttttaaaaatactccatattaaatgctacagaaaataaagttaatgagcaggcattggtatcaaaaaaaggggagaagacatgtaaaatgtggaaatgctataaaagagatatgaacctgacgggttccctatatcctatgcaaggcatcctggacccaaaacttttatttcatatatttataaaataaaaatgtttcaaactctgactactgtgtatacattttgttaaaagtctggtggttataaaattgaacaaaaaacatagctggcctttagttatgagaaaattccacttcccaaaatacctctgaaagcttaaggtaattttaaaaataaatgaaattattaaaaaggaatgagaaaaagtattttcataatagcccattttttgtttttatagtatttaaaataatggtatttaaattttgagcaaagtttttcaaagtaatctatgattcaggttctaaaatccaaaaaaagttagggttcaccagtgcccagtataatatttaaaactcctctaccaactcaaactgcatatacaaacaatatattaaaactcaattttaaggatttttttatcacttagttattaggtcaactaataattaaaagatatactatttaaaaggacaacattttttcattattaaaaggtaaatcaggagctagaacttcttgaagtttgcatgaaaggtctagtcaacacagtataagaaacatttaggtcttcaagttctatcagaactctcaatgaattaataattagccttatgatttattttaatataatggcatctgtgaatgactcaaaagtgttgtaattaataacccattttcttaccaatttcttataggcattctagaaaaaatacatgtgtcttaaagtaaaagtgagacagagagaaagagagagagaaagagacaggtacaaggggaaagggaggcgtggagaacaaaatctgcaatgggtacacacgttttactttgaccaactacagagaattcacaaattatttttagaaagcacaattcaaaaatatatgctctacagcttaaattgtcttacaaaattctagaacaaagttcacattaacatgacttctatttagttatcccataacatttaaatttttcaaacacccattttaaaaaacaaattcgtaattttaaacatgagtgatgccaacttaaagttgccaaaccaagttcaatatgataatcaatgaaccaaattattttgaatcttatatcaagataataccataactattgcattgactaaactcaccttcaaaaacactatgtcacaactaaaaaataaattaggagctactaataaaaggacaatgacaactaggaaagaatagcacattcattaatttaaaaagagttccatttttaataactttgtgattaagacattattacaatgcaactgcctttgtaaaaaaacaagtacaaggaaatgggtttaaaagtatttttgctctacataacatccagaagcgcagctctaaaacagttccaaattaaagtgaaccaatggaatccctaaattatttatttagagttgatattattctttctttatgaattaacctctctcctgccatctggtacagcattttttttccttcaaaatgtaactgaattcatattttcttcaagagggtttatctgcctcccactttatcatcttacacttccctcatctgccatccttacggtactttgtcattcatttatacatactgtctattaaaaccaggtgtgattttcccaatagaaagtataaatggaaaagcaaagactacttttgatttacaatttgtataaattagagaagttaattagggtgctcagtcagtggaggacaaaatatttaaattttcatcatgctcaaaaaataaacatgaaaagtataaacaaattaaattagttgctaagataaaattcaaactacagaggatggctttcaataaatagcagtcactcaaaagcagaatttaaatttttcacaatagttactgttttcaaagtaagagttccaaggtcagaaaagcaataatttcaatgtcatttttctagagaccattgttttaagcttattaaaaaggctttttcattttgtgttattgtcaaaagaaaaccttgcagctgacagtccagtcatatccattaagttctttaatagcagtacacagatcttttcgaaaaatttattagctcaaggagaaatgaacagtaacaccaccaaatagataaagaattacttatatgtgaaaaaaatgaataggtggtgctaaggttcatgcatttttacatgccaggaccacttgatttttatatacttgatgtgtataaaaataatattttttctcaataactctatcctaattctcctttttaaaacatacaaagcacagaaaataagttagcaagtatatatgtgatgccattttaagataaaaatatatttacaaaccatatacctgataaggggttaatatccaaaagatatataaaaaaaacctcaaactgaatagcaaaaaaacaaataatctgactaaaaaatgggcaatgacctgaatagatatttttccaaagacaacacaaaaaatggccaatgggtatatagaagggtgctcaacaaaactaatcatcaggaaaatgcaaattaaaaccacaataagatactacctcccatctgttaggatggctattatcaaaaagaccagagataacaagcattggtgaggatgtgaagaaaagtgaatcctgtatacttatgttgggtatgtaaattagtacagccaaaacagtatggaggttcctaaaaaaattaaaaataaaactactacatgattcagcaatcccactatgggtatttatccaaaggaaatgaaatcagtatgtcaaagagatatctgcaatcctataatcattgcagcattactcacaatagctaagaaacgaaaataaatggaggtgaatctatagtgaaaagacatgtgagactgagagtatagagagagaccgactgcaaagaagtatgagaaaattttggcagtgatgaaaatgttctacgccttattgtggtaatggttttacagagatgcatgcattgtcaaaacttacggaattatatactttaaaaagacacaatttactgtacatgaatcatatctcaataaatttaatttttaaaaatgatgtgccacaagcatggtatatgttacaaaattaagattatatttcattaaatttgagggccatcaaattctctaaaaaagcaaaaaaatacatgagtatcaaaagtcttaaacttttagaaattcagaacaatttatttgattctgacttaggcatattgccaaatacgggccctaagatgccttatctgtagatgacaagactaccaaattcaagttcaaagtacctttaatggtcattttctctaacacaaggtaagtaaagaaactcatgactaagtgcaaacaagttcagctaccatttcaaggcattaaaacaaaatgttcagaattcagattgtcttacatagttaagccatacaacgaccagtcttctcagctcttgagcacctgatacagtgacacatctaaaagtgggataaaaaacatccaaggtgtttggtaattaagagccaaaaagtaaccagaaaacaaaaagtttgaaaacctgcatcttatagccaacatgttatgaatagtcatttctctaatgtgggaagaaaacaccaccaatattctgacatgctaaaaaggttggacttttcatataaaaacttagaaacacaaacagcaaaaggggcaaaaaaaaaaaaaagaagaaaaagaaaaagtcattttaatactgagaagactacagaacagtctaggtaaaaattccaggagccatccagtctttaatgtcatagtccttaaatgcattgaagcagtatagctacagataaaagagctgttatttttaaatttctgtattttacaagcttagtgtgtttcctatatgccaaatgttgttttaagtgcttttcaaatattaactcatttaattataataccaatccattgaggcagatattttactttatagatgaggaaactgaagtagagcgattaagtaaacttttccaaggttacacaacaaacctggtagtcaaaagctaaagtcatgctcctaaccacaaactttgcttctcttcataagtttttaattcatgaactttcatggatatgagcaaagctttgcaacagaggaaagtacacagactctactaaccacaaacaaatggtcttttgtcagtcaaatgcagttatttagtctctgcaactgcattatttgttagatttctggcagtggttctcaactctggctgccaattctggctgcacattggaatcacccagaagtttcatttaactggtctggagtggcaactggtcatttagtttaacactccccggatgaatccaacgtgtagctatggcttaaaaccaatggtgtatagcaaggttgtgagcttaaaagcctggcaaaataatatagagagcagggggttgggacaaccttaagagtccaatttaattaacaaaaaaaaaaacacaacaaaacaaatcaatgcatggattaaacttaatatctacaaacactggctcacggtgtatcttctgttcttggaacagccttttattataaacatatcaacgataaaaatacttactccaaaatgcaagtctgtgaacacatcctataaggcagatggaaagaaatcaagaaaaatcataaccaatgtcaccaacatgttattcccttgtgaaagtgaacttcacaggtgggtctatgaccacacagagcacttgcttagtttaattttcaactttcaaacaaaaggatttatgaacagccttttggaacttaattttcatatgttcaattaaaaagtcttaccctaatttctatataaatggaaatggatactcacatgctgctctaaatgcatgaagattaaccacctattctaaaataaacacagcaatgggtattagtgtatctacacttaaagcacaataggtcagtatagtttagtggttgtcagatgttagattttgtaactagtataaatttcacttcaaatttaagagactgatatattggggttgaaaaatttttatctgtaaatataaacaaatacacaaaactattactttttttttttttttcttttttcgggatggagtctcgttctgtcacccaggctggagtgcagtggtgcaatctcggctcactgcaacctccgccatccaggttcaagtgattttcctacctcagcctcacaagtagctgggactacaggcacatgccaccacacccggctaattttttgtatttttagtagagacagggtttcaccaagttaaccaggatggtctctatctcttgacctcgtgatccacccgcctcggcctcccaaagtgctgggattacaggcatgagccaccgtacccagctcactattaccatttttattaccaacatacagagagacatacattatacccactacaacatccttatgagaacaaataaagataccataatgagtgtaaggatatatttaccattatatttatagaaaaatagaatgctattcagaataacttggaccatttaaaaaagggtaaaattaatctaatatactcaatttaagaagacatgagcataaattagaaaacatgggtatccacaagttaaaattttaaagttatgaatataaaaagataaaactcaactatctggaaatatttacattagcttcttctgtgcgtgtgccttaaatctacaaggcctggtgctatgtactaaggctacagagataaaaggcagagttttactcaagaaactaagtttagtagataaaacagacaaatgaactggtaagttataaataccataaaggtaggcacaatcatgctatggaagcacaaggtaagaggggcacttaggtaggggcacttacttatgtaggattctgtgctaggtgctgtacacaactgtgtttgtggggatggggtttgtgatgattaataaaaacccagatctttgtttcaagagtttacattacaataaactggcctaaaagaccaaccacgaagaggtcatttcaaaagaggcctgaagatcggactctaaaccataatccttaataatctagatttaaagttgttaaaaacattatgctgctaaacttccagtacaacagtacttctgatttaaagaggaacattttagaaaattttacttgaattggtgggggaaggaagaggggcagggataatgcccaggagccatccaatccttaatgctaccctgaagacataaagacagaatagctacggttaacatctctattatttttgttacttaaggagggtagggatcctgctgcttttgctaattagcaaggactagtaaaaacaggagctccaaaagtactgtatgataaaacagcaaagtctccacttaatcgtcaaatgtgaacaatgtatgagattgctctaggaaattaacaaaaatactgaagaagatatgattataataggaactatgtgacaaatgtgcctgacttatttagacactatagaaatggctaccaaaagatagaaaactaatataaaaatgtgtcaaaactatcaatgaagaaatttaaagacaacttcttaaagtgtgccttaaaaacaagtagctccttacacagtggtgcagcgagactacctattattgaaaaatcattaactcattcagttatctcaactgatgtttcactctgtatactgtatttttatgacagaaataaatatttcataggcacatatgaggaaggaatgaatgtgaaaaacaatttgaactcccaggacgagcacatcctttagtaaagtaccctgcttttctttgcaacagaaaaatcttagttcaatgttttctcaaaaagtgttccaatgatcacctgaattagaatcacatgagggacattaaatatgcagattcctgggccccaaatctcagatccaccaaattgctttctggggacctaagaatcagcattttaaaaagttcactggaagattctggagccaactaacgttttaagaaccatggccttagacgctttaaagctgcaaacatgatatatacttattaaagaaaacaaatgcaccaaaaccaactgaaaatactgatttgtttgattttgaaagactgggactctttgaaaatcaaagcaaatcaatattttcttaagaaatattatagtaaacataattttacgttttcttgaggactttaggctgtcactatgaacaccttcactctactgtaaatgaagcataaatggcggcagatacagttctactactgtgttggtacccagcacagcagacacccgatccctgggagtactccctgtgttctgtgatggttccacttttcttcttccaaactctaactactggtgtgttccaaggatctgtcctcagttctatattacaaccccactgtgcagtttacttgcctcaaagattcagcctccacagagggcttccaaatcctaaacttccaaaggatagattgcaaactaaatcattaccattatccctataacaagccaatctgcctgactaccctgttcctcttgcctccaactcctaccatttccaaagtgtatgctaatagctatctacattttcccgggaaagaaatattggcatcatctttgacccttctttattttcactgaaactgcctattctgatcttcaaagtctgtcttcttctattttcatcatcactactgttatttaagctattattaactttagatcaggttagtataaaagcctcctttctcctagattcctcctactacaatagctgtgtttctgaacctctttgtccactgtgtactctgggagcttttatatatacagatgtctgtgttccacaaagttccaaagattatactgatgtggaaccaaggctaagaaccgctatgttagtgggtttattttccattaaacaatcaaggaatctgcaacaatgcttttggtttctagtgtatcttttcaactgcaaaaagcccctaaaacgataccttgtcacaaagaacactaataataacaaaatcaaatagctaaacactaatgtacattgtatacctacatgcccttcattgaactgactatataaatggtccctttatcttttactattactgattactgaactcttttcattatttttcttctgttgggaatggcagttcaaactctcctagtgcaaacttaacaggaccttctgtgacaaccttcaccttatttatttcaatgatcaggcaaatattctatcacaaaaagctttctgattctatatcagaataagtataagaagaacacaaaaagaaaacagcaaaacctcacttgagaaaagaatctgttcaaagtttcttaaggtcttggacttggtcaaaattttaaagcagctgtgtttaaagcccactgaggaaaaaaaataagaaaagttcaattaaaaggagtctcattctaatttttaaaacaacttcaaaactttgtttctggaaaaacaccaacatcacattcattctcttatttttagcctttttggtttaaaattattttaatacaaaagtttttccccttcccccacaattctcattttaagtgtttgctgaagaatagtcaatcacaaatatatttttcagcttatcctacactgccatgctaattcacctgttaagatcaccccctaattccatgactttaagaatacctcttttaacagtttagtacatacttttacttttttttgtgattgatttataagctgcaggtgtttatgtgataaactgttttaaatctgtttggtatgcagaacaagtaaattcagggattgaataatttgataaaatgtcccaaagatattcataagataggttaaaaaaataaaaacgaaatggaatgaaaagtgtacttttactcctgacaactgcagccttttacattttcttggaatttttacataaacgctttaagtttagaaagagaaatgccaggcataaaagcaatcattacaggaatgggttcatgtgaatacgattatggaaaaaaaaaatcatacaaagacaaccaaaaacacacatggctctacttcagttcttgatttgatacatatttgtcaggctcatctaattaaataatgaagtccctgtttgaaaagcgaaactagtttttttaattaaaaagctgtctataactcttatacatttaaaatatttttggtttacatggaggtcaaattttaaaaattatgtatgcaaagacagaaaacacctatatgtgcaagcatatttccatttataaatatggatctattcactagatagtgaaaaacctatcttatgaatatcttatgaatataacctcactttaaaagactgtctcttaactatcaatggcagacaccagaaataccccttcgcatcaccactgctaggcatctccctaccatttctttttagtaactgcttcagatacgagtgctgcctggaacacacctttatctccagttctcactttacctttagacaaattggcacagcatctcttaagtggtgaaacaaggcaggccataaactggggaaggaaaaagtggtaaacgaaaagagtgcattaagcctacctgctactctttacaaccctgttcacccttccccaccccaagcctgttcatcaccatcaactagcatcagttgggcaaatggttggagaagagtggaaaaaaatcttttcttatcacagcaaaaaagaacaacacaacttattttcattgtttttcctgttttattttcaattccactaatagagataagggaaaagaaggctctgttctccaacctcccagtcactatctatcctgtccttaatattcaatggctgttttgcctccttattctaccctaacttatttccttccctgccatctctccccaaaaaaccctcaccttgtatagccccaactcagctaatcatacctatcctatggatcatccattcccatcaatttataacttttcacctaatggaaattctagggccacttcctgcttctcattttccctcctattctaacatttggagtcactaatattaggtttggagttgggggtggggaacctatattattcccataaaatatgtatagtattaataatgaactaccaaagcatcaagaaagttattttaatatttttaggactccgctcacttatctgtaaaatgaagaagctattagatcaccactctaatatctggctgacaatttccagttcctaataatagggatcttaaactatagatctgaggtagaatacaggaattgtctaagaggcacccagttgaatctgctgatcagccatgtttgggaatcactgctaaatgctaagaggttccttctagtctaaaactccaagatcctaagctggaattttcactgcatttgctggtagaagaattgtgataaaaggggtacagtttccatagttattggtgctatagttcaggtatgttattgattcaatgggcctttgcagactgatctagcacttaagcaatcttcagattacaataacagctgacttgcaaatgaacttgtaaaatatgtttacagactggggaccatcagcacaatactaagtcctcaaagtaaaacactaaaaattatttccttagtattattatgtgcacagagtttttcacagatgacttttttactactaatatttagcctatatgtcagaaataaaggtagaaggagcatgctcattaggatcacttattctgctaattcactgatggggctttgtatatcattcaagcaaagcctagagaagtctagatcaccggtgaaattcagggtattaaagcgcctaaagaatagtctcattcaaatgtttaaactgccaggactttaactccccagaagcatactagatcattcacttatgaactccatgtatctattctagatctggtaacttccgattctcataaacaagagttcctgtggttaatactcaggcttaaaacatggttaaacatgtgggaactaagcacatataaacagcacttgaagagatgccacattagtgtgttaatttgagtggaacctattcatttatgaataaatgaataatgaaattattaaaaggtaaaaatagaaatggaattctatgctagtcatttttctctttagaaagatgcacttaaatttgtacaaaatagcaggataaattgcaggaaaatgtgtccatttatttcctaatctctccaaataacataaaatctacagtgaattccattatgtaagagcattctttgaatatcaagaatgatgcagttgttgctatggtaactactcattttattgactaaattgtgggtttgggtagcattctttcaaaaaacatattttaccatcctaagtaggtctgataagactctttctattgctatctgttaaacaataactacaagccccatttggggatgattaaacagcctctattaaaagctaagcttgatttgctaaggaaagaaacctttaaagtttgaaaaatgaaacatatcaactacattcaaaagaacaaaggatacttagttttaactttctagagtagttgaaacgtgtgtataaatcaacagtaacatgatcttacctgtctgtattccttcactgccataattttccttctaatcctaaattattaactaagtataggactaacaccagaaggctgctgacttttcagtttgcaattaagctaaaatgagaaccagtggaaagctttcctcatttcgatactcaggagaagtctctctcccaagcctatgaaaacagaattttcactgtcaaaatcttataaaacagctgtgtacaaaagcctatatttaaagatatcaaggataactgtagactccaactataaacactcttcaggcacaggcaaaagccactaaggcttcttcccctatgagcttccacagagggggttctcaccggaaccccatccatggaagccgagggtgggctttatcggcaggtgtctttaggaggcttccaatacaaacggtattttcagaacctgcccagatctcttcctcatcgcctaaataaacagttaagaccaagtatttaagaaatgggagtgggggccacgagtgtagcccgcccccttttaacaatgtgaagtccagtcagctaaaaggcctgctggcttcccagccctggaagccaatgcgaggaaggctcggcatggttgtaggaatgaagtactaggaagggggtctgataaggaagcaaatggtacagccggtaggtcaagcgtaaaggagggacaactcaggtttcttttcgtcttttacaaatggattttacctgtcttgttttacctcggcgtctcttgcaaaaagcgacccccacctcctctgtgagcgtgtatgtgtttgtgtgtgccgagacaacaacctcagcaccccggctggggacaggggcttggagggggtggggactcaattcctttacaggcctagaactctcccgaagggccctcaaagaaaagggggcggggaggagcgcgtctgatgccgactagggggctcagaccaggcccgggagagcagcagcggctggggggacgtgcagatcctttacattttaatggtggcctctttggaggagggaagaggtgacaagcggttgggggtgatgaggcctccccttcctccctcactcagcgcgctgtttaccttctcggtacttcttgcggagccgccggtggacgctcttcaccacaccggagagcttctcctgctccagtttccgctcctgctcccggggcggcggagtgttcggggacccggccctctgcgcacgagcagtatttcggccgccggcccctggctccatatcgcagccgccgccgccgccgccgcccctcaggcccccgcagacgctccccagatggaggaggtggggtaggaggagggagctgcggaggcagcagccagaggaggcagaggaaccggagcgacag

SEQ ID NO: 532 - DNA, 64665 bp, Homo sapiens
aattggcgtagcgcttgctgagcggcggcggcaaccgacgtacacaaggggcttgagcgttctgtggagagagtgcgaggtcaggccatgaacttggggtaagcaggggtaagctggggtaagctggggtaagcaaggtggtcgtcagcggagagggaggcatgtgtgtctgggttgtcccttggagtctttactggagaacgttcccaacctgcgccgccgagaggggcagagcccagttctcgggtagaagatcgaggcagatgggtcggcccttagcgactccacagaccttacgttttcacttaatgactagcattaaaactgccagtgatcccctttcggtcccttatttacctcaggatgaggagggaagagaggtgaggaggaaaggagagaaatgacgagacagttagaggaagcgtggcggctcctggggaggactcctggcccatgccccgggttcttcgccaccttgtttttggagtcttgcagaatgttgaaacgcccaaattcgttttaggcccacgaggcggggaaccaggcttctcaagaaatcgatgtagtaccagtgcctaacacctagtaggcgctccttaagtaggggtgaataaataaaaagggctggtgcatggtcttcatcactcgcaagtttgatattttgagaagatgagaagccaccaaactcagacctaactacacatcgttcagcaaatgttattatgttttagaatctggggatatggaaataaataagatagtgtgtcccttaaggagattacagtgcagtgcgtcattgaaggtactttaccattgaagctcttttctttcttggtgacgtttcaccaacataaacacgaactgttcataaccctacaataaggaaagccgtaaaacctattctttccagtgttttacctttaatagttaaggtgaggtaatttgatttcccctacctgagcaacaccgcaaatttcgcattcctaatcagacctttcccagcctctctctcccttgactggcttgctggatttaattttctctctctgaattatggactgtatgtatgggctgccatttttgttctcagtggagttttaggaccttaacagacgttcaagttttgttggcagtggctactgttactttatgcctttgcttctgatatgcacgtataaagcaccatactaaatatcactatgtattatttgaaatattgaaagtggtactctttgctcaagcagttactaaccttgatggcattgttagtagtcatatcgatgctccagcactccatagaatgttttagtcatgagttcattatgaaactaatgaatggcggttaaatatatcttgttcctttaacttatgtgaggagttttggtaacagcattattaaaaaatggtggtatgataacttaatttatagtttaccaataacaaaatgagatttcaggttaatgataacaatgcttgtagtattgaagagtttcaagaattttccccctgtagttgtgggttttatcttggattgcaaacgtttttaattaaaacactggttcgatgtgtacaagattcctgcataaattcaaaataatggatttattgtcaggttcaaatgaacatttctggttatttaaaatgttgcggtttgttaaaaatgagagacaactttctttttttattacagagatggtttaaagcttgaaactgaattactggatggaaaaaccaagctaatattgtctccatatggtatgttgtgttacagaaatctgaaatgttaacttttaaattcatacataaaatttatattagttcaacagactttttgcttgtaatagagtgatatttaaatgatattttagaaaaagctgtttcctcaaacttctgcagatttccttctagccaaataaaatcagattacaacactgcttactactgtcagtattcagactcataacatttaatgttccagtatattgcgtgttcattatatccatatagcaaatatcctcattgcctgatgaataatacaagtaaaatttatgtaattatgttctttgcatgtaaagaatgtatcatttgagaaaagtttatagtaagaccaccgtaaaatgctaaagtcacttttagtattcgtttttaaactcagtgtactttggtaccttctccttcgcatttttttttctgtttatagttttaccttggaaagataaaaaacaaaaataaaatagaagtaaatccttgaactggattagaaaaaaatactcagtcaagatctaaagtttatgctttcgaggataatgttgctagcttaaaatcttataacaatattaattacagttttcttgcattaccaccttagtatgcttttggtggatagtttagtaatttcttttttcttttgtagaacataaatcaaaaatttctgtgaaggtaagccgtataactttgacctgacctgttttcaaatgtaaaatgcagttttatttatagtggttagaaaataattcctgggaaatgtcaagtgttctaaggggtttggaattatagtgaggagttattattttcttgctttcagattggtcctttcacagaaattgaatcattttaggtttagcccaatagaacctctttctctagataagtgctattcagtaaagcatctgtgttaatggaagtgttcattaataaaatcagtattattgaatatggaagccactagtcatgtatagttattgaacccttaaaatgtaactagtatgactgagcaactgaatttctaatttcctttaatttttaatggaatttaatggataatggattgtactggacaatgcactccagagatctttaaaaatagatattcagactttaaacagaaatgttttttcttttcatactcaaattccatttgcccacaccaaaggggaaatttaattcacaaattgtagcatgcatttagcattttcctttaaaaggttgcacttgagcttaagggtaattttccttttaaattattttcccttatcagaaatctattgtgcttttttctacaaaatacattatcactttgtttattttaatttttgaggcagagtctcactcttgtcacccaggttggagtgtagtggcataatcatggctgcagatcttcctcctccagcctcctgagtagctgggaccgtgtgcatgagccaccatgcccagctaattttttttatttttagtagagatgggatctcactatgttgcataggctggaattaccatttaaaaaatttttttgaggttgggcatggtggctcatgcctgtaatcccagcactttgggaggccaaggtgggtggatcacctgaggtcaggagttcaaggccagcctggccaacatggtgaaaccccatctttatgaaaaatacaaaaattagatgtggtggcgctagtcccagctacttaggaggctgaggcagaagaatcacttgaaccctggagatggaggttgtagtgagccgagatcgcaccactgcactccagcctgggggacagagcgaaattccttctcaaaaaacaaaagcaaaaaaagccaactgttttgatacttctactcttcttgctacctatttcttttttaatttttagattaatatcagtaggaatttctcttctcttccataacttactacagcccccttttatctttgcagtgtcttaaagtctttgcttgtctgtggatagaacccagtttggatgatgtaccactttatccttcaactctaagcccttgatggctttacttgcaggtttaattaaggtgaagaagttgctggagtacccgaaatatcactcaataaataggtgaagatgatcagaacaattccacaaactacatataaaaattgtttctctttctctatcatatagttatataccatgtatgctccccaatcacagactacagattgtatgttattcctacccctttccctattaaaaattgcaactaactgctgttatttgaaacacattcacaaatacagtggcctttatcaagttcctagatgaaaagctgtttgtaatggttgatttttatcttctccaggctgatttgttatagaagccacatttgtgaagacattttattgtcattttaaccaactcagaacatctgaagatcccctttataggcctataataaacagaattactggtcttggatttttggtaggcctataataaagttactagtcttggacttttgattactagacttttaatcataaaattctatcagctatctaaaggtgttttagaattttttttttaagagtaactactgtgttctcaactgatgttgagcctaaattgtttactgccttaaagcaaattgtttgggtttatccccattgcatttgggacttcaaaatactgatgcaacctaagtttcccttctgtattgattgttttcaagaagtttctcttcccatattgatagaggttacagagatcctcctcatttcttttttgctcttcacagactataaacaccaaaatcagtagtattttcttccttttttgttttgttttttagtttcccaaatttcacagttctgccactagatgttgaattctcttttctgcaagttattcatgaattatctctgcatagtgcttttctttattccttctaatggggtaagctcctgagttactacaacacctacaggtctctttttttttcccccatttcccactggttgaattattgtaatctccatagtttgttctttaaacacagctgaactctatctcattatcatcaagtttaacatatatgtggtcaaagtgctttcctaattctatcaaaatctgtgcatttttcttttctttttttttttcttttttgaggcaggctctctctctttgtccaggctggagtgcagtgggacaattatggctcactgcagcctcgacctcctgggctcaagggatcctcctgcctcagcctcccaagtagctaggactacaggcgcgtgcccacaccaccaggctcagttaattgtttaaaattttttgtacagacgggagtcttcctgtgttgcccaggcttgtctcaaactcctgggctcaagcgatccttccgcctcagcctcccagagtgctaggattataggtgtgagccactgtgcccagcctctcctacatttttatttttcttcaatctgtggtaatgaagtaaacttggttactttcctaatttcttaggtttataggaagagaaatgggaaaatacagataatacagtatcataagtaatttattaaaataatggattctaaaactcttacacttaaaatagtctcaaagattagttgaactataaaacaataaaaaaatttttatgagtacctctgcacgtgagaatcagtgacatactaaaaggtatttgtaatattagtgctaggtagcacattttatatatatatattttgtttgttttagagatgaagtttcgttgttgttgcccaggctggagtgcagtggcacgatctcggttcactgcaacctctgccttctgggttcaagcgattctcttgcctcagcccctcgagtagctgggattacaggagcccaccaccacgcccagctaattttttgtattttttttttttagtagagatggtgttttaccttgttggccaggctggccttgaactcctgacctcaggcaatccacccacctcggcctcccaaagtgctgggattacaggcatgagccattgcaccctggcccacattttatatttaaaaatgttacttttctctgatttgttctggccttgggatcctggccccatataaattgtgaagtgagctgatattaaacaaatccattgaacattgtctttataataataaaaaatggctgggcttggtggctcacgcctgtaatcccagctctttgggaggccaaggcaggtggatcacctgaggtcaggagttcgagaccagcccggctaacatggtgaaaccccgtccctactaaaaatacaaaaactagccaggcttggtggtgggcacctgtaatcccagctactcaggtggctgaggcaggagaattgcttcaaccggggaggtggaggttgcagtgagctgagatcgtgctgttgcactccagcctgggcaacagagtgaaatgctgtgtcaaaaaaaagtagttaaaaaaatttttttaattgaaaaaaaaaaaaaagagataatgtaggtggtataatctaatgacataagattcaaagctggagtatagtggagatgtcctataacaactataataaaagttcctgaagtaagataatttctagttgttgatgaagatttgcaagtattaagagttagtttcttatggttatattacctaaatagcaaaatggaaaaaagtttagaggactgatttatcacagatcatataaagataattggtgatttttcttggacagttataaagaataagcttctggtgttttaacagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaacccctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtaagatttttctaaagttttcatgaattttgattttttcaatatgtgttttagaatatcagattcattgggttttatgtaactgtgactcttaaactctaatttaacctgtcaatctattaaaataattgttcttttagaggactttctctaatatgcaaaattatttttatagttgtgccatattttaaggttagtgttcagaatattaagaaacctagtttctgtggattttagaaaaaatgttagtacaaaaaactattattatacttattttagaatataggaggctttactcatatttaaaatagttatatgaaacattgtttaaaaacaaattacggtatttccagtgaaaattaaggaaaccttactatgactatttgacttgagttactgaaaaacattgctttcctggccacagcatttactcttcctgttcctcattccatgctaagaaatggcagtactttttttaaaaaacaaggttaacacagatttggaaggaacagtagagtgttacatgctttgtctttcacaagtcctggcattgtattgtgtttttaaaagccttctaatttccactttgggataaggaattgcgaatatgaagacaatagaaatatctaaaattttattaggcaatagtgaaataaataaaaaattaacagttcacatggagaggccccacaaatggtttggggacccattaactcctgaatattcccgtgatactcaagatggaattatttactctcttgttatagattattcttggtaaaatgagggagctggattttgtctttaaggctaaaattctagcaacaacctgcttattaggcataacgagaaatcatatcaacaaagttaaaagcagaatttgcctaatcacgtagactttcatgatttctttctcttcactgggagaactagcacattcaaaagaaatcagaacattttttgagccatcctgtgagccctctaaaacatctgattttgatattatagctgggcatagagacaattcatgaaaaggttttccactgatttcacagctaaataagaaaaataacgtcaaggtaatgagtatttatcaagatatttgtattcccctttaggttgtgatttgtgttataatttttattttatttatttatttattttttgagatggggtctcgctttgtcacccaggctggagtgcagtggcacgatcttggctcactgcaagctctgcctcccgggttcacaccattctcctgcctcagcctcccgagtagctgggactacaggcgcatgccaccacacccggctaacttttttttttttttcttttttttgtatttttagtagagacggggtttcaccgtgttagccaggatgatctcagtctcctgacctcatgatccgcctgcctcagcctcctaaagtgctgggattacaggcatgagccaccacacccagccatataatttttatttttattttttatttattattattatttttttagatggagtctcgctccgttgcccaggctggagtctcgctgcgtcgcccaggctggagtctcgctgcatcgcccaggctggagtgcagtggtgcgatctcggctcactgcaagctccgcctcccaggttcacgccattctcctgcctcagcctcccaagtacctgggactacaggcgcccgccaccacgcccggctaatgttttgtatttttagtagagacggggtttcaccgtgttcgccaggatggtctcgatctcctgacctcgtgatccgcccaccttggcctcccaaagtgctgggattacaggcgtgagccaccgtgcctggccagtttttatttttaaaagcatgctggcaagaggaaatggagatttgttttctgttgttgctcgcttgttttccttatttgatataagaaattgtatggctatggtcatgagcaagccatttaacctctgggcttcagtttcctttgttttgttttgttttgttttgttttgtttttttgagacgacatctggcccagactggagtgcagagtgcagtggcacaatctcagctcactgaaacctccacctcttgggctcaacccatcctcccacctcagtgtcccaaatagctaggactacaggcacgtgccaccacacctacctaatttttgtaatttttgtagagacgaggttttgtcatgttgcccaggctgatctcgaactcctgagcttaagcaatctgcccacgtcagccttccaaagttctgggactacaggtgtgagccaccactccctgcttcctttttttctttttgacaggaagggaaacttaatggctacctcaaggattgttttgagagttaatttaagtaacgtgtaagacatgtaagaactgtatagcactatgccaagtattataacagatgtaatttagtgttaattttaaaacatgtattttacctcctaggtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatgtatgtaactcctatctgttgttattgtgtggtcatcttcagaatatggttttgcttttcctttacttgcatgtgaaatagttactctgaatacttagagctatttaaaagcttattacttaatatttatggagtcagttgtgtagaaatgtatgatacagtttctgttatcttttgtgttttaccttagagagaatgaatggaaaccagctgatatattcagtactctgggggaaagggaatgtgatagaagttcgttggaagcaaaaaaagcccagtggaggaaagagctaggtaggtaacttttatacctttattatagttttattggcttaaagaatatgtattgaagccgggcacggtggctcacacctgtaataccagcactttgggaagccgaggtgggtggatcaggagggcaagagatcaagaccatcctggccaacatggtgaaatcccatctctactaaaaatataaaaattagctgggcgtggtggtgcacgcctgtaatcccagctactcgggaggctgaggcaggagaattgcttgaacctgggaggcagaggttgcagtgagccaagatcgtgccactgcactccagctgggctaccgagcaagactccatctcaaataaataaataaaaaagaatatgtattgaggatgaagtttaggggccaagggaaaacgtcccctttgccctctggaggttttctgaaagatcaactgacaaaaggcaaattaataaaaggcatacaaatttattaacatgcatggaagttttacaaaatataaaaactaaaataaatggccagatggctgacacttgtccaccatgttgaggttacagaaacaataggggttggagcatggcaaaacagattatgggagggggaggagaggcaacctggccagtaaaagtgtttttttgttttgttttgttttgttttttgagatggggtctcgctgtgttgcccaggctggagtacagtggtgtgatctcggctcactgcaagctccacctcccgggttcacgccattctgcctcagcctccccagtagctgggactacaggcacccactaccacgcccggctaatttttttgtatttttagtagagacggggtttcactgtgttagccaggatggtcttgatctcctgacctcatgatccacctgcctcggcctcccaaagtgctaggattacaggcgtgagccaccacgcccggccaaaagtggttttattatgtacatgagacctcaaaggtagtagccttcagagaacagatgacaaatgtttccttcagacctttaaaggtgtcagactcggttaatttatcctagatctggacaggggagaatcctcagagaaagcctggctgcgtcattgcagattttctctacagatgcaaatcttccccacaaaagacagctttgcaaggctacttctgtttgtaggccctctgaacagccatcttgaaatgtgtcaaattaatacattttggggtaaaacactgtagttccctttaaagtatagttatccctcagtatccatgagagactggttcaaggatagtcttcccacttcagggtgccaaaatgcacagatgctcatgtggaatccatggatatggagggcctactgtatatcttttagtatgatattatcaaaagtcgtattttataatatttgacatctagagtagttctctacaaatgcttaagaaacttagtggtttcataatgccttaggtcgtgtctttttgttactctgaagtgtgcaccaaaaacattaatgtcatcagtacattctgcagcccttgtaaggtcaaagatttgtaaacttttcccatttcctggaaatccttttttataatttttgatagcagacatcctatgcgtttaaggatggttttactaaaaactaattgatttcacttttttaaataaccaaaacattctaatgaagaagaatcattgttgtatcagacagtatgtattctagacagaaataagcttattgctttctttcagctttggaccttataacagaaaaatctataatttctgttagagtcttgaaatttcgttagtgactaagaaatatccattacttcttcgactaaacttggagtctgcgtatcacaatctgcaaaacatgtgacgtaacagttgtatttcttaggaatagctatgctaaaggcatgagatgggcttcaccctagttgaaaaacaagaaagtcttgtgaggccatcactaacttggctgggatagatgatttagaaaaagagataagcaagaccagctgagtggctcacatgtaatcccagcactttggaaggccaagatgggaggattgcttgaggccaggggttcaacatcagcctgctggagcaacagagtgagaccctatctctacaaaaaaacagagagaagcagcagaaataaggagtgaattgatgctggaagtcaagtgtgttagtctgttttgtgttgctataaaggaatacctgagactgaataattgataaaagaggtttatttggcccacagttttgcagactgtacaagcatggtaccagcatctcctcggcttctggtgaggcctcaggaagcttttactcacggtggaaggcaaagggggagcaggcattttacatggcaagagagatgccaggctcttttacacaaccagctctcatgtgaactgacagagggagaactcaagcatcatcccaaggggatggcaccaagccattcatgagggattcatctcctgtgacccaaacacctccccttaggccccacctccaacactggggaatcacatttcaacatgagatttgaaggggacaaatatccaaactgtatcatcaaggtaaaagaagaatgaagagattaaacttatgttagcagtatcagaaggtttggcggtcttgatgtgtgtttatatcacaatttcatctttaaatattttctttcagcacattccacatcaaaatgcaataccaaatgtctgaaataatatggaactacttggaaatgaccagaatattttgtgctttaatcatttttgttgttgttgttgttttgagacggagtttcattcttgttgcccaagctggagtgcaatggcaccatctcagctcactgcaacctctgcttgctgggttcaagtgattctcctgcctcagcctcctgagtagctgggattacaggcacctgccaccatgcccaacttactttttgtatctttagtagagacagggtttcaccatgttggccaggctggtctcaaactcctaacctcaggtgatccgcctgccttggcctcccgaagtgctgtgattacagttgtgagccaccacacctggccttatgctttaattattttaaaaatcagtttactgtttttttaacttgtctcagtaaagtgcctctatttaagtcatgcttccagtaacattcttggaatttaaatttatacaacattgaattttgtatttaaagaactactgttgattggggggttagttttgactatatctctcagacacaggcttttatgttttttacttgtcagcaattaagaaataatagctaacattcattgaatatttactttgtgccaagccctatattgagataggcactattattatccccattttatagaagaaaccaaggcttagaaagcttaccagcagttggccaactgcggtgggctcatgcctgtaatcctaccacgttgggaggccgaggcaggtggatcacaaggtcaggaaatagagaccatcctagccaacatggtgaaaccacatctccactaaaatacaaaaattagccgggcgtggtggtgctgcctgtagccccagctactcaggaggctgaggcaggggaatcgcttgaacctgggaggcggagattgcagtgagctgagatagcgccattgcactccaggctgctgacagaatgagactctatattaaaaaaaaaaaaagcttaccagcagtttgctaacagtcacgtagctgggaagttgttgaacttgaattttaacccatagttctctacttcagaattctagcttttaattctcttaataataattgaatgaacattacaggaaactagaacctcgtgataattgacaaagtataaaataagttattccaataaaactgctccttattggtaattgtgataataaaattgtaccatacttaactttggttctgattaaattttttcttattctgtgtccctaaaaaattattctccactttgtgagttaatctccttcctaaaaaagagttttgattagatctgtgttggtatctgcattaagaaggtcagatttgtttacatggttctgtttttacagtttttgtacatttttttaaaaaggacattatttacagatgaacaggttgctttaaagaagaaagaaaaagaagtttctgaaaaatggaatgatccttggaaaaaatctgaaagtgataaaataatatgggaaaaacatcaaattcttgaccaatctagggtaagacatcttaattgcaatttttaaaatactaagcagtgttcatattatagaatttatttttaaagcttattaaaaaaaaaaagttttttttttgagacggagtttctctcttgttgcccaggctggaatgcagtggcacagtctcagctcactgcaacctacccctcccaggctcaagcgattctcctgcctcagcctcccgagtagctaggactacaggtactcaccaccatggccagctaattttttgtattcttaatagagatggtatttcaccactcaggatggtctcgaactcctggcctcatgtgatctgccagccttgacctcccaaagtgctgggattacaggcatgagccaccgtgcccagcctatttaaaaaaacttgtcatatttttgggttttttgtatgtgtgttttttttaaaaaaagaaacagggtcttgctctgttgctcaggcaggtatgcagtggtgaaaacataattccctgcagccttgaacttctggactgaagggatcctcctgcctctgcctcccaaatggctggtactacaggtgtactccaccatgcccagctaattaaaaaaaattttttttagagacagggtctcactgtgttgctcaggctggtgtcaaacttctgacctcaagcgatcctcccaccttggcctcctgagtagctgggattgtaggtgtgagccactgggcctggctcatatggtattttaaaacagtgttatttttaatttaattatgaccttaactggtctctatttacattctgtgagttgtctcgttatgtcgttaggtgaatgtagaggctccctttagagtcttataaaggagctgtgcaatttttgaaatgaatacaaaactctgccactatgtgtaagtgtttagttatcaaatatacacatatgccaagtgtgtcttgtgtagtgcttttgtgatttttaaattttatctgtggttaattttgggtaaagaaacagtgtcactgtttttctatttatttttacacttctgctagctcttcaagcattctatcacagtctcgtagccaggttatggtggtccaagctgatggggcattcacaacttagagctagtcagactttagaggtaagtcctaagtgtcagtactttggatatttaaaccttttagtatttgacctctaacctattttccttgaaggagagaatctaagtcctccttatttttagttatcagttaatttttacttgagtgtattatgcttcatttgctatcccttcctccttgtgaacatttacattttagcaaatgtattctgaaaataatgtagtaacctgaagggatgattctcctaaagagatgattctggtggtagaaatttttggcactatggcctaattaggtaaatttcttatagaaacccttcaagttaaattttgtgcatggctgtctgttctgcttcatgtagagctgacttgcctacattgaatacttttgttgtctgttgataattttacattaacaaaaggaatgaaatctgaattgcatttgcccacaatcccaaaagcacattgactgaaaaggcaataaggttgtcttggtagaactcattttggaaaattctgtagctctgggtgataattttaagtgtgtaaagtttagaagttgtatgcagacaccgttaaaagttgtagctaaaactaagttttcatgaagttggtgaggatccgttgttggcttatttacttttcaacatcaggataaaaaatctgtaatactaaaaatgttaaataatttcagttgccaaattttcagttgaaatgtcaatatataatttatttcttaatttgcatggctttttaggtcatttattatctggggataatccataccatgattgttaatgcaagtaaagaaccatttgaggtgacatttaggttttaaaatattttgtatatattttttaatgatagtatttgtcagttgatgaaatgacgaggctcatgaatttggaaaggagaactttatttctcatcagcagttgcaacctgcagcatggccattctgacaggctgggaagcatagccttcggccaaccaggagccagaaacttcaaggtgttggggaagggaacaggaatttatgctgagtgaagtggctgaatatacgtatttaataagcatagaaggagtcatgaatatttatgaaaggagaaacatccatgcacaattgagttttatgccccttcatgggtcccatgtacaaaaaatgtcagcgttagcatgatccaagggtagagttttcagccctctgacatcaaaaagtaaagcagaggacacaaaaaccttttggacagaagcatcaggtggttggttggtatcagtgctgacatcttctgaagggctggtttctgtttagcccttaggctaaatagtggttagccagggagggaggaggtataatgtggtgtgtctgatttccccatccactcatggccaagaactcagttttcaaggcactttggggtccttggccaagagatccattcagttggttgggggacttagaattttacttttattcctcatgtgtatctttttttaaataactaaaaaaaaacaataaagttatttaaaaaatttttggaatcaaaagttgtgggggttgatgatgggagaaggactagaaaacgaaacacatgctatatccaggactggacaaccaagagttaaaagagtatgattattggctcattttttttactatttaaatgcagttttcgctgggtgcagtggctcatgcctgtaattccagcactttgggaggccgaggtgggcggatcacgaggtcatgagattgagaccatcccagccaacgtggtgaaaccccatctctgctaaaaatacaaaaattagctggacatggtggcacgtgcctgtagtcccagctatttgggaggctgaggcaggagaattgcttgaacctgggaggtggaggttgcagtgagctgagatcgtgccactgcactccagcctgggcgacagagcaagactctgtctcaaaaaaaaaaaaaaaatcagtttttatgtatttgtatgcgaatgtggtacaaaattggagagatgttattgagggaaaaggaatttgctgtgtaacaaaaaagccctcttctcaaataccttagagcagttgttttcagaaatcccagctgtagccacaactatttatactatttgaatatctagttagtctctccatataattgggagggaaagaagtttggttgtaggcagtcaccaaagccttgagtgttaaaacatgaggtaatgcatatgaagtgcttagaatagtgactgacaatagaacaaatgctaacaaagttttgttctacttataatttaaagagttggggtctcactttgttacccaggctgaacaggcacagtcatgttgcactccagccttgaactcctgggttcaagtgattctcctgtctcagcctctaactggcttatttcacttagcataatgtcctcaaggtttacccatactgtagcatgtgtcagaatttcatttctttttaatgctaaataacatcctattgtatgtatataccatgttttctttatccattaatccatggatagaaatttggattgtttctaccttttggctattgggaataatgctgctatgaacattggtgtataaataatctttttgagttcctgcttcaattcttttgggtgtgtactcagaattggaattgcaggattgtgtggtaattttttgtttaatttttatgttaaatttttaccaattttaattttgtaattttgtgttaaactattttgtgttaaattttgtgttaaactgctttccacagcagctgtaccatgtatatttccatcagcagtgcactgtgttccaatttcttcacatcctcaccaacacttactttctgatttattgacagtatccatcccaatggttgtgaaatggtatcattgtggttttcatttgcacttcccaatgattagtgatgtggaacattttcccacaggcttattgactatttgcatgtatttgaagaaatgtctattgagatcctttgcccatttcagtcaggttttttgggggtttttttgttgttgagttgtaggagttatatattttgtatgataatcccttgtcagatacatgattcacaactgttttctcccattctgtgagctactttttcactctcttgataatagtgtcctttgatgcacaaaagtctttaattttgatgaagtctgttttatctcttttcttttgttgcctgtgtttttaatgtcctatcaaagaaatcattgccaagtctgatcatcggactgtattttcttctaagagttttctagttctagctcttatgtttaggtctttgatctattttgaattaagttttctatatggtataaggtcagggccctactttattcttttgcatgtggacatctagtttttcctagcaccattgttgaagaatgtcctttccccattgaatggtgttggctcccttgtccataactatttcactgtgtatgtgaggatttatttctggtctcctctattccattagtctgtctgtatgctactgcctcaccatcaggaactatgacccttccaactttcttcttttttaagattgttttgtctattcgtggtcccttgagattccatatgaattttaggatggatttttctatttctgcaaaaaaaaaagattattgatattttcatagagattgcattgaaactgtagattgctttgggtaatattaatatctcaataatattaagtcttccaattaatgaatgcaggatatctttccatttatttgtgtctttaattttttttcagcaatgttttgtagttttcagtgtacaagtcttactcctccttggttaagtttttctttttaattttttaaattttttttgtttttttatatatttttctttttattgttttggttaagtttattcctaagtattttttctttttgatgccattgtacatgggatttttaaaaaaaattttatgccattgtacatggaatttttttttttattattatactttaagttctggggtaaatgtgcacaacatgcaggtttgttacatatgtatacatgtgtcatgttggtgtgctgcacccattaactcgtcatttacattagatatacctcctaatgctatccctcctccctccccccaccccacgacaagccccgatgtgtgatgttccccaccctgtgtccaagtgttctcattgtttagttcccacctataagtgagaacatgcaatgtttggttttctctccttgcaatagtttgcttagaatgatggtttccagcttcatccatgtccctacaaaggacatgaactcatcttttttatggctgcagagtattgcatggtgtatatgtgcatagtattccatggtgtatgtgtattaatccagtctatcattgatggacatttgggttggttccaagtctttgctattgtgaatagtgccgcagtaaacatacgtatgcatgtgtcttcatagcagcatgatttataatcctttgggtatatacccagtaatgggatggctgggtcaaatagtatttctagttctagatccttgaggaattgccacactgtcttctacaatggctgaactagcatgtagtcccactaacagtgtaaaagtgttcctatttctccacatcctctctagcacctgttgttccctgattttttaatgatcactattctaactgctgtgagatggtatctcattgtggttttgatttgcatttctctgatggccagtgatgatgagcatttttttcatgtgtctgttggctgcataaatgtcttcttttgagaagtgtctgttcatatcctttgcccactttttgatggagttgtttgattttttcttataaatttgtttaagttatttatagattctggatattagccctttgtcagatgagtagattgcaaaatttttctcccattctgtaggttgcctgtttactctgatggtagtttcttttgctgtgcagaagctctttagtttaattagatcccatttgtcaattttagcttttgttgccattgcttttggtgttttagtcattttgtccatgatgtcctgaatgatattgcctaggtttacttctagggtttttatggttttaggtcttaggtttaagtctttatttcatcttgagttaatttttgtataaggtgtaaggaagggaaggggtccagtttcagttttctgcatatggctagccagttttcccaacaccatttatgaagtaaggaatcctttccccattgcttgtttttgtcaggtttgtcaaagatcagatggttgtagatgtgtggtgttatttctgaggcctctgttctgttccagttgtctatatatctgttttggtaccagtaccatgctgctttggttatggtaaccttgtagtgtagtttgaagtgagacagcatgatgcctccagctttgttctttttggttaggattgtgttggctatttgggctgttttttgattccataagaaatttaaagtagttttttccaattctgtgaagaaagtcagtggtagcttgatggggatagcattgaatctatacattactttgggcagtatggccattttcacaatattgattcttcctatccatgagtatgcaatgtttttccatttgtttgtgtcctcttttatttccttgagcagtgatttgtagttcttgaagcggtccttcacatcccttgtaagttgtattcctaggtattttattctcttagtagcagttgtgaatgggagtttgctcatgatttggctctctgttcttggtgtataggaatgcttgtgatttttgcacattgattttgtatcctgagactttgctgaagttgcttatcagcttaaggagatttggggctgagatgatggggttttctaaatatacaatcatgtcatctgctaacagagacaatttgacttcctcttttcctatttgaataccctttatttcttcctcatacctgattgccctggccagaacttccaatactatgttgaataggagtggagagagagggcatccttgttttatgccgtttttcaaagggaacgcttccagttttcgtccattcagtacgatattggctgtgggtttgtcataagtagctcttattattttgagatacgttccatcaatacctagtttattgagagtttttagcatgaaggagtgttgaattttgttgaaggccttttgtgcaactattgagataatcatgtggtttttgtcattggttctgcttatgtgaatagattacgtttattgatttgcgtatgatgaaccagccttgcatcccagataagaagccaacttgatcatggtggataagctttttgatgtgctgctggattcggtttgccagtattttattgaggatttctgcatcgatgttcatcagggatattggtctaaaattctctttttttgttgtgtctttgccaggctttggtatcaggatgatgttggtctcataaaatgagttagggaggattccctctttttctattgattggaatagtttcagaaggaatggtaccagctcctctttatacctctggtcgaatttggctgtgaatccgtttggtcctggactttttttggttggtaggctattaattattgcctcaatttcagaacctgttattggtctattcagggattcatcttcctggtttagatgtgggagggtgtatgtgtccaggaatttatccatttcttctagattttctagtttatttgtgtagaggtgtttatagtattctctgatgttagtttgtatttctgtgggattagtggtgatatcccctttatcattttttattgcatctatttgattcttctctcttttcttctttattagtcttgctagtggtctatcaattttgttgatcttttcaaaaaaccagctcctggattcattgattttttttgaagggttttttgtgtctctatctccttcagttctgctttgatcttagttatttcttgccttctgctagcttttgaatgtgtttgctcttgcttctctagttcttttaattgtgatattagggtgtcaattttagatctttcctgctttctcttgtggacattaagtgctataaatttccctctacacactgctttgaatgtgtcccagagattctggtatgttgtgtctttgttctcatggtttcaaagaacatgttaatttctgccttcatttcgttatgtacccagtagtcattcaggagcaggttgatcagtttccatgtagttgagtggttttgagtgaatttcttaatcctgagttctagtttgattgcactgtagtctgagagatagtttgttaaaatttctgttcttttacatttgctgaggagtgctttacttccagcttcgtggtcaattttggaataagtgtgatgtggtactgagaagaatgtttattctgttgatttggggtggagagttctgtagatgtctgttaggtctgcttggtgcagagctgagttcaattcctcgatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccagtatgtaatggccttctttgtctcttttgatctttgttggtttaaagtctgttttatcagagactaggattgcaacccctgcttttttttgttttccatttgcttggtagatcttcctccatccctttattttgagcctgtgtgtgtctctgcatgtgagatgggtctccggaatacagcacactgatgggtcttgactctttatccattttgccagtctgtgtcttttaattggagcatttagttcatgaacatgtaaggttaatattgttctgtgtgaatttgatcctgtcattatgatgttagctggttattttgctcattagttgatgcagtttcttcctagcctcgatggtctttacaatttggcatgtttttgcagtggctggtaccggttgttcctttccatgtttagtgcttccttcaggagctcttgtaaggcaggcctggtggtgacaaaatctctcagcatttgtttgtttgtaaaggattttatttctccttcatttatgaagcttagtttggctggatatgaaattctgggttgaaaattcttttctttaagaatgttgaatattggcccccactgtcttctggcttgtagagtttctgcttagggatccactgttagtccgatgggcttccctttgtgggtaacctgacctttctctctggctgcccttaacattttttccttctttcaactttggtgaatctgacaattatgtgtcttggggttgctcttcttgaggagtatctttgtggtgttctctgtatttcctgaatttgaatgttggcctgccttgctaggttggggaaagttctcctggatgatatcctgcagagtgttttccaacttggttccattctccccatcactttcaggtacacgagatgtagatttggtcttttcacatagtcccatatttcttggaggctttgtttgtttctttttactcttttttctctaaacttctcttcttgcttcatttcattcatttgatcttcagtcactgataccctttcttccacttgatcaaattagctactgaagcttgtgcatttgtcatgtagttctcgtgccatggttttcagctccatcaggtcatttaaggacttctctacactgtttattctagttagccatttgtctaatcttttttcaaggtttttagcttctttgcaatgggttggaacatcctcctttagcttggagaagtttgttattaccgatcgtctgaagccttcttctctcaactcatcaaagtcattctctgtccagctttgttccattgctagtgaggagctatgttcctttggaggagaagaggtgctctgatttttagaattttcagcttttctgctctggtttctccccatctgtgtggttttatctacccttggtctttgatgatggtgacgtacagatggggttttggtgtggatgtcctttctgtttgctagttttccttctaacagtcaggaccctcagctgcaggtctgttggagtttgctggaggtccactccagatcctgtttgcctgggtatcaccagcggaggcttcagaacagcagatattgcagaacagcaaatgttgctgtctgatccttcttctggaagcttcatctcagaggggcacccagctttatgaggtgacagtcggcccctactgggaggtgtctcccagttaggctactcggtggttagggacccacatgaggaggcagtctgtccgttctcagatctcaaactctgtgctgggagaagcactactctcttcaaagctgtcagacagggacgtttaaatctgcagaagtttctgctgccttttgttcagctatgccctgcccccagaggtggagtctacagaggcaggcaggcctccttgagctgcggtgggctccacccagtccgagcttcctggctgctttgtttacctactcaagcctcagcaataggggacgcccctccccagccttgctgccgccttgcagttcagtctcagactgctgtgctagcagtgagcgaggctccgtgggcgtgggaccctccaagccaggtgcaggatataatctcctgatgtgccatttgctaaggccattggaaaagcgcagtattagggtgggagtgtcccgattttccaggtaccgtctgtcacggcttccctttgctaggaaagggaattccccgaccccttgcacttccagggtgaggcgatgccccacctgctccgtgggctgcacccactgtctgacaatccccagtgagatgaacctggtacctcagttggaaatgcagaaatcacctgtcttctgcattgctcacgctggaagctgcagactggagctgttgctatttggccatcttggaacctcctccggaatttttttaaataccctttaagaattgttctttattggtatatagattagtatgtagaaacacaacttatttttgtgtgttggttttatctcctgcaactttgctgaatttattctaaaagtgttttttagaatcttagtgatggtcattgtccagtgcaagagtttgatgtggatccttctggtactattttgctttcttgatgagtagatacataaacttcgatctacattaatgctcaagatagtcatatatgcataatcataattgaattctacatatctttcccttttttgacttctcaactttctttattattattattattattattattattattattattattattagatagggtctcataacctgtcacccaggctagaatgcactggcacaatcacggctaactgcagccttgaccttcctgggctcaagcaatcctcccatctcagccttacaagtagctgggactacaggtacctgccaccatgactggctaatttttcgtattctgtagagacagggttgctcaggctggtctcaaactcctgggttcaagcagtgcaactgcctttgcctcccaaagggctgggattataggcttgagctgctgtgcctggccaactttctgacttttaaaaatattatatgtatttgtgaaatgcaaaaaaaacataaaggatagtacagaagacatttctatcatgtcatacatatttaggaagagcccctcgtatggcatagttaagaggtttttgtttgtttgtttgttttattgatcattcttgggtgtttctcccagagggggatttggcagggtcataggacaatagtggagggaaggtcagcagataaacaagtgaacaaaggtctctggttctcctaggcagaggaccctgcggccttccgcagtgtttgtgtccctgggtacttgagattagggagtggtgatgactcttagggagcatgctgccttcaagcatctgtttaacaaagcacgtcttgcaccgcccttaatccatttaaccctgagtggacacagcacatgtttcagagagcacagggttgggggcaaggtcatagatcaacagcatcccaaggcagaagaatctttcttagtacagaacaaaatggagtctcctatgtctacttctttctacacagacacagcaacaatctgatatctctatcttttccccacatttcccccttttctattccacaaaaccgccatcgtcatcatggcccgttctcaatgagctgttgggtacacctcccagacggggtggcggccaggaagaggggctcctcacttcccagaaggggcggccgggcagaggcgccccccacctcccggatggggcggcggctgggcgggggctgccccccacctccctcccggacggggcggctggccgggcgggggctgccccccacctccctcccggacggggcggctggccgggcggggggctgccccccacctccctcccggacggggcggctggccgggcgggggctgccccccacctccctcccggacggggcggctggccgggcgggggctgccccccacctccctcccggacggggcggctggccgggcgggggcggccccccacctcccgggcggggcggctgccgggcggagacgctcctcacttcccagacggggtggctgccgggcggaggggctcctcacttctcagacggggcggctgccgggcggaggggctcctcacttctcagacggggtggctgccgggcggaggggttcttcacttctcagacggggcggctgccgggtagaggggctcctcacttctcagacggggcggctgccgggtggaggggctcctcacttctcagacggggcggccaggcggagacgctcctcacctcccagacggggtcgcggccaggcagaggtgctcctcacatcccagacggggcggcagggcagaggcgctccccacatctcagatgatgggcagccgggcagagacgctcctcacttcccagatgggatggcggccgggaagaggcgctcctgacttcccagactgggcggccgggcagaggggctcctcacatcccagacgatgggcagccaggcagagacgctcctcacttcccaggcagggtggcggccgggcagaggctgcaatctcggcactttgggaggccaaggcaggtggctgggaagtggaggttgtagctagccgagatcactccactgcactccagcctgggcaacattgagcactgagtgaacgagactccgtctgcaatcccagcacctcgggaggccgaggctggcagatcactcacggttaggagctgcagaccagcccggccagcatagcgaaaccccgtctccaccaaaaaaatatgaaaaccagtcaggcgtggcggcacacgcctgcagtcgcaggcactcggcaggctgaggcgggagaatcaggcagggaggttgcagtgagccgagatggcagcagtacagtccagcttcggctcggcatcagagggagacagtggaaagagagggagagggagaccatggggagggggagggggagagggagagggagggagagggagagggagagggactagttaagagttttttaagaaaatattcactcagtttttatctactcatatcttaaggaattgaagtggtccaggaaatctttgtacaggaataggcccaacataagatgggtggaagaaaacaacaatacatacaatcataggaaagaaaaaagacttggtataacattaaatttaaaatacagtgaggaaaaagaagaaattgctgtgggaacactcccagaatataggaagaagtttcaaaagagatgaaaaatctggcatcaaagatattataaatagcttataaaaatacaatcttgaatcataggctttcctaaagaagaaaacagaagtaataatatatcaagtttcatagaaaaaactttctagatccagaagaaaattaggttgaatgaaaagagggccaatttgaaggtatatcataataagtttgcaaatatcaagaataaggatatacttcttcaagcatttaaatatgagaaaatgacaacaaaaatcaaagtaaccttagttttcttctctgtatatagtatagcaatatttataagggtttaataaatagagctaaaatatttaatgcctagacaagatgttcatttataaagagaacatagacatactcagacctgaataattacataaaatatttctcccaaatatttcttttaatacaaaagttcttaaagatcatttctggatcagaaaaatgggtcaaaattaaaacaatttacaagaattttgtggttagaaagtaatgagtagctgacacaaaagtctctaagacattgtgaaatgaaaagagtaatgcatatactataaccatatctatatttaaagaaagactttaaaagactagtacatacataaacacacaaacacacacaaaaagcagaatggtggtattgtctcactctggtgaaggacagtggaaggaaacaaggagaaccttctaattctttatgcatttgttttgttagaatattgtgcaaagtgtttagctgttgtgtgatctctccataaaggcagagtttattatgattgtgaaaatcagataaaagttaaagaatgtacaaaactaaagtaaccggccaggcgtggtggctcacgcctgtaatcccagcactttgggaggctgaggcgggtggatcacgaggtcaggaaatcgagaccatcctggccaacatggtgaaaccccatctctacttaaaaaatacaaaaaaattagccgggtgtggtggcgcacgcctgtaatcccagctactcaggaggctgaggcaggggaatggcttgaacctgggaggcaaaggttacagtgagctgagatcacaccactgcactctggcctgggggcagagcaagactctttctcaaaaaaaaaaaaagaaaaaaagaaaactaaagtaatcattagtataattataaagagtatctgccaacatagtttgtacagtaaacatcaagataaatagtaatagcaagataacaagaatcaactctgaaaagtcaaaaatcctttgttaaaaagcagagatatgaaaactccaaagacttgatgcttaaaagagacatacttacaataaaattatacattattaaaaattatgggctggatacagtggctcatgcctataagcccagcactttgggaggccagggcagaagagtagctgccttgagccaagagtttgagaccagcgtgggcaacatagtgagaccctgcctccacaacacaaaaaaactaaaaaattagccgagcatggtgggatgttcctgtagtcctagctattctggaggctgaggtgaaggaattactttagcccaggagttagaggctgcagtgagctatgattatgcttgggccacagagcaagaccctgtctctaaaaagagataagatgccaatatattattactatttgtattggtggttctaggcaatataacaaggaaaataaatttcaagtcctaagaattggagaggaaaaaatgaaagtgtagttattcgtcatgtgtatagaaaccccaaagaatctatagatgaaatattcaaagtaaaaagtgagaattaataatttattaggctataaaagtctcaacaaatttcataggttcacattacatagaatgttatagtggattttattagtttgttctctcattactgtaaagaaatctctggggactgggtaatttataaagaggtttaataggcttacagttttgcagactatacagaaagcatagtggcttctgcttctggggaggccccagggagctttcagtcatggtggaaggcaaaatggaagcaggcatctaacatggcagaaacaggaccaagagagaagtagcagggagggctacacacttttaaacgaccagatcttaccatgaaaaacaatgtggagattccttaaagaactaaaagttaggctgggcgtggtggctcatgcctgtaattccagcactttgggaggcctaggcaggcggattacctgaggtcaggagttcgagaccagcctggctaatatggtgaaaccccgttccctaaaaatacaaaaattagccaggcgtggtagcaggcgcctgtaatcccagctactcaggaggctgaggcaggagaattgcttgaatccaggaggcagaggttgcagtgagccgagatcgcaccactgcactccagcctgtgtgacagagactccgtctcaaaaaataaaagtaaaataaaaataaaaaaagaaccaaaagtagaactaccatttgattcagcattctcactactgggtaactacccagaggaaaagaagtcattatacggaaaagatacttggacacacatttatagcagcataattcacaattcaaaaaatatggaaccagcccaaatggccatcagtcaatgagtggataaagaaactgtgagatagatatagatatggatatatgatggaatcctactcagccataaaaaggaatgaatgaatagcatttgcagcaacctggatggagttggagagtattattttaagtgaagtaactcaggaatggaaaaccaaacatcttatgttctcactcataagtgggagctaagctatgaggatgcaaaggcataagaatgatacagtggactttgaggacttatggagaaaggctgggagggggctgagggataaaagactacaaattggattcagtctatactgctcgggtgatgcatacaccagaatctcacagatcaccactaaagaacttactcatgtaaccaaataccacctgttcccccaaaacctatagaaataaaaatttttttaaaaagtaattgcagttttacccattactttcaatggcaaaaaccgcaatttacttttgcatcaacctaaaaaataaaaagatctcatgagaacttatcgcaatgatagcaccaagtggggtgatgttaaactatgagaaaccatccctgtgatccagtcatctcccaccaggccctacctccaacactggggattacaattcaacatgagttttgatggggacacagaatcaaaccatataatggaattaagctagatatcagtaacaaatagtaactagaaaattcccaaatgtttgataattaggcagtatacttctgactgaaagagaaattcacattagaaaatatttttaactgagtgataatgaaaatattacatatcaaaatgtaggtttcctgtgctgagagggaaatttttcaccttaaatgcatctcttgaaagactgaaaatcaaggaatagtgacctaaagtattcatctcaagaggttagagaaagaacagcaaaattgaagcccaaggtaggtcaaagtggatattagtaaaactggaaatacctacaataaaattaacaaagccaaaagttaattgtttgaaaagttatttaaattgataagcccctcataaaatcgagatgaattaaaaaggagatattaccagagaatatgacattagaaagagaaggggattttctgaataacttcaccaataagttagagaatttgggcttaaaaatgagcaaattattagaaaaacatagattactaaaattgacacaagaagcagtaaatcagaatggtactatctttattaatgaaattgagcttattactaaaaacccaacaaaataaactccagaaccaaatgtgtttactggtgaattcttcccaacaaaggtagaagtgaaaaccttttaggttgtttataagggtagtaaacctgatacccaaaactaacattttttaataccaaaacccaacaggaaatataagaaagaaaaataaatacaagaaagaataataaatcatgatgagttgggtctattcaatgaatgaaagcaagctaggtttaacattcacaaatcaatgatagtcatcatatttataaaaataataggtaaatttaataaaagtggctagacacaagaattaatgtaccagtgtcattagcacaacattgaaaggatgatctgttaaaaagtaattgatgaatgacctaatcacaagttctgttcttggaaggttaaagttaatattataaaatagagggagaaaatgtttgcagattaatccttgataaaaggacttacatccagcatatatttttaaaaactaaacattcactaattagacaacccaatttttttaattggcagaattttaatagacatggctccaaagaggatatatggcaaataaatacatgagaaacggatttttagccatttgttaaacctctatgggccctctggttccagagggaatttaattaatttttaagttcaaagtaattttgttttttaaaaagtgatttcagctctgtgttttgctgctgttcctcctgtaaggtaatgaatggtctttgtaatccagtgtcccgacatccctaccacccacatgaataccttttctgcgtggccagtagacaaggtcggcaggtggatgttgtcatcttaactggggaatcatgaactggcaagaagggctgttctggcccatggcaaagtcaacactgagtgttctttcccaaagctgcatttttataagactgctttaaggggagaattacatgaaatggaaacaggcatctgtagtggaccatttgaaaagccctttattttcagttgtgacttaaccagctgccatttgtacagcatttgaatcaggagtgagactaagatttcctaacagaataatttgaagactgaaagaattacattaggactctgtaacatcaggaactattttaggggaaggttgtagtgggtttcctatgagttttcacacaaggctgtcatgtgagaataggccatgtgcagtggctctttgggagatcaaggcgggtggatttcttgagcccaggagttcaaggccatcctgggcaacaacatgataaaatcctgtctctacaaaaaaataaaaatagccgggtgtggtggtgtgcatctgtagtcccagctacttgggaatctgaggcaggaggatcacttgagcatgggaggttgaggcagcagtgagccgtgattgtgcactccagcctgggtgacagtgagaccctgcctaaaaaaaaaaaataaaaacacaaaagagaataggctccaaacacgtttaggaaaccagtttttatgtaggggaagtctcaggtcaataatagggagatagagtgaaaaagtcagttagcctgggaaaagaggcttctttctttaactgtatggaggatttagtgagagggaatgctagaagaaggtcaaaacaattgttacagtgtgtcttgtgttatacacaaatatgccttactcaccttcaactaaatgcatgcagtaaaccaaaaggaatgcagttctacctactacctctccccatctcccacccccatgtttttcattcttctaactgaatgcacattgggagagacttgtgaaaaagaatgtaagaataatgtaaagcctttcccagtcaacgacagaaatgaaatgcagttaagtggtagtagctttgtaagacatccttgagtaagaaattaaagactcaactgagagatctaattgttcagttatcttagggttatgaatatagataaaacattttgagtgtttaaggaatttttaagggtaattttaacttttgtctaatccctgaataatttgcaatgccactacactaaaatatggaatcagatctggttacatcaaacttaaacaaatatacagcatccactcttttagcttccctgggtcacactgcaagaagaaaaacggtcttgggcaacagatgaaataaactaacactgtgatagctgataaacttaaaaaaaattgcaaaacactttcataatgttttaaggaagtttacaaatttgtgttgggccacattcaaagctgtcttgggccacaggttggacaatgctcgtttttcttttcccattttgacctctaaaacatttcttgaggtataaaaattgttaaatcttttacctaaagataatgttccttttgaagtgattgttttagacttaaataagttggatggtttttaatctggttagaatgtaggaggacctgagatagaaggatctttactttttgtataaatatttcttctgatcaaaacagtgagttgtaaactatgagctttgtgatcttttctggtaaaaacaagggaagaaagtaacattgtgaggtatatcgtcattgtaggattctgtcaaacagtttttcttaattatgtcttgtagttatttcatgtaatgaaatgttttgttgtttgcctgttgcatttcagaagaatttgagtagaatatatttttttccttttttaaaagagtatcctaaactcatcaattaaagtggcagcaaacttttatgctactgttttcattttttactttttccttaagattcaaagactcgttctggacacagtatatttttgttattgaaacatcataggctgtgatagagctgtagtagcagaaacctagaagacagaggttctcctagagagagacatgattcaatagggaaagtctcttgctctcacacatctttctatattctccttgttcttggtccaaagacaatattccaaatgttgtattccaaagccaaatgtaaaacaatattcatctgttttaaattaataactctttcagcctctaaaagagacttagaattttgaaaaacaatatttttgagacagggtctcactctgttgcccatgctggagtgcagtggcatgatttcagctcactacaacctccacctcccgggttcaagtgatttgtgtctcagcctctcaagtagctgggattacagacatgcaccaccacagctggctaattttttttttttttttcagtagagatgagattttgccatgttggccaggggctggccttgaactcctgggctcaagtgatctgcccatgtcagcctcccaacatgctgggattatagtcatgagctgctgcatccagctgaattttgaaagtcttttaattgttttggagaaagaattttctgtttttcattagaaaattcccttcccttacacttagatatcttattatatatctctgatctagtatatttaaaatatgattctgagaatcagaatatatctacttaattctttgaattcaaattcgtttgaagttattgctcctcttacagataaatgcctcagtggattaaatctgtatgttactttggcaagatttgcacatattaagtgattagaaaaagagaactgaactttagatggcttttatggctgttgtttaggaaacagtactgctggagcaccctttcagtgctgtgaaacaagaactgcaaagaaaatggattgaagagttgaataagcaaatagaagatgaccgtcaaagaaaaatagaggaaaaaattatatattcaaaggtaacttatgaggttttgtggctataaaagaaaaaataaaatcaaagtctttaatcaattaaaactagaagtattctgaaactcttgacaagaccagaatattccatttattccacatttgcccatgtgaacctgtttcattgaatgcattatgtgatgttgcatagcttcttacaactttttagaaatttcctaattctttgaatttctcaaattttcaaagctagtgatctatatgtataaggactctaaacagtacagtcttgttaatttttatgatgcttattctgctctaaggtgacttttagaaatcatctttggttgtcatttagaattatatatgagaataattggaaaaattcttagcaattcttatttgtcatcattagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaagtaagttcatgcttatgtatttattgacttttcagaaagtctgtgtgctttagtaagactgttgttatgtctaattggtttcaggtttggtatttgtctttgaaatagaaataattagtagatttatcccaaacaaaaatgatttagcttgttgaatctacctttttgaggttttgaatagctaatgtatgtatcttgccagctttctccgttctatgactgctctcttggacccagctcagattgaggaacgagacagacgacgacaaaaacaattagagcatcaggtattgcattgttaaacattgttctttaccttaataagtaacagtcatggtgaacatatacctaagtaaatggaaatttaaattctgatgtaaactttacagcataggtcctgtccagttgtgtcacgaatccaatccctaccacaactggcattgtaatattagaattagcttatcaaatgctacagccacctgccttccagtacagaaggtctttaatatattaagttgtatatgtgaatttgtgttgtcttaggttagtactggtttttttttttttcatcaatttatttctcctgagttctgtttaagatgagaattcattctttgaatagggattgaactagaattatgactaagaaatctaatgcataatggccgggcacggtggctcacgcctgtaatcccagcactttgggaggctgagtgggcagatcacgaggtcaggagatcaagaccatcctgtgaatggtgaaaccccgtctctactaaaaatacaaaaaattagctgggcgtggtggcaggcgcctgtagtccccagctactcgggaggctgaggtgggagaatggcatgaacctgggaggcagagcttgcagtgagctgagattgtgctactgcactccagcctgggcgacagagtgagactccatctcaaaaaaaaaaaagaaatctaatgcataatataagaaaggaggctaaaattaaaattaaaacttcctgtcctgattttagcctaatgctaaagggactttaatatctgcataattcttcaaatcctttgatatatgaatttggcatcattaatgttatgcttagtcagtgagcagacatttgcagagcatctgctacttaacaggcactatgctaagcactgagattatttcttcagttttttttaataccatttcctccagtagccctcctagggttgaagaaaaggcatgtagaacttgacagtacaaatgggagatgggagaaatgcattggaaatttgacatttccacttcacttatataaataatactttcagtatgctgataaaaacttatttctacagtcaccaaactaatgcttcatggattttaaaaattgatatataatgttttatatatttataggatacatatgatattttgttatatatgtagaatgcgtaatgattcagccagagtattctggtatctatcaccttgagtatttatcatttctgtgttgggaacatttcaagtttactagccaatttgaaatatataatacattgttgctgaccatagtcaccttactattgctatcaaacattagaacttattcctttcatctaaccatatgtttgtacccattaacctacctctcttgatcactaccaccctcacacacacccttcccagcctttgatacctatcattccattctttagctcgttgagacctacttttttagctcccacatatgagtgggaacatgtgatgtttatctttatatacctggcttatttcacttaacataatgacgtccagtcccatctgtgttgctgtaaatgacaagattctattctttctttatggccaaatagtatcccattgtgtatataccacattttgtttatctatttgttcatcaatggacactcagattgtaaatagtgctacagttagcacaagagtgcaggtttccttttgatatacagatttcatgttctttcgataaatatccagtactgggaatgctggatcatatggtagttccatttttagttttttgagacgtctccatactgttttccatagtgactgtatttatttacattcccactaacaatgtataaggattcccttttctccgcttccttggcagtatctgttagtttttgtcttttggtatgtttgtttgtttgcttgtttttgagacagggtcttgctctgctgcgcagtctggtatgcagtggcataatcatggctcactgtagcctcatacccctgggctcaagcaatcctgctgcccgagcctccccagtagctgatattacaagcatgcgccaccatgtcaggctaatgttaatttttttcttttatagagacacagtctcactatgttgaccagactggtttcgagctccttgcctcaaacagtcctccaacctcagcctcccagagtgctgggattacaggcatgagccaccgggcccagcatttttgtctttttagtaatagccattctaactgaggcgatatgatatctcattatgggtttgatttgcatttctgtgattagtaatgttgagcattttttcatgtacctgtttgccatttatatgtcttctttagaaaaatgtttattaatgttctttgcccactttttaatggaattatttggatttttggtgtgtgtgtgtgtttagtttgagtttcttaggcattctggatagtagccctttgttggatgaatagtttgcagatattcaaactactgaatatgcaagctattgaatattcaaactactgaatattcaaactgggggacagactgtctctttcactctggttattgtttcctttcccgtgcagaagatttttagttcaatgtagccctattcgtatgtttttggtccctgtgtttttgaggtctcgaccacaaactctataccagtgtcttgaagtgttttccgtatgttttcttctagtaggtttacatttttgggtcatacatttaactatttaatccatcttgaattttttttttttttttttttgaagtggagtctcagactgtcaccctggaatgcagtgacgtgatcagctcactgccgcctccacctcccaggttcaagcaattctccctgctcagcctcctgagtagctgggattacgggtgcatgccaccacacctggctaattttttttttttttttttagtacagatggggtttcaccatgttggccaggctggtcttgaactcctgaccttaaatgatccacctgccttgccctcccaaagtgctaggattacaggcatgagctaccacaccagcccttgaattgttttttgaatatggtgagagatggggctccaatttcattcctctgcatatagatatccaattttccaagcattatttattgaagagtgtgtgctttccccaactatgttcttgacacttttgttgaaaatcagttggctgtaaatacatggatttatttctggattccctattctgttccattgatctatatgtctgtttttataccaataccatgctgttgtggttcctatagtcttgtaatgtattttgaagtcaggtagtgtgatgccttcagctttgttcttttgatccaccttgatttggttattacggctcttttttggtttcatagaaagttttgaattttttctacttctgtgaaaaatgaaggtggtattttgatagagatagcattgaatttgtagattgccttaggcataattcttctgatccatgaacatgggatgtcttgccatttgtttgtatcctctttcgtttatttcatctgttttgtagttttttatgtagaaatgtgtaacccccttggttaaatttattcctagatattttattgttttgtagctattgtaggtgggattgccttctttatttctcagctagtgtatagaaatgctactgatttttgtatgttgattttgtattctgcaactttactgaatttattgatcagatgtgaggtttttgtggagtctaggttttgttttggggtttttttttttttttgagacagagcctcgctctgttgcctaggctggagtgcagtggcgcgatctcatcccactgcaacctctgcctcacaggttcaagcgattctcctgcctcagccttccaagtagctgggactacaggcatgtgccaccgcaccttgtaatttttgtatttttttagtagagatggggtttcgcagtgttggccaggctggtctcgaactcctgacctcaggtgatccacccgccttggcctcccaaagtgctgggatttcaggcatgagccactgtgccagtggagtctagggtttttaagatataagatgataacatcagcaaaggggacgttttgattttagtttgttttgttttgttttgtttgtttgtttgtttgtttgtttgttttgagacagctctgtcacctaggctggacttcagtggcacaatgttggatcactacaacctccaccttctgggttcaagcaattcccatgcctcagccacccaagtagctggaattacaggtgtgtgccaccatgcctgggtaatttttgcataggggactttttattttattttatttattttctattttatttattttatttattttctaatttaggtgccttttatttatcttgcctggttgctctggctaggacttctgttgctatgttgaataagaatggtgaaagtgggcatccttgttttgttttagctcttaggggaaaggctttcagcttttccccattaagtatgatgttagctgtgggtttgtcatatatagtctttattattttaaggtatataccttctgtgcctagtttgttgagagtttttattatttagtgatgttgaattttgtgaaatgttttttcttgtctactgagatgatcatatggtttttgtctttcattctgttgatgtgatgtatcacatttattgatttgtgtatgttgaattctgcctgcatccctgggataaatcccacttaattattgggtattagttttctcatgtgctgttggattgagtttgctagtattttgttgagaatttttgcatctatgttcatcaaaaatagtggcctgtaattttctttgttcttttttgttgtgtccttctctggctttggtatcagggtaatgctggcctcacagaatgagttagggaaaattccctcctctttgatttttttggaatagtttgggaagaattggttagttctttgatagtttggtagaattcattagtgaagttgtctggtcctggactttcctttgttgggagacttttttattaccaattcagtcttattactcattactggtctgttcaggttttctatttcttcctgattcaatcttgatagcttgtgtgtctccaggaatttatccatttcttctagattttctagtttgtctgtgtgtagttgttcataatagcctctgatgatctcttgtatttctgtggtatcagttgtaatttctccttttttattcctgattttatttgggtcttctctcttcggttcttggttagtctatcaagtagcttattggttttgtttatcttttaaaaaatctttgtttctttgatcctttgtattgtgtgtctctattttgtttaattctgctctagtgtttgttatttctttccactaatttggggtttgttcttttctagttccttttaggtacatcattagattgctttttgaaatgtttccacttttttgatataggcacttattgctaaaatttccctcttagcactgcttttgctgtatcccataggttttggtatgttgggtttaaattttcatttttttcaagaatttttttaaattttttccttgactggatgcttgttcagaagcatgtggtttaatttctatttattggtacagttgccagtgttcctctcattattgattactggttttgttccattgtggtttgagaagatacttgatatgaagtcagttttttaaagtttgttaagatttgttttgtgtcctaacatatgatctgtcctggagaataatccttatgctaatgaaaagaatgtgtattctcttaactgttggatgagatgttctgtgtccatgtgttctcatggttcaactcccacttatgagtgagaacgtgcagtgtttggttttctgttcttgtgttagtttgctgagaattatggtttccagcttcatccatgtccctgcaaaggacatgcactcatccttttttatggctgcatagtattccatggtgtatatgtgccacattttctttatcgagtctatcattgatgggcatttgggttggttccaagtctttgctgtagtgctgcaataaacatacatgtgcacttatcttttttttttttttttttgagacagagtcttgctctgtcgccaggctggagtgcagtggtgcaatctcagctcactgcgacctctgcctcccgggttcaagtgattctcctgccccaccctcccaagtagctgggattataggtgcccgccaccgtgcctggctaatttttgtatttttagtacagagagcatttcaccatgttggccaggatggtctcaatctcctgaccccatgatcgggctaccttggcctccaaaagtgctgggattacaggcatgagccaccgcgcccggctgcatgtatctttatagtagaatgatttataatcccttcggtatatacctagtaatgggattgctgggtcgaatggtagttctggttctggatccttgaggaattgccacactgtcttccacaatggttgaactaatttacgctcccaccaacagtgtaaaagcgttcctatttcaccacatcctctccagcatctgttgtttcctgactttttaatgatcgccattctaactggcatgagatggtatctcattgtggttttgatttgcatttctctaatgaccagtgatgatgagcttttctccatatgtttgttggctgcataaatgtcttcttttgagaagtgtctgctcatagtcctttgcctactttttgatggggttgtttttttcttgtaaatttgtttaggttctttgtagattttgaatattagccctttgtcagatgggtagattgcagaaattgtctgccattctgtgggttgcctgttcactctgatgatagtttcttttgctgtgcagaagttctttagtttaattagatcccatttgtcaatttcagcttttgttgccattgcttttggtgttttagtcattttgtccatgcctgtgtcctgaatgatactgcctaggtttacttctagggtttttatggttttaggtcttacgtttaagtctttattccatcttgagttaatttttgtataaggtgtaaggaaggagtccagtttcagttttctgcatatggctagccagttttcccaacaccatttatgaagtaaggaatcctttccccattgcttgtttgtgtcaggtttgtcaaagatcagatggttgtgggtgtgtggtgttatttctgaggcctctcttctgttctattcatctatatatctgttttggtaccagtaccatgctgctttggttattgtaaccttgtagtatagtttgaagtgagacagcatgatgcctccagctttgttctttttggttaggattgtgttggctgtttgggctgttttttgattccataggaaatttaaagtagttttttccaattctgtgaagaaagtgagtggtagcttgatggggatagcattgaatctgtacattactttgggcaatatggtcattttcacaatattaattcttcctatccatgagtatggagtgtttttccatttgtttgtgtcctcttttatttccttgagcagtggtttgtagttctccttaaagaggtccttcacgtcccttgtaagttgtattcctaggtattttattctcttagtagcagttgtgaatgggagttcactcatgatttggctgtttgtctgttattggtgtataagaatgcttgtgatttttgcacattgattttgtatcctgagactttgctgaagttgcttatcagcttaaggagatttggggctgagacaatggggttttctaaatatacaatcatgtcatctgcaaacagagacaacttaacttcctcttttcctatttgaataccctttatttctttctcatgcctgattgccttggccagaacttccaatactatgttgaataggagtggagagagagggcatccttgccttttgccgtttttcaagggaatgcttccagtttttgcccattcagtatgatattggctgtgggtttgtcataagtagctcttattatttttagatacgttccatcaatacctagtttattgagagtttttagcatgaagggatgttgaattttgttgaaggctttttgtgcaactattgagataatcatgtggtttttgtcattggttctgtttatgtgaatagattacgtttactgatttccatatgatgaaccagccttgcatcccagatatgaagccaacttgatcgtgctggataagctttttgatgtgctgctggatttgatttgacagtattttgttgaggatttttgcatcaatgttcatcagggatattggcctgaaattctctttttttgttgttgttgtgtctctgccaggttttggtatcaggatgatgttggtctcataaaattaattagggaggattccctctatttctattgattggaatagtttcagaaggaatggtaccagctcctctttgtacctctggtagaattctgctgtgaatccgtctggtcctggacttcttttggttggtaggctattaattattgcctcaatttcagacctggttattggtatcttcagggattcgtcttcttcttggtttagacttgggagggtgtatgtgtccaggaatttatccatttcttctagattttctagtttatttgtgtagaggtgtttatagtattctttgatggtagtttgtatttctgtgggaacagcggtgatatcccctttatcattttttttttttttttttgagacagagtgttgctctgtcacccaggctggagtgcagtggcatgatctcggctcactgcaagctctgcctcccaggttcacgccattctcctgcctcagcctcctgagtagctgggactacaggcgcccaccatcacacccagctaattttttgtattttttagtagagacggggtttcaccgtgttagccaggatggtctcaatctcccaacctcgtgatccacccacctcggcctcccaaagtactgggattacaggtgtgaggcacggcacccggccccctttatcattttttattgcgtctgtttgattcttctctcttttcttcttattagtctggctagtggtctgtctattttgttgatcttttcaaaaagccagctcctggattcattgattttttttgaagggtttcgtgtctgtatctcctacagttctgctctaatcttagttatttcttgtcttctggtagcttttgaatttgtttgctcttgtttctctagttcttttagttgtgatgttagggtgtcaattttagatctttcctgctttctcctgtgggcatttagtgctataaatttccctgtaaacactgctttaaatgtgtcccatagattttggtacgttgtctctttgttctcattggtttcaaataacatctttatttctgtcttaatttcgttatttacccagtagtcattcaggagcaggttggtcattttccacgtagttgagcggttttgagtgagtttcttaatcctgagttctaatttgattgcactgtggtctgagagactgtgtttttatatctagttttttttgcatttgctgaggagtgttttacttccaattgtgtggttaattttagaataagtgtgattaagtcctcagaagaatgtagattctgttgatttggggtggagagttctgtagatgtctattaggtctgcttggtccagagctgagttcaagtcctgaatatccttgttaattttctgtctcattgatctgtctgatattgacagtgggatgttaaagtctcccattatcattgtgtgggagtctaagtctctttgtaggtctctaaggacttgctttatgaatctgggtgcttctgttttgggtacatatatatttaggatagttagctcttcttgttgcattgatccctttaccattatgtaatggccttctttgtctcttttgatctttgttggtttaaagtctgttttatcagagactaggattgcttttctttctctccgtttgattggtaaatactccttcatccctttattttgagcctatgtgtgtctctgcgtgtgagatgggtctcctgaatacagcacactgttgggtcttgattctttatccagtttgccagtctgtgtcttttaattgggacatttagcccatttacatttaaggtttatattgttatgtgtgaatttgatcctgtcattatgatgctagctggttattttgctcattagttgatgcagtttcttcatagtgtcgatggtctttacaatttggtatgtttttgcagtgggtggtaccagttgttcctttccatgtttagtgcttccttcaggacctcttgtaaggcaggcctggtggtgacaaaatctctcagaatttccttgtctataaaggattttatttctcctttgcttatgaaactgagtttggctggatatgaaattccgggttgaaaattcttttttttttttaagaatgttgaatattggccccaactctctcctggctcgtagagtttctgcagagagatccgctgttagtctgatgggcttccctttgtgggtaacccgacctttctctctggctgcccttaacattttttcctccatttcagtcttggtgaatctgatgattatgtgtctttgggttgctcttctccaggagtatctttgcatttcctgaatttgaatgttggcctgtcttgctaggttggggaagttctcctggataatatcctgaagagtgttttccaacttggttccattctccctgtcactttcaggtacactaatcaaacgtagatttggtcttttcacatactcccacatttcttggaggctgtgtttgttctttttcattcttttttttctaatcttgtctttttgctgtatttcattaagttgatcttcaatcactgataccctttcttacgcttaatcagtttggctattgatacttgtgtatgcttcacaaggttcttgtgctgtgtttttcagctccgtcaggtcatttatgttcttctctaaacggttattctagttagcaatttgtctaaccttttttcaaggttcttagcttccttgcattgggttagaacaggctcctttagctcggaggagtttgttattacctaccttctgaagccttcttctgtcaattcgtaaaactcattctctgtccagttttgttcccttgctggcaaggacttgtgatcctttggaggagaagaggcgttctggtttttggaattttcagtctttttgtgctggtttctccccatcttcatggatttatctacctttggtctttgatcttggtgacctttggatggggtctctgagtggacatcctttttgttgttgatgctaatcctttctgtttgttagttttccttctaatagtcaggcccctctgctgcaggtctgctggagtttgctggaggtccattccatatcctgtttgcctgggtatcaccagcagaggctgcagaacagcaaagattgctgcttgttccttcctctggaagcttcgtcccagaggggcacccgtcacatgccagccagagctctcctgtatgaagtgtctgtcagcccctactaggaagtgtctcctagtcaggatacatgggtgtcagggacccacttgaggaggcagtctgacccttagtagagctcgaatgctgtgctgggcgatccactgctctcttcagagccatcaggcagggacgtttaagtctgctgaagctgcacccacagccaccccttccccctggtgctctgcctcagagaggtaggggttttatctataagcccctgactggggctgctgcctttttttcagagattccctgtccaaagaggaggaatctagagaggcaatctggccacagcagccttgctgagctgcggtgggctctgcccagttcgatcttccaggccgctttgtttacactatgagggtagaaccacctactcaagcctcagcagtggtgggtgcccctcaccccaccaagcttgagagtcccaggtcaacctcagactgttgtgctggcagggagaatttcaagtcagtggatcatagcttgctgagctccctggggataggaccctccgagcctgactacttgcaaggctccctggcttccgccccctttccaggagagtgaacagttctgtctcactggcattccaggcaccactggggtatggaaaaaaaactcctacagttagctcggtgtctgcacaaacggccgcccagttttgtgcttgaaatccaggccctggtggcataggcaccagagggaatctcctggtctgcgggtggcgaagactgtgggaaaagcacagtatctgggccagagtgcaccattcctcacagcatggcacatccctcatggattcccttgggtagggaagagatttccctgaccctttgcactttctgggttgaggtggcgcctcaccctgcttcggctcgctctctgtgggctgcacccactgtccaaccagtcccaatgagatgaactaggtacctaagttggaaatgcagaaatcacccgccttctgtgtcgatcttgctgggagctacagaccggagctcttcctattcggccatcttgccaacaaccctccatcttctagaatttttatagtttcaggtcttaggtttaagccctgaatccatcttgagttgatttttgtataaggtgagagatgaggatccagtttcattctcctatatgtggctagccaattattccaacaccatttgttgaaaagggtgtcctttccccacttcatgtttttgtttgctttgtcgaagatcagttggctgtaagtatttgggtttatttctgggttctctgttctgttccattggtctatgtgcctatttttatatgagtaccatgctgttttggtgactgcggccttatagtatagtttgaaatcaggtaatatgatgcctccagatttgttctttttgcttagtcttgctgtggctatgtgggctcttttttggttccatatgaagtttagaattgttttttctaactctgtgaagaatgatggtggtattttgatggggattatgttgaatttgtagattgcttttggcagtatggtcattttcacaatgttgattctacccatccatgagcatgggatgtgtttccatttgtttgtgtaatctgtgatttctttcagcagcgttttgtagttttccttatagaggtctttcgactcctttgttaggtatattcctaagtattttatatatttttttgcagttgtgaaagggcttgagttcttgatttctctgcttggtcgctgttggtatatagaagagctactgatttgtgtccattaatcttgtatctggaaactttgcagaattattttatcagttctaggagctttctggaggagtcttacagactcctaaggtaaacagttatattgtcagcaaacagggacagtttgacttcctctttactgatttggatgccctttatttatttctgttgtctgattgttctggctgggacttccagtactacgttgaagaggagtgatgagagtgggcatccttgtcttgttcctgttctcagagggaatgctttcaacttttccccattcagtattatgttggctgtgggtttgtcatagattgcttttattacattaaggtatgtcccttgtatgctgattttgctgagggttttgatcataaaggatgctggattttgtctaatgctttttctgcatctattgagatgatcatgtgatttttgttcttaattctgtttatgtggtatattacatttattgagtatgttaaaccatccctgcatccctggtatgaaacccacttgatcatggtggattatctttttgatatgttgttagattcagttagctagtattttgttaaggattttagcatctatgttcatcaaagatattggtctgtagttttcttttttgggtgtgtcctttcctggttttggtattagggtgatgctggcttcatagaatgaattagggagggttccttctttctccatcttgtggaatagcgtcaaaagaattggtaccaattacctgaatgtctggtagaatgctgctgttaatccatctggtcctggactttttttgttggtaatttttaaattaccatttcaatctcactgcttgctattggtctgttcagggtatctaattctgatttaagctaggagggttgtatttttccgggtctttatccatttcttctaggttttctagtttatgtgtgtaaaggtgttcatagtagccttgaatgatcttttgtatttcagtggtgtcagttgtaatatctcctgttttgtttcttagtgaggtgtttggattttctctgttcttttcttggttaatcttgctaatctatccattttatttatcttttcaaagaaccagctttttgtttcatttgtcgtttgtttcaatttcatttagttctgctctgatgttggttgtttcctttcttctgctaggtttggtttgttcttgtttctccatttccttgaggtgtgaccttagattgtctgtctgtgctctttcagacttttttgatgtaggtgttttagggctatgaactttcctcttagcactgtcttaactgtatcccaaaggttttgataggttgtgtcattactgtcgttcagttcaaagaatttttaaattttcatcttgatttcatttttggcccagtgctcattcaggagcaatttatttaatttccatgtatttgtgtggttttgaaggttccttttggagttgatttccacttttattccactgtggtctgagagagtgcttgatataatttcagttttcttaaatttattgaggcttgttttatggcctgtcatatagtctattttggagaaagttccacgtgcttttgaatagaatgtgtattctgtggttgttagactaaatgttctgtatatatctgttaggtccatttgttccagggtatagtttaaatccattgtttctttgttgactttctgtcttgatgacctgtctagtcagtggagtattgaagtcctccactattatggtgttgctatctcatttcttaggtctattagtaattacaagtttgggagctacagtgttaggtgcatatatgtttaggattgtgatgttctcctgttggaccaggccttttactattatgtaatgtccctctttgtctcttttaaccactgttgctttaaagtttgttttgtctgatataagaatagctatcctgtttgcttttggtgtgcatttgcatgaaatgtgtttttccgctcacataaacttaaagtttaggtgagtctcctaagagggcagatggttggtaagttcttatccattctgcagttctgtatcttttaagtggagcctttaggccatttacattcaatgttaatattgaaatgtgaggtactgttgcattcatcatgctgtttgttgcttgcgtactttggatttgttttttgtttttgttttttaacttgtatttttgttttataggtcctcctgtgtgatttatgttttaaagagattctgttttgatgtgtttccaggatttgtttcaagatttagagctccttttagcagttcttttagtggtggcttggtaatggcgaattctctcagcatttgtctgaaaatgactatatgatgcttagttttgccaaatacaaaatttggctgataatttttttgtttgaggaggctgaagatagggccccaatctcttctagcttgtagggtttctgctgagaaatctgctgttaatctgataggttttcctttataggttacctggtgcttctgtctcacagctcttaagattctttccttcgtcttcactttggataacctgatgacactgtgcctaggcagagatctttttgtgttgaatttcccaggtgttctttgtgcttcttgtgtatgcatgtctaggtctttagcaaggccagggaagttttcctcaattattcccctaaatatgttttgcaagcttttagaattgtcttctccctcaggaacaccaattattcttaggtttggtcatccgagctctgaatttctttcttctacttgttcaattctattgctgagactttccagagcatttcatatttctaaaagtgtgtccactttctttgagctctaaatttctttcttctccttgttcaattctgttgctgagacttaccagagcatttcacatttctaaaagtgtgtccaaagtttcctgaatttttggttttttctttaagctatctatttcactgaatatttctccctttacttcttgtatcatttttctgatttccttgcattgggcttcgcctttctctggtccctctctgattagcataataactaacctcctgaattctttttcaggtaaatcagggatttctttttggtttagatccattgctggtgaagtagtgtgatttttgggggggtgttgacgagccttgttttattatattaccacagttggttttctggttccttcttatttgggtaggctctgtcagagggattgtctagggctgaagagtgttgttcagatttttttgtcccacagggtgttccctatgtattacgcttcccccttttcctgtggatgttgcttcctgtgagcctaactgcagtgattattgtctgtcttctgggtccagccacccagtgagtctacttggctccgggctggtgctgggagttgtctgcacagagtgcttatgtgaactgtctgtggctctctcagccgtggataccagtgcctgttctggtggaggtggtggaggatgcagtggactccgtgggactccttagctttgatggtttaatgctctatttttgtgctggttggcctcctgccaggaggtggtgctttccagaaagcatcagctgtagtagtgtgtggagagggaccagccatggtgagggccctagaactctcaagattatatgtcttttgtcttccgataccagggtggatagagaaggaccaccaggtgggggcggggctaggtgtgtctgaggtcaggctctccttgggtgggtcttgctgtggctgctgtgggggacggggatgagattcccaggtcactggagtagtgtacctaggaggattatggctgcctgtgctgagtcatgcaggttgtcagggaagtgggggaaagccagcagtcacaggcctcacccaactcccccacaaaccaaagggccagtctcactgtgtcccccgaccccctcaaacgcctgcaacatcccccgagtctgtttccaggtatagggcccagctatgaaagaagacctccccagctgcgaaagaaaacggctttagttcttcccccacctgtggagtctgcaagcccaattcatgcccaccccccaccccccacgcccagttctggcaaggaagcttctcgtcctgttcaagttgttacaaagttcatctagagaagtaattctccctgtggagttttaacccctgctcctctggccaccctcctgatggatccctgtggtgccaggcagggatgggatccttggggatcccacgagctcccagtgtctttctgctacttcctctacccatgtatttcactgggctcggctctctaacttgactcagccccaggtaaagtcgggagcttctcccgcaaagactttcagcttctccagtgggggtgtgtgttcgggagaggagggtctccctttcccacttccacagttgggtcactcacagtatttggggtgtctcccagctcctgcagcagcagtctgctttcttcagagggtcctctaaggattgctggtctgttcttgcagttgatctatagctaaaattcacaatgcaagcctccacatgctgctgtgtctggagctgcaatctagtcctgcctcccatctgccatggtcctcaactcctatttccttgcttttttacatattctgcaccttgatatctgcatatctggtataacgatcacttcttccgattttttgaatttgctttcatatctatgatggtggttgggtaggcactttggctttgattctgggtatgtgcagtagtgtaatctctatagacttttttttggccgaaaacagtatctgtggtatctgtaatttccttggtggcttagggtgcagttgttcgtggaggctgtggtaaagttttgttgtgaacggggacaccaaatggaccagtcgttaggttgcaggatgctagcagtaggctgagcatgcctgtccttgggccccagggctgtatacactggcatcagtggtagcaggtcaagccaggccaattattgggcttctagatggcttgctcaggtgctgagaatggtgacagtgggttgggtgggtgagtaggttttcaagccactgggcagcaaacatgggcaatggcagtagtagtagtgggacaaccctctgggatccaagcagccagtggtggtgttggcggtggctataatgggctgcgtgggccagtccccagacttgcaggtggcatatgagggtgggtgccagctgtgatggtaatggcaggttgattgggcccatactctaggaggagtgctcaggtgccaatggtggtgtcctgggcagggcagtccccaggtccctggaccaatgtgcttggttactggtggagatgcagcaaggctgggcagacctgcccccgggttcccaaggtgttgtgtgcagtgctggctgttgtaggcaggggtgggatgatttcccaggccaccagcagaatgcttaggttggggcagtagcagctgcattgtagctctgctactagggagggtgggtttgctttcagtgggttgctcttgcagatggtgaatgtcagtggggctctagggatgtggagatgcaggggctgttgggccccagagcaagatgcaggaccactagggactgggctctcaaaatagtgccatgctacagttccttaggtcttgggtgtttgtggagcctagtgtgagctccctcttgagcagtgctttcatgtggtctccaggtaacgccctgttagtcttgagacccacaagagtcaaggggctgtttgatggttaggattgtaggagtccttgatgggcatgtggattgctggggattgctcactttccttttcctccaattaggcagcctctgtagactcctagctaatcctgtcaagacaggctgctttgctttcttccttgcttttgatgcttcctgtcatgttgaattccactgttctctgttagatctacgtgaagtatgattgtctactcattattttggttcccctctgtggaagaggtgagcactgaatgtatctagtcagccatcttgaattccctcctgcttagatttttatttttgacaatgatttacgtgattgcttatgactagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagtaggtacttacattctaattgtaactttggtttttgtttgtgtttttgagacagggtctcactcttttgcccaggttggagtgcagtggtgcaatcatagctcactgcagtcttgacctctgggcacaagttgtccttccaccttggtctcctcagtagcagggactacaggcacgtaccaacacatctggctaatttttttgttggtctgtggagacagggtctcactatgttcaagcgatcctcccacctcagcctcctaaagtgttggtattacaggtgtgagctaccatgcttggcctcctaattgtaacattttagaataaaaatggatatgtttttaaaggaaaaataaccagaagttgaacatttctattattttgaattgtgaagctatgtatggaaatgtcagaccttcacataaagttagcaaagagagaagcttgagaaagttttattatttcacatgatatagttctcaaatgttatattggtttggctttttctgttgaggaggtcaagatgaattattacagcacaaagcaaattacctatgtgcttcatttttatctactcctagtttttttgcttcatttctaagcaataattattatatcaataattattctaggtatgttaagagaaatgattggcctatcattatccacttaggaacatacatttgcagaataattggctgggattgatgatacaatttgtgactgttagagatctctgtgttaaatggcctttttaaaaagtagatacctagttggctaggagaaccctaagtggtgcagacaagataggtatgtatggtggtggtaccatatttgagctaacctaacaaaaatactcacttgctaaagttttaaagtgtagagcactttaaacattttcttgccttttgctgcagttttcccacttggcaaccttcactccaaaattggctggtaaagggacacatggtctgggttccagtttcattgagttgataggctgagccagttacccctaggtaacatgaggaaatcagtaaagtatcatttgaaccgcaagaaatggtcataaatcttgtgtttaccttttaaaatctatttttaaatgtaataaaagtttttaaaactttgaaaacttttagtataaatttgaaatgggtaaaaagagttatatttgtgattgaatacagctgtagaaaaagatgttaaaatgtaagctccaaaagggcaggaactttgccttgttgactgttgtacccttagtgtctaaacaagtgcctgatacataggagaagcttagaaaatgtttactgagaggaaatagtcaagtctttgtatgtttaatagatgaatttagtaacacatcaatattgacaggaaatcatgactctcaagacaaatgagctattccagacaatgcagcgagcacaggaactggcacagagactaaaacaagaacaaagaatccgagaattggcgcaaaagggacatgacacttctagactgattaaaaatcttggtggtaagggcctaaccagaactttatttataatatttttagaagatgattttaaataattcctttttatctttgtttggagacaaggactcattctgttgcacaggctagagtgcagtggtgccatcacagctcactgcaacctcatattttttgtagacatggaatctcgctttgttgcccaggctggtcttgctgccttcagatgactctcccaccttggcctcccaaagtgttgggattacaggtgtgagtcactgcacccagcctaaatgattgcctatttttaataccttcaatatacctactattcttgtaggaatatcagactttaaactagtataattttataaataggaatgcttaatttatgtggaaaattgcaataaaagcagaactaaaggttaaaatgtgttaatgttaaaataataggtaaaatgtgtactttttgtgtctatttttaccgagaacaattattaaatgatctccctaaattcagtaactgataggaatgtgggtactttttgtaagaaaatttttattgcagtgttcattctgattaagtgaaaattattgtatttagttgctgctatacataatttttattaatattccttaagtgttgttttatcaggtgatttctctttgccagttgatacaatacaaatggaatataatgcatctaacatttcaaattcaagacatgattctgatgaaatcagtggtaaaatgaatacatatatgaattctacgacttctaagaaggatactggtgtgcaaacaggtatttgtgtggaaattgtggtttggtttaaaatttacttaaagtcataattaaagcagttagaattaagttcaatttaaaagttcaaaaattaacaaaacttgaggttttcagtaagagttacaaaataaagggataacagctttgttgaaacatgtcatgtaccacaaaatttatcctacagtttagtcttttttggtattcagtggtgcaaccattaccacaatcaattctaaaacattttgatcactctagaaacactgtacccattacttgccactttctatttctcttttctcctccagttaacattctgtctctgaatatttttgcctgttgtggacatttcacgtaactggaattagaccacataacggtcttctctggcttctttctctcttagcatgttttaaggttcatccatgttgtagcatgtgtcagtacttcattcctgtttgtcactgaataaatattacatttataataccacatttttattcatgagttgatgaacatttgggttatctccactttttggctatgaatatgctgctgtgaacattcatatatagatttttgtggatgtacatttttagttcgagagaagagtagaattgctgagtcatgagtaacaggtactgtatgtttagcattttgaggaaccaccaaactcttctccaaagcagtggtaccattttacattcccaccatcagtgcatgtgggttctgattctctatatccttgccagcccttgttattctactggttgtgaagtggtatctcaggtggttttggtttgcatttcccccccagtgactgatgatgttgagcatcttttcatgattatcagttcatagaaatggaaattagagtggtggctgccagtggttgggagtatgtggttgttctttaatgagtatagaggttcggttttgttgaaaattaatgaaagaaaaaagtcttagagggcaataattgtttaatgttttggggaaaattatttaatattgaaaattttgtttacaatttttaaaaatcatttgcaacttttttttagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggtaaagctcttccatcttagatgatgtgttgacgtttctggattcaaaacacagtttctcatacgtatgctttggtaaggctgttctgatctgtttcagtttacattagggatcagcaaactatatcccatgggcaaatccaggctgctgcctgtttttggaaagttttatacgaacatagtcaactcattcttttatgaattgtctgtggctgacttcacacaccagactagcaacagaaacaatatggcccacaaagctgaaaaggtttccttatgcttatcgagtcctttacacttacacaacttctgtagatggatgctgtgtattcaaatacccctttaaaacccttgtttatagtccacatagacagaggtttgggagattaggaactcccaaggattagttttgactctggaaaaaactatatctattccattgctcagtcagtacctgttattcaaatattaccctcagactatttcaacaagtagccctaaaaatatttgtggggacatgtgaagatgctatatattcctttctgcatttatctatccatattttaggaagaagagcctctgaatattcattcattcagcaaggaaaggtaagtatgcatcagattaattccgcagctacttaatgctttctatgtgggacaaaaaagggattcaagatctggacagcatcatatggtatatgtagagaacaatcagaaagggtgtggcttccaggtgagggttagaggtttaagggatagtgtggcactttagcaggagcttgaaggcccaagttggactgggcctaggcaggaatgtagataacatttacttttatctctagacttaactaagtgattttgatattccaggtatgtcattagcagaataggcattctgctttgggaggagggatggctgggggctgtgaatgggaagaaatgactgataaggacaatgagaaattcagtcagttaatgagagatttagaaccattagaatttttattctttgtgcatgaaccagctggtttagttgtctcagaatggggctctaaaaacaagtttcattcaaatggtgagtacattattgtatggtgaattatctaaggagaaacagtaggctcagattaaccaagccagcactgttcctcaggatctaggaattaaatttctcccttgtgctacagtacacataccatagctagtgctagtaaaaacataaatgaataccattctcttccccggttttatggaacaatattatagagttcaggcttctatgcatacattcccaaaggtgttacaggtacatttagaataaagtgaaatgggccaggcatgtggctcacgcctgtaatcccagcactttgggaggccgaggcaggtggatccacctgaggtcaggagttcaagaccagcctggccaacttggtgaaccccgtctctactaaaaatacagaaactagctgggcactgtggcgtgcgcctgtaatcccagctacttgggaggctgaagcaggagagttgcagtgagctgagatcgcgccactgcactccagcctgggcaacagagcgagacttcatctcataaataaagtgaaatgtgattaaagagatatacttaatctaaatacacaattttttactattttttttttaaataggtctccatcatcaccagttccagtagtgaaaaacagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaaggtaagtaaatattaagcattctaactgtaaaaattgaagacccatgtaaaccccgtcaacaactttaaattccaaattagtaattcctgcacttagttctataaagtttcttgaatatgtcttaaatttttcttagtactttcctaggatacatacttattataatgactcctgacaatattatatagcacagggctatgtcattttactaatgtaattgactgacttgttactttcatctggctttagactgtggccaaaaacgacagctatttgattctgactgtgtcagggatccacttcttaatcctaacatggtgaaaaatagggatcgacagcaagcaatccttaagggactttcagaactgagacaggtatgagctttttcaagtgtagatatgtctgttctttatgtggcgtgggcggttgggggaacctgttgaacggtttgttttaagttacttcggtgcatcccaggatttaacaaaaatatttcagttcctgtatgtttgttagacacaaataaaatgggactttcctaagacttgcttttacactgccgtctttgagtagttctttccagtacgaaatcatcagacagttctaaaattaagacaagtttattgagtaaaaaaatgcatacattggaacggcaaaacatcaataaggccctaaaacaaaaaatacagttatgctttaacaaattcttagcaatgtggcccacgctttttaaaaaattgacgtgttggcagtgtttgttagaacattgacgtacatcccaaatagtaataaattcagtatgaaattatacgcataaccttactcaccatactactttttctcccaaactattgtgacttctttttgctctctgattaaaacaaacaggtaacatccttacacctttgctccatcccttgggctttaaaaagaatggctgtagttagttttgattcactatatactctctgtacttgaggaagagtaagctgtgtttaaaagtgcccttttccatgtcgtcatgtaccaataccctctgcatttcaaaatgttgactcagatgtttttccctctacagaactagaaaattgtccccccactttggtctatttactcatttgaagacaaacagggttactaagagttttacataagttatttctttagagtgacgaagtgttagtttacttcttgcttagtggagacaaaaattgtgagataaagaggaaggaataggatgtacacatttacccatcaatatagcacccagtgttatttcagcaggacccttctgttagcatctaaggtaaggttaggacagtcaagataaaatactggatgttggccaggagcagtggctcaagcctgtaatcccagcactttgggaggctgaggcaggcagatcatgaggtcaggagatcaagaccatcctggctaacacagtgaaaccctgtctctactaaaaatacaaaaagttagttagttagttagccaggcgtggtggtgggtgcctgtagtcccagccattcgggaggttgaggcaggagaatggtgtgaacctgggaggcagagcttgcagtgagattgcaccactgtactccagcttgggcgacagagcgagactccatctccaaaaaaaaacaaaacaacaacaacaaaaaaaaaacactgtatgttaagggagactccttcagtatctaagagcacttgggggtggactgggggagaagggatgacttcatttacccccatagttatggagtcttgagttctaagaaaattttcatccctattgatttttatgctaaaaacagaatcttacaaatgtgatagctatatatccaaatgaggtggtctagtacaagcatttctgaaaaaatttttgaatgacaaaattttatcctaagcgatatgttttccaagtgaatataattctagtttaacacaacattgcaagtcaggtgtgcacattttactaacaaacatatatcaatgtgatttcagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtacttgttctatacaataaaacagatacttcttttgtaaaagcttagtagtaa

SEQ ID NO: 533 - DNA, 64665 bp, Homo sapiens; identical to SEQ ID NO: 532

SEQ ID NO: 534 - DNA, 64665 bp, Homo sapiens; identical to SEQ ID NO: 532

SEQ ID NO: 535 - DNA, 99896 bp, Homo sapiens
ggttgagcgtttgcattagatgacattgaaaaatagtagaggaatattttagtcatatgccagagctggttttataaggcttttattcatacaaaagttctgtgatccccagaaagccttatttacattttctcgtctattttccatggattcctccaactgttgtttatcatactttctagttttctacgaagattacctagcattctttttttttttttttttttttaaataaaggaaacaatacttcatggaataattcatgaaaatttctctgactatacattttcaattttcatgtcaatatgatagaaatgtaaatgttatctcgatttgtacatttctatttgacttgcaaatttttgctcctttaaattttctcgtttggtatttttactctttcctaagtaaataatgatataatcgcataaggatcgactacatcttgtgtcctctcatctacttttaatatcttcctaaattattttacttcaaatctggttgtattgatgcctgtgagctgattgtttacatttctccccacatctctgttcaatgacagcatgtaggtagcttaaaataaccatggagtatttactccagggaaatcagaaaactccatagactagggctttccccgccatagagccagggcacaaaactctttaagactaccattgggttcgaatacacattagcacttttaaaaattttgatggtaaaaagccctaattatttgactgcactgcagaaccaaacatgcatgctaatcttttaaagcgaggtcccaactcattaaggtaatcatagctttcatcctgatcagagactgctgattctaaggagctcagggatccagctaatgaccctgttccctcaaaagcgtaggtctggagggaatcaaaaggaggggcacacggatcagtattagcttcttcgagcttttccagaatgaatttcctgaatatggcactgtcggggccaacttgcaaagactgcctgtataggctcctgatctcagcgcttgtggttttccgagtcttgcgttcccgcattatggtactactcctcagctctgctatatcaaaggcctctgtatcttcttctccacccccttcatcatcatattggaatatattctctctgaaatcttcacttttctcaggaaatagaatctgttttctccgttgttttaaacccaaagtcaaaaaaataaaccctgatgaagaaagcacatcagaatatcaataaacaataaagagtattataaacattacagtctttgctctcatttcaagctcaagatgagtgcttaaactttatgattataaaacaaaaagatacatttgttattgaaaatttgccaaagggacttgcaaaattacaaaagaatgtatcacgatttttctggctgatgacttagagtcaaagaaaaccataaaaatatagtgaactatatttattaatatatatattaatatatatataatataatatatatagtgaactatatatattagatgatgaacaatttaacattcaaaatctgtttcttctcaaatattaaaatagaataaagtagaataaaactttgcaacctgaatgcgtttgtcaactttagtagccaatgcttcatattaatagtagttcagaacaacagaacagtttgatgttccctattgaagcaaaattctgtggcataattattttctaaattaatatgtattgactatgaagcatacatcaggcattcttctaaaagctttatatttattgattgattttattcttgtgaaagtcattatattattatatcctattatagatgagaaaactgaagcacacagatgttaaatgacattgctagaaagacacagctagttgagagatacaatggaatactgttcagtcaccaacagtgaagtcatttacagcaacatagatgaacctgctggacatcatgttaagtaaaataagctaggcacagaaagaaaagcactgcatgatctcacttatacatggaatctaaaaaagttgatttcatagaagtagagaatacaatgataggtaccaagatttggagagtagtcaggggagtggggctgaagagaggttattcaattggtgcaaagttacagtgggacaggaggaataagttctggtgttctattataccgtagggtgattgtagctaataatttatttcaaaataggtagaagagataaattggaatgttatcaccacaaagaaaggctacatgttttcagtcacaaatatgctaattatgctgacttgagcattatacactatatacaggtattgaaacaacacactgtaccccataaatatgtccaatttgtatcaattataaatacaataaaataaaaaaagacaaaagtagaaagttggttcagagcctgttttctgtgacaccacataaatttcagaaatttcaaactatcatgcatttgaatcataacacatttgtctagaattattatttattacataagataattttaacatcatgtagaaacagaaaaaattcagaacacttttgctttaattttaaataaaaatgtgtgtgtgtgtctgtgtgtgtgtgtgtctttgcgtgtgggtatcaaggataaccaagagccaacctaggatcttatgtagctgttcagaatttcacatgtaggatttgaaacacacatgaagtaatgttatgaatagtatcacaaagagaaatatgttggttatatagtatttatataaaacttgcatttaaaatatctaaattaaataaggtcaccatatttgcattcatgtattgcactttagaactcatatgatatatatggttgaaatagaaaggagtctaataaatacttttctgatctgaattggagataaacatttataaaacattcaaaggaaatcactattgtaatagttgacccgtaactcccacctgctaaattttactcacatttgtaattacaaagctgccccttgtttgtttgtagattttcagggcttggtttaagtctgtatctataggtagctcagtattttagtcccccaaaattatgcttttactatttatctttgcttctggatctagctatgtagctatgaattcagcttcataatcaaagatcattaaaaataattttaaaaactgaagctaggtcctaaacaattgtaatggtaggtgtaaatgaggaatggattggttttgaaaccttgagaaagataagttaagtgaagacaaggcaggtcctgaaacatatctcatgccagtttgagtggtcagtttgacatttcagaaactaatacatttgctctcactcttcaatgtagtttcattggcttttggtttgaagttttgagggaggcaagagcagagtttagactatatattttggcattaaaaaaaggaaaaggttatgctagatgaatattttatagtcctgaaagcctgattaagaccttttggtgttcagctgcctcatttgtgaaatgaatataaattatctgcttataaaaacagtgatagcaatagaaaaaaacaagcaaacaaaaactaatagcgctcttttactgggatttctttctcttctgtacttggatttaaaaaagacgttctcttatacattcctcatttctaacatttactgtcctttttattcacaaaagacttttggattatttttagttttaattgacaaaaacatatacatttatggtatgcaatgtgatgtctgatatatgtatacattgtggaatgattaaatcaatttaattaatatattcatcaccttaaatacttataaataaaagtggtatgttgaagagatagccacacttccatgttcattacagcattattcatgatagccaagatatggaattgatggaagctaagtttccatcagtgaattaatggataaggaaaatgtggtatacagacagaacgaatgctatttagctttaaataagaaagaagttctgtcacttgccacaacatagataaaactagataacattatactaaatgaaagaagccagccacagaaagacaaacactgcatgatctcactttgacaaatctaaaacaagtaaataagtaactcacataagtagagagtagaatggtagtagcaggatagcaggtgagagaatgaagagacattggtcaaaagacacaaagtttcagttagacattaggaataaattcaagagatctattttaccacatggtaactatagttaataataaggtattttatactcgaaaattgctaagagagtagattttactgcgctgtttttttttttaaatgcaccttgggctctagtcagttgcagtacagtgttgtataacaatgtgttgtggtcatggaatcttagcacatcattttctagctgtgtgacccttcataaagcacaaagctttttgagtttctattccttcatctggaaaatgtaggtgatattagttactacttaataaggttattgtgaggtttggattgcatagtgcatataaaacactgaagattgtctcctggagtataataagcactcgagagaagctcgccattattatcactaatttttacatgttttatactgttacattgtatatgtgtcaagaacatgcataaacagatgtgtacatacatactcatacaattcaaagatcatgtttttatccacttatttactccacttgatttaagaattatactacattcagaggagcaataaacgtacacacagacccacattataatgctataatagaattaactatgtatttatcatgttattttaaataaatgagtatatgttcagttcagcaccacctaccaaatatgatcataatgcaaatgagaatagcaatgatgacttctacctaccaaatatgatcataatgcaaatgagaatagcaatgatgacttctgtcttgaatcccatggaaagcacaagctcctggtactggcaggtctgtgtgctcccactgtcaccacagtcacagacatggatggtaagggtgtttgtacttgtaagtgacgggattccattgtcggcaattaagatggagatgtagaagacaggttcttcttgaaggttaaaaccagttctattagtcaaaatgacagctgtgttatctaaaacaaaaatccatgtgcataattttttcaactacgtaagagaaatttgtatgtaatagtcacatgtgctagggacaatagtatagagatatgatcaagtaagttcaaataaaaggaagacgaaatttctgacgagaagacaactaaaacatccacactaaattattagtgttttgacattacctaaaccctaattatgtaatcagatgaattatttaaattatgtagtaaaattactatttaatattattaaatattgagttgatactacttatttagttaaagtatttatattattattgaattaattaaattggttccaaaatgtctttgacacatatataaaacatacgtgtaacacagaaaatggctttttaatcagatatcaataatttatagggactaccaatatgaaatataagctgattgagctggctttatttgtgttaattacatatgacacggtctattttctaatacttgtgacccattatttgtacaaatccagggaatatacaagactttcaaagatatatatcaaagcacatgatctcaaatactatattttctaattagacaaaataatttcacttggtagacaagatcctattagtatatttcatatcacattgctgttattaatctattttgtatttaaaattctgaaaatcattacacttagactgattcatttacctagagagtccattcaaaaaaattcatgaaaacaaacaataagcacttcaacaaatatgcaatgactcttctgtgaatcccaaaatattatgaataacttttgtcattgtaatttcttgtacctcagaactgtattttccctttacttcttttttaccatccctcaaaatattttctatagtcaccaaattttagaagacaatagcagtaaaaggaaaataaaagccttttgaaatgcatgcttaagtaggacatttcccaaatcacctttttaaagacaattcactatgaaacccttaaggtctataaagcccatgtgattttattcgctaggcagatctaagagttgagagacagttgacactttttaaatatgcgttttattaaattacttgtgaccacaagcattaaaccaaatcaattttgtatgcttcaatgtatttatttcacctcagtaatttattttatattaatataaattaatctatatatacaaatatcaatgtatttaaatatatacatttaaaaactccagcttagattcatttatattaatatatgtattttaaaatataatttttaacttagagtataataataaaaaataaataaataaaataacgttgaagtctgcaacaaataataataataataataataataataataataataataataatacatgtaccccctgaatctaagagtttgttacatggctaaattttgtggaaaggagtctggagatttgtcaaagagcttgaaagagatatttgtggtttttgtctgaaacatatttgagtttcctccccgggggaatttgacgagggcaaaacagacagaaaggtgttgcatttactctcgtatgaaaggcctcttctgaacaaagcttaacctcagctgtaaggagaactgcaagtatttggttacagatacttgagtaataaatcaactgtgtttcataactttgaggtatgaaaaaattaaaacagaagttcttattatgacaaaaagtatctcttactgaagctcatgaaaaagaagcagcgtggctttgtataaagttaatccacctctacagaaaggaaaaataaattctgcccctacaaaaagttctttggaacacttaatccttagattgatacaaattatttagttttgaaggaataagaactatattaacccaatttcacatattctaagctcctaattgatgaccctaaatatttttgaatcaatcaagctaatatgactaactaaaataaatatcattttcttcctcagtcatagattgaagtctgagttagatgagaacatgaaaggagctgtggtgtcagaactgcaattatattcgcagggtcattcagactttacaagagcttacagccattgataactttaaaaagtgtttctactttgaagaaatgcggtgagaaatggagtcaatatttttagaacttaacattgagttttgttttccattttaattgttactcttttgcttgatttccaaacattattatgttgcaagaacagtataaaaatccatgccataaattccattaaagtctaacatgagtcacaaaaatgtatcaaaactcattatgagtgaatgacattaccttgattatctatgattgtaaaacttgaattgttagtgtcttctacagatagattaaagtaaaaatggtgctcttctatggattcatctctatccactgcactgatagtctgaattacctaaaaaaaaagggggatagatttttgttgttgtttggattcaggaagaagatcactgctgctattattattagcttttattcacattgctttattacaatcaatagggacattgcagaaaataactgtcaaatcagtggagaatattaaaatgttttttctcaggttaaaaatatgttcacttccttttttcaaagagtgttgtaatattacataataaacaaactcttgttgatggatcaggtggattccaaaagctgtttgttgaaagtctccaaagcattgcttttgtattactcacatcctccctgcctacatttcactctttcttccttcttaactttttctttatctgaatgtcagacattatgatttgctaaagttgtctatttcctgtttttactgagagcaaaactgtggtagagttactggcttactaaactatttgctgaagtaatgagatttgcaattgattgaggaaataatgcatttaaaatgtaggggcaatgtacatgatttcctttgacccataatgattataggaaagtgttttacatcaaataagttcatctctatatctcagatcataaaacaatgaagtactgcagacatgaacaaatccattttcaattaattttcttctttcaagacatgaatctgtcagtcaagtagttcattattgtcgaaaaagatatgctgtcaagatcacatagtgagattgtgattaattgtggaaattaaagtaaattgattatagaagttattgtttcgaattttctacaattaaagtgcctttaacaatatgtcaaacaaaaatagcctcagatgcaagatgacaagcccagatttatattatacttcaaaaaaatagatacatcttcacaggcataaagaacattaggaaaccaatacgatctgtatattacttctccacattgatttatttttaactcattacacattactaataaataatattcatttagtgttaattaagtaatttaacaaaacacattttattcaatccatgcttataattatacatgtggatattgatttatgttaaggtaaagccttcattttagaatattacaggattttgtataggctgggtagagggcaggggcttggaaacccaatattctgaatcctggctttgccatttagaagtttttaaccttgaaaaataaaaatactaatacttaaccttcagggttcattttcaggattataggtcttggcttgtcagagggtttgtcacacgacaaactattatgtgttcctatgtctattatgtgttcctcatgaaaatattctcttgttgagtttttgcatatcatggtgtcctgaatattgttagtcataggcatatggatatctttatatgcacatttgctgaaataagattgataacaaagtatagaattcatgtttatcttgctggcatatgtggctacagtgttcagataaggaatattttattttactacctgatgttctgtattaaacatgagcatctgagtaaatgttgcaaatgtctccctttgggaatgaagacttaagaagactggagatatgctgtatgtatgtcaaaagatttttaataaatcaaaataccttatgcatatgtacaggaaactgaatgagcaagatttcaacagtctgcctccttttaaatgatcatgtctccacttatatttgctttgtaagttgggcttccaataagatatgttttactggctttcataattactttataaaaataggaagacacagacataaaatgagtcatatatcaagtattatgaattttattgaagttaccttgaacaggtacacttaaacacataccactaataaagggaccacattaatatgctaataagttttgatggaggatatttatttttcctttaaatataccaatggaaaggttttcattttcattttaaaataaaattataagaaaaacttctatatgttgtattggttgctatttacttatatctctttatctgggaactatcgttgaccttatacatttatgaaaggagtaaagataaattaaaaggtaaaagtatataccaagaacagccatggcttgagagattgggaaaagagaaaatgaaaataactccaaattatgaccaattctgaaagctcagatttttagtattctttttgctctctacgtagaatgttggccaatttatttctgatgcagtacattcaatcatctatatacagtgcattgaaagctacaatggaaatacattgtgtaagccccaagaattgaaaagtaactacaatttaataagaacttacctatgggccaggatctgttctatacattatcttagataatcttcacaatggtctctggaataaatcctattattgttcccatgttataaatgtttatattaagcttcatataagctaagtgtcttaggtaagtaaattggctgggccagaattagaatgtaagctgatgtcataggcaatgtgaaatatgagtagtaagtgtagccctctaggacatattgttcatatcctagacttgttcttgtcctaccagatttacatacaaaatgataccgtaaaagacatgaaattccaaaagcaagtaaaaatatgtctcataaaagttagtgacagagaaataagtaatataattttgtagaataaggaccaaaaataatggttaaaaatagaagaaaataatgtgttttgatatgggagaaagggaagattttctagggtaagagtacagccaatgagctaatactcaaataaaaatatgaattgaggaaaaaagtgtgatcccaagcaaagaatatcaagaaaattaatgaaggcaaagatatcatacattaggtataaatgtatgaaattaatattttgtagattaaagatgacctactaatggaagtttcataagttccaatttagttattttatgaaactataatcactatttgactttaaagataatcaggagaataaagataatcatttgcctgctattaatcattatgcactatgtctttttttaagaaaaagtcacacatgggccagtttactaagatatcattccagattaattatcctgagccaaaaataagcccaatactcacattcttcaaaccaaagagatggttcttattaaacatgcaattgatggacagctaatttaagatgcaactcttgtacacaaatatttggagcaagcaatacatttgtgtctgtttccttaccttcatggcaagtcacaatgaaacctacttccaggattagtcaatgaataaattgttgaataggattataaactatagattgaatcatgaactctaaatcaagatacaaatactgagtattaatttatataactcatcaattccttgaagtgcacttaataaacaataaaaaaatgcttctcaatagaaaaatgttaaacaaaaagttggagttgtaataaatgaatatctggaaagattttcttaaaaatcttatctgagttgcttatttagttattctaggtaggtataccttgtattaggctaaagatgcagattgtctcccattgccaagaaattattatacaaacatatgtatgagaccatcactttttatattactctaatgagtaaatgattttaaattacacctgttttgacaaaataaatctataaaactcaaaaaaggtgttgaacatctgttcaaacaggcagagtacaaaataatacactaatagaagtagaaccaacaagaaagtctaggttgtagtatgcttgttgtctttctttgtttagcaaaatattagaagaaaaatgttcaaaaggtcattatagcataatattttagacctggatagaactgaggatactctaagttttctaaaaggatttttcacaaagtttcattatatttatttaaatgtcatagatattataattgtttttgccattaacttgtagaaattgatattcagttgaaaaatacacattcctagatttttatctcaatacgtattttctaattttccttttaaagttaatattccaaatatacttttaaaattcacataaaatcagcatgtatatggaaaaatattaaactataaaatatctcattagtatcttaaatgtatccatttaaaatgtatttcattagtacttacagcactccaagcaatcctatgccctggtggtacaatcatggataaagttagtctctgtcaccactgttcacattctagtggtgaagaagatcaagcagaattgcaaacttaaaaagtattgaggaagtacagaatacccaaattacattttaaaagttataaacacctaaagtacttaatacttaaatattggggggtcagagaaccttgtatctgtgctgaaattagaagatcatacagcagaagtgagcaggggatacatcgtggacatattaaagagttttgactttatactgagggacactcccaggctctaagttgggaatgacatgatcattacttttatttgggatcacatggttccaggcaaaggactgcattttagaatgctccttctgaggacatccttagtgtaagtctggaaatagagaatctagtccgcaagctattgtcatgatcctattgaacaactgcttggtaatcaaaatcactttatgtgatatacaaaaaaacccactaacaatcacaattatggaatgtgttattttaaatgagaaacaatacagaaattactgagcagtgttcataaattgagaatggtacagtatgcttcaaatagagatataattcctgagtcccaaaatttgcctaagggtatgctgagctccagaagatgtcaccaaagtaatgttttttcaccattttcaagagggctatatattctcctcgctactctccatccagtaaaatctgattctcctgaaactgcatgactgcagtcttacctaataaatataattgatttataaaactgatacattgctgcatatgtgctgtgagattggatgaaggaaagtttgattttacaggaacatccctctgcagacctgcttaggtcaggttcactctagaagagaagataggtcccttaggttaggttcactctagaagagaatataggttcctattagggtagaaagaatgatgatagagagaaattgatacattaaagacatatgtaggagatgggatcaacagaaccaaattattgattggatatggagaataaagactagaattaattaaaaatgatgtccatatgtctttttttcttgcaaaacttgatatcataataattttcctagggatactgaagaaagggaaggcttaggagcaaatttggtgtaaccatgggacatctgagttgttttctcaggttagtcagacacatagcttaaaacagaaaaatcaggcagagatacagttatttggatatgaactgtagtcgagaggaagaagtggataaaagaagaaataatgagttcaggaaacttttggacacaaaagtgaaaggaagagaatcatagatcacaaaatgcaaccactgaaatttaggaaaaagaaaatttttacatggagacaaggtaaatgtctttagacaaaatattggtatgagtgaatctgaaaattatcgatattatactttacctccaaaaaaaaagacatttaatatcagtcaaaataatggcactcagtgatttgaaaaatgataactatttgcaccacatggcaaaggcaaattaccctgatgtcagctcatttattatattaatatttgcaaattgctgaaaattctctcctactcttccccaccctggccacttacacattaagaacaaaaccaaaaattttgtttacccacataggtatttgagtaaatgtttggattcctccagagtagagtgtgactactctggcatttttattttctatgatcaatttattatccatccaaagtagatagatataagacatccttttacctgccattttctctggctgtttgagcatgtgggaaatgagaaaagaatcatcttcataaattaaaaatatgtataaaatatttaatattctgttaatgattttaattaaaagtatgtgaagatgatattttggatatattatatcaaataaacattactaaaattaacattatctgggtgttttttatatttttaaacgtggctacaggaaaatttacaattctatcatttatttggaagcactgcattacatactcatattttcaaataatttttctttttttcagtgactttattttatatgtactttatatattgtatgaaatttggctttagaactccaacaaataatagtgtaagagaaggcattgttttcttattactgttttaaattatattaccctatcagtttcaatattacataaagttttgattatcgattgaggactataatattttatcattattatacgtattatgtgtgccttttgaagtcttatatttattacctaggatttaggtttattattcttattcattacttatttatttatttatttttgagatggagtttcactcttgtcactcaggcttgagtgcaacggtgcgatctcggctcactacaacctcttcctcccaggttcaagcgattctcctgcctcagcctcctgagtagctgggattacaggtgcccaccaccgtgcccagctaatttttgtagtttcagtagagatggtgtttcaccatgttggccaggctggtctcgaacttctgacctcaggtgatcctctcgcctaggcctcccaaagtgctgggattacacacgtgagccactgtgtcccacctaggtttacttttatctgagggtttcttagcatcaaatgaaaagttcgtgtatataatttttatgtgtattatttagttcctttgacttgatatgtaaaatatttacagatttcaaagtattgtatattgttaactttttattatttttaggaaagtttaaataacatgaaaattaactgtaactttgaaactcaacgatacaaatctcttgaccgaaaatattccttagaaacttctctgtgacatagtctcagtattattaagcataattgttttaatcctcttttctatttttcttacattatttcattttatttcattccagtctaatgactttttttaaaaacctgcattttgaaatgattatagattcacaagaaaatgtaaaccctgtgcatgcagtctctcagacacttcattcagctaaaccaatggttacatcttatgtacctgtagtacattattaatatcacacacgtatgatgacaaaacaaaaaaatcaacctctataacacatttatagtggagttcttaacttttgttttttactttgttaattcgactcccctaaacatctgatgaacgacattattaacctgctccactctcatctccaacagacattgacaatgttgtttgtgtgcaatgtcaagtgtacatagacaccgtgtagctaattcaaatctctttagaagacaatgaactccatgttaagaacttataatgtatgacatgacccttaattgtcactgttaatattaacaaaactacttttaccacagtcctcttttaccttctttcttatttgttttttatctttacaaaatccttagaagatagagattgtagaggagaagctgtattattatttttgaaatgaggagattagtattcagcatggttaggatattatcatctaattggggtagtgtggatgagtgatagagatcttcagctattgcactgtgtaatctttttgttattgtagcttgttgtttttgatgtttcattctcacataaggggaaacatatttgaattacatctcatggtttcctatacatgtgatttttagacaataatcaagaataccaatcagaaattccaggaacttaacactagaaaacaaatgtttattgcaatcctctctaaagaaccactttgcctttcaaaaacatgggacaaaacaaaacctaacaaagaaacaaaaaacaaaagacatttaaataatacataaaaagaacaacacttattttgctatcctgctcatttttctcaaagggtaaaagaggcaaatccatcaaattcaaaaagatgcactcagctatcattggaaagctgtgtgctatgtattgcttaagagtaaatgagggccaggtgtgatggctcacacctgtaatcccagcactttgggaggccgaggcaggcggatcacgaggtcaggagatggagaccatcctggctaacatggtgaaaccccatctctgctaaaactataaaaaattagccgggtgtggtggcatgcacctgtagtcccagctactcgggaggctgaggcaggagaatcgcttgaactcgggaggcagaggttgcagtgagccgagattgcactactgcactccagcctgggtgacacagccagactctgtctcaaacaaaaaacaaacaaacaaacaaaaaagtgagaaacgtgatagacagttccaatcgaaagagaaatagagcagcctcagttattaaacgcctatcttttttaaactctggccatcctggggccaagaatgataactagctggaagaaaatagctgtttttttttttttttttcagttttctgatgctgtagcacatctaagcaatctctaaaatatacaaataaatccatcatgaaaaagttaccaattatttttggagataaggaatttttttcaaaagagtaaagaaaatattgtataattttttctttttttgagttaatttgagttattgtataactgaaaagaacaaagaaaatattgtaaagcataattttaagatctgtatatcttcactgaaacacatttggagaattttatattgttttaaaattttatattttacccattctacctattaatagatttgcattataaaaaaagtgaaccagcaaatttcatggacaaccttataatcacatcacaaactttaaaaaacaagttttacaattcaaagaattttcctttaattatttttcaatacaagtcttcaagtctgatagtctgataaccttgatgttaaaataaaggtaatacaagaaaacgttgctcctgtaggatgatttattgattgttatgtaatcttattgccttaaattgtgttacttcaagatattaatctggttgttttattaatctaggaggtactttgaaagatcacttttctttttattagttttaaggtgctttattagataaatggtgtcccaaaacaccctttactttggttattattcttaaataaaattttctttataatttcattttatatacatttttacatacttgctgaaatttctatacacacaagtaattcatcaaaccaatctatgaatcagtttactaaaaatgttcacttcctattaatattagtaataaatagaatgtggtttctggatctgataaattttttaaatgttaatttctatgaatgcatattgtggaaaataatttgggaaagcttcaacagtactcttacctggttaaaacattcagaatgataaatatgtcacctgtaatggatacagagtgcttggaaatttcttcattggcaaagtcacccacggtatttacattaagtcatttactacatcaacacgaggtactaacttttataaagaacatttcttatcaaccagcaaatattcttgcatattgaggacagaatgacttcttcaggattttgcaaataattatcttctcacttatctctggcctttatttatttatttatttattttgtttgtttgtttgtttgtttatttgtttttgagacatgtcctcactctgtccaggctagactgcaatgatgcaatcatagatcattgcagctttgaactcctgggctcaagtaatcctccctcctcagcatccttggtagctggttctacaggcattaatcaccatgcccagctaattaaaaaaaaaaaatgtagagacggaatttcacagtgtgaaagtccagtccagaaaggctggtcttgaactcctggacttgagtgctgctcttacttcggcctcccaaagtgctgggataacaggtgtcagccatcaccccctgcctgcctttatttttaattaaaatgtattagtctgccaaaaagttacagggtttatgtagttacttgttctgttgttgttgttgttgttgttgttgttgttgttgttgttgttgtttcgagacggagtttctctctgtcgcccaggctggagtgcagtggcgcgatctcggctcactgcaagctccgcctcccgggttcacgccattctcctgcctcagcctcctgaatagctggtactacaggcgcccgccaccatgcccggcaatttttttttgtatttttagtagagactggggttcaccgtgttagccagaatggtctcaatctcctgacctcctgatccgcccgcctcagcctcccaaagtgctgggtttacaggtgtgagccacccagcccggcgtagttttgttttgagacagagtttcactcttgttacccaggctggagtgcaatggcgtgatgttggctcactgcaacctccacctcccaagttcaagtgattctcctgcctcagcctcccaagctgctgggtttacaagcattcgcccattcgccactacgcccggctaatttcgtatttttagtagagacgggggtgcgccatgttggccaggctggtttcgaacccctgacctcaggtgatccacctgccttggcctcccaaagtgttgggataacaggtgtgagccactgtgcctggccagttatttgtaatagaaacgattattaatgttttacacagctttcaaacattttttatacaatttgactttttatcctttttcttttaaatataatatgttttattatatatattttttcttctttttggtatagttactttttaatatgtttcatattaattcgaacacatttaagcttaaagagttctgtgctattcctaggatttatgtatttattagacatttaaaatattttggccttaaaaaaattatttaacaactttctatagggatatctggaaactaatgttgaactatatgtaagattgtctgtagcaatttgatagaaataatgtttacctataaattatttttaatagttacaatttaaaaaaccctctgaaaaattgataccttttcctaaaacattaatttataaatatttatactaattaaaaatagttgaaaaaaataaaaatcacaaaaaaatgagatgaagttttaatactgcctttatcattatcaaaaatgaaagagaaagcgtaggaattaattggacaggttttccaattttatttactgacaattccatctgtattttctgcaattcctcactaacagatcacagaatcttgggaaatgactgattccatatctaggacaggaaatgtgaaaggcctggctcggtatcagcctggttccaacagagggacaaaaccacatgatcatttgaaacgaggaattctaatagaattctaagctataatatcagagcaatcataaagatgtaaggagaactctaaagggtatcctgacgctctgagaaaatatcagaggacagccaagcgtgggcggaaagccttctccctgggaccagcttcagccctccttggaggaggtgcagctgcagcataccctatggaagatgttcacaggttgcctgggttcacattctaacccacattcttcaggaaagaagaaacaaccctccagggtaccagtgggctggaggataaatatgcaggacttggcgctcacctcactgcgttgccaggtctggagcacagtgtttacactcggtgggggtggggggggagtgggtctcaaggcggttgtcatgagcccaggcggcagttgctggttgccaagtgcctgtacatttggtacattagggtctgtatgtgcgtctggggaaaagcaccacacaaatccccacacgtccagagagctgaccatgcagtatgacaaagggaaaagcaaacatgccacgtactggatctaggaagagaagtcttctcctgcaatgttcatccacagccctctactgacaaggctcaaccttgcactcaccgtaaaggagaaaagctctccgggggtgggggcgggggggttggggggcgtaattcctgtgcacagcgcaggaccttgttaagcaggtattgaggcatgaatgtgcgccacgaagcattaaattgatcagtggcagagcccagaacatattgctgtaccagaaaccatgtaagcaatcaaagactaacatgttgtctaaagtacacagaaactgacatgaatgtgtgaggatctatttttctaaacattctttgtcctttttataattccttttgtgatgtagatagcttatttttttctttatttttatttttttcctaacttgtgcgtgtgtgtgtgcacacatgcatggacacctgtaaatattttttaaaacaattattgcgctgctgctttggaactttgaagaagcctggtcctttttaaagagtagtgtggacaaagaacacaaagtttcagttagacaagaaaaataagtttaagagttcgattgtacatagttaataacaattgactatggttaataacaacatattgtatacttcaaaatttctgagagtagattttaagtgttctctccacaaaaaacaagtatgtaggtaatgcatatgttaattaacttgatttagccatttcacaatatatgcgtgtatgtttgtgtgtatatatatatatatatatatatatataaacatcatcatgcaccataaatatgtactatctgtatttgttaattaaaaatatttttaaaaataaaaataaagagtactctagggaagtggaaacagtgaactttgttttgggtttcttaatagaaacaaatccatgctgagtctatcaccctatgcacatactcttcttttagtttctggtataatgaagctttttatttcttaccaacagtctctaaattgtgtgtccttcatgttttattctgccccaattttatttttagcaattccctttcagggatctcaggctgagattatatcaaagaaggtgccacctttctctttactatcattttctcattctaaggtggagagctgtcaaagtgtttttccatttcgtttgtgccaccaagttccctgcttgaaacctaagaaagtatatactggttctggattttctcttggcttaatccagaatttacattatttaatttatctgacacgcatatttaacaatttgtgtcctaatggtgtagacatttccttattttggtgattaactgttccttatgtttaaacattttctctgtttacttctaaatagaatgctcttcagagtttccttatcagcaccacttaatattattgttaagattatggtgaacctaatcaaataacttttactaccctttgtaataatttttaaaaactacttatacagagatattgcattaaaataattacggttcatatgcacaccatttcagttacatgagctatgccttattacctttgaaagcatttttttttagagattgcttcattggttttagtgttcatacattaatatttcacttctaggaaggaggaagagattaacagcactttaaaaagtttttagtggcactttgggaggcatatattaatgttaggtgtttggttttaattgtattaacaaaaacctacccagtgaatttcaaatcagaaatctcaacccaagtcagtctgactctatgatcaacactggaggaaacacaacagtcttgtgcttgtgatagccataattcctggattattaaaacaaggcatcttaatatatgagaaagtatctactataatgttatatacattgacagccctcaaaccatgtgtccactgatttcaatttgtaaactatcatgtatacagcagggtgggaggaaattgttggcttctccttggatttaaatggaggaacatgataggtagccatatatcattctttcagatgcttataggactgagacagacttccagaatttgacagcgacatctgcacgtcccaaaataattatttcatgatgtgtgacactctccttaagggaaattgtaaaatagggctgaccaatgtcccttattttgagtttgaagagtgcatatcccaggaaggagtttggaatcagtcaaattgaccttccttttatttttgcccttaaaatcataaatagcattctttctgaatagagaaacagaaaaacttgtttttcatatttttagttgtgtgcataatctaaagagagctagtctttatgattagcatggaatatggggtaaaaatcactatcattcttggagacagacataaattttaattctggcttacctattgctacattatatgatgttgagaaagttccctaagttaactaaactttttaagcatagtatacatatatgtacatttataaaaagtattttatttcatagctttttccataaagctttacatttatactttaagcagggcacaagaaaactctatgccattgcacccaatagatatttctctcctcagtagagtttaagactgagaatacttttacagtacattgcaataaacattagcatttgagtttcctttggatcagttctacctgtttgtagataatggtatttcatttttgtggttgttatagaggtacttcaaagaataaacaaatattaacttatttcaaatttaaaaattatatcttcaatgactatgtgggtatgtagacacttttataaatctaggatacattatggaacttagtaacatggtggttttaaatgccttgaatattatcaagatacttgtcttggacattttcatgatacatcatcatccaaagaattatttcatcattgtgcataagtttttttcacatatatatttaaaagacatgtaatttgaaagattgtgtattgaaagtttgtgtgaagaatgacaataatgaaataaatcttcactatttcatcattctttttttttaaaattgtgttgctcaaagtattacatcaactttgaaaaatatataaaagaggactggcacaccatcttttagtttcatttctattttcattgactatacatgtccagtaatatttgaataagtgttataaagataatttcaaaatcagggatagtttccaagaattagttttattactgaatatataaatatgtatatatatatatgtgtgtgtgtgtgtgtgtgtgtatgtatgtatatatatgtgtatggcaagcttaaatattgaatgaattacaaataaatttttttaaatatctattatatattggtgcactcaggtatacatatatattaagttttttagtataactaacaaatactacttagtaattctattttgaactatatccatgtggttagtattgtcatttttgcttattttttcatatttacaaaacatacaaaattgtttttccaggttgcatgtgaaatatatttttctgaaagcatatgaattgaatacttttcatattataatcactatatgtgcatacatatataactatggaataaaatcaagaatctctgctgtcataaatctagtaatatattgaggaaaatacgaaaatattaaacagaaacggccaagtgtggtcgcttacgcctgcaatcttagcactttgagagtccgaggcaggcagatcacgaggtcaggagtttgagagcagcctgcccaacatggcaaaaacccatctctactaaaaatacaaaaaaatttagccgggtgtggtggcgtgcgcctgtcatctccactactcgggaggctaagacaggagaatcaatcgcttgaacccgagacagggaggttgcagtgagccaagatcacgccacttcactccagcctgggcaacgagagcaaagctccatctatatatatatataaaaaacagaactttgtccaattaacatacttaccacatgggacatttacagaaataggtgtatagaagatgcagtaaattaaacctattttttttaggcttaaaacaggctaataaatggataatctaaatacattcatatgtacacttcatatgtacatgaaatgaatgaaataatttactatactggtactagaaatatgaaatataattataataaatataaaccataattttatttataataattctagaaatatgttacatctaatatgtaaatttgatatatatttattagaaaattataaaattcatcatttcaaaaattatttgtattttaagaaaactggtgtgccacatttaaagtatcatttattagatttacatgttattatttaaaagttgcttgttatatttgtcaatgtgtctaagtaatcagatgtgtttgaaattcttgagaacattagctatgtccaatttctaaatatataatctacttatagtaccacgtttgaagaaaaatgtctaagctgaatttctgcaggagccatgggtccaagttcacgttcattctgtttttgtgatctcttctaccctatactgtacgcccatacatttctaaaatagttcaattttggttctagggaaagtgcaacacaatagagagcctctgaaatttttatatccaccttttactttcccaaatccttgggttctaacccattagaaatgagtgctttaaatttttaaagtcatttgtatatttataacaattctattactgttttcaaaaacattttggaaaatatttataggcaagatttgatcattatttccagtgaaatcacattcaaaaatacacatagcttaatgaaattcagtcatttcaagaaatattgacaattttcactatgttgcagtttaataatcagtaacagttaagatgtacctatttcttaagatatgagtattcctcagcatagtagctaattgatcaaatataactttggttactaacatttattgaaagagaaatataatttctgcttttgtaaaatccaaatggtccctgactagctttgttgataaattcaaagctacttagaataattgagttgatagtatctgtataactgtttagtatcatgaactctagactgtaaaatttttgaacattagtggacattttttaaagaaaaacagcttatggtatttaatagtcttctgtgtgctctaagaaacctgataattatattagtttattatgtaccagagcttagaagtacacaaataacattctaacttaagtttcacattttacaaataaaaaagtgagcagcagataagaaagtgtgtgaaataaattgtgaagtaatgataatgtatttcaaaatgagtatgttctcataagtgtttacatatctaataatttgtacaaaactcagttttatttgtgttgctatacctggtatagcaattaaacgctacgaaaaaacattctggtgtattttccctccatatgtttatgtttatgtctcattttacctttacctgcatgatgaataaaaaaaaaaaaacttaaatgtgactaacctatagaattaatttttttaattgtattggcaaagtataaatgaactactgaataataaatatactataaaagtaaactactgaatcactatcgttagcaaatttttaaaaacattttaggaatttgaaagtagaaaacttgaaatttgcatgcttttaaaaattaaaataaaatattattatacaaagctcacaacataaaagcatgtaattaatataaatagaataaattttttgatgttttaaaataagatgaatgcataacaaaaattattacatattataaagcttattttatatatataatttgtatatatattgaatataatataatatagaattacaataattatataaattataatatatgaatattaaagatgttgatatctattatataacaatattgtataatatatgaagaaatttcatattatgaaacaatgatatattgtttagactttgtaatttataatgagtccttacctgaccagagcctgcattttcacaaacataagtctcatagtattgagagaactcaggagcatgatcattgatgttaagaacttgcacatacagtgggatcgaagagatctgttctatattgtctgcaatttgaatatatataataaaaatctaacatattttaatatgtctttagaagagacatcattaaaattacattagaggctacgtggtgtatttttattttacttgaaaaaagcaatctgaggacaggatatctatatgattcacctacttatcaacaatagatcctagaaaaaaattccatgctcaatatattcaaaccaagcaatatttattgagtgcattgtatttgccatgggctgtaataagtgatgagaaaaagcagtaaaaagataaagtaaaataagggtatacggagagcttgcaagagtccaggaaccatttaaagttttgtattaactcatttaattttgatcaatatatggattattatccccccaattttacggataaaaaattgataaaccatttagtttcaaaaattacagttaaattacttgtgtaaggttatagctgcagtgctataacaaaaaaaattctgtgaaccactgaaatttagggcgtagcttttaaaaacaaataattagaatctaaatatattttaaagtaaaatagttataataaaatctaaataaagtttttatataaacattgaattgagaagattttctaagtgagccaagaaatccaaaaaacataatgagagaaaattgtggttaaaacatttaaatctttcaaattgatataaaaaagacatttcagaaaaaagtatgaagtaggaattcacaggagagaaaattcgatttatcttatagcagactttctcactgctgtcactattaatattttatactggataattcttagttttgggagattctcctgtgcattgtaggatgcttagtggcatccctgacttctattccccgaatgtctgcagcatccctcccatcccagtgtgtcaatccaaactgtattcagacattgtcaatgtgccctggttgaaattgggggcagaagtgtggagccaaatggcctgtagtggagacacgccgcgttatcataatgttcacacagcctctcaccacaggtaagaagaatgatggtttagcccatgccatttttgtcatatgcgatagaacagcacccagtgatagctgagtgctgaaaaataacaatgtaaaccgactctagcaatggataatgaaatttaaactacacatatctgtgacccaatctgttaaacttaagctacagtctaaggtatcagtatttgagtaaatgatccgattaaatacattccagagttatttgcattacatccaaattatataaacgactcaaatgtacaacaaaaaagaattggggagaataaattacaactgaactatgatattatgtggatttattaaaaatttgtgagtctggccaagcatggtaactcacacctctaaatcccagcgctttggaaggccaaggcaggaggataacttgaactcaggagtttgagagcagcctgagcaatatagtgagacctcatctctactaaaaatccaaaaaaattagctgagtgtagtagtgtacattgtagtctcagctacttgggaggctgaggtgggagaatcgcttgagcaggaggttgtggcagcagtgagctgtgatcgggctactgcactccagcctgggctacagagtgaaaccctgactcagataaaagagtcaatgtaacacatttttattgtgagctctaaaactggatgacttgagtttgaatcttgtttctcaatttgagaaaaatacttaaccagaatgcctcagttggcattctgaaaaatgggtgtgatagtagtacctgccttatagggttgttgttaagattaaacatatacataaagcaattgcataaattacatgaagcaattacacaaattggttaatatacataaggcaattaagagtacttagtacataactgaacaatgaatgttaaatattattgttttgttgcatctactaaccagacatgtattttgtgaactgaaaaaagtaagttgcagctattatattgtgtaggtttattgtttttaatctttctctctctcaggctgtagtgcagtggcaggatcccagctcactgcaacctccacctcctaggctcaagcgattctcctgcctcagcctccctagtagctgaaactacaggcacatgccaccaggactggctaattttcgtatttttagtagagacaggcttttgccatgttggcaacggtgatcacaaactcctgaccccaggttatccacccaccttggcctcctaaagtgctggaattacaggcttaagtcatcatacagggcctctctttttcataaaaaaaaaagaaagctataggaaaggtgcatacaattaaagggtataggagtgggattctttagtttgttttagtgtttttatttaaaatatatgtactatttgcaatgataatttgaaagaacaaaacaaattaaaaattagaggccttgtacttgttgaaagcaagggaaaatattttttctttccttccttttctcagagcattcatacacacacacacacacacacacacacacacagagaaagagagagagagagggaaaaaaaaagctttgtatgtaagttttttctttgtccctttgaagcgtatggaaatctttcaaaagttcaacaagtttcttggaagctttaggatccaggattgtatttatcaagtaatggtgaccatctctttgaaatgtaatcttcaaggaatacagcatccctatatcctagatgtggggaaggataggagactcattttagcaacgatcttgttctaagttgtagaactacctcttgtcataaagacatgaaaagttaagttgtcctttggataaaaccacttagcaaatacaggcggtcactccaactacccagtgaatatagaatgaattctatgtgacaaatagtgctaagtcctcatacttgaatatctagataatatttaacttgagaacatgtatatattggattgcacctgcttgaccacataaaaaggtgagatttctttccattttggcaatctcttagatttcctatgatgcagatcacattgtgttttaatgctttccagtaataaaatttttctctctgttctacctttgaggggaggttttctgggctgggatgagattttgcttaaaattgaattttcccaacaataacagttacaattaagatagaaattgtaattttcaattaactaaaaattaaaatttctaggatttattacacacacacacacacacacacacacatccatggcctttaagaaatacagcaactattagtatttatcattttgagacttttctccattgtgtgacatttaggatgaaaataaattaatggaacatttaaaaatgaaaaggtatttctaaagatttcaagaagaaattaaccagaaaatttaggttcgtatttgttatggtttcagcgcatacatcatcacagaatatctttttgcttaaataattaaattgtataatgtaattcagttgtgaataaactgacagaaaattaataagaaattcataatgtttttatctttgtgttcctaaactttgcttgaaattaagttaaattaaacctttggtattactgcacaaaatgtatataaaacttcacagcttcaccttaaaatagtagttttattcacttagctagcatactgataaatagcattgtgcttaatttgggaagctttccagaaaagagactaagcacaacgaacttcatttgctggaaaaaaaaaatttttaaatggaacatctctttcctataatcagtataattgctatggtgaaagcttttcaaggtagttagcaaatgcagctagatgatttttaaaacagttttatgtaatgccctgttttccaccagtaggtggtttgtttatattgctattgaagcttaaatggtcaagcctaattatttttggttcaatattgatttcacagtagtaaaaaaatggcagttacacatattttccccaaatagatctaaaatgggcttaatgatgtagaattttttaaaatgttagagaaagaaaaaaaatgaaaatttgttatccagtgttataaaagcttgttccaacaagtttttccttaaaatgaaaaaaaaaaattgttctcagaaatacacaatgaataaaagctgcatttaaaataaacatctttgcattttctgacacgagaagccttgacatttcctctgttacagcgggcatttattccattgtaacatttgcctccttttatggtttagttaaatggaaccttgaaaacccagattcaagctctcctacagtgtttccatagaactgttcattgtatcgcaaataatatgcggagatgccttccactccaccatatcacctgccatctgcctgataaagtaaggaaaagagagatatctgctccctgcctcaacaaagagtgaagaaaggaaacaggattattaaaattctatgtaaaatcagctataagaaaagatgcatctgagaatattttatatttgtaattttaatactttacaattctaaatctattgactaagtaatggaaatgacttcgatattttatattgtgttatatttatttctttaagctttaataaatataattgtatgaataatggattcatgattttaaggacaatatccaagtggtaaatcagaaaaatttacaacccgaaaacgaaatcatccacctaaataaacaagcagaatttcaggtgaatttcatttgtattttgttgtttcctcaatttattcttgtatggaaaattatttactgttataattagaaaatagtttagaaggtatttagtggtaagcatataaataaaaactaataaaatacgcaagtacacacatttacattgaatgtcatttaaataattccaacaacattttaaagtagccttgtccccatgtatagaaatttgtaattatttacaaaatatggcaaacaactgtattggatttcaaatgagtacttacatttttctgtggctgtaatacttaggttgtaccaagcactgatttcacgatccagtgagttacttgtagtgattgtaccattatcattgatattgaacactttgctcctagtaatagaatacctgaaccaaaaggaaagtataccttaatatttttattctatctgcataacagtgttagataatactctttaagcaataagacatcttattcaatgcatgctctacatagccaatatataataccgaacaacttttaaaacagtatattcctgtatttaagattcaactcagtggagatagaaaaaaagacgtaacatgactttagatttaaattgatggatgctaaatctaaaattaatgattgtgaatctttttttcctatcaaataaattaaaatatatcttcagcctagacgagtattgatctctttcctatgtcacaggtgttgcttgcgaatctgttcattttactacaactacttggcttgatatttaacaaatgtttttgtttgtttaaaaagtaaatttgataaaaagtaaagtctatatagtagatagaattttaattcttttgggaaacctgaaagacttctgaaatctggaatctggaatcaggaatccaaaatatttatatatatatatatataaacatatatataatacattatatatgatatatattttacattttataacacatgacatattttattacatatataacatatttgtaatatttaatacatatatgctttattctatattacatatagaaaatatgtaatacataatacatatatgttttatgcatatatatgtaatatatgatacatatgttttattatatattacatacaatatatgtatgtatatatgtatgtgatatattacatcacatgtatttattttatattatatatttttacatataatatatatgttttatatatatacacacatataaaacaaaagtaaaatacagtagttctaatgtgcttttagattgtgcatggaagaaagccaagttacaaatttctcccaagggaaaaaaaaaactgaaaaatgatctccacctccacaatgaaagaagacttcgaaatactcagcatgtctcatctatgtggaaacaattaataataaaaattaaagagcaataataactagggttcaataatggcttctcattgcatgtatattcctgaagactttgatgagatatcaaggaagtttaccataattatatggcaaagatgagaatattttaattttgagttcaagtatttccaaaaacattatgctactttgtagctaggtattcagataaggactcaatagaaatcacgaggaattaagctttaggggagttcagttttaactgtactccatttaaaatatttataagtattttccctaaatatccccaagtggttgcctttcacacctaatagaattgttggaaaaattatacagtgttttaacagttgttattttgaattaaacatctaatcctatttctgtaaaatgtcattgcacataaagcccatttaaagtttgacaggatgttatagtctttagtagtttaattcacatctgttagaatttaggaagaagagccacataaacaataaattggttcagttcccattaattaattaaaacagaagtaaaaatatatgtagcccctctaggatgtgatataagcagtgatgtgtaatatgtatcatttttcttaaccccttttagaaccacaaattctcgttatgtaagttttcttttcccccactccaccttcactggacaaaatttgtttggctttgaggtaagttttagttaaattttacatatatgtaaaatacatatatatatttttcccatttttaaactagggagacaaacatcagaaaattcataaatatgtaaacagctgacttatttagatatgtaccatcatgacctcagcaaaatttaaaatttggaattttcccactaatccaattaaaaacattttacaataattttggacttacagaaatgttgcaaaaacagcacacagcatttctacatgctcttcactcagctttttctaatgttaaaatcttatataaactttaatctgtttaataaattaatcgctataatttaattaatcaaactacaaactatagttggatttcactgttttttttccactcatattcttcttttacaatccaatgtagaatccaatacggcctttcattttcctgcgtccttagtctcctccacgattcctcaatgttcttgtctctcaagaccttgatgctattgaagagtattggtcaattattttaaagagcgtctctcaatttgggtttgtctgatgctttctcatgattagactaaggttacatatttttggcaggaataacacagacatgatatactttcttaggctatcatatcaggggaacatgatgttcatcatatctcatgaatggtgatattaacattgagaactcgaataggtgatgacgaccccatttctctggggtaaaattgctatttttttcttctgtaattcataaggatctcaggaaactattttaaaatgttctggtttctcaaacatttatccactaattttcagtatccatagaggaataatgttaacattttttaatactttctttctggaaccacaagatgctccaggatgatcttgtcgtttccttacaacagctctggattccagttatcagatgagttgcagcatctttgattggagagtagtattagaaagcaagatctaggtattaagagttcccattgcttcttgagtttcattgtttttaggtcctttgagcagacatcagcaggaaatatatgtatgtatacccatgcgtacaaacacatctatatttatttccatgtaattccttctgtctgtatatatattaagaaggcattcgtgcatcatacctcagatttcaatccagtgtgacaccttcatgtaacttttctcattttttatttgtaatcatttcttttgacaataatgcatcttagtcttactatctacagcatatttacttatgtgttcaatcccaatatacatgtagagtaacactgcaatccctaaatagtatccatgtaaaaaatatattcactatgtagagtacatttcttctgaacagctatttttttctctagatttagaattgaaatactctcttccaaaattacttaggttgtattttcctaattcctctccttttgattatgttatttgtctataatataataaagtacatttgcaatagtttgccttcaattttggggatatctccaaagtcctatttgatttttttccagagtttacactaattagtattttcatctatatcttggagaattctctgaacttggacaaaagaatagtcatgtgtccgccttcacataatgacacagaacaattttatcaccctcctttcctttgtcatatctttttagtttaggtaccacagggtttatttttgtttgttcattttttttaatccactcacctattgaaggatatttgagtcaattccagttattggagatcatgtataaagctgccataaatgcttgcatacaggttttcatgtcaaaataaatacactttctaggcctgctgcaacaaaacaccacaaactgggtggctgaaaacgataaattaactctattagatttattaaaatcaaagtatcaacagggtcatgcttcctttgaagcctgtaggggtgaatccttccttcctgtttctagcttccagtgatttccggcagtccttgctagtcttccacttgtagacgcatcgctctgatctctgcttcggttgtcacatggcagtcctctcccagtgtctgtcttcttataaggacaccagccattttggattaaaaacatacctgctcaggtatgaccttatcttaactagttacctccacaattactctatttcttaacaaggccacattcgggtgtactggatgttaggactcaacatgtctctttaggacacaactcaacccaaaacacaaagtttcctttattcctgggtaaatgcttggaagagggattgctgggtgttgcggtcaatataagtttaatttataataatcttgtatctttctgccttgataaactcacatattactgggcatttttgtgaatttcctggaattatctaggcaataatcaagtcatctgcaaataaagaaaactatattatttctctccagcttgtatgtttttatttctttttctcacttactgcatggccaggacttccaatattatagatttggactagtgaaagagtacattcctaccttgtttccaatcttaggaaaaaagcacataatattccataattaagtataatattagctgcattcttttgtagatactctgtatctgtttaagaatcttctattcatattgtgctgattgtgctgatagtttttataataagttaattttgaatattgtcaaatgttttttctttgtctattgagatgttatatggcttttcttttttaatctctcaatatggtggtttatatgaaactattttaatatatagacacatccttgcattcctgggtgcactccagttgataaggatatactttccttttcacaaatagctcaaattactattattgtaaagaattttcatatttgtttatgagggatattgatctgtagttttctttgcttgttacgtatggtaggatatatcagtggcatcaatttttactggaactgctctttttttatgaagctatttaactgactttttggtggtatatatatgcttgtgtgtatgcatgtgtatgtatacatatttatgaggttgtacatatatggttgtttgtaaatgtatacgtgtgtgtgtgtgtatgctaaggttatttatcttttaatatctttggattctctcaagaacttcctctaaatgtataggcatagcattgttcaaagtagtccctataatctttttaatgtctgtgggatcaatatgtgtgctccctttttcactttggtaataataatttttgtcttctctctctctctctctctgtttgccccttggcctttctcgatagagattaataaactttagcaatattttgaaagaatctgctactggcttcattatattactccgttgctttcagtttcactgcttgtgatctaatctttttatttcctttttgtcctgcttgctttgctttttatttgctcttttttttctaacaggaaataatacaccatctttctcatacttacaaaatatttcaaagtttgactttagacttaatttgaaaggaaacttcaataacgtccaaaaagtaaatcatacccattgataccaaaagagtaatccctatatctgaagtccaaaagaataaggcaattgtcttagtcatcacagacagctattaaaaattaccatagactgggcagcttataaacaactgatatttatttgtcacatttctagaggctggaagtatgagattatgatgccagcatgattggcttctgacaagagcactctttcagttgcagactgttgacttctgtgtccttacagccagagagaggcttgagagagctatctgggttccactttaagggcactaatcccattcattagggctccacctgtgtcacttgatgccttataagacccaccttctcgtacccacctaataccatttcattgagatttaggatttcaaaatgggacccaccttgtaataccatttcactggcatttcagatttcaaatatgaattttgagggacgtaaacatttagacttctgaaataatacatagtcttagtgataaaataaaaattttaagaataatttcttatgaagttcttaataattttatggtagtaattttattacagattgtttgggctcctctaatttttaccatacaaggctccttaaaacaattctatcatctcactttcaagtctaaatattaaatttttccattatttctgtgccccattttttaaaaattgacatgtagtttgttattataattcatataaaggtagatcttgctcctcaagcttttatgacctcaactaaagcaagagtatttcgttacaccagtttatttaccccacccaagacgtgatgaaactgagtttgggaatttccatgctttacagaaacagcaggtgattcttacttagtaggaaaaactaatatgagttgaatgaattggggctaatttactatgtttaatatgtgttagtgtttctcccacaacaatgagacatccctaaggctaaaatacaatatcctaatattttttctggttttcatagctcttaccatgcagtgagtattaaagaagagatattatcaaattaaaactcaaattgaaatcattttgcattttatgttcaaatattttggggatcttttgcttacaaagaaaaaagagataaataaagaaaaccaaaaagaagcctcctgaaatgtgctgaagtgggtattttcataagcaactgattttgtttttatgatgtattttgaatgtttgttaaatcaagctatatcatatgaaaaaaatcaacaatatcaacaacaaaaactgctgtatcctcagtgatcctaacatatgtatgaaaagcaatattatttaaaagacacttttaaatgaaagaacatctgtcaaatcattaaaacgtgttttttgatggatacaagttattttaaaaagtaataattgccagtataaaggtggaagtcattagctaaaatattttcagattgaagtaagtagacaccaatggtgatactataaaatacaaaacctcttaatatttggttgtaccttaggtttttcttcatatatatgtagcattttcacatgtagtaagcatgcaattcttcattgtgtattattgtgctttaaaatgtatgcagtggtattacctatgcatcacaagcatcatgaattataatttactcacttgtactcctaaaattaacagttttcaatactttattactataaatgataacatatgaatatcttaatcatcaaagcattttttaacattccatattatttagtgttccctgaagaacaatgaataggtatacagatacattttttaaagtaaaaaattgatatgcacttatacaatcactaaaatgtctatgactaattaagaactacatatgcgtatcagaaggcaacattttatgaactggaactataatggaaaagtgggaacatttcttggtatcaaaaattaaattgagctttttcattgagctactgcaagaccttcacagagccaaggagcagctagcattttaattaatatatgaaggtttctggaaaataggtgagtaaggaaaggtgttggagaaatcattacgtaacaagctttggttttttatgcccaaccagactatacctcaactactgaaacaaacaaataaacaaaatataaaacaaaagcaaaataaattataacatagtaactgaaaataacagactattttaatagatggcaaatatctgtttaattgtaatacaagaatagatttctaaccctttgaactcctttaagtggtatcctgtaaaacacaggttcccaacccccaaggccatgaacagcaggccatgaacctgtccatggcctgtaggtgagggcaggcgagccagccttactgtctgagctccgcctcttctcatatccacggcagcattagattgtcataggagcatgaatcctgttgtgaactgtgcatgtgaagtatctaggttgagacctccttatgagaatccaatgccagataaactgaggcagaacagttttattctgaaaccattccccttcacccccccgaccttggaaaaattgtcttccaccgaactggttcctggtggcagaaaggttgaggaccactgctataaaagctttctcaatttttgaatatcatttcaagtaaatagtatttaaataagccacttttttgttgtcgttgagacggagtctcgctttgtcacccaggccggagtgcagtggtgcaatcttggctcactgcaagctctgcctcctgggttcacgccattctcctgcctcagcctcctgagtagctgggactacaggtgcccgccgccacgcctggctaattttgttttgtatttttagtagagacggggtttcacatgttagccaggatggtctcgatctcctgacctcgtgatccgcccgcctcggcctcccaaagtgctgggattacaggcgtgagccaccgcgcgctgccttaaataagccacattttgatcagctttgtttcagctctaattggggctttttaaaaaacgattgttttcctcttatctcctttccccaattaagagggaatataatgcactgaattttaattggtaattgcctccttcttgcacgtgtttgaaatcaccaattttactgcatcttaaccgacactgaggttccctattttgcttaaattgttacaaattaattaagacatacagaaatatagatacagatataaccttgtttaaatttgcacgcaggctaggggcggtggctcaagcctgtaatgccagcattttgggaggccgaggccggtggatcacgaggtcaggagttcgagaccagcctggacaatgtgatgaaaccccgtctctactaaaaatacaaaaattagctgggcgtggtggcgcatgcctatagtcccagctactagggaggctgaggcagaagactcgcttgaacctgggaagcagaggtggcaatgagctgagattgcgccactgtactcgagcctagaagacagagtgagactccctctcaattaaaaaaaagattgcatgcaattttatttttaatctattttatatttacttatttattaatgcaaaactgaccttacagacatacctgataggagatttcctattgtctgggtctgtggcagacaccacgcctacaaatgatccctgtggggtttcttcaaaaacttcaaatacataatatggaaggaggaaaagaggaggctcatcaacatcttccacctggatcttaatgaaagtggtggaagcctcagtgtggtacttcatgagctgctcaggaacatgatggtttttaacttttgctctaataccgtagtggttctggtgctcaaaatccactttctgcaaagaaacacagtatacacaaaagaaatggctttagtaacccaagatactatttagaaaaaaggttttacctgttaaattaagtctcagtggcctttcagttagatttttctttttatgtacatggatctctctgatataattgttaatcaggcataacaaatctgggtgtattgtcacttacctattttaatttggagataaagttatacttttgaaagcataaacatctaatgaaactgagaattaatttcctagtatttaagatattttccaaaaagttttattattagaattaaaaaaatgttctgcatataattcaaaacactctgtaataactctctcatctctaaaatccttgtctccataaaacataaattactggttctcatttcaattatttaatgagttaaaaactaaccagctacacaaaatatgttatgttttaattttgcgctattctgcaaggcaaataattttaacatgtctaccttttttaatataactattccttcttgagtttcatgattagtaataatgtcaaatgtttgcgaatcatcctcttcaatgctgtaatccatttctgcattctctcctatgtcattatcatatgccatgattgttcctatagaagtcccagtgggtgcagattcagagacagtcaagcggtataaacctttaaaaacaaaattggaggtattttggataaatacttaatatagacaacttgcaattatagttttttgtttgtttgtttgtttgttttttcgagacggagtctcattctgtcgcccaggctggagtgcagtggtgtgatctcggttcactgcaatctctgcctcctgggttcatgccattctcctgcctcagcctactgagtagctgggtctacaagcgcccaccaccacgcccggctaattttttgtatttttagtagagatagggtttcaccgttttagctaggatggtctcgatctcctgacctcatgatccacctgcctcggcctcccaaagtgctgggatttcagatgtgagccaccgtgccgggtcgcaattgtagcattctttatttttgatctgtagggaatcccgtatctacctttcccagttacttgttcttaatctttctttatttgttctcttttttctttctctttttcctttctttctttccttccttccttccttctttccttccttcctctctctgcccccatatatagtctctttccctttctttttgaaatataaatattttctaatctcctatttgagcatctatcatcatctctcaaatatatcttaggaaagtctatcaccaatattatctctatttacatgcatgtctcctcaatattcatgttttattttttattgtaaccttcaaccatactaaattaaatttgacagaaataactttcaattttactctaacattcctgatacctgaagttactgaataaatatacatgtggaataaaggtgggagagtctgcatgcaaatagtagagttccaagaacgatagtttgattttgagggtctgagcctgcattacatcagccatcctggaaatgcaaggaaatatagatcgaaaggagttggtaagtgaatgtaatataaaaaacattttgtagtcaaagatgacctaattgatttggtcctaagaaataattgcagatgtatttaaaatacataaatataactacaaattgctgggcacttttttttttatttttcaggagtaacttgtgtaaaactgatatagaactatactatttttaaattattatttgcaattgcattttcatccatgttaatatatgacattactcatgtcaagcggcatcagcaaacatgcaatattttaaagaatggaactccttagaattctaaaaagaagcacatataataaaattcttctttaaagggattcctagttcctttagaagcatggaggaggcagtcacttcaaagattgcatttgagaccttactttttaagtggaataagtgttaatttttaagagctaatattttactacatttttagagcagaagttgaagactgactatatagtagtgctttttacattatagaaaaattaaaagaattgtttatgttattggaagattaaaaatcactgacattaatctgtagaaaacaattacattgccatgaacgtgaaagcagatgtttaagacttaaatgttattgagttgatattaaactattggtcttcaaaatgaaaaagaactgaaatattttcttcagtcaatattttgtctacataattttccatactttcaaaaattattttattgaacataatttttacaaggtcctgtcctagaggctggagatagaacaggtgacaatatacataaaagctgccaccatcagctcatattcttgatgataaaacagacagtaaataagatactggtatataagaaggtagtattctggtggaatggcttaaaattaaagataaggtgtaaagtattcactgtagatgtgacttttggataagaattgaagaaagaaaatgagtatctggggaaatataatttcaagaagaggaaaagccagcgagcctggagtgttctgggaaaagagaggataattgcctggtgttggtttcttagtaagcaaacaggcagatagaaacactaagatttcaagaggtaatgagacaggactggacaatggcagattacttcagaccattaggactatttaggtgatactaaacctaaggattttgacgtctgtgagggagatgggaagaccttcaagtgatatgatcagacgtgcattttaacaagattataaagctgtgttgaaaataaactaaaggagaacaatggtgtaagcaaagagactagatgagagcctattgcactaatagagacgaaataagatggtgccatgtgccaaagtgctagggatggagttggtgagaagtgttcatatttcggatattttctaaggcagagacaacagcatctgcagggaattaaattttaactctgagaaaaagaaaagtagaaaaagtagcttcaaatctttatgcaaggaaggaagagggtatgcgtgtgtgtgtatgtgtgtgtgcgtatgtatatgtgtgtgttttgtgtatgtgcatttgctccaagaatattgaaagccaggagctatcagaattgtggaggctatcaattcaggctgggggaaaaattatggttgacctgggtatggctaccataatctgagtgggatcactaattcttctaattcttcaaacagtggtgtttatatcgaataagcaaggttttggcttgaagaacatgaaacctggatgtgtgggtacatgagatgggaaaatctgttggaaaaagaggttcagaggaggggcagctggaatcaggagttcagttaagtgtgtgttaggttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaggttttaaatgtgtaatatatatgtgtattatatatgtaatatatgtgcattatatactatatatgtgtattatatatattatatatgatatatattgaatgtatattatatataaatatattatatatttgttatatattatataaaatattatatattatatataatatgcatttatatgtaatacacatatataatatatacaatgcacatttaaaacctaatatacacttaactgagctcctgattccagctgccccctcctctgaacccctttatatatatatatatatttttttaaaaatatataatatatgaagttgatgagtagacagatttacttttgcgaagctcaagggagaagttcagtctggagatgtatatttaatatgaggttctcagcccagaggtggttatgtaaagccacgtgtctggataagatcataaaggaatgagtataaaagggaagaaagacgagatcaaaggcctgactcacaaatgttccgaagtttaaagtatacaaagaaaaggcaaggaaggaaaaaacagagactagtaagacagaagaaaaagctaatgagaatggagcattaaggttttcaaggagaagttgatcaattacataaaattcttccaagaaatcaagtgttatcagaactgagaattgacactgcattccacttaggttattgatagaaatgatcagatcagtttggtcaagtagtgtggatgtaactcaaacggagtaagttctgagattttgaggtcgttaattggaaacaataagtatgaacaatattttaaataaatcttctctaaagagaaaggaagaatacaaagcatctttagctaagtatggaagtgaaggcaagaaagtgtttttgttttgtcttgttttaggatgtgagaaaaaacaataataaacatgtttcgatgtgatagatatgaaccagcagaggacgctgttcacacaagggagagggatgtttgagagatgcctttaattgggagggtaggaagtgttgcccacaacagagggtataggtattgagtatttacattgagaggagggtaatgggattcccacaagggaaaaccatgtggacaagagtaaggaggccagaatcagattcacccacactcgtatatgagtgaaagtattaagaggaataccatcatctcatattcagacttgagtaataaagataattttaaaagatattttaaatattctaatttattcaaaatattttaatattaaagtcaggaaaaatcagagggaaactgagaaaggtagtagaagcttcaggatattttatcgcagcaagttccttgggaattttcctgtcttccagagtcttctacttgctatttaataatcatctgcataaatttagaccaaatttatttaataaatccagacactatttcccacatattatatgccaattattttataaagttctgggtatttcatatttaacttggtgttctcctcttgccttcagaggccatattaatgttgtggacagaagacaacatatgtatcatatacatcatatgtgacactacacagagagagacgaaggtgcagactctgacccctttgcctatagtccatccacagaggaactgttttctcaacccatataacagtggtaattttttaatatgacaaaatttaaaattgtgagatagagcagaaattaaaaaatgagatttgtgatatttattgaaaaatcaaaagatctgataaccttgcatatgttggctacactgagtagttgtctgtatcatttaggtgtgggcatttgtgtgtgcgcacacacattaacagatattctcaagtctgtacaactaatgaatggaaaattcagggtttaaaagcaaatttgtatgatgccaacttcctgtgcttattcatggactcaactactggaaggaagtcagtgaaagtagcatttcacttgggccattaaaaatgacatgatttcacttgactttgaggaatggggcaaggaacagaaaaggatgaggaaaaaaaagtaatcaaaagatagttttgtttctgtctataaacaatcaataactaagaaatcatgctatggtatatatttttattggctcttttctttgttccatgctaattaaattttcttcctagcatgataattacttatgctttctggaagtgcttataaatgtattcctgtagctaaaacagtataacctgaaaaataaatttcctagaaaagaaattcctccaataattgcataagaaaattttacgaagcataccatgtgtttatgtttagcttgcagtaattgcttaaattattagagcaggtgtggcctattctggcttataaagtaaaaagaaatacaaaaagtcatttttaaatgattatctatggtttgcagaagaaggaccccacaaagatatctgtgtccaaattcccctgaacgcataaatatgtcaccgaaagtggcaaaagagaattaagtttgcagatggaattcaggttgctaattagctgaccttgagatgggaacattatcctgctttatccaactgggttcggtctaattacatgagtgcttaaaagtggaagaggcaaatgtgtgggttagagggttgtcagtgtgtgaagtatgtgacactccttgctgcttctgggatgtgtgggctaaatcaagagccataaagaggccttcaggaattaaggatgtctcccagcttacagccatcaataaaacagagaccttaactctatatacatgtaaactgaattctgctaacccttaaatgaactaggatcctacagcaagaaatgcctccctgaatcctttgatcataacccaatgagacccataatacatttgttttaagccatgaagttagtggcaatttattacagcaagaatagaaactaacacattattctttcatttgtatttaacatttaacatgaattaaaataatcataccagaacaattgacaaatttattttatataattttagtgttaatgtagtgcttttagaatgaaaactatataatctacttatatttaacacactcatatttataatgtaatgaagatgtagaatcctttttacttactttctttaaatataggcttattgtcattaacatctgaaagtttaattaatacacttgttgttccagacaacgctcctggctgaccaatcatgtccttggcttgaatgattacccaatactcatcttgcagttctctatccattttagaagatattcttatgactcctttaaaaatataataaaattccaattatttcattattaatcatgacaaagttctagttaatttcttaaccattgcagtatacattattttgctatatgttgaaccactgcaatgtgacagagacttcactagagaaaaataataaaaaataaattaaacatcaacactgcctagagtctagagtgatcatcacaatattaggaacactggtaggcccttaataaaatactatgttaagataatccacaggtagaaaaaaaagaatgtcttgtttttactttaacctattttctgctatctcttctaacataatatcggcttgctacagttaactttgtccccgaaactctgaagttagtatattattgatagatttgtaaattataataccaaatttatgaaataaatgtcatgcccttattattttgaagtctacttagaattatgagatctgaagaagacctggttgttgacccagttattttatgtgtgtgtgtatacacatatataatatattcaaactcaagataattaatgataaatattgcaataaatgcttaaattctataaaattatttaatatacatttattaactatcactgaaaagaacctaagaaaatcttaagacaggttcataagagaggactcaacatttctaaagatttggggaacacataaacagtcacaaaaaataaataatacccaatacccaaatatatcaagggcaaaatattcattaaaaattgtgatattaatgaacataaagatggaaacaatagacactcaggactactagagaggggaaggagggagtgggggagatagttgaaaaacttctgattgggtagcatgctcactacctgtgtgtgacgggatcattagtaccccaaacctcagcatcacagaatttacccatgtaataaacttgcacatttacgccctgaacctaaaataaaagtaaattaaagaatacaataaacttgtgaaaaaaatgacatatgagtataaaatgcacacctgatttcaaagactgagaacaaaaaatgtgaactatctccatagttttgtattatttgttgaaatggtagtatttttgatttattggactaaatttaatataatataattttttaaagaattgttatatgaacttttaaaagataaattagaccataacatgaggggattttagttgcggactaaagtgtttcacacatgtaatcaattatttgaatccaatggaaagcattcaatatgttgcacaagtgctgctagcgtctccctgtatgtgactcaggggagagggacctaggagtctttgttccccattaactgtgcctactttgctttcaacttttcctctcagccttttgactgaataaaggatatgtatttctggatcttatgcacttcagaacttatgctttcagtaatttaatccatgtttgtcgttgtccataccaacgcttctccagcaatgcaagtaatagtttagctaacctgctcagtatagttaaaaagtcagtgtgcagggtaggggctgggggtggaaagaaaacatggtcacgaaggcctggtatgacccagcatgggtttgtactctagacacctccctttcttctctcttctgcatttctccacactggtgttcagttattctaagagtttcaactctttcccacctcaggaatttccctaatttttcccatgccctgaaatcatcttccactctcccttccttgtctacagactcagctaaactttctgatttccgtgtattctgccttgaccacacaacataaagtcaacctgacttgttttctcccactgaaactttttggttttacttcataagtacctacagtggaatgtatgtgtgtattactattcatgtttaatatctatctgtaagttccaagaaagaagagtccattattatatcttgtttttgttactattatgtattgttttaaattttgcaatttgtacctttataaatctagcaagttgtataacatttggtacatattcagcctttctagacctgaatgtgtgagggaattaaagtctaatgttttgaggcattcattgcatataataaaataatttttcttccatacatttgaaaaaataaaggccatgtacattcctgagagaattaagaacataggtactcaaataatattttttagaatctgactctctcaagaaaccctaattgaaaaaggctgagacattcaatatttgctgaatgaataaataagaaatgtttaaagatccaacacaatactttaattctttaagggttttgatataagctggaaatagtattttccttgtattaaaaaccatagaattttacttctttggcacttctcacgttcttgggtgattagttatatatatatattttttcagtggagactataatcttctaaaggaaaaaaaattacatgggcctaatctttgtttaaaacacaaaaattaatttttgtttaatgaattagggtcatatgattgtttaaagaaaagagaaaactgtgttctacttattttatattcaattgattaatgcagattggtagagcaatattacaaaaagaatcaaatattgtattcatgtaaatcagaaatctgtaaaatacagaattatttttaggtgaatgtctcatatcaatgtgtacgcttagccttatactcagacttaatctcagtcattctgcagggttatgcagctgtatttcattgtggttttagtttgtattccctgatgactaatgaggctgagcatttttaatatgcttactggctttctgtatattgttctttgtcaattgcttataaatgttttttccctatatttttaaattgggttgctggtctctttttctaattcatttaaaagaatctttacatatgatttaaaccacatacataagtaatttgtgctatggacatgaaaaatccagtctcctagaagtatcagctaaaagactaaaagtaattaaatgcttaggaattgcaatctttttgcttattgacatatcaggactactgtaaaacatgtttctaagcagataatttttgctgacaattgccttctttagaatcatgttaaactttgcttgtttcattcacaaatacctgttgttggttcaacagaaaaatatggctggccttgaagtaagctgtagaggagacgagcattattaccacttgagggatcgtcagcatcacttgctgtcacctggataactaatgttcctaaagagaacataatacaggaaattaagattgtggttttattcaggatgaattcagttctgtgaagcggtctttctttaccaagcaagatgttgttacaaaatgaaagctcaattcacctccttgttcttaattgtaaaagtaatgtatttttttgttgttttttatttttttcaggcaaaagaatataacttttaatacaaaatattcctaattcctgtatgcaatatggaattttaaacatgtagattgatggcctaataagatgtagctattaaacaattcattgtaatgtataatttataaatcataaacttttccaaggtgtattattagtggagaaattaaaaggaacttggaaatgcttttcaccaaaaattatagtgtagcctgtaccttaaacaaagtggagaaggttgataaatatttacaaagattattgaattgagcttgaaagagtatccagttgaggataaggatgggcataattattcagctcctttaattctcttctctaatatacctacttcctttgatgaattttttaaaaagcaaagtaaaatcttgcagatattgataacataagcattctcattaaaattcagtaacaagaaataaaatcatatggaataattatgtatacatttaaaattagtgctcagatttttaaaatatttattcaaaaatattgagttttcaaagtatctttctgtaaacatggaattgaatgttatggatcttatttgaaatatgtatttgttgaaacactgtttactgtgtcaataagaatagcaacacgaatgacacaaaatcaaatagcttctgtggttttgtttacaactagcatcatgaattttctcatcgtagcccaattttataaactgatacactctaataggaatccattctatacttcactaacatgaaacttttgctgtggccctaaatagtacatattctttgctcttttgtcttaatatttttataatgctatttaacatttgttttaatatcatacagcatattctattgaagtagaatttcttcttattcacataattttatgggtaatacttttacctgattcaaaatgaatcaggaaaactttttgcctctcttttccaaaacttattgaataaccactcaatgtgtagacacttactagtttcagatgttttaaagtgaatttatttagtaatttgtgaaagtttttccaacaaaatagttaacagggaccatcactttcattgatccatattgcgcaagacttgttcctttaactatccttctatgcaccgatccacttacttatcccacatttcctcattataattctctatcatttctttccataaggggttcccatccctggtttctagaattatatttcctatctttggcttcagatacaatcatcaaaatcataccattttcagagttgactgaaataaattttagtaatatcagtctttagagcccctaagctagtactatacaaatgagaaccaagaagtccagaaaatgcaatgactcacaaaaggtgacctcacactttgatgatagaaatatgtcatacagttaggttcttttttccagtccagtttttttagcatgctttttctataaaataaattttattatatatatttaaggtatgcaacatgttatgcatatagatagtaacatgattactatagtaaagcaaattatatctatcatctcacaaagttacccatttttgtgtgtgcatggaaagagcaagtaaaatctactcactcatcacaaatctcaaatataatacaatattattaactatagtcctcatgttgtacattagatctctagatttgtttatcttacttatctgatactttgtattctttgacttacatacctccatttcctccctcttcatatccccgacacattattttattctctatctttctatattgaactttttttagattccacatataaataagatcatgcaatatttttattctgtgtctggcttatttcacttagcataatgtcccccaggctcatccatgttgtggcaaatggtaagattttcttctttgatgagacttaataatattccactgtaaatatatgacacagtttctttctttattcctctatctgataagggatttatttaagagaactcatacaactcaatagcaaaaagccaaataatcagattaaataattggcaaagaacctgaatagatatttctccaacgaagacacacacaaataaatggccaatggttatatgaatgggttctcaacatcactaatcatcatgaaaatgcaaataaaaactactatgaaatatcacttcacacttgttaggatgtctattattaaaaagacaagagaaggcaagtgttggtgagagtatagagaaaagggaacacgtgcactgtaggtgggaatgtagattcatgtagccattatggaaaacaatatggaggttcctaaagaaattaactataaaactactatatgacccagcaatcccactactgggtatttatttaaagaaaatgaaatacaccactagtaaagatatctgcattcccatgttcactgcagacttattcacaatagcaaagacatggaaacaactctcatttctcttgatttccctttgtatctgataccagtgtgtactccttacacacacctggattattgtgcctgctcagtaacctactgtacacctgttctctcaggtctcctcttgatcacacccatagaaagcaaagaggtagtgacatgccagagcaggtgaacattttttactgatgcttcatttacttgtaaccaaaagttacttcttcagtgtttttctcctgttgtctactaagtggagaatctaatgtattctgttaatagattacacaaaataatttccctgagtgtgtagaaaatctaaaaggtcaaattcttagaaattttagtggaaaaaatctgtgatattataaatattcagaataccactcacacatgaatttgatggggattttaatttctggggaaatatttgttattctttcttatgacacttgtggcattttaaaagaaccaaggctatagaattggtgtaattcaacaatgttttagaaatgcttactttttggtaaggactatcaatgagtattaagtgattcactccttacattttttgtgtgtgagaagatgtttatgtgtatatataggcatatatgtatacaggtagatctaagtatggtgtatttacatatgtgtatatatacatgtatatatacacacatatattttcagtaaatgtgtgttttacatttactgaaaaggttccctgatgttcagctctgccaccttctcatgaaggggttccctatatttgtataatcttatctctgattctctagttggctccactagctattcattgctccagggcaaatattcttgtctgaactactgtagttttgtcctaggcgtttgctccttattagtgcaactcctgtaggtatttttcttcaataaaattgccttgcagaggttgcagtgttcagacatagcgccattgcactccagcctgggcgacagacatgtatctgtatctaatcatatatctttatctcatatatatatatatataatatatatatttaagagggcaaaaatatgcagcagtatttccaaatatttagtgcttgtagtttttctcttaatttttattcatgccttggaaatgttggctgtaaaatttagatgaatcttagcaatgctcgatttttacaggaccctaattatctttgtttattttatttagttgttttctactttcttttccctctttcagttattattgacaccatgatttataaaacacagtttaagcaattttaaatcctcttggattgtttctatgtttttaaagagaattaagcctgtatgttttcctaatgagtaacttgtattcggcagaaatcctcaagaaatagtcaagtaacataaagagatcacaataataattaaatataaaagcagacagcaatacaaaaatatttaacacaattgtaaatatttatatttttataaagacttgttatttgtaagcaaatcaatttgtacattcacctgtagttaggaattagttttatcgtccacataaaattgaaaatattactatgaaaccaataaagtgtctttcagtggaaatgatcaattgtcttatagtgcccctttcctagttaaatataggttaactaacacttgttggtttagacaacgaatgtttaattcctacataattttttataagaacatatgtaagtatttcagcatttgtctgtaatatcagaactgtgtcatgtttgagtcatagtgaataccaccacaatgctcttttcaagtactggaggatttctaggcttatgtaattacttccgttcatgtcctgattattgtttactgtcagaatcactccgaagaggtttatgagaaatgcggctcccatccccggtcatcccatttcctaaaaacaacccactcatcactatgaattgctgttgtgttctaaaatattatggctactattctacataaggaccattgtttacacaggccatatctgtaacctcttgaaacttttaaaattgtatttccatggaaaatatatttcaatttttttatataaaggagaaaaataaaaaaaacaaagtacatctaaaaatcaacttacatttgcaataaaaactttttaaaaattaagaataaaaggaaactttctgaatctgataatgaatgcttttaagccttgacagtaattatatttaattgtgaagagttaaaacttttcctctgcaataataaaaagaaaaaaatgtttttctgtcactattatttttttcggcattgtactgaacttcctagacaatgcaatgaggcaataccatgcagttataacgcatttatagacaggtagataaataaatattggaaaagaataaataaaactaaataattaaagttaataatattttctgctagaaactcaaaatatgcatatagttacagaaaaacattaaattcataaatttagcaagtcaacagggacacaaatgttatataaaagtgcattttttaatatatgaatatatatatgtatatactctggcatatatatattcatgaaacctattttagttaaatatataatatatatgaaaagaaataaaatattcaggaatatctaaacaaaaactgtaacctctgcaaaacaactaaagataaattaatgatataagtaaatagatgaaaatactggatttaggaattagatgactacttaaaaataaaaaaatacacagcttaaaagctagctcaatcaaaatcctagtggactgtataaatggttaacttggaaagacaattaaaaaataagtaaaatttgtatggaaaaacaaggaccaagtatggtccaggcattttttgtttgtttgtttcttttgttttgtttttgtttttttgagaggaagtctcactctgtcgcccaggttggagtgcaatggcgtggtctctgaacactgcaacttccgcaaggcaattttattgaagaagaatacctacagtagttgcactaataacgagcaaacgcctaggacaaaactacagtagttcagacaataatatttgccctggagcaatgaatagctggtagagccaactagagaatcagagataagattacacaaatttagagaaccccttcaccagaaggtggcagagctgaacatcagggaaacttttcagtaaattctgcaaggtcagcttgatatctccatttatctgtccatctatctaacaccaattttgtgatataaaatttggcacctgctttacacctttcacaaatatcagcttaaaacagactgtagatccaaatgtgaaaggtaaataataagaaaaataagaatataaatattagaacaataaaactttcagaaaaaaagaaaaatagagggggaaaagcaaaaatttcagaatcagggcaaatatatgtatataatatttatggaaaacatatatttagtcctggggaatttgatatttttctcaaagcccaaatctctttttcaatttgttaaacatattttttattactcttcccagcctggattggttgttcttactctactgaagaagggtagcatatttagggtgcattatctgataagaacatgaagcatggtacaggtcatatatacctaacctctttagtctctcttcattcatttgatgaacattttattatgatagcattaatacttgcaaagtgggtcttactccattggtggatcaaaaattaaattctacattttatactggaaataggtatttctaacaaaagacaaataatatatatgaacattaataaaatcttttttagagaagattttaacattaaatatagcaccagaagaatattcttcataagtatttacatcatttaatgagtttcttagtttaactattttatcatacagtgcctttgggttatcccttgtcctctttcagatttaactatatcttaagagaagtctatttattgctcatttgtctgacagactgtttctcacactccatggaagaagctacaagtacaaagtaaatgtttgaaaaattcactctggcttattttaatgacttaataatagtcattttgtaaaacagaaaatctgggacaaatgcttctaggacatgatgacagaaacatagaagtaaagcagaactgtcctgggtaaaactgaagatctggtcactcaatctaccttaaaacaacagtgacaatataaagtggccaccaggatagcacacaaaatgaaaataacgtagcacgagttgtgtatattgaattgccacagccttaagtcctattattccctgcaatacaccatccagtaagcagaattgggtaactaccaaatgatgggaactctgaaaagtttaaattaatgagatccttgaaatcaaattagcaaggaatgtaaacagagagtgaaaaaatgctttttgggggaccgaagggtccaaagttcagcatgcatacctgagtggggtcactgtggctggatcagaggtgccagtggtatttggaaatgcaaagaatcaaaatgacttgtagtttgtatccattctaagtgaacaaaagtgtgcttagaaaaaaaaattctcttagaatcatactttaattagagtagcttatcagttcacttattctgataataaacatacaaatataattactaatgtaatcttgggttccattattgtgtggacagttgacattgtttgcattactctggagagacttttcataattgcaaatttaaaatattaattatgtctttctagctagtttccaaatcttggcaacttttcatagcaaaaggtctttataaaaataagttcaacacaatatttgactttgcttattttatcaatcacattctttgcagaaacttattgtaacataggtcagtggtccttaacttctttggcaccagggaccagtttcgtggaagacaatttttccatggtcagggtggggagtgggcatggggatggtctggggatgattaaagcgcattacagttattgtgcactttatttctactattactacattgtaatatataataaaataactacacaactcaccataatgaggaatcagtgggagccctgagcttggtttcctgcaactagatagtcccacctggcagtgatgggagacagtgacagattattaagcattagattttcataaggaacatgcaacctagattcctcacatgtgcagttcacaatagggtttgcaatcctatgaaaatctaatcccgccactgatctgacaggaggcggagctcaggtggtaatgcaaaccatgaggagcggctgtaaatacaaatgaggcttagctcttttgcctgctgctcacctcctgctgtgcagcccggttcctaagaggccacagacaagcaccagtctgtggcctggttgttgggaacccctgacataggtgacacaggatgtacacttgtaccacgtgcttgaaaggaaaacgttagtttggtcatctctggaaattgcatttactgatatatttttcatttttatgacagaaaattttagtgtgataatagtatcttaacagaagataatatatttgttgtgtgtgtgaaatgaagcattcttgtaatgtttaaaggtgctaacctgtataaaactacatagaaattttaaagattgagagcattaatgaaagcatcaataataatttatccaaacatcagatgtattctgccatcactgagtaaaacctgaggtaaaggtagtgtaactctgtctctgttgagttatgtaaattttattattaaccaggagttatgcagaggatgaaactattctcatgcagatgtttaacatggcttacaactttattaaatgatgttctttcctgtgtcacatagaatgctttatccactggtgattatgggaagcatataaacaaaaaatcataaaaagtgaaaaattttcctatgcagactaatttagatattatgtaagcaatagagaaattagcaacctgtggcgagggcattttataattaaagcttacatttattatggaatactaaagtacaggtgccacagtatgctatagtgtttgaatgccaagattccagctgtagatttcaaaatgacatttactttagaatgttatattttattcattttgaattcaatagtaaggagattaactgttcttttcttacaatgtagatataaatttaatggaaaagctatttttacatccagttttagtacaagtatactttgattaatctgaaacaaatttattgagatgttgggttgtataattgtcaacttcaatgttatacagatcaaataatattatagtgatccacactctgcatatgtaatttctgcaacaataaaacaggattaagatgaatgaggtgatcaaatgatcaaatacatgacataagagttgtataggtatatctgctcactccttcacattgggaacttattttattagtacaaggataattatttttctaccagtactgactgacccattcttgctgcatttatacttgagctgcaattactctacaacctaaagtctcgaagtgaaactcaggaaacagataatattttctcacttgtcatcttaactgggcaaagtgttcttcaaattttttatttttctgtccatagtcacctaaaaactaggtcatttttattatttttgtgctgcatttttgacacctctactttttataatctgagataatggaatttaagtaaaacaaattagactgtgtttaataaatcaaacaatattatatttagaagaataagaagagaaattcatcccagtctcagtcatgttcaactcatgttcccaaaggcaagagatttatagaatctaattcacaaatgtgataaattttgaaaattcatgattttttattttcctgagtattaactgaaattaaatttgtatagattttccatacaaagcttaaggtgaatttaatatttctataaaagctctcctttatgacatattgtaccatattgttgatgaagaatattaaattttctatatgcttttccaaaaaatgcaacttaaaatattgcataataattacagagatcattataacatattatatttgaatttaaaatctgaaatgccaaaataagcttccttaaatagtaaggtaaacagagtcttactcactagttatccccattcattttcaaaagcatctggttttgaaaataaaaggaaatggttattgcaagtggaaggaatgttggacacttgataatattaaaaatgatgccctcagtgactacagatatgaaaaatttggtggaggatatttatttggaaaagctccaaagagagtggatagtctttttactagacaatatattctccttgcttttattaggcagaaatatgtgaaactaaattttaaggaagtcagattttaaattttccttttgcatttgcacatacacagacatataaacaaagtctattaacactaatgatcattcataatgtgtacaatatcaatatctatttattatggttgttttccacgtaatgtgactggctaaagcatgtttcacttttagcaggattttgtgctgatttgcagaagataagttacccgactctgctttggtttaattgcttattaagtagtatactacacgtattttaaatgccccttcttttttttttttttgacattataaggttttaggtaaaactagcaaatattactgaaatggaagattacatatttgataggctggctattcagatacaatttcagaatgatttccatgaatttcacatctcccgaaatcttctatttatatcctaaactattctaatcacttatttagcatttttttgtccacccatgtactcactcatttatttattcaatccttccaaatctcagtcactctatgacttgtggtctaataaatcttatatttttggatggcagaaaaatagtaactttgcaaatccaaagtgacaattgggaaagcataatgttttatctcaactctacttgaaagttctagtttgaagttaatttcatttcaaacataaatgcagtcagtaaaagcccatcattacttgtaaagaaatgtgtgtttaataagcaacaagttaataattttcttgattttatctcatgacataatgaaatatggattcccttcagtaattcaaaccaaattctgagttcaagtgcagattcaaatataataataggcagttcacttcaatacaacagaaatatatgtaagaaaaagaaacagcaaaatgtttgcaatagttgtttttgaagaataaagtagctggctaggaaatttggaagtaaggtcaatattcaaaaacttaaatggccgtggatatagaaagataatgaagaattgaagttatatttaggtaataaaacccgcagtattcattaatttaatactgagattgaggaaaaaagataaatcacatataattttattaattgatttatttacttcacagtcaacacaaatgcaggaatgcttcagaaggaaaccgttgctagaagtttggcaaagcaatagaaatattcccctatttccatattatataacacttctaatagcaactgaccatcactcagctggcctctccctctcatggaaaggttacacaaagtgctcattagttcttgcatgatttcatacaaagcctggaccctaactggcactcacacagtatgtattgattacacaaattgaaaagataatttgtacctctatctcaaattgcaatgcacaaagagatttgtgcttgctagatattgcacagaccaaaccatcttttgcaatctctctgaacatctacagtggggctgcactgataccatgataccaataattctctcatgggttcactacccaactctgtaaaatggcagtattgtacctcctcttctctaaaattttacccatgctctctcaattactgccttcgcattatgcttcactgacaaaatagaaacgtttattaactgattggttatgaacaaatatgttaacatataatctgtcccttctataagtacaatggattccatgaccctttctttttttttttttttttcaagaacagtgttttagaagttatgtccttttactttgcttcaaataatattattctctggaatcattccccatagtatataacagtgctgttcaatttcctttcttaaaaaacaattgaatagtcataaacaagcaaaaagtcctcttgaccttcatctttttctacctagcatctcacatttcattttctccctgtggcgtaacaccttttagacttggcttaaatcattattacttcctcttattcttccttttatgccatacaatagtcttcagtgtgctgtaatagcacaaattaaactgttgtacttatcaaaaaaccaggggtcttcaacttaccaaatcaaaagtcaccactctgtcttaatcttagcctcacagcagcattacacacggttgagggatttcttcttttggaacatcttttctcatatttttcccttcttcctacaacgcttgccaatcccactcattctaatttgccagccgactgctttttgcttaacagtcaagtcagcctggatgcttttctcttctccagctacgttctctgccaaagggatctcattcattgccatgcctgacatacgtgttatatgttgatgacttccatattgatgtatacagccctgagcactctgctatggattcttttttcctagaatgtggtatggatggcctctttgtataattcacctcaaatatcacctcctaaaatgtcccgtttcctccagacaattaataatcatcatacctcacccatacataacacttttatactatacatgatcatatattacctcctttaattaaaataactatttcttatttgtatataactaaaatgtgtttcatattagcaggtaactcctttatctcctttacaattttatctatagtttcaaaggaagattcctagcatgttacatcataatatatgcaagaagaagaagaagcagtggcagaggaagaaaagcaagaagcagagggaggaaggaggaagagagggaataaggagacagaggggagggcagtaagggaaaggagtagaaggtggagaagggggaggaggagagggagggatgaggaaggtgaactgtttctttgcctacctaccaaaatagagtaatttaaagtgctatttacatctcataataatttgtcttgatatatattacacaggcaaatttgtttctgctgtatttaaagacctatgttccaaacaatgtagaaatacatctttaaattcctacctggaatgttaaaaatcaagaatcagaaaattatatgatgaaatatgtatttttggaatcattggctaatgaatcaagtaatgaggtaaagtagttataagcatgttaccgtaatttaaaatggccattatcaagtcacatttatttgtcactgttaagtaaatttttgaattaaactttccagtatattgtgctacaaaaattttttgagtgaataactgagagaagttgtgcataatcacaatttcccctttactggaaagacatttctaatttccaagacagtcaattcttatatcttatggaaaccattctctcctaaatgcattatatttaaaatattaacaacaacaacactgggttttgaaaagtatctttgaataaacacagccacacacaggtgttcaaccacttagttttgtcttagtggttttttcttcatgattttgatgtatacaatagagtctaataaattcacttttcctatttttatgcatatcttgcaggattatcttatttgcttttatgagatacaaaaatatattttgttttgaaaaagaaattcttgtacttaagaacctagtaaatgaacaaggtctaaaaacttacgaattgctcaaataaacatatctaaacttcttttattcctgtgaaggctgagatattttaataacattaatatgtagtacccttttctcaaaattttgatgcatagtctaatttttcaaatattttacttaaacatatttgtagaaggaagttctagtatagacccttaaatcatctacttccaaaacatatccttcaaattttaaacctgcttcattgttaatatatctttgatgtaaattaatatgcaataccttctggagacatctctggtacaatggcctcataaggttcatctaggaattttggttcattgtcattgatatccgaaactttgatgacaaactcagactcaggttccacagcccttccagtagcgatgtctattacctgggctcttaagatgtagagggatcgctcctctctatcaagcttctgtatggcatatatgtcacctgttctttcatcaatgataaaagtacttccagctccagctcccaaaagcttgtactggaaagaattgtttccattgtctaaatcagatcttagctgcaaatggaaagagggatcatttagtttccaaacatctgaaatggacaaatcaaaatcaagattttctttttatgtatgttaattattccccaagttaatgattttatattatttccacattacattaaatgaggcaaaatattaatatcaagattaaaatctatcaccagggagaaggaagagtgaatatttagtgtaaagaactatacacatttcattattctaaacagaaacaaaaataattggataataaagcttcttttgtaagttatgcacaacatagttggttcagtttttatttataattaaattctcagtcactaaaactatactctcaaatatttatactagattgggtccttgagatagatagaaagacaatttagtgacatttaaacactgatgttctatctcttgcatgaatatacatggaaacaagaaaatattaggatgaaaattagggttcataaagataatgataatcttgactgttcattaggtatttattacatgtcataaaatctataaattgctttatattagtgttctcaagtaattctcatatcaatattatgaaatacatattattgatatgatcaatttttctatagagaagaaaagtgagattttgttttacaaacttttttcagagtcatatggtctttgtgtagatatagaatttacaccacgaggctatcaaatcttctatgaggctgtcaaatttcagactgtccactgacaacaactcagttacatcttctttagcccttgggttttagccataaagtataaaactttcttctcaatatattctacctaattctcaaatacacactttcagcctgtgcactcattttcatattttcaaaaagcaaagtaaattagttcatcattcatactgttgaggtattatttagaatttttaatttatctgtaaaaaaacccgtctaattctgatatagttaaaatgatcacatagcttttcatatcagaattatttgtatgtaagagaagaatgtcatggttccctaatcattgtgaatccacattttcttgattcaccatttatgaaaatgctcttattcacagtaagagttcctctgaaaatttacaaagataatcatgaaatcagttgtaaacaaattcatgatttttctgatggcttaagttataatttcttatactggataaattaatacactttctttgcggttgtggagaaaatctgaaggtactagtaactaattttgcattttaataacatgccgaatatcaatgctatgtaatgaaaaataacatccagattgtctttctggtaatacttcttttgatagttcttaattattcctaaaagaaattcttcatgcgatgatgtaagaaattgaggaacaaattatacaatcaaatcaatatatcaagtgagcaatgtatggttcatatttttaaattatatcatttcaatatgatttgataatttatttgatattataatgaagataaattaagtttagtaataagtaaatatattgcaagtatatgtgcagtgtaattttcaaagacaagtaagcttgacatttttaagacccagatttaagggaagacagaaacaaaaacgaaaaagcttacttgaacaccagccttttaatgtcataaaatgcatatgttaaacacatttcaatcaaatggcctgtagtattatacaattttctatatttttattcaaaaaatattttcctaattaggctgctactatcaatttgctaaacaaatatcacttcaaattttcacttaattgtacttcccaatcttaatcatttttcaaacaaatggatcaaagagagttatcttgaacgcagcagctaaattgtatatttactaactcttttgacaagcacctaaacattcattattgttctttttgaaatcagtgattcacttgttttttaagcctgatgagtttgtgtagcagaaaaacatttttcagagtagtttcataaatatgtctctgaaatgaaaaaataggcaaaaccaatcactgtgagaaaggaggtaaacagagattcatgtggggagtagaaacaaacaaactagaaaatgtgacagccccagaggtggcctgtgttccaattacactgatgcacttccctataacaccttatttactaaaagccaatagctgattttagcctgtcaccccattcagtgatgggagagtatatggtgttctgtgcagtccactgtaaaggtagctagagactcagttactgagtcggcacctaactgtggaccttcttagtgccaactgtgcgtattatttacctgtagtctgagtcgaaaataaaaggggttgagaaatatttcttgtaatgtgtgtgtgtgtgtatgcgtgtgtgtgtgtgttcacaatacaccctcctccctgcacgtttggaaatacttgcctaaaatcctaatctaaggctttggttgaatgtactcatatacatttggctgataacacaggtgaagttctatggaatccagataccatgctaacactgcagctctcctgaaagggctagaaaatgagagttaataaattttgagtgcttcaccctttgggcccaattaaattttagtgccagttaattagcggttaaacttatttcagttcatttatctagagaaaaagccttatggaaaaggacatgatattgtaatcacctttgtttaaagaaaaccaaataataaaatacaagccaaaaacataaataggagatgctttgtctcattaaggaattgttcttaaaatatattcttttaagaaagtgaacataattattccttttactttaactttactaatcaatttaagtgtgtaggctcctgaagctacttaactgtaggagaatatggtattaacctgcttcattaaaaatgaacgaggggtaaatcaacagctacttagcgtaacagaaaatcgggctaaatactgttggtaaatgatatttgtctcactgtgactgcttagattcattaccaaaaataacgcaataaagtttccagatgttgaaaatgagggctgcattttcatacgggatactgaagtgaaatttaaaaaccagagctatccctcttcaagattttagtggatgttttaggtgcttgcaaatctgaaacaattattgatgctgctgtttgaagcttttcaatggcttcactgtaaaaatgtggaactcatcaaatctccaaacttctccaacatatttatttacattgttgtgctatttactgtaacattttaaataaataagtacctggccgatgtgatgactagtcgtattcatttcctctggtacaaaaaattggttccacacccagccacgcttcactctcaaatgagatcgcactggctgcttgactttctttgtttgagagttttctgttgctccaagacaaggccataggagaggaattcccaacataaaacgcagcagtaaataacagttcattgcgttgactcttttgattccaactattactcttcagaggaaacaggacgtcactaacaaaaatcttgctttcttttataatcttttctgattctgtgtaccttctatatacctaaagcgtcagaaacaaaacaaaatttgacattttaaaataacattttctcacataattactaaagacaggttacaacttctgcatctgacaaaagtggaataaaaataaacatttaatttatcttccaattaagctggctaattatgatttgtagctcagcaataatttgattagaataattataaatttccactcaggcactgctagttttaaactgcagtcataaatctgcctgaaagttgaaagattgctctgggagtctcctggattgacagctgacattgagatagacttccttttaatttgacttgcttactttctccattctttctcagtaaaatacaaactatctcattaaagcaacagtcaatccaggaggaaaaaagtcttatttttcctttttatatttgatagagataagcttcctcatccaatttcccaaattatggtattttatgtagtaattaaatagacaaaatgacaattcagcttaaaactggtgaattcaataatcagttacactgatactataaaacactgaatagaaagcttgcataagatatttactcttttttaatttcaaagatatggggaagaagtgtttatcagcttaacaaaaacaaaatcctcttaggacaataaatacaaaatgattgttcctgggtaagaatgggtgaatgtttgtaatatgtaagaatgatatgaaatgtatcttctagtatttaaatattaaaacaaaagactctggctattgagttttacatttaaaactttccattgacccaaggctctctcttcatgatgggtacctctaatccttatatgtaacttaatagttttgcatttccaacatctacatccagccaaatttgatttattttatgaagaaaaataattttgtaagattcacaatggagtttaatgtcatataatcaacagaaaagccagagttcatgttaggactttttctacatgattgtgttttgaatcttctgcatgtatttttgaatgactccttagagattttttaggtctttggctcgtgttaagaggagttgttaaaaaacacctaattaagaaagtacacagggattctgtggtcccggtatactccctttaagcagatgtattccttgttaaaagtttacttaatgaaggtcatagagaaattcaactgaggtgaaatttatctttatgttacgtatttgaaattcagataaatctgctctttagaaattgctaaaatatatatttttggtagctgatgaataaaaatatttggaactggtacaatattattcatgaaaaagattttttttataagtttggcaaattattaccaacactgatatgaagttagctggctgtgtttcagtgaatataatttttgggaactttatattatggtattttgatacatataaagataaataaaatagtgtaatgaacacctggatatcattaccctgtttcagtaattaccaacacatggtcaatattgtgtcatttctacacgtgctcactttttaatattaaaaccaatttcaaattcatatcattttaaccactgaagccacacacacacacacacacacacacacacaagtatacatgttatgtaagtgtgtatacacacttttaaacatcaaagcttaaaattaagaaaaaattttaatataataaaatattcatacagtgttcaaattaaaaatctttatctttgaattaagatttaaatatgtccacacaatgcagttttttggtacatttctcaattctcatttggtctacaggtttcctccaatttttctttccgtttatatgctgaagagtcaaggttatttgtcctacagagtttcacatagtctgaatgttgctaattgtatcactgttgtgtgattcagtatgtttctttatcctccatattttttataaatgtttaggggcttgattagaagtaatataaaatattcatcaaaaatattcatagccaatcctattgcatgacatctttagtagactaggacacaaaatatatgttcaagagaccagaagaaatgttgaacgtgttaagcagaaaaattgaaaaaataaaataaagattaaacttttagagaataatactacaatgtctgtgatgaaatacactgcatatgattaatggcatattattcacactgagaaaaaaaaacagttaaactgaagacaaatataaatcttctgaaaaaacataatgagaaacaagttaaaaaattaaaaatgaacaaactatcattgagttgtgagacaatttcaaacattctcatttatgtataactgcagtttctagaaccaatgaaatttagaaactcatacatccaaaatgtttaacaaaacttaagcacaggtgttaaaaaatattataccaaggagcatcatgattaaattactcaaaaccattaataatgagaaaatctgaaaggtagacaacgatatgttatatatagaataacaaagataaagttgttagcagatgtctcatctcaaacaatgcatgccaaatgacactgcagaaacatttttaaagtattgaaaatgaaaagaaattaatccaactgagaatttctcaaccaatcacaatgatttttgtaaagagatcagctgaattgaaagagaagaaactgagctgtcaggtattggaacagctaatccaaagaacatgtaaaaaaattaagaggtaagcctttagacacttagtgcaatagtataagcaagaggctaaaacaaaagaaattgttgcatctccttttttcatttcctccatggaacagcactctaattcagaggataagcacagacctgtggatcatttcattataatggtagtgctacaaaaaactaagtcattttttatggactctggggtcgggggagtgcaaggggagtgttaagagtgaaaaagtactaagtacattgtcagagtgggaaactgtcttcaaggtttcacccactttactcaataaggagacctcatcagaaatgctggagaaagacctctgcccaaggccacagataaagccctctttacactttaacactggggctagtaatgcaaatatgagaagagcatgacctaacagaagggactgtgtccttgactgcaactcccttcagagaatgcaatgcactggttgtgcatcaaatctggtgtgacaagggaatgttttcgcagtgactactgtactgccaggtcaagtctttatagctgcctatcaccaggcctgaacaaatcacagttgttacaccaaagccgtattcctaatcttcaataaaggaaagtgggatgaagactctttctggtgtacagcatcagcacacaaggggaactacaatacgatacatgattaaatgagtccttcaagaagaaataaaataatactagaaggaaatctggatctatgcaaaaatagaatcaccagaaatggaaggtatatcagtaaatagaaagaccttctttaaattataatatcattaaaggagaattggctgttaaagcaaaaataataacaaagtattgtggagcatacatcatttacagaagtaaaatgtatgaaattaacagcataaagattaggaatatgctattttaagctccataaaccatatataaagtggtatgatataacttaaaatagattataataatggtacatgcgcatataataaacctaaagcaactactaaaataaaataacagagtttactacaggctacaaaatagataaaactgaagcctaaagaatactcaatctaaagaaaaaataaaagaaaaaagtgagcaaaggacaggtgaaaaaaacatacaagtagcaaagcagtatgtttaatattaaccataataataatcactctaaatattaatgggataaaaaaatcaaagtatgagatgaggattattagatttttaaaaagactcaactatatgtctttaaaatgatttaaaatataaaggtacagtaggtaagaatttaaagaatgaaaaacatatatcttgctcaactctagtcaaaagaaagctacaatggccataatattagataatgtagattttgggacaaagaatattagcagtgataaataatatcatttcataattataaatttcataattataagtgataaacatatcatttcataattataaatgataaacaatgtcatttcataatataaaacaatatcatttcataagaattatgtcaattcattaacagggcacaacttttctaaatgtttatacacttaataacaatgcctcaaaataaatgaaatacaagatgaaataaaaccttattgtattacaagaagaaacacacaaatctataattcaaattgattcatttctattcaacattatactgaaaattctatccaatgaaataagaaatgagaagcatctagattaaaaagataaaaatatgtttatttacacagggcataaatacacatatagaaaatcttatgaaatctataaaaatactggtaaaatctataggtaactttagcagggttggaggatacacggtcaatattaaaatcaattatatttctatttactagcaacgcataagcaaaatttaaaatttatacaacagtacattttataataatataaataattcaaagattgggacataaatctaacaaaaatgtgcaatacctctctattgcacactataaaatactgctaagaggaatcaagaaaaatcaatatgattggagatatttatgatgatactggatcagaaaactcaaaatggttaaaaatgtcaattccctccaaagtgttgtataaatgcaattttaaaaatacaattaaattaaaattaaaatacaaaataaaattccaaacaggtatttttataaaacttacatgctcattctataattatatatgcaaaagcatggggcttagaataactcaaagaacattttaaaagaagaggaaatttggaagactatgccatctgactttaacacataatgctacagtaatcattatggtaaagtattggatcaacaaataatttagtagaacaaaccacaaagtgtacaaatacacctacatttatgtgatcaattgatttttgaaaaagttcaaaaggtgaatcaatggagaaataacagtctttgtgctaaaacacctgagtattcacttgagaaaaagatactttcatccatactttaccgtgcatgaggtcacaaaaagtgaatacaaatttagatgaaatacttgtaatttctttggcaaagatttcttacaacaatatcaaagtgcacttgttaaaaactgttaaattggaccatatcaaaatggagataatctctgtatcagatcccattgctactgtaaagaattcccacaactcagtgtcttaaaatgatacacatttattgtcttacagttctataggtgagatgtttaaaatgaatttcactggactgaaaccagggtgccagaaaggtcatgcttccacccaagtctctagaggagagtctatttccttacattttccagcttctcaaagtgtattctattccttgcatgccttggttcatattccacctctaggccagcagcagagcatcttcaaatttctctctactctatcttcacattggcttctctttgttgtgttaaatttacctcttctccctttataacgacacttataatttcctttaaagtccacttggataatacaggataatcttcctacctaaagaccattaactgaatctcatgtttatctacagagatcacagtctttggttttaggtgtgaagaccttgatatctctgcgagccattatgtggtctacctcagatgataattacatgaggaaacaagtcacagactgagcgaatatttgttaattatatatcttgtattcagagtgtacaaggactttcaaaacttggaaacagagattcatcacaatttttttaaatacgcaaaatatttaaagagacatatcacaaagagttgacatgtaaaataagttaaaaaatgataatcaacaccttcagtttcaacgggtaaatgcaaattaaaactacaatgagataccagtaaactcttactagaacgaatataattaaaagactgaccttatcaagtactgaagagaacatagagcaactgtacctctcatacactgctagtgtgaatgtaaaatcgcatgactatttagaaaacagttctgcaatttgttaaaaagttaaacatatacctaccatatgatccagccattctagatattagctagatatcaaggatatctatctagatatctacctaagacaaaataaaattatatttccatatgaagatgcttacatgaatatcagagcaggtttatttgtaacagaaagaaactgggaaaagtcaaatgtctatcaacaagtcaatgtactaagaaagtgtaatatgtctatgcaatgtaatgatactcagtagtgaaaagaaatgaactactgatacagtaatatccaaaataataatgagtaaaacaagcctgccaacaaattcaggttgtgtgtttccttttgcatctaattttagaaaatttaaaacaatcatagtgactgaaatcagactaagaactgtgggaaaatgggggtgggaggaagatcaggagggaaggatgatgaagggacatgaggagacttttgagggcagtgatgattgtgctcattatctgtattgtgatgaaagtcttagaagtagaaatatgtcaaaaattcaattcaacttgagtatatgcagattattgtgccaattatacttcattaatgttgttaaaaatcttgacttgtcaaaacctagaaaaacaaattagacaactaaccgtggaacaacagataatagatgtttctgatgtgttatgatatgacctttataaagaacattgcctataaagtattttaccaaaaaaagttgaaagctaattttcaagttatgggaaattaacctgtaataaaagaacaaattaaacaggaaacaaagtaaacaaagtaaaaggaaacaatcaaacaaacccaaattgtgtctttctacagatttgctacccacagtgtaatctgtggaatagcagcatcttactacagatgcgaaatcttgagcttcttcacagataccgactttgagtctgcattttatcacactcaccacaaggtctgaatatacaataaattttaaaaaagcattgatctaccacaaaattgatctagtttatttgacatgtcaaaaaaagcaggagtataggaaagatattgctctagattaagaaagatttaagatatactagaactagtgtaaaatgtgggcattgtttgggtcatgactttacaaaactgtttttatatttgcatttttatggatttataaaaaatttagtctgtataaggtataatacatactaatgtagagatgagcaatagatgataatgagaaagtattgccagtttttttggtcattgaatgtttctttcttgttatataaaaacacgccctatttttagtcgtgtatacttgaagcatattggtattagaaatgacagggtgtcttgagaaaaagtatattttctttaaaatatctcaaaaaaatggaagataggcaaaaccattgtggtaaattgataataattgttgagttcgggtcacgagtatttggatagttgttcttttattattcacttatgcttaaaatatacgtattaaatcaacaacaaaaatatacagcaattcgtacttttaaatcaatatgttaaacaaatacaagtaattactgtaataccagctattgatgacaatgtatagaaagcagaactatacaacactcataaaatggaaaatttggacactattttggagaataatttggccaaaagcaataaattttacaatgtgtatataaagtagcagttgtattttactattttatacctagagaaatattcaaatttttccactgggaagcaagtataaattggattaattgaaaaaagaatgtttaaattaggataccatatgataataattatataagtgtttcacaattacaaggcaatgtcccataatactcttggcataaagcaattagttaagttagtaagtctaggcagagaaaactgacaaaatttgtcatggtaattacaatgattgaaataagtgaaatttgtctaaaagttgaaacttagaagtttctgcaagattctccttcctcgaaaacagtttaaagtaaatatgacaaacaacaacactcatgacatctgggtcatttttctaccaagtgctatttttccctattaaatatatgattgaaatatttctcaattcaatttaaagttaaaaatcatcatttataattctaaggaaaaagccctttaatttgaacactcttagataaaacattcaagaaaaatgaatggtagcagtaggtatatctcaataatgaaatactgtggctttgtttatactcctctatattccaaactttctataatggtcatacatttcagcagaagtgaaaaacatttcacataatgctccacttctgattgaagactggtggcagctgtcagcattgctagactgagaaacactctgggctgaaaccaggcaaataagaaaaaatgctctcgcctgaaatgggccctggataaaccagcagtggcattttgccctgcatttccaatcttgtttatattttccaatcagatgaatatgctaaaaaatctacctaacatttcagtatgaagaaatgctaatactatgtcttatgttagtgtgtttttatattttctcttattgctaatacctgggaatgttaatccatatttattttcaaagttgtaaatatatttcaaaataaaagtgcacttatattagcacaatattagatactaaactaattataatcatatttaaatagcattattataagaagaaacaacatattatggccaagtaaaattgcgagtatgtttgtgatgattaatattaggtgtcaacttgattggattgaagaatccctagatagctggttaagtattttttcttggtgtgtctgtgagggttttgccagaggagattaacattagagtcagtgaactgggagaagagtcaccctggttgtggttgggcaccatccagtcacagctgccagcatggctagaacaaagcaggtggaagaaggtgggagaaactggcttgctgagtcttctggctttcatcttcctcctgtgctggatgcttcctgtccttggatatcagactttaggttcttcggcctttggactcaaagtggtttgctgggggcctctcaggcttttggccactgaaggctgcactgttggcctccccgcttttgagactttgggactcggattgagcgactactggcttcctacctcctcagcttgcagagggcctatctgggacttcaccttgtatccgtgtgagttaattctcctaataaactccctttcatatatgcatatatcatattagcattgcacctctaaagaaccctaatacaatattttatttaatgtgttaattacatcccatatgctaggacttatattcagtaattttaagtgacctgtcctgtaaacaaatgtattcataactactgatcttaaagacatcaagtgtattctatacactgtactttattgaatggaagaaaaaaatgcataaatatctaacactgtgacatctatatctaatggttcactttgtttacattgaataaagatctataaattacattttaacgtttggaccattcttcaaatgacaaaatatatgttttctattatctcttcttagtatataatttttccccttgttctaaagattcttgaggtcaagtaaaaaaaataagtcagaatgatggatttgatggctgtgtgggggaagacataagttgaagctgggaaatgtggatgggataaatttagaaacttaatcctgtttgtgatctcttaaaaaatcaagggaaacttggcagcttcacagaatgacaccatgcataaaaagactttgaaatggctttctcagaaccactagtatgaaatataaagaaatgtgagtggatacagtttgcatacataagtgaaaaggaagcaatattttggggccaaaaattttaataacccatgtgtcaactctttctctaaacattcattgcacagcactaaaatgtgaaagatcattttctgttttatttatgaactctcattaagcatataatttgcatacttactgtcaccaaaaaaaaaaaaaaaaaaaaaaagccctctgggacagctacagcagtgtgagtcagaatagctatactggagcctctgatgccctctttgacattacacagccttccacattcactattgatgtgaaatcctaagatatacagcaacaagtgccatttcatttttgggctggatatcatgaactttattcaggagcagtggtagaggactgtggattaatgagcagcatatgtgaagtggtaagcactgacaacattaagactgagtgtgcaaaagttctaaaatgaaaagagatagattccaattggttaaataaatgctggtgaaatttcatattcttagatacagtatttcactttttattcccctccacaaactatcagaccatgatttgcccttatttgtcaagggtaaatttttgtatgctcctgtattgaagatttgcctaaaacacctttatcagtatagatcttaattatgtctttaccatctttgcagtctgattttttaaaattattgtacttttttatgagcctttggtgctctcagtgttatacaaaaataaacatcagacatataagcattgataattatattctttgtttaaaaaacatagtgacaggaatagaatgaaatgaagggcatctgaaatttatagggttcgtgtgagaaaaataggaataaaaacatgattttctttttttaacttttattttgtgtttggaggtacatttgcacgtttgttatataggaaaactcatgtcacaggagtttgttgtacagattatttcattactcaggtactacgcctagtacccaatagttgttttgttctgttcttatcccacctcccaccctctgccctcaggtagggcccagtgtctgtagttcccttatttatgttaatgagttttcaccatttagctcccacttataagtgaagacatgtgatatttggttgcctgttcctgagtgagtttgctaaggataatggcctccagctacatctatgttctcacaaatcacgtagaccaaggaaacagaatacagagcctagaagtaagactgcacacctacaatcatctaatctttgacaaaaacaagcaatggggagaagactctctattccataaatggtgttgggtaactggctagccatatacaaaagattgaaactggaccctttccttacaccacatacaaaaatcaattcaaaatggattaaagacttaaacatgaaacccaaaactataaaaaccctggaagacaatctaggcaataccattctgggcatagcaacaggcaaagattttatgacaaagacaccaaaagcgatcacaacaaaaggaaaaattgacaagtggaatctaactgctcttaagaatccctgcacagcaaaataaactattaacagactaaacaggaaaactacagaatgagagaaaatatttgcaatctatgcatctgacaaaggtctgatatccagcatctatcaagaacttaacaaaaatttacaagacaaaacaacctcattaaaaagtaggcaaatacatgaacagacacttttctaaagaagacatacacttggccaacaagcacatgacaaaaagctcagtctcacttattagaggaatgaaaatcaaaagtacgagataccatcttacaccactctgaatggctattatgaaaaactcaaaaataacagatgctggtaaggttgaagggaaaaagatacacttacactgtcggtgagagtataaattagtatttacattagttcatttatgtcatcattgtggaaagcagtaaggcaatttctcaaagagctgaaaacaggactaccattcaacccagcagtcccactactgggtatatacacaaatgaatacaaataattctatcataatgacacatgcattttcactcatgcacacatgaatatacataccataaaggtacacgaatgctcattgcagcactattcacaatagcaaagacatggaaccaacctcactgctctttagtgacagactggataagaaatgtggtacacatataccatgaaatattatgcagtctgattttaacttaaccatcacatgaacacaggctatttcttattactttcctgtgtgtttgcagtcaaacctgtacaatattttcatgtttttctaaaatgtgttttttctcttaatgttcttatgacaagatatactacagaaaaataaaacactgttttacttctaatatctaaacaggtattctactattcctttgattatttcagaagataaactcacataaacctgtctttatttttagttttcatgtacaattaaaaagcactgtaaacactctcaatagccaaaatccattcactgggaggaggtacataaaattggtctcacagttgaacaaacgaccaaccgttgaatacaaacattaaaaaatttatgtcaacatgttgttactcagcagccacataatttggtgccataattgtcaagtgaaataaagaaacggaacacatacaatataatttctttaattgaaggaaaaaagttgtagacaaatgcagggaagaagtcctggatatatataatataaattgattttatataaataaatgttattttgcaccatagtaaagaccaagagagtcactctctactgactttcgggttattttcccaaatagtttgagatggaatgttctaaagacagtttgctggagataagagtagcacatgtggagcaaggatggctgaataactaactcaacaccaacacttgctagttccatcaccttggacgaatagctcgacctctggttgtctcagttgtctcatgtgaaaattgaggataattattatgcctctcaaggtctgtgttcttgatgaaatgagttgctgcatccaaaatactgtccggcacgtattaagagttaaatgtttttagtgagctacatgaaaatagctattgacaggtgaataataagcatctagtgatttctgcatttctcaaggtcgaaatattcagctattttcatttctgctaaaaatatacacacataaaaagctttgtaaatgactattgcaaaaatactttagtatatattttccctgatgtatatgttccacatgtattttcaaattatttgaatgtcattattttttttctaagcatggttaagtgactatgacagatacatattatcatgcttgaagcaatacatgatattgcatggacatatataagctgaaaatgagcccagtgtgactcagaacaattatattttcaaagaagactaattacgacttaagggatgaaaaatattataatctatgcacttatgcagtttgaaactgaatctaattagaaattgtcttttctatgacctcttcttggttacataaagctaattattccatctgtgaaaacttgtaaaaatataatgtattccggaaagctcatggaaagctgaaatattgagctcaactaagcccagcttctcatagagaaaaacagatggcaattaatataatgtctccatttttagaaaaatattgagtaggcgtggccaaaatgatatatcatagacttagaatttgtggtgatcagagagttccaaacctttcccaaaacaaagaaaaacagaaaaacttaaaggttttgaaaatgctactaaaaaataagaataagagtttctcttcatcaatttaaaaaacacatcttacctctcctcttgggaagtgaacacatgaagcaagcaaatactataaagccttcgtgtgaaacaaataggaacacatggctctgggggactggagtggtaatattaaaatggggaagtagttagagaatattacctatctttcttctaatttgagagattctttataaaaaggaaaaaaaaaagaaggaagccacaaagtgtctataaacagtcccctttcattccaaaagcacctctgtagtaccatatagaggagttaacatggagagttagtggcagattttacactatgtggtgaagtctattttaaaaaatgatactaacattgtctcaatgctcatttcaaaaaggtactctgtatttttgtgaatttatttaaatcttgtctgtgtagttaaacacagaagcaagaaaattaatattagaacaatgttaagaaaaaataaatccccttcttgaattgttgtggctggaatatcttttggaatgcgtattacctattgtctttattcccacttccatgcctatccttttatttaatctatttttatcttatattaacattttaattttattagttagttacaatatgattttagtcttaaaagaaattatttggatcttctaatcagtgcttagaagcacctgcattaccaggacattgaaataattgttctgtttctccatcaaacaccctagatccatgaccttctattgccttcttgaaggtgatatttcatcccagcactctgactaatcctgctcttcagcaaaggacaatataagtaagagaatcaataataacatggaggcagaattgacaaaacttaatgaccaactggatgtcaaaagaaattgcctgtgttaggagtgtcaaatgagagttgggaaacgcagaggttaagataccttcaaaaatcacaagtgacaatgctaactggtgctggttactccagactcagaaggaactgcgattgctatcatgatattcttccttccactccatcactctaagaaaagcttaggttcagatttttaagacctcataaactgtccctaaattctgaatgactaatcggatgaaatggctatgactggtatataaaacaaataaaaaaaagaagaactaaaatgttttggttactgtggtagacatataattgtttaccaatatgtctcttgcaattgcacaaggttacatgactggttttactaacaagatatgagtaaaagtgatgtacaccattttcgaactgaaacactgaaaggcctatgaataattgtctcgtctttattgcttcctagtttggcaatcagtagttgaaggatggtggagcctctaccaagcctgcgtcactgagtgactgtgaaacttggatacacttcccccactaacttccacctgatgtttgtggtaggaggttgctgagaaatggaaggttaattggttactgtaatagcctagctccccgactaacaaaatcaactgtgtctctaatgccataatggtactcatctgttctcttagtaatttgtctcataattcaatggtacagtaaatattatattcatttcaaaagagaagaaagatcaaggtgagcttgtacaacaactcctcaaaaaatgtcattttgttgaatttcatttcagtgtaatattgatgagaaaaaagttgattcactgccagagccactatctgtgttgagtctgcacattccccccatgtctgcatgggattatctggatcctccagtcacttcccacttcccaaagctgtgcacatcacgctggttgttcatctacaaggccccagtctgagtgagtgtgaccatgtgagggtgatcctgcaatgggatggcaccctgtctagggttggttcccaccaatctccctgggtttctgggataggctcctgtcacccatggccctgaactggaataaccaggttggaaaataaacgaatacaaattattgtaaaatgaagatttgtaaagtacatgatcatcatacaaatgcaggacaataaactatgctgggtaggaaagagttcagcgagccagctgttatttgttaattcttgtgtttgaacttcatagtggccagaggtgatcctgacaatctttgttttgccaacattcatttcttgatttaacccatcaccacaactgccagtcactcactgattcgcccaaaattgggtaaataatgatcttactcatttttactaatcatatatatctatatctatatctatatatatatagatacagctcagatttatttcagtgtttaatattagaaatgttttggtccttatttataagtttagtgaagtttttgttaccagaaatatgtcatagggactaaactctcctttatctcaattagcctctgataaaattggttttattacacagtgtttcacttaaagttacagtttgaagactgaagtggaatatatgcagatacaccactaaactactgattagggaatcatacatcccaggcttcttttgatgattaatgaattaacagctttttagaaagcagagaataaacaaataatgcttcctacttccaacaataataacaacacaagaaaaaatttaaaaagtaaaaataaaaatctttaaaggttgatgaataaggtagactgaaaatttcatgaaccttcaaataaatcatgatggtttaacaaaaccaccaattaccatacatgtagagtgggaaattccatagtcataaaattatgcaaagactattttttcctaaaacattgttcagaataatgatcaaacattatgttagttaaccatgtttatcacgtaaattatatttgacaaattgaatgaatatacatatttgaatatatatacatatatatatatacacacatatatatatatatctgtaaaggcaacatgaaggattacatatttttcttcgaaccaacagtgtatttcattttcccaagaatttctaacagtatttatttctttgttcttatgctttcattaagaagatatagtttcactttgcacttgttgaaactctttttagccactgcttagtatagtaaataaaccattgtattcaatttgacagtttttgctgatgttgtgatagtagctacataatacctagacaaacatatcatccaaatgttcctttctccaattatcagttgtcctttcagcacatctctctataactgtaatatctataaatttactctactatcaaaaataatacttagtaagcaccactgccaaatggtatagaaagtactattttgttatggaaaagatataatataaacatgattttataaaacacaatccttcgtgaatggaaaaagaaaactaaagtcatgcactttgttaatttgcctttctttatgtatatatatgtttgtgttgtgtagaatcagtacaaaatctaaaaattaatataattatatcacagaaccacataaatctgattcacatgaactgagtgaaatataaaaatcatttgatccaggcctgcaaaagcactttatttgacaatagcagtaattatgactttaacaaatgaacaaatatgacaaaactattattattttgttagacctcattatatttagtttaaaattttattgtgaatgtggagaatacctcaatctttaaataaatatgtagacaaataagggttagtttgatccctcaatttcagggaaattgtttctacagaaacacagaatcatttcaaaagcttgacaaaacagataatcccactccacagctactgattcatgagctgggtattttttttaacaagcctcaaagatgactttacggtaaatattttcaggaaatatcatcaccatcatcatcttgtcaaccatactgagtgtttactctgtgatgattactatgcaaagataatggcattccttaattgacttgtcttacaataattctatagtatatgttctattatgttgctattttataaatgcagatactgagcatattgaagttaagtaacttgtcttagccataaagcaattggtgggattggaattaagacaaagaattttgctttctttagagctggtacctttaaccaatgtctttgcagaagccattttctggaatacgtatatctttaaaaaaaaaaaaagaaaatgcatgtagaagttggttaacacttatttatagaacagtgtttttcaaacttttcataatttattctcctatcagaaagaaatactgctggtgaaccccaatatttgtatatgtatttatatactaatgattcacaaacacaaatgttatcactatgtaaagtatttcctaaaatgaactcaaaattgaaatgcaaaagaatgaagtaaagcataaatataaatgaaatttctcatatttttccatagttcatttaaaagcatggtgagcctgctgtgttatataaacacttccttgcagacttccttgtaagatgaaggagcatggcataatcatgttggattttgcgggtctgtatcttccacctaagcctgtttggggtctatcattttccctttcttcctcaagaggataatcagcagtgattttttttatgtattactttttaagttctcattttgtaacattaagtcaatgttgacccgtaagtagaatctgcataaaatgtaatgatttgtacctccatgataccatagtttcatgacactagtcaagattcttaaacaatctcagattgagtatcttcagctgcaagacgatttaataaatgtaacctctagatcttctggataaatcccattaaaaataacagaaactgtagttagaatatatcaagtgtttaataaaggtcctcatgtcatataaacatgagatttatttaaatacttataatgtctgacttctttaaataaatgcttattaatcagttcctggagtgcataagataatcactggtaatcacccattgctacaagaatcatcaaaggagcagctctcaatataaatgctatttaagccatgcaggagagggctccttccaagtcagaacgattgaaaacgggaaatatttgctatgatcatttacaaatgattttaggtgtatacaccgaagattagtgtgcacagtttctattatgtaaaattttcagagttggcagtagacaacagtacaaatctatcataaatacttataaaaactaagagagtttagatagaattttaatttagcagaaggttaaaattcttaccttatattgtcactgtcacgtccgaatatagattttgaaaatcattgataatctagcaacttacaagtggaattctatttacctactttcctatttactttaatggaaaaaacattcctgaaaagtcatattggtatttgaggaaaattaaatcttggggttctattttgaagacattttttgcacattctggacataatatcttcagattatgtggcttcagtgagtatctgcctactgcatcacaaaacagtctaagcaatccatatttatctcttttctaatctccagacctacagaactactttccacgaggcatttcaaagtgcatactgaaattcttactttctattcactcttccacctaatcgttatgttccttctttcccttaatgaaatcagcatcctgttgaaagctcacacttgaataaaaggttcttctctaatgtttccttcagctaacctcccatatacatacatttgagcatgaagcctgactagagatgaactatgattaattctatgtcttaaatccctcaagtaaattcatttacctcctattacctccaagttcttaattcataataattttaaaatctttattttgtacatattcaaatatgaacaaataattgtacatatttatgggatacagagtgatattttgatacatgtattcaatgtgtgatgataaaatcagggtaattaggacaacaatcacctcaaacatttatctttgtgtgtatgtgttaggaacattctgaatcctctcctagctttttaaaaagtataaattaaattattgttaaccatattcactgtacagtgctatagaaaagacgaatttgttcctcctctctagccataactttatatctattaaacaatctttccccatttcctcttcttccattctttcctttctctaataatcataattcttcactctatttctgttagcttaattttattctagctttcaaataacagttagaacttgcagtgtttatctttctgtgcctgacctatttcacttaaagtaatgcagtccaggttcatccatgttgctgtgaatgatagaatttcattcttttctatggctgaatagtatttcattgtgtatatacaccacattttatttattcttttatttcttgatggacacttagttttcttccatatattggctattgtgaattgcaatacatatattgcaatacacattggaatgcagatatattttcaatatactgatgttctttcatttcaataaatacccagtagtgagattgctgaatcatatattacttctatctagttctatttttagtttttggagaaaccttcatactgttttacataatggctgtactattttaccttctcagcaacaatgaaggagttccattttctccacattcacaacagtatttttttttagactttttgataatggacattctaactggggtgaaataatatctcattgtgattttgatttgcatttccctgatgattagtgatgttgaaaatttttccatatacttattggccttagttcataaattcttgttataaattgtttataataacagcaaaataaataggaattgtatttttgaaagtaaccaataatgtttctggagtgttaaatactgaaagtcattttattttcaatctcacatctgtgactctatcttaaagaaataaattgatatctaaaatgttcttatacaaaaaaatttatcaatgtattatttattgtgtctaaacttaaaacctaattgctgagataagccatgtactttttgacatataagttctcttaagtgtttaaagatgttggataggattatggcaaagatatttggagacttgcatagtagaaaaacttagtagtcgaaaaaacctcagggtatcaagaaagtagagttctacatcacattgtattaaaaaataaactagtgttaacagatgaacacaaaaatatatatattttctaatttgtcactgaaagagaccacaacataaagaataattctggttatttcttccactaatgtacaccataagtttccaattctgatcttttatatcggccttcaattaagaaaaattaataatttgctgtatagctgaagagaagttttaggagtgaatctcaggaaacagaaataatgaattgaagggtaactggaggttaagaatgaagttccacaattcaaagtagtctttcaaagaagttgctgagagagggaaaacagagagttgggatgatagcaatgagaggtttggagttaatgaggattttttagaagatagataatgtgctgaatgaaaatgggctaaatgccccactttttaaagacccaactgtgtgctgaattaaaaatatctgtttcatgtacaatgacacccacaggctcaaagtagaggaatggagaaagatctatgaagcaaacagaaaacaagaaagagcaggagctactattcttctttcagacaaaacagacaactatcaaaaacgacaaaaatcggcattacataatgataaagggttcaattcaacaagaagacttaattatactaaatatatatgcacccaacactggagaaccaagatttagaaaccaaggtattgaagacctacgaagaaacttagataaccacacaatcataattgggagactttaacaccccaatgacagtatcagacacactaatgagttagaaaactaataaagatattcagaacctaaacttgacactttaccaaatggaactaacagacaactacagagcagtccatcaaacaacggtagaatatacattcttcttatgtacgtatggcacatgctctaaaatcaaccacacacttggccataaagcaattctcaacatgttcaaaaagcccaaagtcatacgaatcacagtcttggaacacagtgcaataacaataaaaataaataacccaaatgtccaacaatgatacactggattaagaaaatgtggcacatatacaccatggaatactatgcagccataaaaaattatgagttcatgtcctttgtagggacatggatgaaattggaaatcatcattctcagtaaactatcgcaagaacaaaaaaccaaacactgcatattctcactcataggtgggaattgaacaatgagaacacatggacacaggaaggggaacatcacactctggggactgttgtggggtggggggaggggggagggatagcattgggagatatacctaatgctagataacgagttagtgggtgcagcgcaccagcatggcacatgtatacatatgtaactaacctgcatattgtgcacatgtaccctaaaacttaaagtataataataataaataaaattaaattaaaaaaaaaagaaaatcactcaaaccatacagttacatggaaattaaacaaattgctcctgaacgaccttcaggtcaacaatgaaattaaggcagaaaggaagaagttctttgaaactaatgaaaatatagacacaacataccagaatctctggaacactgctaaagcagtgttaagaggaaagtttattagtcttaaatgtccatatcaaaaagttagaaagatctttacttaataacgtaacatcacacctagaggaaatacaaaaacaagagcaaaccaacccagagttaacataaaaaatagctagctgagctgaaagaaatggagacatgaaaaacacacataacatcaacaaaaccaaagttgttctttgaaagaataaataagattagtatagtactagaagactaataaagaaaaaaaaaaggatccaaataaacacaactggaaatgtccaaggggacattaccaccggccccacagaaaaaaaaaaaaaaaaaaaaaacctgagagactctatgcacacatagtagaaaacctagaagacattgataaattcctggaaacatacaaccacccaagactgaatcaggaagaaactgaaagagattaatagtgagttccaaaattgaatcagtaataaaaaacctacccaaaaggaaaagccttggactagacgaattcacagccaaattataccagatactataaagaagacggggtatcaattttactgaaactatttcaaaaatttgaggaggatggactcctttctaactcgttctataaggccggcatcattctaataccaaaatctgtcagagactcaatagcagaagaaaacttcaggccaatatcctggtgaacatagattcaaaagtcctcaacaaaatactaacaaaccaaatacagcaacatatcaaattcaatccatcatgataagattaccttgtttcctgggatgcaagattagtttaacatatgtaaataaataaatgtgattcataacataagcagaactagaaacaaaaatcacatgatcatgtccatacacacagaaaagcttctgataacatttaatatctcttcatattaaaaaccctgaaaaaaaggcataaaagggacatacctgaaatataataagagccatctatgacaaattcacagcaaacatgatactgaatgggcaagcgctggaaacatttcccttgagaactggaacaagacaaggatgctgactctcaccactcctatttaatatagctgtggaagtcctaaccagagaaataagtcaagatacagaattaaaaggcaaacatataggaagagataatgtcaaaatatctctcttcacagataatatgattctatacctagaaaagtctgcccagaggttcctagatctcattaaaatttcaacaaagttttgggatacaatatcaaggtacaaaaatcagtaacatttctatatactgagaacgtccatgctgagagccaaatcaagaccacaatcccactcaaatagccacaaatagaataaaatacctaggaacacagctagtcagggaggtgtaatttctctataatgagagttacaaaagttactgaaaatcaaagaggacacaaataaatgaaaaaacattccatgctcatggataggattaatcaatattgttaaaatgaccataatcctcaaggaatttacagtttcaatgctatttttatcaaactaccaaagacattcatcacaaaattaaaaaaaatcatactaggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgttaacccgggaggcggagcttgcagtgagccgagatcccgccactgcactccagcctgggcgacagagcgagactccatctcaaaaaaaaaaaaaaaaaaaaatcatactaatgttcacaggaaaccacaaaagagcccaaagagccaaagcaatcttaagttaaaaaaaaaaaaaaaaagctggaagaaccacactacctgacttaaaagtgtactacaaggctacagtaattaaaacagtatggtactggtacaaaaacagactcatagaccaacagaactggttagagaacctagaggctgcatatccacaaccatctgatcttcgatgaagccatccataataagcaatggggaaaggactccttttaaataagtggtgctgggataactggctaggcatattcagaagatttaaactggaccccttccttccaccatataaaaaaatcagtacagattaaatacttaaatgtaaatcctacaactataaacaccctaggagaaaacctaggaaatactattctggacataggccctggcaaagattccataacagactccaaaagtgattggaacaaaaattaaaattgacatgtgggacctaatcaaactaaagagcttctgcacagcaaaagaaagtatcaacggagcaaacagacaacacacagaatcagagaaaatatttgcaaactattcatccgacaaatccagaatctataaggtacttaaacaaatcagcaagcaaaaaacaaacaaccccatttaaacatgggcaaaagatatgaacagaggcttctcaaaagaagacatgcacacagccaacaagcctattaaaaaatgagaacacctggacacaagaaggggaacatcacacacctgggcctgtcatggggtgggaggaagggggaaggatagcattaggagatatacctaatgtaaatgacgagttaatgggtgcagcacaccaacatggcacatgtatacatatgtaacaaatctgcacgtggtgcacatgtaccctagaacttacagtataaaaaaaaatattccaaatatcactaatcattagagaaatgcaaatcaaggtcacaatgatataccatctcacgccagtcagaatggctattactatgtcagaatataacagatgctggcaaatttgcatagaaaagggaattcttacacactgctgatgtgaatgtaaattagttcagccactatgaaaagcagtttggagatatctcaaagatcttagaactaccactcaactcggcaaccctagtagtggattatatcactaccattcaactcagcaatcctagtagtggattattaactatatatttgaaggaatatatagttctaccataaagatatatgcacaaatatgttcatcacagcacttttcacaataggaaagacatggaatcaacctggatgctcatcaacaatggacataataaggaaatctgacacatttacacaatggaatactatacagccataaaaatgagatcatgtcctttgccccaataggatggaactggaggccattatctcaagcaaactaatgcaagaacagaaaatcaaatactgcatgttctcacttataagtggaaaacttaacattgagtacacatggacagcacagtaatagacactggggcctaacctacttcagggtggggtgaggagagggcgagaatcaaaaaactatctgtcaggtagtattatcactacctgggtgatgatataatttgtacactaaaccgcagcaacatgcaatttacacatgtaacaagctagcacatgtaccccctgaaactcagagttagaaagtaaaaatttaattgaagctataataaaatatagaatactaaaatggaaagtacacttcaaagacatgctataaaaggtaaataagaatatattattattttgatacaaaatattttggaattcaatctcaagataagaattattttagtttcaaattgtataatataaaattgaatgtttagcctctttcataaaggatataatgtaaaaaattgtatcacttgttttatatttattttttatattttctgcatattaacttaaattcatatttgtaaaactttattttgttgagtttattcagagtatttaatcatgaaaaggtattgtcaacataaaacgtggtgccagatggactaggttagcacaatgtttaatgctattattgcatattttggggattttttttaattgtctgctatgagctgtgtatgaagaatgactaagtaatattcagccagcacggaaagagaaatatcacattttgtcatctttatgtggaatctaaaacaatggaactcatagaggcataaagtagactggtatttacagaggctggtggggtggggcagatgaggaaatgaaggtcaaatctcagacaggaggagtatgtttcacgtttcagaaggggttctattagacagtgtggcgaatacagttaatagtagagtattctacatttcaaaattcctaagagagcaaagtttaaatgttctcaccacaaaaaatgttaaatatttgaggtgatggatatattaactagcctgatttaatcattccacattgttttcatgaattctaacatcagtttatgtctcataaatttattcaattataaattgtcaattttcaataaaaaataaatattgaaaacatcctataaacagattaataaattgttttaacattaatggcatgaatataggataaataaatttctactttttaattcccaaaatgagaaattcaagaatatcaccttaattataaacaaaaatgtgtatggtataaaacaaaacagaagtgttttgagttttttaaacacagaagacagtaaagtatacgtccaagggttgtatgtaatgggttaaaaatatgtatcaacttaaggaaggaaaacagtcatgaacgtttatgaaacagtcgtgaatatagttaattcatgttacaagctggatttaaaaataaagatagataggatatcttaagtatgtaaatcctttgaaatttgtgccagatagaataaacatactttcttttagtacttaaatgtaacagcatttagtataatctaaatgcgtgactgggattattgaataaataaatgtgactttattcctaaaattttaaattatgtggactctgaacctgcaccaaattgtcaataagtatacagacagctagaatatgctgttgaaagggatgatgttttatataaaataattccttactttattttttaaaaatctggcaaccctaaagttctaatgttttgtttcataatatttaagggtcagttaagtaatgtcttgctgagatttttaatatttaactcactctcttaaaagtctattgctttttccttttttatgcacaaaaaaatctcaatgacatgattataatctcataaaaatcatatttgtgagttaagaattgtatgttttaaacactggtttaaaaatgcaatacacacacacgtacacaaaatgacaacatcgctttgtatctttaaaaatactttaaattaaatttcatgtaagtggttttattaaatccatattgtataaaatgacatgaaagttttataaataattcacatggtcttgaaattatcaaaggagtatacacatgcattcaaaattatctgttaatagagaaatgtgtagccaggtacacatatgtgtgtgaaaacatcaatacgcttatttattattaaccaataaatttggagtcaaatcctcatatgcctacagggttgggttattctataagcattcgataaaagagagaaaataatcaaaaataaaccaatgtcttacatagtctcccaaagaaaagtgttatttagaagaaggggaattatatccacctgacgagtgacattatagcccatttatttctcatcaaatactatgggggaagagttacattttgctttaccagttcaagagcaatttcaagcactgtcaagaagtatttgcttagtgacaaatgacactactctcttgaaaattcagagatgcatctataccttttctctttgcctttattattattctagttacattttatgtttatctttatgtttagtagtattatctctacatcaaggaaagtcatatattctccaccaggcctttttaggaataaaatagatggcaaactctctgacacaatttaactataaaacaacttaaagtcaaaaaaatagcgacttcttttctgtgatgtatttatgatttgctcatttccacaggaatgacatttctaaattttgcacacagataaaactgcctaggttattttaagacatgactgatgtgccaaaattatccccactttaatacagtatcttgcaaatttgcaaatttcatttatcatgaaacttcttagaattaaaaaacagctaaactggatctactgctctggtatgttgagaaaccactgtcctaaaataacatttcaaatttcacgtgttgtgccaaggcaggatttttaaaaatgatgttttgctttaatcttaagacatacttggatgattctgaatataattattgagtaattaatgtgacacattttgacaaaggtatgtattctagagtatgttttaaattcagacaagcattctcttaacgaatcatatcagcatattcaagagggcaggcatcatttgaaaaggaaattgatctgttacacattttgacaggctttagagcatttagctgtgttctctcaattgaaaggtggtgagagtgggtaaaaaaaaacgctgtaagggtacagtttatcttgttttgttttgatttgattttaaagtggcaaacatctttctagtcacttttgcaaagacactcattttgtcaatcaggggctgtcttcaccattgatagaaaggattcctgtgggattattattacgttccatacttagttgtgtttcaacttcaatctgtttcaccaaagcaaagatacaggtgatagaagatcatcgatgttaaaggaaatcgtcgtgacaacaaatttttcttattcaccagcatggttctcaaacacttggttaggagcaataaattctcatgtaaagaaggtatatagaaagatcaatatctccttttaaacagtttaacacatttattcctaatgcattactactcactaacatgctgaatactgctatgtaatgttttaaacataacatatatttaagagtacatgctaagatcatgagtggcaaaaatgatcagttgatatttagttatagatgatatgtatcagattatatgtagctgtattaggagaaattcctgaaagatggatctggtttcttaataatgcataggaggcatctgtgcacatcattttaaagcatcttcaatttatgataatttaatcaaaaatttttttatgtttcttgaggaaatgtaccttacaaacattcctaagtgaaaaacaaaacaaaacaaaaaatataagtagaagacatatgcttttcgatatatgcagatgtgtctgtgtgtgcctaaaattataaatatttcactggagcctaagtaaagaatttactaatgtgtaagactgtaaaaatcagatatttatataatgatatgagcatttcgttcactgttataaaggcttggtaaagtggaaaacatatgtaaaggaaaggagatctggtggtttctaaatgacataaattgattgtttaaaaattttgaataattgcagacaataatgaaatgcttattccttttaaaaataaattgttagttattttatttggtcaatataaatgttcacattacattgaaatttaaattctttgaaatcaaaaattatagtaagtaggcatactgctgataattacaatattaagaatttgaaaaaagaatatattaatgcatataattttacttaatattgtaactacatctaaaacataaatatatattactaaattttcaaatattttatctaaataatgtctttcttacagatatattaattcaacaaatgaattaatagagctaaaatataaattgacataatctaaagaaaacctttgccactctatttaggtattttttgttgctaaatattttatgtttttatatttaatagatttattaaatccctttggtaaacttattttgaaatattttattataattagttattcaattaaaattgcatgtaccaaattagaattgaaacaatataaaatgtcttttacagtatgcattttcctaatttatacttttcttaatttatactttcatatttgagaaattaccttttgtgttatgtataaatgttataatacatataggtaaattaatatgcctgtacaattttaggcatatatgtgtttttattcatagcaatgctaatattttaatttttttggaattataatatacttaaaatttttcatatttattctgtatatattttttctcatatacttaatgatgacaactctattgttcatattacctgatatacatggtaaatacatgataaataaaaaataaaaccctgaacaaagaaaaaagtgcaaagaaagacatgcaaagaaaggttgattcatttattctaagaaacttgagaagttttaaatatcctaacataggtgtaacttccccccaacaccaacaatctgtattacagagatggagaactgttctcacaaatacgtgttttgagaaagttcagtacaagtacacatcatggttttaaaatttttagaatattttccttatttcctatgtaaatattttccttaatatttttagaatattttcctagcaacattttgtcatgtactttttgacctattgactcattaaagatgatgcatgtagtttataatatgcctgattatcacagtcttacctttgtaacttcaacttctagaagtt

SEQ ID NO: 536 - DNA, 205743 bp, Homo sapiens
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggtgagagcgacccccgagcggcgcccagaccctggcccgagagcaccgacttggagcgccttgtgcaggctagggctgcacgctctcctgcttgggagtagaaagggggagggtgggagagcgaagaccgagctcctcggccaaggagcacccacaggggcctaacgggaggctctccttctttccgggtcgtgggggggacggccctccggtcacccctgcatgcgggccgcgcaccgcgctgtccccgcgtctcgcggaccgagaccggcggtgaggatgggctgcctccctcatcctgcgctaaactcgctttgtctgtcgcctctaggctaagtgggactgaccggggcccagagtggacgaaccgccagcatggggagagaccagcgcgcggtggccggccctgccctacggcggtaagcgactttctgcctggtccccgtgggtcacgcgcgcatggacccttcggtgtaactctcggggactgacaagccgggcccgcacgttcacgtctctcttcctccctttcccatgcaggtggctgctgctggggacagtgaccgtggggttcctcgcccagagcgtcttggcggtaagtcctggctcccgcgcttggacttgcgcgcccgagagtggttgggacgtttgagtggccttggagaaggcagctcgtccgtgcgctcccgagtgtgtgtgtgcgtgtggatgttcgccaggctgcccaccaaggttctgagaaagcttgctcttccctcatcatgctttccacctttccttccccttgggttcccagcgtcaatcctgtgttttgcaagcgtcggcctttcacgggaactgggaacttaaaatgtagcctgaggcaccgttttcgttgctttgggcaaagctgcagccgtagaggccaggaaagtgtgtcagtcactaggcagtgagacgccaggcttagggcgaaaaaagttttcctggaactcgggagctggtggggagtctctgtcacggactgagggttttttgtgtttttaaatgggagtctctgggtaaaggggcggggcgaggaggcgaacgagacaaccttagtattgtttgaattgaagcattgcgagggaacaatggcagaaaaaccgcgttttctcccaagtcctgttccggccctggaagagctgctccgggcgccacactgggatcctgttcgccgagcctgcccctccacgccggccgtgcacagccctgccgataccgtgggtgcagctggcgactgcactgcgaggctttgtccattttatacgttttgtttaaagagtaggagccacttttactgagctttatgtaaccatggctaaaatgaagaggtttggtaggtgaattcggtgcaggactcaaatgtttagacaggagctgaaagcggagggagctttcgagatgtccgctgtccctcctctccttactgtggccgatggagtagccctgccctgtggcagccggggcccaggtggattcctcctgggaacgacccctccctcctcagcgcgcactgtgccagagcagtacacaggtacaaagggcaaacgtgttcatgatttcatttgaattctgttgtttttacatcgttctgccctgatgtaaaacaaaccaggattttaaaggcagtgagtgatgaggagctactcccacttggggaagagctgctaactttacttttccgctgctgttggttccggttcaaagctcggtttgggaagtaagaggaggactcggagactttgaccagagcactccaggccaaagttttcttccagttcaggtctgtctcttcgtcccagccccgacttaagatcagaacctagatatttgaactagcccagtgaccctgtgaattctaatgcacaggtctgtactgcatgtaagacttggctcagatttatgaaccagaagcaatgcatgcacgcgcacgcacgcacactcaaagaagggggcgatccctagaaaataccacatcgggctgtgtgtgctttggttgtgctgccacctgcacccctttgtcccttagagccacttttataatttccatatgttcatgcctaaggatggtgggagtcccaggtattcttttctgaactcatcctaaaattggtagaaagaccaccaagcacctaggtctaaagatctaggtattagcctgggcatggcggctcacgcctgtaatcttagcactttgggaggccgcggcctgtggattgcctgagctcaggagttcgagaccaccctgggagaaacacggtaaaaccctgtctctactaaaatacaaaaaaatcagccgggcttggtggcgcttgcctgtaattccagctactcaggaggctgaggcacaagaattgcttgaacccaggaggccgaggttgcagtaagccgaaatagcaccactgctctccagtctgggcgacggagcaagactctgtctaaaaacaaaacaaacaaacaaaaaaaacctagttactaaacatagctctgccctaatctcttaaatccagagccccagtttccgtactctgaagaattacggcttcacagaggccaagtgccctaaggcagataggacacctctatgcctccccaaaacctcatcattgctgcaagctcacccccagtctctttgactctttgatctttggatggcaccaagaacattgattgcccagcagagcttctcaaagtgcaggccccctagacccccagacctaaaccctgaaaggcttgttaagaagtcaggccccatctcagaccttcaggtcagacattccagggtggagtccgggactccgcctccccacatgataccagaatctgggaaccactgagctacagtattgggttgagaggcagttgagattacttgccaattcactttattttcctgggctttagattctaactcaaccaaaaaaaatagatatttttaatcattttactagggacctagtaatatgtgttgttaagagacatgtagtttgttacgttcaacaaggggctggtcttctacttactcacttcttggtaaccactggctttaatggctgttccttgtgaaataatgtttcaattttcaactgtattgattaaagatttttcttaattgtggcaaggactctttcctgcgtaggtcagttcaggaaaaagggctgccgctgggagccctttggcttgttttgtttcggaagcagctaggatgggcagtgaagagccttggtgattacttattgggcacttcctgtgtgccaatttgtctgtactaatgcttctaatcctcacaagcaagcacactgatgagctaggtaactattattacccccattttacaggtgagaaaagccacaaagggtttgcagccctcgcccaaggttcctgtctttgtaactgaatgagacggattagaacccaggcctcttcctccacaccgagcttcccagggcctgaaaggtggccgggagggcactcctgagtttcagtctttgagtctcctggggtgtgggtgctttcttcttggtcttgaccgtggactaacagtggagcgggcactgattcctaggaaggaggctctccccctccttcctcctctgcttctcccactgtgaggatcaggggcagcaagtgaaggagagaagcaagacccttcccaaagggaggaaaggaagccgaaatcccacggggcagcctgggctctagactcagtgtgaacccaggtgatctgtgtgggcacctcaggacacactccctgctgtccaaggtgccctttctaaaggtgcccttgtttgaatgtggtgccaagatgcacaaaatggcttcgtgtaaggcagtgtgacacaggggtcccatcccagacttgaggcaggtgacggggtgcagttctcagtctggtgggcagctgaggggctgccgcctggggcggacattcgccaagcctctgcgtcctagttctcctctcccccaaaacggaggtgttactcatcccacccacctcatagatgggggtgctgtgaggtgtgtgggtgcatgtgaagcgccttggagggtctggcacagcctgggtgccaggaggtatcccctgggcctgtttaagggacttcccctcggctgcctattctaaccttcatggaggcttgaaagcactcactgtagccgctctgagcattgtcacctatctccagaggctggcagcagcctgagggatcaaatatgcagccggctgggtggtcacctgaggacctctggccgggacctggggccacaatagacgtgggttcacgtaggcatcagtgcggggcccctgcctgccaccctgccgcttagtttccaggctgtcctcggggctccagccccaggaaattcgcctgaccttcctgttggctgccaccgccttccctgccctccaggccggcagctgcggtggcaagtcctttccgcaggctttggtacagggaggagaggtgttcatgccgcacgaggcccagagctttctgtaaggatcgggaaggacaattctttcctgcatttcctggagctgaagcgctattgctcaaaacatggccctctgagaagaagggaaaagcacggggttcctcctctgctcgtggataaacaagcatatctcagctctctggaggctgttaaagtcttcctccatgggtggcttgtaggacttggccacgataaataatagcagagatttgtcagcagcatcccagaaggagaggtgggtaggaagggtaaaccgaaaagcgcaggagaggaaacaggctctgtacgaccaggcggctatgtttacaaccagagagagagaggtgaagaggaaaaggttctagaatagaaaaaagattttgctaaaataataaaaatcaaagaactgtgtttaattgtgtttctggggagagggaaagaaaatggatgtgtagtttaaataatagagaaactcaagggaaaaactgagtgccatggagatttaacttttcaaccctgtgttgataatataatgaagagatcaccatctagaaagtggtttgagaatgtctcattctttttatctgaagaagaatgtttgtctttgattagagggttttagagaaagctctgaaactggcctcatgctttgtgtctgctggtgtctactgtgtgatcactgctgaaggtaggaggcaatgtctgcaacccccagccttggctgatagagcttgtgaatcagggaccaggaatgacacaatagtcttgagaggccataaagtctaatccagcctgttgctaaccgggttctgacttcagggcaagacactttacgtgctttggctctggagcctggaagagaatgttgtgtggaatggatctctcaggtgatcaacataccatgagtaagttagaggtcagcagtgagggctggcctgtgcaggtgtgctaagacctgtgagggtgagccggggtctccgctgtgatgctggggatgagaaagcccttccagataagctccagaatagaatctatccagcctgcaccaggatatcgcttagaaatcaatatgccacatgggactttttatcttcacggtgtcgagaagcttctggaatccagtaaatatgtgacatttctcagttgagatgaggaaaagggcagagttcctggatagtcccctcttgctgtttccctctggtgcccactcccttcagttaatgagaccctgtcaggacaggtgacggcctaagtgactcactgctcttgatttcattggtggctccggaggacggtaatttttattttggttacccctgaaaggagaaggcggcatctaattctagggagacttcacaggtgtctccagtcctgttgatgtggccagagagtgaatttcaaaggacgtgcgagcagccggcgtccacccggcaggctcccaccccggtgccccgcgtccacccggcaggctcccaccccggtgccccgcgtccacccggcaggctcccaccccggtgccccgcgtccacccggcaggctcccaccccagtgccccgtgtccacccggcaggctcccaccccagtgccccgtgtccacccggcaggctcccaccccggtgccccgcgtccacccggcaggctcccaccccagtgccccgtgtccacccggcaggctcccaccccggtgccccgcgtccacccagcaggctcccaccccagtgccccgtgtccacccggcaggctcccaccccggtgccccgcgtccacccggcaggctcccaccccagtgccccgtgtccacccggcaggctcccaccccggtgccccgcgtccacccggcaggctcctacctcggtgctgggttccagcccctcccctgtctcctgagctcctggctggctcctgagtactctgcttcactgtcttctgttgccttggatgaagctgccttttgaagcaacatgcttttttgtaaaaccggctcctttgaagtgcagcctggtatcctggggcgggtcctgggacagaaaagctgcactagtggaaaaactggtgagattctagcggaggctgcagttcaatgtgataatgttgatttctgtaccaatgttgatttcttagttttcacagaaatgtgccatagttttataaaatgtcaatatgacatcatgatgtctgggtgaagggtatacagggactctctgtactatctctgcaactcttctgcaaatctcaattgcttcagaattttaaaatgctcccaggagtcagcagccagtcacatttggtgtgcatgggtcagatggacaagtgcatggagaaggctgaaagcagccagtctcgaatgagcagatgtgggcagcaagagggaaatgttgctcccattcttttctctcatagagtaagtgaacagaagtctcttccacttagtggaaaatacagcagaggtagacccaagcgaagcctgagtaaaaggatttttgtcccctggccgtgggtggagtcatttgtgaagacggggaggtttccctgtggagtttctgcagcaccacatgggaggcccggtggagctgtcatggggcctcttcttcgctggggagggaagtggccgctccgttgtttcctgagcccaagatggaagggcaggcttgtatcacagtgtcgctgcaaggacagaaaactgacagtggaggagcccggtgctgcccatacgcgctcacccctaggaacgcatcaggcagtaccctcgtgccctcctgggctgcacagaatgggagcccccttcccgcctgcctaggaaaccccatgggccacagggacgggcaggtggcaggtggctggtggctggtggaggacttaggcctcctgcacacgtgggtcacctgatagaaagggacaggccatggcagtgggattcagagtcccagcctctcagtggcctcagcttctgtgttagttaggggccaagggaaaggggcctggagccaggatggccagtggctgttgccttgcacagttgcctgtcatcaccctgccattgataactggaaatgagaagcatgagcagagccgcctctgcccggcccctgccagttctgctctgcacaccctgtctgcactccaggccttagccccggggggataaggatggcctgtccctttctatcaggtgacccgcagcaggtatcacacacctgcacatggctggagcctctgtcctttgcaactgaggcccatttcagggtctagctaaagtgtcttctccactgataggattttaaattctttaggatcgaggattataagtcatgattgtagctctatagacttgaaacatttgtcttcacccatcatccactttttttgtttgtttgttttcgtttttgttttagaggtggagtctcactctgtcacccaggctggagtgcagtggcgtgatcttggctccctgcaacctctgcctcctgagttcaagtgattctcctgcctcagcctcccaagtagctgggattacaggcacgagtcaccattctcagctaacttacgtatttttagtagagacagggtttcaccatgttggccaggctggtttcaaactcctgatctcaggtgatccgcctacctcagcctcccaaagtgctgggattacaggcatgagccaccacgccctgccatcatccactttttctcccagtaacatgtcttctttagctgacattgctgttcccacagtccaagttcagggcatcttgcatcggccctcatggaatgattcatgggtacctttatctgcccgaggcctgaaatacagtgggccctcaacagagcttgttacataaatgattgcagttagttggcagcaatgcaagcagatcctttggatgaggagtacagtcatggaactattaataaaagaggagattaaaatgtatttattcttactgtgggtttttttttcccaaattatctgctttctcccactggataaaactagccgtatatgatgataaaggaatcatggatcagtctgaaagatttgcattttttcctagggattgtttcaaccccacccatagaattcctgttttgttgcttttacccagttcagtgatctctcatgtgggaattagagaagaatgtgtgtttttgaatttcatggactgattatctggtacctggtggtaaatattatataacaatatttttccacatgttgagtgtttttggatccctgactgtggagtaatgggaccctgtgagatccaggaaaagggcttctgttggtgcacagggtcagacacacgtgccctggactgcatcaaaagccatggtttgtccacgagagaaaggagatgccgattggcagccgtgatgcaatcattgcaaactgtgtcgggaaggagcatcgcagcgatgcaggccctggagccaccagcccggccctccttcccgctctgtcctccccgccttccagtgacactggctccagattaggtgaaaggaagaggtcccctgggagattctttgtgggatcaccagaaccaaacctaagagagcatcctgaagatgcttccagcattccagaacctctcggagcagctaaaacaccctgcgaagaaacatagcaaatcctgtttgctgagccactggtgctgcaaactgctctaagccacggatggttcacagatgggtaaactgaggcatgtgcaggaaggcacctggtaggtcaataggaacaaagtggggagtgaaacctagaacttgccgattctaaaacctctgctcttaaccactggctaggtgaataagccccagccacagaatatatatacacgtcaaaatacagaaattgtggtacatgtaaaacatagatatgtatattatatgtagaaaatatgttatcaatctacatggaatatacagacatagatgatagagataaaagagagagagaacacacacatacatatgcaccctgtactcacacacacacagacacacagatgcacacatacatgcatgcacatagacacacaggcacacgtagacacacacatgcacccagcacacacatacagacacacacatgcacatatagacacacttgcaccccacacacacatacagacacacagatgcacacacacatgcacatagacacagagatgcacacatagacacacacgtgcaccccacacacacagacacacacatgtacatatagacacacttgcaccacactcacacatacacacagatgcacacacacacgcacatacacatagatgcaaatacacagagacacacacttgcacccacacacacacagaaacacatgtacacacacataaacacacatgctcatgcgtgtacacacacacacacttagccggaggacgctcctggtttctttcttcatgggagcagccaaggcagaaaaagactatacctgcctctggggagcatcaaacagacctgtttctttagggtcccttctgcagagaggctggacagaggcgggagggtgactgagtagcctcatgaactctgaaaagtaaaggctaagatgactgcactcaggagaggcccttaaaggatgaccaagaaatacatgagaatgggcaaagggacaatttcacctgcagaaccaagagtcctgcagacacaacccccaaccggccctctccaagtctggcttgaaactccgggccactggggtaaatgctgctgcagctatgtaaaggggaaaaggaggggcaaacacggctttatgtttggctgttggaaaattctgctagtcctaatttagagaaagacttactgaaacgctatgggcaaaagagaccttcccaaaattatcttagacgtacaggaaacccagtgggcactacagagagacaggggattccattttccctggaccaatgccagcttccttacgctgggtcttctctcaccgccccgtgtttgtgctgctgtttttcatggaagtccccatgcgccaacaggaggataggtgtggtctgttaaaaagaagtggagcctgtgggcttgagcccagcgactgggaaaagtcacttttcctttctgagaatgcttgtcttcatctgtaaacgggaatactgaaaactatgtcccagggtctcatgtatgtgacattcgttcattaaatgaacatgtctgatgctgctaggaataattcactcacgagttctagaacaccatggactcgtgtctgggtcagagcaaggacaagcaaggaaccgtgaagtctgatcagtgtgtgtgtgcgcgcgggtatggtttgggttgtccaaatatctgacccaactttactttaaatatgtcatctaggattattcatggtaagaaagcaacctgcagacgttcactatttgagagccactttatttgttctatatgagacgttcagtacgattgattttgtatgcagttgtactcatcagcaagcacctataagagcccccactcaccctgctcacaggaaatgtcaggactcaggcatgggccccacagaaatagggccagctggggtcttgggttcgaaactgctgttgctgctgcccagccaggtgatgttggtgcgagtattcaactctttacactgtagttacatttctaaaactgggttaaaatagttcttaccttatgcacgtgcccagaggagcaagaagaaattggctgtagagagtttagcaatcttagcattgcggtgcttgatcaacactagttcacatctacctggctttaggttgttgttttttaggtcttcatcctcaatacctaaagaacttgaagccacagagagtgaagttcaagttaactagagttattgttaactctagttaacagtatgaaataatgaaatattccatatttcattatgggcaggttgggggttgtgtctgcaggattctcggttctgcaggtgaaattgtccctttgcccattctcacgtatttcttggtcatccttgaagggcctctcctgagtgcagtcatcttagcctagagttaccttagccatggtactgggacaggaggaagtgggtcagcaggactggtgggtgcgggggcctgtggggggaggttttagtcttcacgattctggtgcctggagtgctgagaccctggtggctctgagcagatggccgctgagtgagaactggtggagatgcgccttcctgatgccttgagacggttatttccattttccttaagtttaggaaatgtcacccaaaggaaacattttaatattaattaaatttcagtcaaggtgtaactaacttatttccagaacaaatggaaacacttataaacaaagaacaatttgttcaaataaccatgagatgcaagtataatttagcaaagcaagaaaactcaagaggctttggtttggcaacatgacataaaaatgcagaacagaatcttaggagagagtttccttcttgagagagcagaaagattccctccataccatttcctagcagcgcaactacttctcagattagcatggaaaggcctcccagactagcccgtaccctccaacagccaggtgagtcaggccaagacgtgggttccctgaggaagattcccgctggaaatttcagggaagaacctcacctccttccctttcttccttatttggtagttgtcctaattgtaacaagcatccaagttacaattcaagaccaagtagggacctgaggtgatctcctgtcctgtctgaaatccaccttcctttcctagctgttcccgccagatttcagcgccctcttcccttctcctcccaagacagtcttagctcagacaggatttccttagtcttagtcatcagctcttattgtccggcctcctccttcctgttgtaaaacaaggaatcttaacagcaagtaggccaaaattgtgtatcttcagtgatatgtcaatttcctgccggtaagtgcagacatcaggttttgtggtggttacccacatcaaggcgccagaggttggaaaagtcaacgcatttctagttaaggcacaccgcacagtgagttttcagctgtctgccttggcttttgtgaatgtgtctctgtccacccgaaggttctggttctcgcatactgggctctccttttgccaggcgcagccgcacaacccaggaacagtcctaacccattacataaggtggctaggcggggctggcgggtggcactgccaggtcacctccgggcactgggtgacccagtcattggccccctacggcgaccccctgccgcgtgggtgccactggcacctcccctggactcccagtgctgtgatttctgggcgatttctctgctctccaacaagagtgatttgttatctgcttctcacctgattggaatttaatggtctagaaacaaatgagttatttcactcaggagggggaaggaagtcagattagtcatgctggtgcttgatttttttttaatccaagaattctttacttaagaagtaaaagcaattaagaatagtactgaatcctgcctagaagttccagaacaaggaatgggatgacaccgatagatatttcaaataactggaaagtttagttccctctgaacaaagtctaactctgaggccatctgcttctttttatatcaaaacagagcagcgtctcaaagaaaataagtgtatttaaaaggaaagatcataggtagatagaattcatccgttttaaaagttgcctttttctcctttttatagcacctttcaaaaacatctcttctttcaacacttctagctcatcagtgagagagaacaaaaggctacaactgttgattcaggcaacatttttgccttcatgttgatttttcttcctcattgggtttaattaactagagtgtctaagaataaacatagaaaaaaggcctgtttcatgggcttttcttagtctttcacatttaaaaaaattaccttagatctttattctttctaaatatttcatgtgtttaaaaactaggtaactttcctgtaataaaaaataaaatcttggcacattatcaatatagcacctaccttacaaacacagtgttgataaactaaccatctgaagataatcttactaatgtcacatcaggtctcatatatgtgcgtatttatatagtgtgcatgtgtgtgtgtgtgtgtatgtgtctgtgtgtatatatatatatatatacacacacacacacacatagagagtgtacatatatatatacacataatgcaaacctgtgtccatttttaatatttttttcattgttttaaattgtggtaaaatatatgtaacataaaatttaccattgtacccatgtttaaatgacagttcagtggcattaaacatatcacatttttgtgcaactgtcaccattgtccgtctccagaacttgctcatcatcctaaacagaaattccatgtgcattaaatacctctgcatcccatccttcccccaccctctgttaatctattctactttctgtcactttgagtgtgactactctagggacctcacagaagtggaatcaggcagtgtttgtccttttgtgactggcttacttcgtttagtataatgtccttgtattagtccatgttcatgctactgataaagacataaccaagactgggcaatttacaaaagaaagaggtttaatcaacttacatttccacgtggctggagaaacctcacaatcatggcagaaggcaaggaggagcaagtcacgtcttacatggatggcagcaggcaaagagagaatgtaccagcaggggaaatgtcagatgcttataaaactagatctcaggagaactcactatcatgagaacagtatgggggaaaccatccccataattcagttagctccacctggccccacccttgacatgtggggatgattacaattcaaggtgagatttaggtggggacacagagccaaaccatatcagtcctgaagatgcatccatgttgtagtgagtggcagaatttccttcctttttaagccccagtaacagtgctatgctttttaaagttcttatttttaaactcagttttgtttctttggttgacaggtttcaaatggttaatgtcaggtattgcaaatcagagaggtttaggaaatggcgatgtgagacccagctccagatgaaggagcagggggcaaggaagcctggggctggcctgcctgcctgtctctcggaggcggcctgcccgtgcctctgttcttgatgtttgttttgctttctggtaaacgttcaccactctcccgaaggaggttggcttgggccgcactgagttggtttcctctgggacaggcatgggaagctgtccaggagggaaccgggtgtctgggtgggaagccagtgagcgaggtctgggttgcccacacaggtgcaggcaccagacctaaagcagttctcctggagcagttcctgaagccccagaactgcgtgagattcctcaggaggaggacaggggatggacgcgtcaagacaaggggagaagacatatggggaaccccgggaggggctgtgagaggaggctgtgatcgggtgcaggcctagatcttccccatggcttcaccaaactgacggtcaccagcctcccctcttcctgtggtactggggtcagaagatggagagtggagacagggagccgatgtccacctctggtcactgcccttcttccctgctagacttcaggttgctaagggctgggaacttggtttattcatcaccaggtcctcccacagcacaggaccttcacatagatgctggagtaattttattaaatcagtgtgttatttaactcttccacggggaccctaagatagttaaggtttctctgcaggcgcagctggcagcatgatcagaggctactgaggccgcccgagtcaggtcagctggagcgggagggcggatgcccagaggaggctaacaaagggcgtgttgccatctcctttttacattttgaaggctttggcatgacccccaataccagctgttacaaccaacccagcctgggcactgttgcacagtctaggaggagcaagtagacaaagatagggatccactgattctatgaaaacttgcagctgattgaggggaggtgtcagtccatgggaagtccataccacaggggttgggagctacattccccagagttcaagggcctgttgctgccccactgccttagattcctatgactggacatcagaggcccactggtgactctggaatttctgttgcaccctctgtggtcagggagctctaaccaggtgatgccccgatgcctgggaggaggagcgcatccacaggcagttccttgcctgagatgatgtcaggcatcgggatgagggccccccctgtggaagctggacagccgtcttgctgtttgcttttatattttttgagttagtcatgctaaatataatgtctctgcagctgtaaaacctggagctgaagagaatgagtgtctgggaagctgggggccagcccacaggctcctctcctagacagacagagcatgcaggatgcccagtgccagcttcccctacctgctacctgcagtattgcatacaataagggcaggtggagttgaagtcagaaaattccaaaggaaaggggcttcctcctccacaccaaatctaagcacaggccccaggtggctccctgaggacagggaccaagccatgggcacgctgcccccagcgcccagctgggcatctgctgtagcagctggagtctaagccacacaatagacagagctggtgggaggaaagagagagggaaagtcgagattcctggccaggaccgaagctaagtagtttggggactttttgttcagaatcacaacacaaatcattatgctgagtgcgaaaggcatggccctcaaaaatgtgcaccttgggtcaactgaaggttcctctctcattggtttcacttgatttgaattacagtcgaaaaaattattgggtagacagacattggcttatctgcaaagtcaaactaatgcaaaatatgcttcaactgcaagacagagtgccaaactatttcaatttaatagcatggtttttttttttcttgagcttcaatgcaaagggaagccaggcatctggccagtgagcagtctatgagctgagctgtgcttttcttcagggcaggcagaggttggccagtggccttcttggcactcccagaaactcagcttcatgggcgtcaagggtaagaatgtggaaggtggtctggtggccaaaatcacacagtccctggatgtggtggtcaccatccaccaatgtccactggtgggcgataactggactcgctccttcttgacacctgtcctgctgggctcttgatattgaggctactggaggaaggagcttgcctgagaaggcacttccacaaggagagggatctgagtccacaggggaggggaggtctcttcgcctgaatgcatgagaaagcatactggacatgaagccccagtcctggctgggggtcagaagagatgggccggagcagcactgcccgaacggatgcacgtttgactcagccgatttggatcaggcaggtctggggctcctgggactctgcattcctaatgctcccaggtgatggtggtgctgctgcccagggtgccacagtgagcagcaggtcctagaagacagcctctggagggctcttctggcctcgggattgtttctgccttgagtggttgctttctagcaatagaaaaatgtgtaggtggggcctcccggcccctggaatctcccgccaatctttaaaacgtggtgaggaccaccctacgcttgcctgctgattgatacagctttaggaattgggtgagggaaagataattttcatctgttggttctttggaagggttaaggaatttctcatttacaaagctctttatcttttgacgtgtgggactgagccttccaggatcatgtcatgcctgagagcacgttcgacccttagcatggcaaaagcagccttcacatgcacaaggaggatggggagaagaggcatcgtaactgactgtatgaaaacgtctgcgtccccacaaagatggactttcttacaccatccaccttagctcagccttttaccaaagtttaagccacatgtgtccataataataatcggaaatcaacgcatttttaataagcatttagaaccaatgatcagaaacagaaagtgacactaatgctttgtggagagtttacccgaagatttttttctctttgaaatgaagtcaaaagcacattcctccccacctgttacctccctaagttgttaaaggcagccctgtttctcctggagtgatacttgattctccctggtgatggtctgccatgcattgatgggctctagttaaaacatctctcagacagagtcctttggaaaattccatgaaagaaaccgcctattagagataaaagcaaaggttaagtaaccagatagatcatagaagtgtctcccagggaaatcgtattggaagatcagtggctgaggtaaaggacgctgggcttgaacacttaactaaggctgcctgatcactggaggcttcctcctggaggcttctaatccccgtgtcgcttcagcctttctgtcttctcagattgcttaccccggtaggtgctgcccttcccttcgggacacggaagctacactttgctttgtgcattgtcaaggaggagaaacaggcacttcctgccttatgaatgtgtcctgttcctgaatttcttttttttttttttagacggagtctcactctgtcgcccaggctggagtgcagtgttgagatctcagctcactgaaacctccacctcctgggttcaagcgattctcctgcctcagcctcccaagtagctgggactacaggcgtgcgtcaccaggccgggctaattttttggtatttttagtagatacagggtttcgccacgttggccaggctggtcttgaactcctgacctcaagtgatcctccctccttggcctcccaaagtagtgggattacgggcatgagccaccaagcccagccccgaatttcattttaagtcatttgctcagaacccagatggcacctgcccttcgcccaggggtgaggagcttccacctcggagttcaaattcatctccatcagtccctgtggaacctgggaggagatctgaatttttttattggaaaatgcatcccctgtgagatgaatttataatcctccctcagcaagttgctggtagaattaaattctacagtgtacataaggtacttaaccacagtgtctggcatagaataaacacccaaaaggtgcaattcctgcactttcctctctatcctcgtgcacctaaacctcagcctcctctgtctgtctccctagtggcagctgccagccttctgctcccctgagtcacggcgtcttggcaagtactgcccaaagtgtttcaatacagagatagctcttcagcctctctttcccttagcacattgcaggccccaggaattgtggaaacaggctgtttgaggacatctgtcatttgagctttcactcaccccagcatgctggggcccttcttgggccctgcagccttcagggcgaggtcacacagaggggacacgctgggcccttcctgctgccccgcgcctgtctggctgcctcatcagtgactcctggtctgctgggaggtgcccagtggaaccccctacatcccatccgattcctaatctatttcctggtggtcaacctggccctctgctcggccacctgtggacagcactgccttcccttgagtgtgggttggttcccaacatcagagcagttcacacagtctcagatggcagtcacccgcccgctcaagagcgtgaccactttgtgacctgatcaaagatagacaataagcttggcttcgtgataagcctgtttaatgtatcccctcctcttattcccagaagttttaagaaatattcaattagcgactcagagtcacaacccagatacctctgcctgtctccagcagacaccgctcccaccccagccctgtggttgctaacctgggctagcctgtccccagcacacacacacccctcctgctccaactctaaggtgctaacccaggctggcctgtccccagcacacacactcttacatctgctccctccctggtttatgattcccagggggcccccacccatggaatttgggcgtccccagttactctggttgggttgtttacccctccactggcttgcttcctgcccttcccggggggtcctcaccaacccccaagagctcagcacacacaatcacccactccgggtatttcagacaaacttctcctcgcgtcacagaccacatttgattccatccaaaacacaatctgtgatatcacctccaccacccaaccagccgtcccagcaggtcagtctcagaaatataactctgcattttacatttgactcttgtcatcaaaagacaagcaattgaatgtgctttagagtgattctcttaaatagtcccagatggtttttaagtgtgtgtctttctatagtgaagagattgggggtggggtgttgggttggaaaacaaagaaattcagcttgaagtagtcagcttgtgttgttttaggagaggaattcattctgtgggtgtcagtgaagcattaaaatccccccaacagctccagagaaatagttccctgctgtggcccacaccccagctaattctgttttcgtcattagttaaggcagttgtcctgggtgaagtcttagcacttgtccatcatcttttaaaacttaacgcttgaagcaaagttgtgactgtaaacagctttgcaactcttcggtcacacacacaaaatgattcatttctcatagtcttagtaaagtctaaataagtttttatcatattttcctaaaatcttttttatgaaaggttttttaaatgatgaagtgatgtatagaactgttaactcaaaatcatacaccacaaacctcatcaacctagactaatcactctgactttgcagtaaactgtaggcaagaaggagtcttcagttaaattaatagtctggaaaagttgatcaggaatataatctgtttaagaaaaaaatcttcttaaggaacttctgggacacttacttgtgggcaaaaatcaaacgttcttgataaatattacgaatttgtttaattcgtcctgaagagcctctgtcggaggaccatgagttccttgctcagttgttggattgtttaaaaatcagttaaacattgtttctgttttcaaaattttccaattcagatattttttctgttccaccattaaataaaattaggaatattttccactctggcttggcatgggagaagagacaacccctggcaggcaagttcactgctatctgaagcaaatgcggtgcaagctgagatttgtgtccatcgagcattttactgtctttctctgtctcatcccttggtttcatgaaatatgaaaatagaacagcgcacttttcagaagaaatcgatggctcagacacatttaccttaatgggctgctgggcacgtttaattcaacgactgtgcggtggtaaggatggtagataaggacattgttctctgaagggctcgttctagaccagcttgcccagactgctgtgaaggtgatccaggggcccagagcagacagagagatgacgcccagagagacgggcgggctccgtcacccagcagcgtctcctagcagatctgagatcctagcggatccaaagctaccatggagccctagtccactgcagtcttgataaactcatgctgtcatctaattcactagctaaatcacttcatatattagatcactttttgagaaaattacatgactcactgtttttaaaagcctgctttggaaatgatgaacagaaccttctagtagtccaaaacccattgagctttgtagaacaacattatggaacaaattttatacttctttgaggtcctgtattctggcgaaaaataaattcttcttctattttagcacaatgtgtttaaagcccataatcagatacagaaatagaaaacatgctaatctgaataaaatgaagaagtaaatggagaagtttagacctttaagcaagttgcttgttacttcaatacttggggtattcgattttttaatgcaaatgttttcaaagatacactaattttgaaataatgtaagacaccactgcaatcactcttacattcccggtagacctctgagagcagcaaccaccctccaccaccccactaacatcatcttgaatcaacgctttaagaaaaaacatacttgctgcagtggttctggagctggagaaggaagatagagccagccacaggtgggcgtgccctgcaggggaaggcgtctagtggtccctccgtaccacagagcattcccaccctcttccctcactgcgggtgccacatatttgttgtggtttctttgtggttgtcaaagccaagtttcataggtgttatctcactttatcctcatggcatccttggaaatagagggcacaggtgcagtcataccaaatacagacaaaggaaaaatgccagtggaagtcaataacatgcctgaggcctctggtttgtgaagagctggtgctggaaccctgactttcttttactcaaagggtttgtcccaagcgaattattccaggtccacacggctctgtttgaagtacttcggtggatgcatccatctggtattctcaaccaccccatgaaagagacagaggaaggttatgaccaccacggcactggcaggaggagagaaaaacgcccagtgatggctcagcacacccagcaaagtgcataattccagagggtgaagggtgagttggtgcgtgcagtgaaatacgatatgacgaggccaacttttcatctgtttaaaggacaagaccaagtgtgacagattcaagtatatgtctttaagttgccaaatgaacactgtgtgtattttgctttttggtaaatacaaattactcttctgaaaatttggaagcactgtgacagttttctaatgaaattagacggagaatgagttttaccattaaggactcaaggctttccacggcccctttaactgagaatggaccttgattttgttttgcgagtcactcttacagctgcatgacttcatctcaagcaagctaaataaaggaattttcggtattataacggtcactaagcagacaactgacgtgtcagcgattagaaggggtaaggtttcggggcgagtgtggaaagatactgctgtaacacgatgttttactcggtggcttcattgtgtaggtgggtggcgagtcggaatgaagctgggaggcgcggggtggaggcgggggggcagccccaactccagagctcttcccagccagaatgtcagtctgattggggcaaatcccctgaagtctattgaaactccccatctgcctgttcacaattcatctaagcaactctgaaaagaggataaacctcctcaggccagtatttctgggattctgttatggttcaaagcagagtgcatatctttgtttttccaagtgtccgatgtctgtctacctctcctcttggaaacgcttctccgatccgcagggcacgatggggtccccgcggcctgcggtgccttcccaggctgtatctacatgcagcagggctgacttgggccttctcctttaaatgaaagacctcctactagatactttttgctgagagcaattagtttccaaaacagcaattaagaagagtttgctagcagtaactgccagcagagttgcctgttttgacctattttggctgagtggttcctctctaaatggtttggtaatcagactattaggctgctggggagccttccccaccacattcctctatggtgtgtcttccatctacccgatctcgccgtgccatcactactcatgaaattgctgtttaaataaaccctgggtgttcagattctcttaggatcagtaatatttttttctttccatgcagctttttttttaaaggaaatttactgatataattttcttctagaaagatcacaatggtcttaccatcctccaaaaatcagcttgaacattttatactggtcttaaaatatgccaataaaatcgtgtgatagtgccaggccattgcaaaggacagagaaagtcatatattacagttcccaattatttgagaatcatcctaaaagaggaggtaagaacagggttatttgagagatagaaaacctaccccaaatctccataataatttttctgcagtagttttccttttactcatctcagatgtccaggctgttggaaagaggggacgaatcctaatttttctggcttattaacgtcaacagtgatgaagtcctggagccaggagagcagccggccgtggctgccttggcccatgcagactcacgcctgaccctcgttactgggccgctgacttccacggtgctgagaggtgggaaaggaggtgcacccacagcccatgggaggtggggagggtgatgtgttcacagaccgccggcagctcttgattcaaatcattcacaaccacaaagccaagtttctaagaccaagggcagtaggaggaatggaggcaatattccaaacaccgactcaaaaccaccaacaaaagaatgtgctatctagtatttactctcacaatgtttgcctttctctgattcctaatgagttcaagcacttttgtatagatctactggccatttggttattctctctgtgatctgccacttccagccttgtgcccattttcctgttgggtgtcattttccatacccacttgggaactctttgtatcctaaatacagtcgcccatttggttacctgtgttgcaaagaccttttttcactctgtcttttctgtcttaatgatgtccaataagctgatgcctacgttttattgtcatccaatttatcaattttttatggttagtgttttcccaagctcattcattaattctaaattttacaatagattctgttgtgttttctgtatgtaaaatcatgtgatctgcaaataatgatggttttacatccttttagtcattatacttttttcttttttcaaccttattatactgtctagaatatattagcaatgttaagtcaagaaaggcttattagccaagtatacattaagtagacttcaccaaaaagctttgaaatgcatattgaaacctacataagggctatttgcagaacccaagctcacatttaaaaccgcgggatctccaaaatagctttctggactacctttgaatggaaagggccatggcaaacaattttccaagtcctcctcatctttagttaggtttcggtcagagattcaaatgcaagagggatgtaaaccagggatgaagtgatagtggcagcaacacaagttcgttctcctgtcgcaatgatagacaggacggctcccacacacagcaccttcttctagagcacttttcctcctcttctctccttttgtcctcttgagtttgaacattgatggtggtacatgatgttcctaaaaagacaagcacaggcagatagagagaaacgttgggcccacggaaatatgaattcatccagatttctactgtgttaacttttaatagaggaatccccttctatgtttgtaccatgtgttgccatccttaaaaactctgtgttgaaaggtgaccaatgagtccttccagtagtacctggtttccttagtaattgacttgtcacatatttctgcatcaacagtattctcaaatgcacgcttactttcagcaatggtgaagctcactgctgagctcaaagtccttcacaatctgaacacacggtgctatttccagaagcccaaattcccatggtagctatgtaagttgtatctctgagtcagcaagaagtgggtgcatgaggcttcccaacccaccaggtccttgcaggcagccaggcttgcttctggagagggcagagggtgaagggctgcagctgtgcatgtggtcagccccatcatcctaaggagatattcctgagtgtccaagaaaagcactgctccaccctactttctgaccttgacttatgacccctccaggggtgtagtgaccacctgaaggccactggcccggttactcagaaatgtacctctttgaatgctgcctgcctcgaggtgtacctctcatcatcacagaaggaccaccgcttactctttgttaatgaaatctgagatgcttccaccttcctattcttggaaaacattaggagtcccacacctcttgcagccctgatgtcctgggacccagtgtccatcccacatccagcctacttcgtccaagccaggtcctctgagctgtttgctgtgacattcagaggcagctttgctatctgtgaggtgtgttctggtacctacaggctccgtgagcactgtctttcctcactgatctcttctttaattctcttcatgggggcgatttcttgtagcactttttcttctccaaacattttctaacttacctaagatgggttatgattgaggtgtcccctggctacgacctactgcacctgagatgggaagaggaccgctcacgaaccgtggtcctgctcccacaccccaataatgtacaacttttcatatcgggacacagccactgcctctgcgagtctgaactcgttgccatatttctgtgtgcttttattctgggccttgggcagtcccatctgttttgttgtatagttatgattataaataataagagctcttaccttgtgtgataagttcttatcacgatctaggtcctgggcaaggtgctttacacgaatgacctcaagtgacctttagattaaccctctgagataggaactaatgtcatcctcatctcacagacaaagaaaccgagtctagaaagtcaggtcatggtggggccggcaccgcccatggagctggacttgggtgctggccccatgctcctgctgagttcggctggatggcagtgaccatgcttgctttgagggcgagggtcacacccaggtgtggcctgtgtccccaggtgcctagacacggcctgaacacagaggcgtttgataaaaaatgtacaatatgacgcacagtcagtgcctctctttggggctgaatagcgcatgcccttaggttggacagtaaaatcggccttcttgacattcagaaaggctgacccagctttggaactctgcttggtttgtttgttcgttcctttgtttatcaagcacagcagatgtggcccgcatctaacctgttgtgagcaccaccaccatctgcatgttggaagtgcctgcacgatgccctaaggattctgttccagaggcttcccttagatgagaccacagagcagccgtctgcctggggagcagacccatggccgcattccagaaagagtgttcatgctcatttctactaaaatccaggtttcgcacttggaagcggcttcccttcccaagtagaaacacattccatttccttcatacctgtcgtggtcatggcacactcattcaagatgtttatgagctgaacatatttgctccttacagtgtggatttatagtctaagaaacttggaaaagcctccatgcaggatattgtgagacaggtcaagaaaattccattccccaagaacaaatgttatgcagccagtatataacaatgctttgtttatgcagagcatttaggaatatggagaaatgcttaatgtgaagacaaagtaaagatgcaaaattgtatagaaagtataatccgagttatgtagaaagaagtgcaagagaaaagaccagggaaaatgctgaacgttctcccggagcaggcctgcttcagccctcggtctgattcagcacagtcagatccacgcagcccgtcttcagtccagggaggaggaagataaagagctgggggcccagctccaggtgacctcaactatctctctgtccctcacctgtgctgctgccctgatccctgggcatcttccctctgcagaggccgagcccccagcctgtgtcacacttctcatccctgggcttctccttggccctctgggctcaggtgcagacattcatggatcctgttcattgatcctgtggttgggagtctgctgacctcctccactgcctgcaaccgtgtctccaacacaggcgactcctgagttctctttgtaatgcttcagccatggctcctgctgtggtttggctctgtccccactcaaatctcatcttgaattgtagctcccataattcccacatgttttgaaagggacccagtgggaggtaactgaatcatgagggcggtttcccccatactattcttgcggtagagtaagtctcatgagatctgatggtttaataaggggaaaccccttttgcttggttatcactctctcttgtctgccaccatgtaagacgtgccttttgccttctgccatgattgtgaggcctccccagccacatggaactgtgagtcctttaaacccctttttctttataaattatccagtctcacttatgtctttatcagcagcatgaaaatggactaatacagctcccttggtgcccaaagtggtgactgagctccagtttcttgtccctgatgtccactctggctgatccaaacccatcacatgacaaggcttggccacccatctccaaggtggtgacattttactctcaaactgaagaagataaaattctgggatccaaaattactagatgcctttcttctatggagtttaaactacttcacatatactatttcactatcctcacaccacgtttttgaaacaagggtgggaaacagatagttgtggcacacactgttcaaagtttccacaagatcctggaagtctgctcccctgtagtgtgctttgcaaaaagaagactctcgtgggcttctgttggcaatgtagactcatccagtctcctgtggatggccacttcattacttctaacccacctttccccccagagctgacatatgtgaaaatgaagactgcaaaaatttgcctctatgtatcttcttggagttttttgatttttaacttttttagtctcggctattttgaactattttctccactgctctaatacattgaagtagagaattgagagtaggccatttcctcttttcctggaaaatattctgatggctctctttgataatttgtctgattgtctcaagcataactgatctttcatgaacacgcagggaatcataatggcgctgcactcggaaagttgagtataatggtgctattcatgaaaatagatgaattcaaaaaaatgggaagcgaatatcaaaatgaagttggacaagtaggtttttataggctccataaaacaaaatgcatcttagaagaggcctgggaggtgggataacaatagcggccgctggaggagggctcctgcgcgctgcccagggctgggctttctttctgatccttacgacgacctggcctagtaggcctcatttcatctgtaaaggactatgttgtggaggaaagagttaaacatactgttgttccctttcctggggaaagggggtccctttttatctgcatcaggggttttgcttggggaatataggaggcaggacatggacctcagggggtggcatctcatctgcaagcagctcatctgggagcttccttcccgaggatgtttgaacatattatatacagagccttgaccccagggccttattcctgaagctttcgttgatcagcttctgggaagcctccagcaaaggcagttcttcctctgctccctctgaagcagttcatgggaagagtcaccacattcagcctggggctggcatcctctggacaacatccattcccacgtggcctgggttgcctctgtgctccttcacgggacactcacaccagttcctatacaggttacatcagaagttcccaaatgttgctctgggtactgcactggttagcaatgcagttttcaaagttccaaggagaaatgaggggaaatgaggaaaacagactgcgtttatctatggatgctgatgctgttttgtacacgtaggacgtataatatatgctcactgcattcaatccgtaagcctgtaggccagtgacagttgcagtcctggcgctctgattccgcggttctggaatggggcatgggcgccggaagttttagaagcacccggcatgatgctgatcacagccaagtttggaaaccactgggctcgtgtgaaggacactgtaccctgctgtttggaatcataaacgtaagatttaaaatgggctttcctaactaataagtgccagtgagggctcaacagctgatgggcagtggagtccagagtgatggtcccagcaagcgttccagcggcatctgccaaggctggaagctgttgccaggctcgagccagagcagcatgggcaggaagctcctgatgggcagtggaagtgagattggaccagcgtcagagggcggatgtactggtggcaggctcagagagggttgccttgggattcacaaagcatggcccatggtgtccagactgggggcttttgaaggcttaggctgatgttcccccttagccacacccttgctatccaaaaggtcctgctccacatctgaccgcaagcagccctctgacacagtgctggaggctctaagaatctgaagtctgcctgtcccagggaagtccctgcagcaggttctgctgtgtgtgtctgtgtccccaagacatttttcaggacagctttgggaaaagcactttttaactgttaaaaatagagagagcattgatacttgtgaagatatatgtactcactaaaatatatgcagtgagcatatattcactaaatgaacatgcattgaaagtaaacagcatgatgccaagggcttgaagttccttttcttgttgctttgtaggttaatgaggccaggggtgtggattaacagtattctggaatcacacaaaactctccaaaggaaccatttatgccaccgtgataggaactgcgtattgctcacttggatcctaagctgatttttaaattagatctttccgtgatcccttgttgagtctgtttcatgtgcattttattatattctataaatatttcactagttgtttctaataattagagaaaaagtgtctttcatcaatttaagagagaagggaatagtctgttaaggctgagcagttactgcatatgaaggctccaatggtgagcttctaccattagctggcaaaaaagagcaaaaatgcaatggaaaacagtgagggagagagagagagaaagagagagagaggagagaggcacagttactgagccatgtggccaactattaaaactaggagaaaagacacagaaaatgttgtgtgtgggggggggtgggggtaaaatgctccccctgaagagcactgaggctctagggagcccgttaaacccagataattctactagagcaggagggagctggcctgggccttcccagttagcactcactgaaaacaacgggcctctgccgagaagctaaacctgggaccccagggatggtttatctggaagattaggggagaaacgtgcaaggcagccaaggcaatccagccatctctgcagctgggaaaaggagtgattgttttcctgagctgctagcctggatttgcagaaggaaagaatgccttgtttctgtcccctgaagacgcaagctgaaaaaatgtctggctgctcttcgccgccctcccaggttctctcccacagccaagaacgactggctgctgccctgagccgggaggtcacaacgcttgtggagtaaggagctcgggtttttgtttggggctttgttttgttttcttaagtatctgcaggacaatgtttggaagagtcgtatgccccataaaaggaagaaaatggtgctcttggattgtaatcagtgacttgtggttggcagttatgcctctgccttcagtactgcaggcctgtgccttccacggaccttccctaacatcatttctggagatgatggggccagctctttaagaaactattttttcacgttatcatgtggtaagaacagagatgaacctcagagatgaagagtgtgattgagctcagagaaacttcagtgacttgattttaaatgggccaaacagttggatttcttttaccttttgtgcagaaagccttcgtttagagaaaagaggactgaattctgatggacagtaggtgtgggaggggcagcatgttatcacaatagcatcgtgatgagattcctggatggagggaatcactggtgcttgcatatttggggcttcatcttagggaagttccctaaaatctctgtagcacccagttttcgtgggaagaatgtcgtgggagcaggggcttccctgaccttggaagcctggccggtcagtctcaaacgagtttactgcctccgacccaattgtgaggactgagccagagggagtgcatgtcagcctcagcctccagcagcacagcccctttctctacaagcctcagatataggggaaaaaaaacaaaaacagagtcaaaagtaggtcttcattaataaaagactgggatctcccagaattaatcatcttgctcatcttttccagttctggaaatctgatctttgaacctggtatcctcagtcttagcacaatacctgggaccataatagatgctcagtaaacttggtgggaggaaaaaatcaaagaaggagtcaaaatagaggtgctcggtgccgaggagttgctaacctggaccatccaaataatgacagtctgtggcacttcagaagcattccagaaatggaacaatggcactccatgaagctgtataaactcataatgtatcctgtaactaacccagtatagaacagtaacactgtttacactgattggaaggaagaaggttcatcctggcggtttatgacattgccagaatggcttgaatccttgagggtgggtgacaggtagagtggataataaatgggcctcctggttcacagagcctgagaacctctcacccaatgggcacctggtgcccctgcagagtccagtctaagaggacaattttttttttcagatgtagtcttgttctgttgcccaggttggagtgcctgatctcagctcactgcagcctccgcctcctgggttcaagcagttccctgcctcagcctccctggtagctgagattataggtgcacgccaccacacccggctaatttttgtatttttagtagagatgcggtttcaccatcttggccaggctggtgttgacgtcctgacctcgtgagccaccgcgcccagccaaggacaatttactctagccacagatatggccatggtcctcatgtaagctgactacaaatacagcaaatccacctttccaaagacttcattctaaagatgtaaaagaacaaaaagagataaaggaagaggatgagaagacttgagaagagtggaagtgtagaaagaaaatgtttaaggttcatcccctccccaccttggggagttcctttggcagcatcttctgaagggtacttctcctagcccaggggcagaaagatccagtcttttggggcagctgcggaagaaaggagagcagtcctgtagctcatgaagacattacgaagcacaaagaactgcacagggacagagagtctttagggtctcgagctcactctatgtccttggctgttaagttccccgagagcaaaccccagcttctcgcttgcttcaggctctgcatgtgtgagtgtgacccttgggtactctcggggcgttttcagccatgcgattctggggacttcagaggactctgttcctttctgactcgtgttccggcgtctgtggattgctcccaacaggaggaggagtattgtctattaagggaaaagatttcagtgacctggcagcagggagcgtcgtcagtgtttgactgtttatggtatgtcagggagctggttcctggcagtggcttccccaggggtggggaggggtgtgctgggggtgacaggaagcactgaatcacgacagagaagggaaagaagcccgcccgccacttccggtgttcactgagcaggtcggtggccagcgctgccttcgcatcagaaccccattttaaaacacatccaagcgcgtggcgtcatcgggacgacgggcttctccccagtagagtgtcagaccaacaccgccctgcacaaagctctgtgttccctgctttctgtcatgttcccacccatagccagaaatcccagctgctggccgtccagcccctatggagcagtgactaagggtggctgtgggactcactcacgagccttaggttgggtgtacatagtttgtggctgattaggtgttgttaaggatttactgttcagggctgttgatttctgccactggcttgtcttctcccaaggacaaggggcctgcctattggcttttagatcttagcacttagcagactctcagaagtgtttgctagaggacgttttctggggaatgtccacctgcactgatgaaaacaactcagtaacaactccactttgagaggagcagagcaggagccttccttaggtgtgcgtaaggggataccggctttaaagacgccaggctgagttgctgtgtcaggattgattctttacttctccatctggaggtgtttctgctttatcagtttctccttgtttccagctctgtctcgctgccagagggccgacgtttcctggcttttgttgtactgtggcacacagtctgttttgaaaggacaggagcataataaaagcggatatgaaagaagggccagatgacatcacatagaatactggaggaagtccgcgtttgtggatgtttataatctcagcatgttagttgtttgtaatatgataagagcacttttgatacataggaggactacaagccttgttgcttagacaggactcacgaatttttatcttaggctcatagtgacgaacagagaatggggatcttggcctggatcccaagtgaccctggctcattggttgacctcgggtacaagattcggcatagatgagccatttaaattgtgcctaagccagctactcattgaattttttaaaagaaagagagagatagaataaagaaagctaagaatttgacttattagagatgaattagcttactaaattttttccttttgaaatcttacttcagagaaattgatggtacctagaacttaacattaaatcaagtaagacccttttaaggtgaattctggaagccatatagagtcagcattatatgcatgcttactcagtgaaaatcctaaagcatgcaagtgtctccataaagagcaatctccttgaacaataacagtgttgacacctgctgttccccaggtctgtatcgtgagatggaaatacaccagcatcttcccccactaggggaagatgataaaatgcaggttaagaacatggaccatggatgctgggtacttcctgccgggagccgggcactatcctcacctcttcccgtgggttaatctcctttcatcctaacggcaaccccaggaggcaggaacagtaggttctacccattttttaaatgaggaccctgcagggcatgtgggatgagcattcctcacaagaccgcccccacgaaacatggcctggagcccgggcacccttggtccaaagcaaatcaagtttctcccaaacacagtgccattcagagcaaaccaaatctgcagcactggagacccgcacacccgactggaagcttagggcagggcaaaggcacaagacagcatcatagcactctggagcccaggaagaacccatcttcttgcaaacactccagattaagcgtaaaaagactagaaaaatcaactgtcttcatgcactggtataggagagcagggtagagctggctcctaaaatttcacactcaggagactctaaaaatcgtgctcaaacctaaaaatgtgtgcatgctaattccaaattagccttatcgacagaggttagcgtccaaaacttggtctaacctagtccagggaacatgcaatctttgcaacttcatactgcagtgactgtgtgtgtggtctctgattgtccatcgaacacaagaattaaaatcccaacaacctagtgaggggcagagaggagtgggattgaaaatccactgttgaaatatccaggtagataatccactcccaaataacggagtgctgcctgcgcctgtccgtacccagtgggtgctctcctctgctggccccaggagtaggcgtctgctgtgacttagagcagattttatgcacagaccttcttccaggcagagaaaaaactaccgagtgtgagttcacagcaaaggcatcctcgatccctgctgatgtgggaaggcataggtacacgccgtctgaaagctgccaggcgtgattcacttggcagcgtacctccaggagaaagggcggggcagaaattcagaaattctaacccagaagccaggccagcaggtaggtaaagtggctgtcgcatgggtgtggtgttgtccatggccccaaagcccctgggactttgatggtcaagtttgcaaagataaagctgcaggcacctgaggctgagcctgcccgggcagcgcagcgctgctgtgtgccaatgcaaacggggaccttccttgcctagaccagtcttcaccaaccagaacagaaatcttattgtattctgaaaaaggattcctggatctctttcattccatgcttttcagatttttttctcccaaatttagcacagagggcaggttttgaacagaactcttaaactgaaggtacttctctggaataaatagcttcaagagatggacccactttgtttattaccaacagggctaaatatttaccttagacctatatgccaatactaaccacatacacattttcattcattgccaaagaataccaagaactggcatgccgtataaataattaaaatttagtgtagataatgtgtgaggtaatgcttatattagatgatgtctcggtgaactctctccctaacgaaacagaagaaaaacaacatagctcataaatatgtaagggtatttattctaaatgtaacatgtgaaactcttcactgcatgtgtacctatgagtctgaaaactcacttctaactatgattacattgatggcctcttgaacaagagttaaaagctccttgtaacttgttcttctcaacacggagacagaacaaaatccctcaggctattaaaaggatgacatgacaaatagccttcataaaagatggtcttttatgcagccaattttcttattagttatttgacgacaacattgaggtttaaatgagtagccaatgagagaatattgaagtaggctgtttgttacagcacatctcctctaactcatacttgctgataggtaattggaacagaagagaatgatgtcagtatgagatggaagtcatgttagttcatgcgtgacatttttcccagcatggtgtttgtaccactgagtaacaggatagctgagggtaagtagaagaatacacatcagcacagcaaactgtcaaggaatggaactctatacgagaccccagggccgcagtattctctctcttgcctcgctcaggccacatactctccttagaaatgctttctccacagctcttcccaatctttggtcatcctgtccttgctctctgcagtgtagcagtctcagcacttccttacacccccttctatgaaactatgccatcacttttcttcaagataaactgttttatttactgcaatatttctttacttgagaagttaacatgtccattaaactgtgctattatttgtattaggattgctaccaattttattaaggccctagttacaaagttgcatcggtattgagtggtctgccccagctctgtttttcccatggacctcggtggtttgctgtgtggttttgcagagtgtgagaatttttcagaaacagtcatatactgtgttacagcagaaaagcctgttcttaaaaagaatgagtggggactagatgtgaatcaatgtgatttgactttcttcttcccaaggtgagtggctggtgtgtttgagttggtcttgactacactgacaaggaaggtgagggtatggaggacattccaagctgaaggaacagtgtgtacaaacgcaagttctttgcgaggatggaacttcagaggtgttcatactcaatgcattgaaaatcctcacattccctcagcatgtaaaataagtgattaagcattccgctgtagttgaaagaaaaagagactttgaaagtggagggaacagtggatgcaggggagcagaaccccagtcggcgggtctcaggagaagcgaagcctgctgttcctgggaagcagtggggtgcaggaatcagaggacagcagatgctggcttcacaccctcaccttccctatgggtacagtcgaggcctcctcaaacacaccagccactcacctgggaaagaagaaagtcagactcacattgatgcacatctcgtcctcacccgttctttttaacctgatatgggctctcaactaaagggttaataccagaagcacccacctagctaagtaccgacctagacagccattagtgatttacaaaaacatgaagggtggccatctatattaggggtggagaaggacagggggcaagggaaggtggtttctggcaattggtccactgacacacccccagctgctgtgtgggacagaagtcacgtgagtcagatagcaacacccaggctctcatcttgttccatctcatctgtgcctgggcatgtgtacctgtgcacagggggaccaccttctgcaaggtagctggggtgcgtgttagttctcagaatagtgccagctgtgtgtccacttcatgatgacatcaagaagatgggctttgggatcctgcccacacccagctccggggcgctgctgatgtatctgggcaaccccagccaggatcctgggctgcctctatcaccctcacaacctgggggccaggagccagcaatgaaggccagtgagaggtgaatttggaaatgaggagctttcctggggtactgaaggaacagtatcaaaatacttgaaaagaaagagaactctttcttgtttgaggcttttggggcgttgtttcctgcgtaactcaaagccttgggaatcccagacagaaagtcatttaagattaacttttgaaatcaagtgagtaagacctgattcaaaggagaatttagccatgggttaataaatatatctaaattgcaatgaaaatcttcagcggtcttagccgttgatcccgtggtcaccatagacaatataaggagcagtgtctatggcaggagtgatggaacagatttcaggaagtaactttgagtgagagaagcaggggccccagaactctagtgaccaagacattcgaagacaggcaaggaaaccttcaaatgcaggcaactcatatttcgacggggcaccctccagtgctccgagatggaaattgcctgcatttcagtgccctgttctgtggctccagtgctctgctgtatgcccactgtgaaggctgcttgtcacctgtgctgcccagctcaacccggcccctttggtcgctgtcctgcctgcctgacggctgacgacggccccacacccatgtctacaccctgggtgtttgctgtgtaggttccaggcttctagaccagatgactcaagatgaggcacatgtgagtctccacccagcacctaataaaaccacccaacaaatgagggctcagctcctcccggggtgaaggccagggtgctctgttgactaaggggaggccatgaaagaacggggaagactggctctggacagagcctcatcccctgcgcttatcgtggctcactgccaagtgcgaacacctgggtccacgcctccgcatgccgggcccgtgtgcacacctgccttcctcgctggtgagagggcgcatctcagcctgcttttcgcctctagaaaggcactgagtgtgaactgtgaagaagtggccagggcagaggatgtgtgtcaggaaatgccaagccccctttcctcactcagccagatggcctacctgtcctcacctgaaaccaggcccacccatgctctgagatcatctctagcccaggacaaggcatttccaaggcagcgttggcttagactatgttggctgggcttcacctctcattcatgtgtcaggagctctaggccggggagccaggcattggagaccctttagctgggaaggctcggggggctgagttacatcaccaaaccctcacagcagccctgtgcaagggtgccatcatcctccctttgtgcagaagatgctgtggcttcaaaggaccagtcacttctctgcctgaactcttgccctttgctacatcattcatgttcccagttggcccctcacacctgctcttcagcatcctgggttctcagcagttcctacctggggccctgcctgccatccctccactgtcattcagcctgctttaaatgtctcaggatgactaatgtcactgggatgtgttctggccctggcctttggcccaccacacactgcatgccctggcagtcaaattcctgaattttttctggagccagtcctgcccgtcaggacccaagctccagcactaaagtacggctgtcagaggtggccctgccaatagcacactgtgtgtggaaaacacccagacattgagctgcctgaggagaaatggaaggtggcccacttggccggtcattgctcgttaaaatgtaaaggtgtgcagatatgaaaacacggggcttgttgccgatgactcaggggagggcaccgaacgtcatgcctcctggttatgtcttgccgccgtgttgaaccaggatggggaatgatcccattcctcaggtattcgtctgggagaccgtaaaggattgcttccagacaggaaggacgtctgtcttcctaaagagtgtctagcccaactcgttgaactactgtcatttctttctggttctcctgttccaaatacacagcctgagctcctccctccttctctgagtctctcagttccatgaggacaggcatcgacgcagtcataactgctggcactcactggcattccagaaaagcccatggggcttattcattgtacgtgggggagcgcccctgtccttcaggcatttcaccatcttgagctggtgactagttcaagaccattctgtagagtgaacacatttatttaggatgcccttgaagtactgttaaacaaaggaagctgaattggctggctttgctgcccggcatatagaagaaggatttgtgctgggtggtacaactgtgacctgcacttcctcttccatataccttgccctgctaataccatgttggaattatttccttaatttctaaagctgcatgtgcggaaatggcttatatttcctgttttgataaactaatagaactttactgagaaccttgttcccgagttggctttcttctcttttggcctcttttttgattaaaatagtaattctaaaagtccagcttgactggacttgtgtcaaagacaaagaattgtatagattttttttttttgccttgaaaagataactttttagctttcaaaaggatgataactttttaacaataggtaatgttgatcttgtttgtcacttggcgtaggtttttcagtattcctctgtggagggaatttgggttagatgctaggcacaatccaatcgtcagctatctgtaaattcccttcagaggatggctcttgttggctggaggtaaattggcttaaaaagacttccttggacaagaagtttcttggaacatgtagaggacaaaatattctttgttttgggacagatgagttttgttcttgcgattcatataactcgattactgctcattttctatgtgcaagttgagaacaatgaccagcattttttttcattcgtctacatggcatccactttaaatgatactcatgtctgaagagggctgggtgcatttccatggtttgttcccttgctatatgttgacaatttgcagtggtagtagagaaatagtagtctcaaagagtttaaattgtttatgtgttttgtttcctggcattcaggttgtcatttaaacctatttttttagtgtcctaaatataaggaccaatctgccatggagagaagtgacattgggcagttttctccacgttttgagatgggcgattcctcagacatctaccaaggaggacacccttttccccggtggcaaaggagggactctccctctgcctggtggcacaggatcctagtgaaggcaacacgatactctcttctcactgtcattgggtcactcacagaagagccagggcagcaaccaggaggaccggatgtcctcttaatcctgcagctgccactcttgatctctgctccaactccactgtatcccattgataaatgacagagtctctgctggcagccaggcagctagtgactccaagcaagaaattctgcatttgatcctgataggagcctggttcaagaaactagaacctggttttccttaaagggttccatgacttttattcttccagaggtaaaagactcaccaaggaatctagattgtgcatctggagtgatttgatgtctatggtaaatctatccatgcaaacagatggattttcatatcttcttttttttttttattgagacacagtctcactccgtcacccaggctggagtgcagtagcacagtcgtggctcactaaaacctccacttctcgggttgaagtgattcttgtgtctcaacctcgtgagtagttggtattacaagcgtgagccaccatgtccagctaatttttacattcttagtagagacagggtttcaccatgttggccaggctggtcttgaactcctaacttcaagtgatccaccgcctaggcctcccaaagtgctaggcttacaggcgtgagccaccacacccagcccaatttccacatctttctaaatgtaatgatgccaagatttaaataagactccaaggaaaagaatttccatatatgaagtcaaccaagaaatccctcactcaaagattcccgttctgcacctggaaaaaatgtctgttgcattccaattgagtagaatgtaatctaaggtttctggaaaacacatcttatgcctttacatacactgccaactggctcctaaacatttccaattcctacagttttgaattggcacagcaatgctggctaccagtttcagaacaggaaaaagaagagctctagaaggatattttgaattttaaaaaaattaaaagagagaactacaattttttttagcacttggagggattagaggctcagccactgagtccttagggctcagagccgccccagatgcagcacaggtcacagaggtcaaagcaaggtccaagggccatcacttttctaggacagacatgccaggcacccactgagtcatggaacatgctgaacctgtaataactcctaccttctgttgcacccagggtgatggttcagtggtttccagctttctcactatctctaaacaaagcctgttttcacaatgcccatccgaccacctagtgtagggctttgcaaacctcggtgtgctaacctggaagtcatgctagaaagcaggttctgctccaagaaaggtggggtggggcctgcattcctcactagctccagggtgatgctgatgggccctgtccacacagcacacttgccatggcgggggccagctgggagagcagctgcccttcagacaagcactcatgacctctttgactttgtgtctaagtccctgcctctgatcagttttcctctctgtttccctcttattccctcccattttatttgtggtacaacttccaggtaaatcttcctcaaactctctgtccagtgtcttctttgctacctgctctctctcttgtttctttctttctttatttttattttttctttttgagatagggtcttgctctgttgcccaggctggagtacagtggcgtaatctcggctcactgcaacctccacctcccgggctcaagccatcttcccaccccagccctccaagcagctgggaccacaggcgtgcaccaccacacccagctattctttttgtttgtttgtttgtttgtttgttcgtttgttttgtacagacagggttttgctttgttacccaggctggtcttgaacccctgagctcaagcgatctgcctgcctgggtctcccaaagtgctgggattacaggcatgagcccccgcacccagccttctctcctgcttctttgctgcctgtggctttctctaccctgctcctcccttgccggcgtgggttttgtccctaagaactggtgcaagaatgaccggtccttcatctcttccttgcagctcagagactttcaagtctaccttgcttcttaggtttatgctgctttggacacttatttcctaaaatgtataattcacatttatttttcagaactattccttttggttccacaacactaaagatgtcaagagcttacaataatcagacttagcaccccttccctttgtccacagtgcctctgccagcttctttaattcctctgcctttcttgaaggagcagataagtccaatggggtctggcctccaggttggtgtgtgatgagatagttggcaaggtaggactgcctgcaggtcctcagtaaatgttcattcatttgctgagggaagtaatgattcatccccctaggcaaactccttccatgatttggaatttaggtctgaagtttcctggccaatgcgcctgggaagccactgagctggctgtcagctgagtagggactaaggatgttcaactgtgggtactgaaaagcggcactagattgaaatggagtcctgagctgcaagttggggagcacagcagtgttggagcatcctgaaagtcataggaagaatgggcttcgagtcactccaactcaggatgttcctgattccctgataatgatcatgatgatgatgatgatgacgatgatgatggcatgaaggtggtgccctcctaggcctggaggttaggggtagccagtctgtctctgctttctagcagtgagagcctcaggctgtcaggcagggaggttggccttgggaggtaggcatagaaggaatagtggagcatagcagagccctagggcgcaggcctgaacacagccagtcctctctgtgaacaggataatgcaatacttaaggacccactgttcctaatttgctctctaaccatcctcttcttcgcagctcttaccagaatttaaattatgtgggtttagttgtttgtttacttatttcaccttcttgtctacttggtcacctgccacagggcaggagcaatgtctaatctgccccctactctatacccagagcccagcacagtgcatggctcagaggaaattcacatcagtgatcatgagtgaatgaatttgtaaagtgaaagcgtggatgaaggacctcccagccccttgccctttgtcatgttagtttggaattggggatgtgaggtgtcctctcactggtgcagttgaaggaaggtgccggatacggttcagattcctcggtggtcccgagttccctgggtggggaggttctgtgtgcctatgaggaggtgagagtcaggcattctccagggagtagggtgcccccaccagctttcacaggccttctgtaaaactggtcccgccaggccttgagtcctttcctgccttggggtgaaggacacccagacaaccacaggagtttggccagccgggctgaacggctacagcacgccccacgagcctggatcacgttccacacctgcagtaggagctgcaggaacctcctggccctgcgagcttcagtggggtcagcagccaggcacacctgcagggggcgtcagtgagagctgggcattggaattgccctacacagttgctgccttggaaattcagacttgaaatgagaaattaatggaggattgaattgatgtttctttcatgagcctgtgattgttgtaaaaagaggtgtgtcaaatgcttggtgagacccatgcaggattctttaaagaacactgaggcaaaccagaccttatagggaaaaacaggcctcacggagactgaagttaaaatatggaccagggccagtgtttcttcatgaagggggtgagcagagatttgaggaggctgcagggtgggaggaaactcatcatttttattaaggagttgacaagaataggatcgcggcttgtctttgatttgcgttaagcagtaaaatgaagggataggctggagggctgagagcagggtggcagcaggtgcgtgcagtcggtatgcctctgctggagggagtggccaggccacagacatgggacaccacatagcagtcctcacactcctcctctgaggtcctcagggaggcatttgtgtctcgagactgtttcagagacccatgtcttctcaggagatgccaaggctcaggtcagagacttgttgagtttttaagagactgtctgaagcacacaccctgccctaataagtcaatatttctgttcctcctggagacctcacattccaaagtgtggtacttcgggctcttgtaaatgttggaattcctaagactctctctggaggacaggtaagatgtcagtgggaacacacatacacacatgcacgtgcgtgtgtgcacgcacggctggcatgtccatggaaactgccttggcgtggaatgagcagggctgcctctcaatgaggtattccttccctcacaatatagcactggagccatcggtacatgtagaaaagtgttactgggaggtatcttaatcagcctacaagtcctagttccaaaagtaagaatgcatcattcatttttgagtgggttatgaataactcactacaactaaatacagtgaatatcgtaaacctagaataaggagtctgttagatcaatttgaaaccattcaaatcatttcaacctttgatttatatggagggatttggcaagtggctttaaaatcaaaattaaaaatagcttgggaaacagcagatggaggatatgagttgatgctttaccctatagacccaggaggcccgcctgcccttcccagacaactggccaatgaattattgggtcaactgaggacctctgccaagcgcctgttcatgcctccctcacgtgtagtaaaaggcatgaatgcgccagcccatctagtcttgagctttggtgctaaactttctggcttagtatggagttggatttctagaaatcacatattcaaatcatgggatttatgagccccattgcagataaacattggagccattgaaaaattggcaaatacctaggatcgtgttttcagggcgtgagaggattttatatatgtttacttttacaccataaactccagctgcctcattacctcactcaagacaaaaagatcactggaaagaaatgtaaaagctttcaaggtactgttttctctgaagggtttgggactttccactttttggagttttttttttttatagtagtaactgatgcatcagatactatattaggtaaagaattataagaagaacataaaaaacgtgaaactctcagatgagagttctctagtagaaaattgttagctgaaagaaaaaaaaaatcacccatacaaaaggaacatggagtcattgctggaacccaaggccaactcttgccaggaggttttgggtcagaagcctgcgtgtcctgcccttctgccctggactatctggaagaccctgctgggcggcagtggcagagtgggcctggccatgccacttgcacctccacgtggacatgcagctggtgacaggaaaggggaaggttccagcagacccgctatcacaaaacaacttacagagggagtccccaagtgatagtcctgtttagtcattgacacgtaactcagaagagagtgaaaaggctgtggtaaaatacaatttgcttaacattggaaagggttctgtcatctggtaagttttacttgcatgataaggtttcaatcagtgaacaccagaagccagccttgtccagggtcccttaggtgtaactgtgtgataatagggaggctccaggcaggctggcagaggctggctgagggtgaaaagctagattaagattcacctgtgagccactgctcacctgtttgtgtggggagggctgcagtagctcaactgtgtgtgggagagggctgcactagctcacctgtgtgtgtgggggagggctgcactagctcacctgtgtggggggagggctgcactagctcacctgtgtgtgtgggggagggctgtactagctcacctgtgtgtgtgggggagggctgcactagctcacctgtgtgtgtgggggagggctgcactagctcacctgtgtgtgtgggggagggctgcactagctcacctgtgtgtgtgggggagggctgtactagctcacctgtgtggggggagggcagtaccagctcacctgtgtgtgtgggggagggctgcactagctcacctgtgtgtgtgggggagggctgcagtagctcacctgtgtgtgggggtggagggctgtacagctcacctgtgtgagtggggagggctgcactagctcacctgtgtgtgtgggggagggctgcactagctcacctgtgtgtgggggtggagggctgtacagctcacctgtgtgagtggggagggctgcactagctcacctgtgtgtgggggggagggctgtactagctcacctgtgtgggggctgagggctgcactaggtcacctgtatagggcggagggcagcactggctcacctgtggaatgaaggttgtactagcttacctgtcaggggagaggaggcctgcgctgagactcggctgatcagaaaggggagaaaagagggtcactctgattgccatcatctcaaaacgtttaatactgtcacgatttgaaaggaagagctaaggtacttgtccagtagcccaatctccaagtccatctttgatctgaatgttgagatcaaggatgagaaacacctttttgccccatcgggattgcccatccagggaactccctccatttcccactgactcacttaaggttgtatctccttctctgatgaaacactcaatggggtcacccacttgcctgaataggtcctgaggaaagcctcttcccggcattcctcctccttactgagcataagtgtgtcccgtagggcgaaggggaaagaaagtggacttcctctgccgacacccctcaaatgaagtcgcaagtgatatcggtggtgcagatgagggtttggcatcccgccagatgcacctgccagtccctcctcctcacatggccctccctttgatcaccatgatgggtgtcccatgagggagccaccgtttgcaccgacacctcctcctcccctccgtggtggcccactcctgcccacctctctgggttccccgccagcattttctccaggcacatgctccacatgtccaggcagaaggcagggctgctgcccatgccccggagtttctcatgcatgccacaggcctgctccttcctgattcctcacttcacatggaatccagattctcggaatgttctcctgacgctgaaggtccaggactttgcttggcatcgggcagtttataggcacttttttttttttttttgagacagtcttactctgtggcccaggctggagtgcagtggtgtgatctcagctcactgcaacctccacctcccggttcaagcgattttcctgcctcagcctcctaagtagctgggaataccggtgcctgccaccacgcctggctaatttttgtatttttagtagagacggggtttcaccatgttggccaggatggtcttgatctcctgaccttgtgatccacccgcctcggcctcccaaagtgctgggattccaggcgtgagcgaccgcgcccagcctagtgagaactatttaaagactccttgaccatagaacatacagcaccaagggtgaaccctggtctcaactgtggactctggtgatggtgatgcgggcagactcagcgattgtaaccagcatacaggttggttccaacctgtacatcctggtgcaggatgtcgatggtgggggatttcaggggtgggagagacaggggtatattggaaatctctggaccttacactcgattttgctgtgcaccaaaaactgctctaaaaattagtctatttttttaaaaaagccttattgaatgttttgaatgaatcgtttctagagttggaaggattctcaacagatgatattttaatacatgttgtagttggcaatgtttaggtaacttttctttgccttgtgttttattgttgcagggtgtgaagaagtttgatgtgccgtgtggaggaagagattgcagtgggggctgccagtgctaccctgagaaaggtggacgtgtaagtcacagcattgcaataaataatattatcttcctcatacagtcatgcctcgcttaacaacggggtaccttctgggacacgtgtggctgggcagtttcatcattgcttgaacatactggagagtactcacacaaacctagatggccgggcctactacacacccggctgtgtgataaagcctgttgctactaggctacaaacctgtacgtaggcagttgcgacacagtactatttgtatatctaaatacagaaaaggtacagtaaaaagaaagtaaaaagatgtaaaatgggactcctgtgtagggcatttaccatgaacggagcttgcgggacttggaagttgctctgtctgcgttggggagtgcggggtgcgtggatgtgaaggcctggggcgtgaccgcgcaccactgtagatccatcaacactgggtcttaggcggccctaaacttacgttttcaatatttttctttcttcagtaataaattaaccttagtttactataacttttttactttataaactgttaaactttttaaactttttgactgtttttgcaataacacttagcttaaaacacacattgtacagctgtacaaacatattttctttttctacgtttttattcgatgtttttttctattaaaaaaatttttttttactttttaaacttttttgttaaaaacaaagaaacaaacagacatgggagcctgggcctacacgggctcaggataatcaatatcactgtctttcacctccacatcttgtcccaccagaaggtcttcggggcaataacacgcatggagccgtcatcccctctgggaacaatgcctgcttctggattcttcctgaagcacctgcctgaggctattttacagttaacatatgtacacatataaataggagtacactccaaaataacaataaaaagtagagtatagtaaatgcagaaaacagtgacgcagttgcttgtcaccaagtgtcatacactgcatgtaactgcatgtccacactttgatgcaaccagcaacacagcaggtttgtccccaccagcaccaccacaaacatgtgggttatgcgctgggcagatccggtgtcatcttagggcaccactatcttcagtgcagtctgttgttgaccaaaaagtcatgatgcggtgcctgattgtacttccatttgaaatgagagtgtcttaaattttctgagtaagtcattgcatactttgctaagaaatttaatcaattgtattctgttccactagaacaaacaataatataatgcaaaattgggtcaatgtataccactttcctacaaaattgagagcaattttaattttcataagcatcttttctttcattcattgttcattataagtacgtacgtgtgtttgcatgtgtgtatatatgtgcatatataaagcaatgatgttttatagttataataagcagaaatgtcataaaaatattctgtaaagaaaaaagtagttgcatttatactgcaatatagttatacaaactagggagcactggcagttgtatcattgctaacaattctcactttgaaaatatttactccctgaatgtctttgatgtggtccgtctgatagataagtaagaggaaaaaagggtaccccaaatcatcaccattacatctggcagaatttgaaatattgccctgatattggatttaatatgttcaatcaaagtgattgatctctgattctgttgcctttaaaactgatatctttaaaactgagtcttggtgttacttggtttaaaagtattatttatatgtgcacctttaagtccatcttgcatgtgtgaaggtgtggggagtagtattttgttttatgacacagcctccttgcctttattccctggactcatgtatctaccctaggacacatgcttgtctacaccttcgtttggcaaatgccaggttgtcaaggcaactggaaactcttccctgaattgccctgatgttgttggaatcagaaattataacagcccttgggtgtccaaatgagtttccccaagttgaatcctgaagtcagtttctaccgtagccatttcccatccctacctgccaggaagaacgaccctctgctggagcttggcctccagggctgaggtgcgatgccgctgcctcctctcctgtgtcccctccacaaaatcaaatgggcacagttcgtgatagggaacctctttataaatactgtcttcctatttcctgacctgtgactgatcattatttcactgtcaaaaatcacaactgaggaggcttcctgcccctttgatcaaagctcccatctctccacctgctgcattcatcattagttgcacttctcaaaacagttatttttgtttcggttaagcattcctctgcctgctgtggggactttatggtttagaaattgctggttgaagatcatttatcagcacttaacaaggctaaataatttttaagtttatggaagccatttcacaagatgtaaaattcccctgggtctcatgctatggattttcccaacgacacttctgtggcagtgatgagaatgcctgactgcagactctccaccccgcagcccttgactggctcagccttatatgggcatggatagaattggtggtatacacatatctgtgagactagctgtgtgggacggagttcgtgtctagagcgactctgcattcttctccatgtcatcagataaacagaacccaaacaaactgagtagaggtgaccggatctgttcttttcactttctatgattatttaatgcagaatcaacatagtaacattttccataatgcctttaggagaatttgattcttcagtaaacatagctagttcagattatttcagtatataatggcatctgcatagcagtgtactgttacacgatgccagaggtcttttcagtgaggttattaggaggggatttctaaggatccccaagactctgtgatttcacgaattcacagcacaggcattgagacctttttatttcccagcgtccctagtgaaggaaacaccttgagtctctttctatactttgccaagtaaaatgaaaaatcgacaccttctggttaatctgattaacttgagtaatccaaaactccgtgtgggcttggctgtcctctagttatccagacgggttatcaacactgatccaattaagctgtgattggcagctgtctgaagggttgtacaaaagacagaggcaaacgatacccgccccccaccccggggcctggactgtgggatccactgtgcacgcgcagcactcatgtggcctgaaatctggctgtacctgtacctctgggtgctgcgtgatgcttgacactgtcatttcacctgggccgaggcccgtgctgccaagggaccacacagccagtcactggagtgtgttaacaatcagcacacagggctgctctgttaattcaggtgagaccctgaacattcactgataaagtgatagaaatagctgatgataaaaggtaagaaagagatcagtgatgccatttaccattttcttattcctggagatattcttctgtgtgttacaggagacaattactctcaggactgctgcatctactgtattaaaacatttttaagatagagcatctgtttcaatactacaaatccggtgcatgtggcttaactatttattaattaacagattttcccaaatgtgctcttgcagaagcattgctctgtctgccctacttttggactgatagtatttttttaaagtaagataatacataaaaatagcagctggacagagcttgctgtcgaaagggctgtgtgcatagtttgttctttcccacagcttcccctggggtggctcccgtctctcttccctgtggtgctactgtaacagccctggaaatgcctggctgcagactcgccacaccccagcacttggctagctcagccttttatgggcatggtaccccagttcatctgtgcgtcaccatggtgacagccaacatcggaagttgtacgtcactggataacttttggacacgaagcagaaatcacaagcatactatggattccagttccaaatggattctcatgtgaccagtgaatgagctttgggtcaatttgcagagctttgttcatccttgggcggtgagtggtagactctcccagcagggagagaattgcttcacccagacagaaccacccagtcccatagataattccagcaagccacagagttgaggcctgaagaggcaaggcaggagctgtgtaccggctgcttggcactgcccacttcccctccctgggcagagctgggaggagctgagccaggagccagcccatgtcctgtagttcacgtacgagcacactgacttcaggagggaaatggcctctgcaaatctcacacccagattgtggcagagtccaaaacaaaactcaagtctggggacttagacaaattctttttccagcataatcatcttctgtgtccgtactcctcttcccatatgtcagcctagaagagtgaggctctccgggatgcagggaagaacataggcagcgtgagaagagagtttcccctcgttatgcaagagttatggttccctagttaactctctaaccacttcttcagttgttttgtggattaaaaaataactttaacaaatgattcagggctctgttgttatttgagggtctgtatttcaaataatctctagtaagcatattggaataattataaatgataagttcgattcattgatactgcatgttctcagatttacccctccactgaataccaggcaatcatcagcaccaaacaaggtgcccgcccctagcacctttcactgcagccctcccaggctcaagcagttctcctgccttaggccctcaagtagctggaactataggcatgcaccaccacacctggctgatttttgtatttttttttttttgtggagatgggattttgccatattgcccagtctggtcttgaactcctaagctcaggcagtctgcccacctcagcctcccaaacttctgggattacaggtgtgagccaccacacccagccttctttttctattctcttttcagttttctttctttatacaccatggagatggaaggcagttgaatgggaagcatcaaagtgagtttcagttacagaatttctgtcagagttatcagcaccacgcaatgtaaaggttaataatatagaaagcagtagaggggcagataggaaatcggagtcaacaaataagacagctttgctttgcttgttaactcacctagcagatggtgaaagtcttggatttttccaagtaaggtcaattttagttcattatttcagtaacttagccaggttcctgttctcccccaaacatctgatttttgaccataaactctgatcagataggttgtttcaaattttttaatgacatcaaccttcacagggcacctcctatgtcctaaggcacttgggtattccagaaactggtaaatatgaagactggttggataactccgtgttgggaattagtgagatggtcaaatggccctgtcacacgacaacagggaaaagagaacccacgtcatcagcccctgaacgagtgagtggaggcctctgcatcactcagcatgcatccaggcggtacccacagtgccccctgtggcctggcagctgcagctgagagcctggagactatgcttctggaaggttgcgattgacaagctcgctcaagtaagcagtggctgagtgcttagggcaacaagttgtgtttagcgactgcattttttcatgtagctaagagtttcccacagtctatgggtccctggacttgggtcaaatagtccttagcctcaccagatttcttaaattcaacactataaatcaaagtaaaagaaaccagagagaaactgagcaaaaatagctgccaagagaagagggaacgagtgctcggggcgggttggaggcagataacgagaaggcaagaaaattctttgtctttggctcctgctgtcagctcagaggggtcatcttgagatgaaaaagaaaagtccccagccttggggaaggaaaggagagggtgccccacgcagatatgaagcaaagccattggcaagatattctctctaaggagagcagcggtcttgccaaaggcatcttctattgtgtattgccgtcataaaccctacccttccatgtagatagccaggattttaaaataaaactaaatcttccccaaggagagaattgcgatgccctggcagcatgggcacttttgtgtgggtgtttccgtggctagaggggttctgaaatttttgtatttgtagtagagatggggtttcaccatgttggccaggctggtctcgaacttctgacctcaggtgagccgcccgcctcggcctcccaaagtgctgagattataggcgtgagccactgcacccggcctctgtcttagttctttgaagatgtgggcatgtgtggaataaaaacatcagtgctgctggtcggacctctttgcaaaccaactgcaatttttccagacagatacttttaaacggtgtgcccagcatacttagaaaaagaaatctccagctttttacatgctgcacagaaagggcaaggaattagtcagaaatagcaaaaacaccacctggcttccaggcttttatagccctgtctacacatagctctcactcactttcaaaaccatgcagttatttttagtgtggctttggagcaaaggtggtctggctcatccagcgctgcaggggctgtggcaactgggtcccgtgattattttctgtgggtgagctccaaactggcccattatctatcaaatcctcaatggtgttatagtggttcttttgacataaaatatttatcatatgggtgggatggcgagtggaggaggggccagaaattcgtaattgcttctctctttgtcagctgcataattaactcaattctaccacaatttattaaaagtcccacttcaagagaatggttaaatctcgctggaaagaaagagccacattatgctctgaagctccaagtttcagaaaatattctttttgtgaatatataagcccaataggtcacccatcttggtcttactttcatgaaaccctgactttatattgtgctttcttttcatctaggatttactatctagaatagtcttacacatttgctatgagtttcctgtctctccactctccccagatcctccctctacccctggctccaaactcaacggagattggatgttcagtatggtaactgctaggcacatgcagctatttcaatttcagttttaattaattaaaatgaaataaaatttaaaattcagttatcctgttcactagccacacctgaagtactcgcatagccacaactccagaagatgactgctctgtttacttctgtattcctggggcctatgcagggcctgacacatggtggatatatactaagtatttgttgaatgaatacatattgtttttaaattttagtagccaactgtggctatgcataatccactgcctgtgttaggggccaagtttcctgtttttcaaggcattttctctcttgcttttttttttcgaggcggagtttcgctcttgttgcctgggctggaccgcagtggcgccacctcgggtcactgcaacctccacctcctgggttcaagtcattctcctgcctcagcctcccgagtagctgggattacaggcatgcgccaccacaccctgctaattttgtatttttagtagagatggggtttctccatgttggccaggatggtctcgaactcctgacctcaggtgattcacctgcctcggcctcccaaagtgctgggattacaggtgtgagccactgttcccggcctggcattttctttaattagaactagatgtctcattgaatggcgcaccaaagtatgaacctcgagactttgtcacaaagggctctgtgaccttgggtagggcacatgacttctttaaaggagtctcctgagggcttcacaccttgctcaaatgggccttccagagctttgcacacccctccccctacccttctctctgaacctgccctttctccacgcaatggccttggctctccaagagtcaccctggccccattgcagcccctgctgctggggcatcctccccggttcattgactccttccttctcttacaccagtgccttacatgcagttgctgatagaaaatacatatttgagcgttgaaggaatgtaaaactccattgctaaaacgaagctagggcctttcttaggatggaggacatgaaagaaaatgccacttccaaagctccacactccatcagattgacaagttagctgggatcagataataatagccatttcatgtcttgattaaaaacctcacacagactccacagaactgttgataaactagagcaaaaggaattcacagttccattcttcttataaaccaaactaaaatgctgactttcgaaatccttttttccgacctcctgatggaaagttttgacaagtgtagcactgaagcatttccccctctctgctagaggagaaatggcaatcttcaaagaccattgttttgttttattcgcttccaattcattcttagtaaacaattgcaggatttctaaaaagaccagaccatagtagttaccagacatgagatgctttctaaaagctactttgaatagaaatgttttctctgaatctgtcttccctcatgcagcaggaagaatgtctgaagctatgctaccttcatatagaaacagcgtccacagtcagtcttcccagttgggtttatctcagcggtcctttagaggtggtctacacaagactctaaatgttcctgcctgtgagcggtcttctactagactacttcaataataaagagaaaactactagattgttttgcaaagttttgaaattactgttgttgttttcttctggagacagtaaaataatagccaaggggagaaaatggcacaaatgatcaaaccaagcaaccgtatgcacattttcctccctgaggggcctttgaatttgccacctaaatgctgcatgcagtgggtaccccaggaaggaggaaatggggtcccttcatctctgctttattttgtccatcattaaatcagaaggacatggttagtgtccttcatcttcgaagggtgaagatggctgcatacattgtctgttactatcattgacattagggtaaacatataataaatgtatttttaaatgaaacagtcatttcaaaatgtccttaggaagctggtcaacctgaggccctgagctgcctgcacttctgagccctctggcatctcacccaaatgagttcattgtggtgtagaccactgaagcgctcaaggtgtcagaggtctgactcacctgggaagcacaaagcaggccttccaaaggccatatgtccccactgattagaaagatcaaaacacccctgtccctttcctctctgtgtccagcctagaggtttgcattctaggagaatggcagcagccagacacctcccaggaacccaatgtaagccctgtatcgatggcagcttcctgcgaagccactgtgagcgtgtgaaaaatccccaccgtaggaacaaaagtttttgtatctaaaacactgttggggtgaataactcttagaggtttggaaccagaaataaagaaaaagaacaaaataaaatggaagtaattaatgttgggtaaataatatctttggcctaacaagttcttggctccattgtcagcatccgtgttttctattaaattgttgtctttgtgaggcattattacagttcttccctcttaaagtctgttttgaataaagaaaccgaaggttggatgaattctatagttaggttggtctctctctaatgaagattaaagttctggcatgtcttagctctgcatggcaataattacttttaaaaaaatgcacttagggtggtgattatggcattgtaaaagtcttatgaaaatgagatgtatgtcaagagaaccttactatcaaaatcagttttgtgcattgcacccatgcttcgcatctgtcagcaaaagcaggctttctcaggtttggtgaaaggaatattgccgtggcctttgaggactgatgagtttccactaatttagagcaaaattaacagaatcctatgagcctggaggaagcagttcacttttgtttgtgttgcttttagcatactgctcatttcaaccctgcttagagaagtggcagatcttataccctcaggcagctgggatatgccagccacagagggcaagatccataatctttaacagattttactgtacacgttcacagccccaaccggccataccattgcaacctaaaagaaagagaggattgaataagcagtccagaaaattcaagcaaaactctgaaacaggaagccaggcttcctgcacttgaaggccttggggtaaattcctcatcatttaacacctgaaattttgcaaatatttggacttctcttcgaagaatgatagaattattggtctagaacatcgactagtcttctcccagccccgtattcaggaaggacagaagaatgcattggagactgatgaatatccactctgttctaaggactccagggagagaaattggatagactttactggtaacttaaggaaagacaaaaaggcgtaggtttatatatatccagagtaaaattcacaaaggcctcaagtcattaaaggtattacatactattgcaaaagaaaataatccaactcccaaaagttgaactaagaaagttcctcttcttccaaataaggttttacttagagactttcagtcccacttaaaacttcaaagcaataagcttcatttcacagcttcactaaatgaaacctaatggtagacatgcctttgactagacataaagtaagcattctttctagagaaaataaatagaaagagaggtttctttctatttccttatcagcttcacctctttcttagaaatgattgctcgtctggacagcatttgtcatgagtttgttttcactttaaagcatgaaggggagagatgaccagggagtgatacccatctgctcatcttcaaggattgcgtaggagttgagctgtagaggtttcactgcagaaagccagtattgtcaagaagcatcctgagaacatgtaattaatctctacaaatggtagaatagttacattagtgccataatttgttatatttaagctatttttctaattcacaatcaactaaggccaaagaaaagggggggggggggttgagctcaataatagcattaggatgtttaatgtgaaatccaagaagactaaaataatacaattaggccaggcgcggtggctcgcacctgtaatcccagcactttgggaggccgaggagggcggatcacgaggtcaagagatggagaccatcctggccaacatggtgaaaccaggtctctactaaaaatacaaaacaatttagctgggcgtggtggcacgccacctgtagtcccagctacttgagaggttgaggcaggagaatcacttgaactcgggagttggaggttgcagtgagccgagatcacaccactgcactccagcctggtaatagagcgagactctgtctcagtaaataaataaataaataaataaagcaattagagttacagtatggctattcaggttgaccattcctaatccaaaaatccaaaatctgaagggctccaaaatcagaacccttttgagcaccgacctggcactcaaaggtcatctcgttggagcattttggatttcagatttttcagtttagggttgctcaaccagtaagtatgtgcagatatttgaaaattcaaaaaactcccaaatccaaaacacttctggtcccaagcatgtcagataaggagcactcaccctctgatgagcttcaatcattgtgagacctttaaaatctaacaccattaatagagagcactattaacactatggacaagtggttcttccagccagaatgcccatcggtagcactcaacaggtggcactatggcataggctatggttaataaaactgcaacaaaggaaaattttagctttaacacgtgccgacttctctgcagcaatcccacccttcccgcctcagcttacaaatacgcactaactcagatacctcaatgatactcaggtgactccagccagcctcaccccaaagctccccattgcacagatgagccttctctcccatcatccacccaccagccccctgtccagccccactttcttcaattcattgatcgcagcacagcatagggaagaacatgatttattgaatcttttccatcctaaagtattaattatcaatagctgcaatataccctgacttcataggaaaacctgcacctcattctaatcaccttgttctgagcgtctcactttccttcttaggtcttgaccttaagatttcaactttactttctagccgctgcctgatcaacgtggagtgaagtgaaatgatttccccctgtatttggaagctgtacttctaaaactctgtcctagaatcacatcactctcttttaccaaccagattattgcattgcattggctcactagtaatgtatttctaccaaaaaaaagaaaaaaaaaacaagggttttttttacttttgacaagttttttgttttgttttgttttgttttgttttttgagacaaagtctcactctgtctcccaggctggagtgcaatgtagcaatctcgactcaatgcaacctccgtctcccgggttcaagcaattctcctgcctcagcctcccgagtagctgggagcccgccaccatgtccagctaattttttgtatttttagtagaaacggggtttcactgtgttggccaggctggtcttgaactcctgacctcgtggtccgcccaccttggcctcccaaagtgctgggattacaggtgtgagccaccgtgcacagctttgtattttgttgttgttgttgtgttgttgttgtttttctgcttcttcactcttggatttccacttgtgcagttaatttttgaacttgattcaggattttgttttgattcctgttaaattgtggaaaggtgcagctacagttgctgatgtggagatggagaaattgaaggtgttcttctgcccttgattttcctctctccctctctcctacttgtctaatactgatctaattcagacatagacagtccatgaagatggctattgaccaaagaggagatttctaaatgctaattcctactagtatttttgggactttattttgaggatagcatggatgaaaagggatagctatgcagccatctgcataccctcaagttgaataatcagactgaggaagttaacaaaaagaactttgtgggtggaaatgaactccttaattccagaagattaaaaagacttctttagtagaaggaaataaagtttaacaaaaagggtgcccttcaaaaatgtcagttatcttggaaggaaagatgagtaatggaaatcccggttgatcacaaagatgaataagatgcgtcctttaaaactggcatttatggaggacaagggttcttcaccagcactctgcatcctttcctagcagccgctgacatagtaagagaagcctctggaattatcttattgcatagaattagttattaattattcctacaattaagatacttatgatacaacaaagaagctcaggatcttaaagtgtacatgatgtgcgttgtatgtgtgtgtgcatgtacctagacctatttacatttatgttctgaaattgtatacatcttatatttaccaagtatttatatattttctgtatgcgtgtatttccaggggaataacaatgtactatcctagaaaatcttttcaacctccagtgctcaacataggattttagttatttttagcacttaatcttatctgagaacttaaaatgaaacccagtgtgtgtttttttaatgtcctgcaactttattagaagacactgttgctttttaaaatttatcatgtttttatatcaagcctgtgccagatgttcctaagtgttttgaacaatagctggttttgaaaccatcaggcgctctccacgtagctctgctgtgagcatcgatactccctgctctctgagcatagtgtagggcgggcggcgggccgtctgggatatgggaaagcctggggcctgggcgctgcaaagactgttctgcctggggtctgacgttggccgtgccgggagctcattgtctttccgtctcccccagttcttatcctactgatctctatatgctgttggctttgagacaataggaactccagaaatgaacagacagggaattggctcatggaggggaaaggaggcaggagtgggtggacaaggccggaaccacatttgcaccctgaggagctgggagattccgctcacctctctctctctctgtaagaatgctacatcccactcagggggtttccaattgtccttactctagttggcaggaacttaaaacataactgaagcatgaacaactgggtattttgatgaatgattgacaacatcccattgtcttcagagcccagcacaccgggccggtcattccactgttgaggtggttccttgagagagggggcagaggaccctgtgcgggggtgggatcaagcacaaagagaaaactttcccaaaacccttcaacagacttttttgtttaagaaaataataatgtttccgtctctgaacaccaagtcaggtgacccgtttttccttcatgtgatttgtgagctatttcagaacctcgtaagtctctctgacaggtcaggaatggggaaatgagaagtgtcatcctgtagagtttctcttctctggaatttgtcttgtgttattttttaataaaaataatcagtgttatgctattgtttcaaatctggagacattttactctttgtgtatcattgcctttcttttttaatgtgtgttatttctggaaggcaggcaagcttttttcttgtttgtaaagatctcttctcctgttgccaagagagataacctgaaaagacagaaaattgccaacttaaactgtagatatcattccattgatttatttacagagctttaaatcttattttgtggccactacagtgaagcaaatattattttaaaagcttcatatgaaataatcattagtagcttgttccattttaaaaattgcaggtgtttcctatgcctttgggcaggttttgttgtttgtcttttgtttgtgtgtctaaatttcccattgtctgggatgtgcacactgcatgtcatggaaggtcattgttctggttcacatgattttatttccaaactgtggtataggttctaatgtatgttggctgctgtgtagctgtgtacccatttcttactagccatgtggtttagtgactaaacagtttatttctttatacataatatttctctgagttgggatgtctgttacctgttttcacagtttaaaaggaagcataatgatttagttgtaagttttttctgccagcactatgaatcatttggggtgtctgatccacttgaatagcacatgtgggctgcagaatattcatattgatggaacaacccaaactttaggatttccattctacctgccacccaaccagtaccaactgtgttgtgaacgcattttttaggtagggaaatgatttacaaatgttagccttctttaccttcacagagttgatatttaattggaccattagtagcaagtacaaatcttaagaacgttttaaatcttgccttcagagggcatctatggtagagggctttgggtagtgaaatatttgactacttttcttaaaaaagcaaaaatcagaacaacttatagaacagtcctcctgatgtgatcagctaaaaagaaatttgaagcagccattagacttaggtaaaacttaggatttaagcaaaaagctgctctctcctgtcctcatgtgtggcttattcacactcaggggtgtctcctgtgttgaataaagtggcctccagctacagccactgcttacacatgcttggttgtgcacatgagagataaatacccaagccgcagggtgtgaggacgtagaaatccagggcatccctaaaattatatcaaactctgccaaactgcctgagaatctatgacatcctaatgcctccgtcctccagcatctgtggagttggctcctttccgcctctgtgttttccttatcccttgttgagtgtaagttaatcgggcacatgccaaggggcagcatccgttttctttttacccccttttggatgctaaggctcttcaaggatataatgcagccctgtgcagccgtggccagtttttgcacggccgcagtagagacttggcaccctggaatatctccagcaattatccagcttgagagttttcaactgaactgaagttttattaatgttcatcataatcgtgtcacgtccaattttagtacttggtatgaattagaggaaaaaggagaaaacgatggcccgttgggtcagcatgcattgtcatgatacccagcattgattgacagcttacggtggtcccggggcgatgggagcactttacatccattcacacttcctccttagggcagctccgtgatgtaacccacttttacaaggaggaaattaattgaagaacaatgatgtgagctgcccaaaatcacatcattagagagttaaggaaccaaactctgacccgagatctggagccaacacttaactttccctgaggggcatcctttaaaatctgggtatgatgttgcaccttgaaactcagttgttcaaaattattctttctttctcaacctttaacttccacatcaactctttctctccctaaacaaaatcactaaaccaaagaagcaaaagtctataaggccacagttttgtgaattaaatatccatccttttccccatctgtttgcgtttatcctactctctttcctcttttggaagcagctctgttccaggaactggcaaatcgatttggctctttttgctttcctctttgctcacagggaatctcctctttgaaaaccagaaaggttctccaaatatagcaaatgctttcctcatctccatccatcctagttacccctctcctcctctcctcccactctcctgctctgtcccactgctccacccctgactctgctaacctcatgccgattatacttctgtagtttcattaagtggatagttttcccctcttcagaagcattcctgagtcaagaacaccctgaatgcactggaagttgttcaagtcttaccctctaagtcaaggtgagatactgtgtagatctgccaattaatctccttagaggattatttaatcctaaaagaaattcttatagctcctggttttaagccctttctttactggggcccttttactttagtccttatctactccaataaggcacatagaagacattcctcactataagatgtgtggggttagagctgttgcccaattggactctgagatgcgatacttctcgccattcaggtgtgaggatggctcaccgggtaagcatcttgactttggcatcacattccagcccttacacctctgtcccagcccctgggtgagccatgttcccctttgccgtcgaattctgcctctgaaaatggaatcatagttactgcctccagcagctccaatgtggcgatggtattgagagatcagcgcagtgcctgtcacagtgcagaggctcaacagatggtggatactaccacgttttctctttctgtggaacttccgcaacagtcatccgcaaaatgacagaaaatgccagtcagttgggcattgcagggactgttgggtttgtgggcgagcatccctgcaaatagggctcccattaaagtctcataaaggaggtattttggaccttgagtctttttaaatttttgacagagccggtgcagtgtctcatacctgtaatcccggcactttgggagaccaaggtgggcagatcacttgtggtcaggagttcgagaccagcctagccaacatggcgaaacctcttctcgactgaaaatacaaaaattagcttagtgttgtgacgcacacctgtaatcccaactatttgggagctgaaggcaggagaatcacttgaacccgggagtcggaggctgcagtgagccaagatcacgccgctgcactccagcctggatgacagagtgagactctgtctcaaaaaaaaaaaaattgacagagaaaatcatcgtgattatgctacatctttatacaggagtggtccgtacaagtttttattcatttaatttttcttctgtgctgcagaagcatttcctgggcttttgacattccctgagtaaattaaggctttgtcagcctctgttctgatttgggtgatttatacatcattatgcagagtaagcaccagtagaatcacagtgtctatttcagctgaacaaaatttttgctaaggaaagaactatctgacattcactggcttagggatatttggggagacacgatagcttgcagtgcagagtggcctcctgcttgttcatgacagtacgaaatgcattcctaaatctcttatgtatcacttctgatctgactgagaagaactaggtaaggtataagtaaggaaatagtctcttatctccacccgcttcactgttcctggcagagcaacagtctggaactgtgagcgtcagaaggtcggagcctgtttttattgcagtgactcttctggttgctgcttgatatcacatgagcctctgacctgcttaactacattttaatcatcctgccttgatttgtattcttggtagatgaattgtgattcattattccataatcattagcccccccacccaaaaaaaaatcactatttttctgatagttttgatggttttagcaaatttttatattagttttggaaactttacttttttataaaaatcatcgtttttacattacatatttgtttcatgttgcaaattatcggaaggaatgcctctcacgctgtaatgtgcctgcaagcagcctgggccccttggtaaagcacagatgctagttctgcaggcccaggagggcctgaagttctgcagttgcctcaagctccccagtgacatggtagctgctggcccaggggccctacttgtaattcaaggcccccgaggaccttcctgaaacccccttggagagtcgaggccaggccgagtgcagcctcaggtgttctcctgagactgacgcatcctgcttgccttggtgaggccaggttattaagcagatagataattcattgtgtgcctagaagacatatcctaaaagttatctttcttgctgagatatggaactagacctgtcttcactcagtgatcgttgatctttagaatggccagtgtggttcatcttattaaggggaaaactttaattttacttattacgttgaatgtcactatgttcagttattgattatcccaccagcttagacttgggtggtgagtgtcttatacacctgaaagctagggtgggggtggggagacttgcttataccaccatgccagctgtagcattctgctcatggtcaccagagtgcattgtcagatgtttcttggttaggacatctgcattctacatgcaacaggtgccatctctgcccttgcttggggtcagagtgctttaatccagatgcagtattggttgcatctgtcattatcggctcatctgcagctgtccttcctgtgtggtgagcctacccctcactcctgcctggtcactctcctgaccctccagtttactttctggctctggaggtgcactgagcaagggcacacactctccctgtatccatctccatcccaggaccccgcacatccctgcagctgctcctgggtgtgcccaccccacccccactgggatttgagctcccctcaactaatgggctttccatggggaatcaggagggtgggaattgtgattccgttaaaatcatttgactcaggaaaagcttttcgaaataatccccaaggaccaactctttacagaaactcctcccccgccttcatatttttggctttgactatggggaaattcattatgttgagctaaccttggtgaaacaatactaaaaatagagataatagaaaaacatgttaaagaaggtaaaatcatctgaatacgtactttataaaattcagcctaatacttaatggctttattcagacctaatttgaacatatcacaagtatatttcaacagaactttcttcttcacagaacttttctggaaaaaaaagtatactgtcaaaatgtttctcttattagcaatcaaaacccagtttggaaaagtgagtggtttgctctgaaaaacaacaaacagggcttgtgggaattcaacagaagaataacccacggcttgtaagaatattaaaaccacggtcacattttacacagttttggcaaaaggaatagcccaggcgtctcgaatcgagatgtaatgtgaaatgaagaatttcaacagggctcattaggcttttgttctatctgagcagagttttctgctttcttggctaaaataagatgcatgcagctttaattgtatctccctttattcaaggtcttcactggcaaccttaagtatcaaggatttgctgctcaaatcatttgtaaataaaactcagatgtaaggaaatacagacaagggaggacaaaagttttgtccaaaaaaatagatatggaacaaattcagagaattgtagatataggaaggacctgatacactagcaagtctcctttcccagttgaggaaactgaggccctccatggtccagaggtgcgcctgcggcctcatgagacagaaccaggccctttcctccgggtccctcgcctcaggagattctctgagatggagaaagattctggaattacagccaaatcaggaggccttttaagattgatttaggaagagctaagagaaaatactaaatggagttgtttccaagaaacagaaataatcagtgaaatttcttttacaaggaaataattgaagcaaatgccctctgcatgaaaagtcgcattaaaacccaccccagtgggcacttcctgaatgcagtattccctgcagacagcatttgaacgatacttaggaagcaaacccttcgaaccactgggaagaatgttcccagtctgacctagacagtccttagacaaggaattcggtcccgcggtgtatttccttctccacaatgtgatcatggtggagagctccacattggtgtcggtggacacagtcatgaatggaagctgcttcatatgaggcagagcctccgtgtcccacctcacgcactctccggctcctgtaaaggggagatcatggagccgggggcatttgggccccgtttgtagtcttgcctggccctgacccatcagcacctgcctagttccgcaggcacggagaagactgcaccttctgctcttaggtggctgcaccagggcttcttgaaaaggggcagcttcctctcagggacatcagacaaaatctgaaggcacttttggttgtcatactgtggagagggtgtttctggcatctggtggggcacagggacgctgctacacatcctatatgcacaggacagccccgtgaagaagaattatctggtgcagattatctgaagtgctgaaggtgggagaccctgggctagagcagtgctcagcaccctaagctaagaggcgagtacgcgtgcaggtgcacccgagggaaagccttgccctcagaaagcccctgcaaaattccttggcatgaccttccatcttgcagctcatttctttcatgtactcagcaaatacctgagttcctactgtgtgtcaggctctgtgtatacctcaaattgaggagccaggggcgccgggcagcagtggggctcacagacttttggctgcagcagaagctgcaaggctcctcccttctcatgcacccccaaatccaactctggaggtgccgtgtcaggcgggtgcacagaccatggagctggggtgctggggtcggagtactccccatggacccccattcggaagtgcgggctgctgggcacattagttaatctcttggcaccaccgtgttttatctctaaaatggcagtgttgatgagccccccactccctaggtggctatgcctgtgcacccctaacacatgagagccacgttaggatggtgtctgggtcccttgtcattatttgggaggtgcagctgagcttcctggtagaaggacttacttagcaacccgctccgccttggaaagctgaccctcctccacctgcctcctctcctccaccttctccagcccctctgtgtcaccaggcagctctctcccgtgtcccagtgagccctccgcaggccagccttcccttgcaatggcctgtgttgccagctagtcctgttctgagaggatctgctccactcaaaccgtccccacaccttccatgtttgagcaaagcatctgtggattgcagatgaaaagaaacttcaccaaagagcacattagtcatggcctcaacccagctgggagtgatttgcatttgataacagctttttaacccccaggagcctcttaagaggtgggtcttgaaggaagtcttctgagaggcttttcttctgaggggagggtcgaacagagaattttatttagacttttctcccaccagcatggacatgagttatcagtattgtttatgattttatagaggagattttcacaagaggaacttttcctgtgcctttgcctaatgcatagtaactataagtcacttgtttatacagctttaatgtgttaactgttaaaatttaaatattaatattttaaataagtctctatttgtatacgtgctgactcatcggattctcacactcacttagagataagatggttttctatgcacacactcacattagaagaatgtagggattttttccatcaatattcgggcaagagggcactaggaggctcatcgaacacccacagggctctacgtcacacccacaagctctatctcacacccacgggctctatttcacacccatgagctctatgtcacacccacaagctctatctcacacccacgtgctctatctcatacccacgtgctctgtctcacacccatgggctctgtgtcacacccacgggctctatgtcacacccatgggctctaactcacacccacgtgctctatctcacaaccacagagctctatctcacacccacgggctctgtctcacacccacgagctctatgtcacacccacatgctctatctcacaaccacaggctctatctcacacccatgggctctatctcacacccacgggctctatgtcacacccacaggctctatgtcacaaccacaggctctatctcacacccacgggctctgtctcacacctacgggctctgtctcacacccacgggctctatctcacacccatgggtctctatctcacacccacgggctctatgtcacaaccagaggctctatctcacacccatgggctctatctcacatccacgggctctatctcacatcctcggtctctatctcatacccacaggttctatctcacacccatggactctgtctcacacccatgggctctatctcacacccacggactctatctcacgcccaccggctctatgtcacacccaccggctctatctcacacccacggggctctcacgcccagcactctggcgtcccctttccttgacatccgcctgctcctctaccgtagccagatttctttaggaaaaaaatgattctttaaaaatctaaaatactgtaaatcctattgggaaataacagttattaaacctcttcatcaggagccaccagatatcaacttaggctgtgcatctttctgccaggtgggtccttatgaccctattagtgactgtctcgcacaactggagataccagtgaacacgtgattgaactctcagcctcaaggacaggtcagaaaaggagcctcaggtcaacaatgtgttctcgacctgcttgaatttgcatctgggaatcctcctgttagtagaaaggttgaccctggacgcagtctgggattgaatctgcctcactcctttttcactccctttcagaaacaaatgaaaggaagtgtgtaaaccacacagccaagcacccaacgcatcatcatcttcatatcatcgttattattagtctaaaatggtggtggtgatgataaccccactccctaggtctcagtacccatactgagattttatgctctccctttttctgctggatttcattttttctctagaagcttgatgctatgccttgattattacttatttcaatgggacaaatttgcactagaactacagtatttgttatcactgaatttttcacggttgccatatatatatccagcatcatttgtgtcctactgctgttgaacaactactttaagatcagaaaatagaagtagtttagccagtctaaaaggatttccattcatcgaatcataaatagagaaaaaaacaatcccttctatccattactaaacctctccattccaaatgtcttcaaacaaagcaattatggtggacaagtatttgaggacagttttttctcataaacagctgcatagtgctatagcatccttgttgattagccaattagaataaattctttccacagcacattttaaaagacttaggggaaaaaacaagacttgcaagacttgaagttttcatagaacaatgtgcacccgtcttccgcccacttccccagagagaaatatatgaatcacatagcagtaaatgagtaaagtatcaaaacaggtgctggagactagggagcatgaatcatcttcttccttagatactttgtaaataaaacaggatgtatttatggtaactctgtgcgtaaacttctatttacaatgaattatataaaataaatacaatgtcacacaaagtaaataaaattgaagaatctattaaatatcactttaacaattatattaaattgtttccttaaattgatccaattttgaaagaggaatttgaataggagagatcaacaacaacaaaaattcctcctgtattcaaactttaaggaacgctagctatctattttaatgagtgaataacttatttcccaaaccacattttaagaaagtcaaaaatagttgcatcacatttttcctattgaaaatatacactttgaataacagaaaaataatccgcagataattttttaaagatttttactcagcttagtggtaatagatttctgtttatattaaccttaagaaagagtgttcagaatggagtttggccatttcattatgagttatggatattattgtataaaacatgtacacaaaattccactgatgattttatctaatttcaaccataagattctgacagagaatcaactcaactagctcttttaagcatcacttttaatgtaccacattttttaagtgactcttgtttatttttttaatgtttgctcaaacttatggggatagtgccatgttctgcgtatccacgctaggatgtggcctttttgagccatggaagatgctgtcagaacagggtccggaaaaaacaaataggacactcgttattttcttgttgatttgattagccatatgtaccatttacaatactcttgggggacaaaaggaagagagggaaaaaacaattgtatctgaatattgcaagctaatcttttataaattttaccctttaagggttgatggattcagaaattaatcaactgtatttttatctgataaatgctaatactgtactgcagtgcagttgtggttttgagagttacattcataggtttatgtcagatcaagaatagattttgttggggggtgatttttagattgtaggaggttttatacacataataaaccaagatgctaacaggaggatgcaatcagtggttattttgtgtcagcccttttctttttttttttttttttttttttttttctgagacagtctcgctctgtcacccaggtttgagtgcagtggcacgatctcagctcactgcaacctctacctcccgggttcaagcgattctcgtgcctcagcctcctgagtagctgggattacaggcgcatgccaccacaccaaactaattatatttttagtagagatgagtttcagcctgttggctaggctggtctcgaacgcctggtctcaagctatctgaccacctcggcctcccgaagtgttgacattacaggcatgagccactgcgcctggctgtgtcagcccttttcaagctgcagcaacactcacactgatgcacttggccactgagaggtgagccattggcagatgatgtacagaggatggaagaaggactgctgtgcaggcggtaaatggcatctgccagactgcacagatgaaggttcctaccctgttcactgccgcatacaggaaatatgatcaaaagagtggtagtgtgtttagacttgtggctcactctgtgtgagaaggaaaattaaataccaaagccatctataaagtagcaaaattgccctaaaagctgcaaattaggtcgtaatcatacatcaatgacagagaagtacatggaagacctggaaggatattctagaaatagctaccatcttgatggttcatctcttcttaattacttaagggaatttcgacaccttattaaaacagaggaagtccaaggtgaactctaaaaccctccttaagtatccaattctatgattcggtgtgaagcattatcacacttgtcccaagggaacttaaccagtaatttcaacgcttcagtggggagtcacacgtcagatggactcttgcgggccatgctctcaggtagtggcttgagtccccctgctcctccaacaaggccaccgtccagctattaatattactcccaattccctggacttgctatgtcctctggcgtgtggagtgcctggctgccgccttcattctctatctgactgtctcctgctcatgctcaaagcccacacccaatgtcaccttctgggggacgctggtcccaaacacctgccttcccaagccaagtcacagctgagccctgtgtccttagcaccctccaaagccactgtcttccctctccatcccccagtggactgcgagcttctggaggatgctccttccctggcatagagcagacatgtagcagcacttagtgaggaaggctgaggcaagctctgtggtccagtttccctgcaaataggggtttagaaggagctgagaaaagaggagatgagggtacactgtagggaagaagtgatattcacaactgacagcaaggaacaaaaaagttaaacagaggccgggcgcggtggctcacgcctgtaatcctagcactttgggaggctgaggcaggcggatcacgaggtcaggagatcgagaccgtcttggctaacacggtaaaacactgtctactaaaaatagaaaaaattagccaggcgcagtggcgggtgcctgtagtcccagccacttgggaggctgaggcagaagaatggcgtgaatccgggaggtggagcttgcagtgagccaagatcacaccactgcactccagcctgggcaacagagtgagactccgtctgaaaaaaaaaaaaagttaaacacaaaaaccacagtatgaactaaaagggcttagaaatctgaggctgttcccatgaagaaaatcctcatcctggacttctgtgtctgctaagggaggcacagtgattatgatagttggaggttacagtgtgtggatagactgtggttacagtgcctggatagaccgtggctgcagtgtgtggataggccgtggttacagtgtgtggataggccgtggttacagtgtgtggataggccgtggttacagtgcgtggataggccgtggttgcagtgtgtggatagaccgtggctgcagtgtgtggataggccgtggttacagtgtgtggataggccgtggctacagtgtgtggataggccgtggctacagtgtgtggatagaccgtggctgcagtgtgtggataggccgtggttacagtgtgtggataggccgtggttacagtgtgtggataggccgtggttgcagtgcgtggataggccgtggttgcagtgcgtggataggccgtggttgcagtgtgtggataggccgtggttacagtgtgtggataggccgtggttacagtgtgtggataggccgtggttgcagcgtgtggatgggccgtggttacagcgtgtggataggccgtggttacagcgtgtggatgggccgtggttacagcgtgtggatgggccgtggtcacagcgtgtggatgggccgtggtcacagcgtgtggatgggccgtggtcacagcgtgtggatgggccgtggttacagtgtgtggatagaccgtggttacgttttgtggataaagcatggttacagtgtttagataaaccatggttacagcatgtggataggccatggctacagcatatggatagactgtggttgcagttatgggtagaccgtggttacattgtgtgactagattgtcgttgcagttgcggatacactggttaaagtgtgtagagtgttgagaaacgctaagtagctttcagcctccctgactgcaccgagcaacctttggtgtaaaaaatcctccaaggttttcggacacatgctcaagttacagaacaaaacaactgcaggattcactttgtaagaagagagactcaggtgtgtttcttgtgtaagccacagtgctggaaaagtaggatggctcctggggatcaccaaccccactccaatctcagccatcatttctagccatgcaattgggtgtatcccttagtatctttgatccctccttgtctgtaaaaaatggaaatgaaaatactcataggttttatgtggagtttataaggcaactagtgcaccatatggagtggagaagtgctattgctattataattgtgtaatagtatgtaatacattgatatgtaatatattaatatgcaattataataataatagcattgttattatttctccactttggcccacaaacctgaattcagccacttctatgtagagagtactcagataaaaaagaaaagtgagatgcttacgctctagaagaccatgatgtgggacagagacggaagcatgggatcttctactgattgtgaaaggacgtgcgaaacccaggctgctggccatccccatgaagggctgctagaagggtctactgaaaatggcccacagttgggtgctaaatgaggaaacattatccagaaaactcacttaaatggagcgactgaggccgggcacggtggctcatacctgtaatcccattactttgggaggccgaggcgggtgaattacgaggtcaggagttcaagaccagcctggccaacatggtgaaaccccgtctctactaaaaatacaaaaagttagctggccgtggtggcgggcgcctgttatcccagctactcaggaggctaaggcaagagaatcatttgaacccgggaggtggaggttgcagtgagccgaaatcgcaccactgcactccagcccaggagacagagttagactccatctcaaataagtaataataataaaaaaaaggagcgactgatacccacatataccaggtgcattagcacaatcactatttccaaaggctggaaggaaatagccttgccgagggccagaccctgagctgctggaggccttgagaatggcatctcacgtccccacggagagaattgtgatgcccggacatcacgggcgcttccatgtgggtgtttccgtggccagagggattctgaaatgtgtagggacaaggacccattccagggaagccaagtgtcggccgcattcaccacccgtcccctgcagtctcacacctgcccgaggaggcagcccagcagtcgggggccccgagctggggaggaacgcaggcggctgcagccccgagggagccctgcgcttgtttctaagaataggtggcttccgggatctggagttcggtttttctaaatacacctcagcccggagactcggaggcaggcaatggggccaagtaggcagccttgggagtgacatcacggtttcctcttttaaggcgattctgaggcttccttctccccaggcccctcccgcccagctgctgcagctgctcagagccacctcggcctccacctctgcggagctctgacctgccctggcttggctgtgcctgggtttgggacagttcggtgtgtgttaaagaagcagagctttaactgcgttgagggtgtgttttccctcctgcctgctcttcttacctgcagtccaaacacgtgtgcctcggttgtttctaaagcttccccgtggactgcatgactgaaaatggactaaatgatgattatgttaagaagacttgacagtgccacctttagagggaaacgccaaaagtggcccagaaggctgagggacaggggcctatgtaagcttcacgggaacagaattcctaagctgtaaggtaacatttctatgcaatatgaaacctgagaacaaggcttaataacagcccctccaggacggcggcaagcgagccctcaagcgcagtctgcatttccccagccgcagccaggcagctgccggcaccttgggaggcactgggagcacgctggtgacttctcttggccagtaggtgtgggcgtggctcggtgctccagacactacttgaaaagggaaggtttctgggactcctggcaccgcggcctctcctctgcccaaatttcaagatttatttttactcgttgaacgaaaaagagaatgagccctgtactctgtcatgctccaaactgctgccccatttttagaccacagagcaagatgaatgctgttggaaggaatgtgtttatgagagagacagtttttaatccatcagagagcaatacttgcgactttaaatatggcatatggtgaaaaagtgtccctgtgatgagtcagcaaaaaaaattatttcacccctcacatatacgagggtttgattagctcactgattgcagttttactagtgtgcagcacagactcaaatttaaatatagcttgagggaaaactctgacatcagaatttgtgcatgataaactgtgttgctcaaacttcaaaggtctggtctccactgcttccgggacctccccctgcctcccaggggacagattcctcgtgtgatcccacaggccagctgcttcaaagctgtgtctttccttgggccccttctgacccattggctcccctgtctccactcctcacggtctgccctcaccctctgtgatcatggctgtggccctgcgatctccatcctgtctccttgtgacagattttccacctcaccctttctttaagcagctgacactcagacccatccttcctttgtgtctgatgtctttggttgggtttataaaggcaagacacttctcccaacccatgcaggacgtcctcacagatcagcttcttcaaggagacctagcccagcccgtgaatgagtggtggcagcgctggcagcatgagaacaggagttgaaacctgctctcaccccggccaaagatcacatcgcttccctttcctataaagtagtgcatcatgtggaggacatttcgtgtctgtaaagtaccatcacccttttctataaagtagtgcatcatgtggaggacatttcgtatctgtaaagcaccatcacccttctccctaatctgtgcatgtgtgtatctgtagaagtgtgcgtgtgcgagaatccacccttcatgatttaattgaaatcacagagcagtgatcagcagcagcgaagatgaccctcacagctggggagcccatgcttgatgtggtcagcattgcctccctgcaggagggcccggctcagggagtccttctcagacccctctgtcttccctatggtctattaatctccccatgcaagggaagatgatggacatcaaatcgactgtaggctgtgctcctctgtgcactctcacgagcactaacacctcccagcatgattctccaggactgcggctccaagaggaaagctggccccagaagcaggctgctgttcagggcctccttgcctggtccagtccttgcttaggtgaactccagctgaccaagataagcattcactgcatttggtttaagcagcctttcgtgtttattgtgttagtgggtgcttttctttctaaagcaaaaaaaaaaaaagtttaaaaatttttaaaactaccctacttcttttatgacttttactcccttctcaaaaatatcagtgtttcctaagttcgataatagcatttgaccaagtatagtacacacttgatgaaattaactcagttttattaaatgcctattttattggcatgggatgatttaagatgaagactctcagtgttaacggcctcaattcatttattcaaaaagcatgtattgagcctgctctgggtgccagctactatgctaggtgcaaggatgtaaatattcgtaagacacaatcaccccactcaggattttttgctgtctacttttattgtcctgtgaagaggaaagtttggagagacccactcccctccaaagtgggtttctaggtcatgtcccatcacaggaggaccagggctcttgagctcgttgggaattccaggaagacttccatggaaggtggctggagtctctgtctccacagattcccaaaggtcacgcagtgaccctgcacagggagccttgaaacctttgcagttggagccagagggactccacacaccttctagcccagcgctgggagtctgtgggtgggaccccgagtggtgatgtgttgcactcaacgccatgccatgggtgaggagcagaacctggtccacactcactctggtaaactgacaccccattaaaccatgttttaaaacttgtgtattgggaacttcactgaactcagcagtagttattccatagggcagctggaaaccattctttagggactggaaagtccattctcatgccctttgacttccttgatgttaattctaaatgacacattctcaggatgttttccccagaggaatcctatatggcagggctgtgtacaggcctgagaagcgacagggcagcctgcggttacacttgactgagtaatccgcttgtttagggctgtggccgatgagtccctgttcccatggtatcctaaacgtttgcagttattaccaaatctgaattcaaccctcatcttttatattgaaattccttttttaaaaagacatatgtcaagtggaagctatttcatttgtatctgacactatcttttcaaactgtttatccaatcatttgggtcccaagtgaattacgaattcatcaacttaaggaagaaacttggaggttaagacttctttttacgatactccctcattcatgaaaaaatgcgtttatttttagtagtgctttggattctgtgttttgtttgttctttggttttgtttctagaagagtcttgttggaagctctgtttccagaatgctggattggctgtggtggggtccataacccactgcctgtatcaaactcatacttcaagaaaatattaaatagttgcagtatctacagggcctctacagagccccttctgctattagcagggatgtgactttaggtcacaaaagaactagaagcaaaatggtgactatcagaaaaccttacccaataggagtagccagacttggtcatttgtgaggagtccggcagccggggttccagcatctctgttgcttccctgctgttgccagtgtaaatgttttatcatagtcaggatctgttgagttaaaagaatatccagagatataacaatgcattctttgtctgagtcattaagaatgtttatgaagaagaaattgagtagtgaaaagcacagattcagagcccggcagatcttcctctgaaaattggctctaccgcttactagcgcgatgcccttgagtaattctctaatctctgtaagcctcagtgtttagttctgcaaaacagaagagcaacacctttctttcagggtcgtcattgggattcgaggtagacaaagtaatctttagtatctagtcacatgatcattggtccccaggtgctcgctaaaaggcagcctccacccgtcctgagagtgaaccactgcattcttcagtgttcccggctggcaggtgtggactgctggttctcttcagtttgctctgaaaatctcactttgctttgcccttgctggatatttacccaggtttcttgggctctttctgcccccacgtgtcttgcacatcccagcaggtgtctcctctggggccttctctcctcttggccccacacattctgtttgctcccagggtggatttggaggggagtggtaacaaagacccaagttttcaacaacaaatggcaggaggtgaagaacttcaaatttgagattctaggaaaaaagaggagtttgaaagaaatactgaaatactgaaagtcacggttgaatatggtgagaacttaagagtaaaataaagaatcatcaagaaaacaagtcagtcagtcaacaacttgactgatttaaaagaaccaatatgaagagtctaaagaactgatttattcttgcattcacgttccaaagcaatttaagtaaactcaaagaatgatgctatagttgaaacgtaaatggaggaggactgggtatttatctccaagatgcagggagaaaggtgggttttgaagaggaggaagccaggacagaatacccgaagtctgcaggaaccaggagctgggaccctcgagggcagtgggaggagagacggtcacagcagtgctgtgagtccgcggggctcttccggcccctctgcctgtgtgtccactcagtatgtgaaaaatgcctgtgaattgttcacccaaaaatgtattgtgcagcagcagatgtcccctaccccatgcagaaaaaaagaccatattagtacaacgcctgtctcattcctgtttcctcaggggatgcctgagaatcccttgctttaaaatcctctcccgacccttatctaactgtggtcaagaataattgttggccatttcctgctctggaaaccatctggtctgctgtggtgccctctatcctccctcctctttaactataaattaagtcctaaaagaaagaagtagaagaactgagacaatttaggaccaagaaagtaaagttaagaaataattgtattaagtctgtaagtttagaaagggctgatagccatggggcaggtggttgattttcatcctcaccatgtagagaataagaagggaaaaacttacatggaggattctgactagcctggagcgagaactcacagtgattcagcaaatatccacacgaacagctgcgaagtattgttgatctccccctggtgtcgcccacctgggaggattggcccacggtggtgctgaaggcaacagtatggaggttggcttcaaatcccttctggcagtgtaaattcatgagaaatgctgaatacagttcatctcatgtgcttttcttttgtaaggtaaaattgagctctttcttttctctaacaagctcattttaaaggctatttaagggaaacataaaattaaaatataaaactgaacctttcgctggctcaatttcttaatgctaaattgctctcccatccaagaataatttcaaaagtttggaatttataaatggcaatacttggatgtggaaattatgttaggactcctatttttatgaatacaatccagtataatgtaaggctatataaaatgaaatatttctgttgaaatgtatttcaattctttgtctgagtagtgaggattttattattggattttagttactcaagtttcagctatatttagtgctgaaattctaggccattttaagagaatcccactataaagagggaaaaaaaaaaaaggccaggcccggtggctcacacctgtaatcccaccatttttggaggccaaggtggatggatcacttgaggtcaggagttcgagaccaacctggccaacatggtgaaaccccaactctactaaaaatataaaaaatagacgggcgtggtggcacacacctataatcccggctactcaggaggcggaagcaagagaatcacttgaatctgggaggcagaggttacagggagccgagatcgcaccactgcactccagcctgggcaagggagtgagatgctgtcaaaaaaaaaattcttttttacatgactcagatacaatgagggtcaaagtatctttgcccaaaacattactgtaggactcatagtaaaaaccttccagcagaatgaggtgttggccataccccctgccactatatgatgactttctccaccatatctgtgtgctgaagagtcagatgggacagtagaagcatgagagaaaatccatgctggaaccacctgtgcttgactttgtaaaaaatttttctcacaggtctttaggttaaggatcttttaactcccttgataatttggcaaataggtattttataatcgtaaaacaagagaaaacattgatgtagtgcttactttctgccagacactgttttgctctgtgtgtgcgtgtgtgtgtctgtgtgtaattaactcacttattactattttccccctttaacatgaggagcagagaggctcagtagtttgccacttgtccactgtttctaacctggttaggctggtcagcatttgaacatggaggataggacagtcacatgacattcgcacaagtagagagaggaacgttgacttctgagtcacaggtcttctcctggtagcgccatcataccttggggatgtttcacagccacaaatccaaacatgcgtcccagactgcatgacccgtaccccagttgtgttgacctatgttcatttcctaactcgtgcaattacacaaggatggtcttggtgcacacgacctctcggtccattttctggccaatattcagttccttgttctcgccttgccatttgccacgcttcagtcagtcttgtttcccacactgctgctggagaggtgggctcctccgcgggtgggccgatgaattacttgcctttgcctttgctagagtgagatgcattccatcatgtaatacatcaaaacatacaccagagttctggcccatctggtgctctttgctcagatcccctggccactccctaattttctccactcccacaacttgctgacatagatttgattttcaattcagaacaaattcaaaacaagtaaaaaagatctgatggaattagcagacacatgtcaaattatccacagcttcttgctggagacacatggaaagatagggtgcagcacgtctccggggacccagagctggagaactcctagcagcctccattttctacaaagccacgggtcctccacagggttggccctagtgcccagaggtcaacagtggagacctgtctcctcctgggaggactggatctcatatcaatgcgtaagatgataattaggtattgccagcattccccttacaaatccttcaggcagggcaactttggagcacagtggttgtgtcttaggaggtccagcaaagccagttcccttcaacattagaacaagtcactcttccttctacggagcactgcctgggaagtgactgccactgccatgttgtgtgacagaggacagtctttaaaggggtttcattcattgtggacagatactatatgaaggcacataagggatttcctgatggggaggatggcaggggaggtgtcccacgatctcagtgcttgttcatcctgtctgtgtctctctctccactccctgccccactcctcatgttgcaaagttaaatgagaacgtgacacatttttcctgtgattttcattttacatttttagatgtggtcattatattcaactggatataacattttgtttctaattgaaaactttttccccaaaagtttttgtgcttttgaagcaaatgcgaaagtccatttctggcagggcgcagtggctcatgcctgtaatcccaacactttaggaggccgaggagggcgggtaacttgaggtcaggagttcgagaccagcctggccaatatgacgaaactccgtctctgctaaaaatataaaaattagccaggtttggtggcgcatgcctgtaatcccagctactcggaagtttgaggcacaagaattgcttgaactcaggaggcggaggttgcagtgagccaagatcgcgccacagcactttagtctgggcaacggagcaagattctgtctcaaaataaaagtccatttctaattccatttgagggatatggaataaagtacataaaaagtaacgagtcaaaagaaagaaaaggttttagtgaaaatgaatgtactcttctcccccttctattgtttgtaatagacttaatctttaaagcagttctggatttacaaaaacaaaaaaattattcagagtgtacccatatcccctcccgctacctctcacccctagttcctccgattattaacatcttgtattagcgtgctgcatttgttacaactgataccagtgttggccttccattattcttttaaatgtgaatctgactctggggatttgtgtgactgaatctcgcagattgagaacgatttttaacaaccagccatgcttgtaaaaacatgtggaagtttctctgactctgaaataagagggacaagatggttcccatgcaggcttgcgttggaaatgggggagcgtgcacagtctaactccatgccccgtgtttttcttgagtagccctctgggttgaatcaccctggacttcagctgaggcagggggattgttttatgctcaagaaagctccaggagtggtagaatctggccatcaagatgttctgtgaaatggggctcttgtcttttctggagaacatgccttcttggccctttgatcatgagacatctcaccacgccctcctttaacattgctaatgatggggactgaccaccccgtcattaaaccccatggcagtctaagattaagccattcagaatcttactagaaatgactaagcggaccgttttttcttgtgaggagagaattaaaggcgtttccaatccctaatgataaaaccagcatcaaattgtagagaattgcaatttctttcttacaaacagcaaatttttgtctcctttcattttttaaactgttgaacgtgtcagatggtatgcatagagagatttcagaggtctagtcaatgtgcaaatgttttgtggttttattttgagtttgaagtcagagcactgaattccacaaggcttgagcctcactctccctcctgagcacccaggcttcacggacatgactaataggagtttattcacagcctgctaccatccttggtcataacgttgctcaaggcccgagcaggcctgccaagaccacagtgtagccctgttaatatcacatgaccgtcggagagtttttggaaaacctcctctggccgactgtttatccgcccccattgatatttgtctgaagataagttatacagtctgtttacttacaaatgcgtcagaacagtcttggacttctgcacggaggttctgccaaatacaagtctaacagggaagtggtttgggcagccccggaaccgaagaacccctcagagcatcacaagccatcactctgggtccctgtcatttaaatagggattcaggcttcaggttgtcagtatttataggcttgattggagggaagtaagccgtatgagcactttttaaatgaatttttatttctcatttccacttagtgatggatgcacatttttccactaataaacatttgaacttttttcagtttttaagaacatcgtaggtggcatatttcacaatcttggcaaggcagacgtttttggagtaaatcgaaactggaggccagaagtactggctctgaactgaactaccacttgcaaatcgatgtagcagaaggaataatggatcatgtggaccacgcagaaagcgatctgagacgggcgtgtcagccgcatgtggatgaatagtcctttgtgggcaggaaggagagggagtgggtgggtatgagggcaggagaaagaatcagctctgtgtttgggggctgtgagaggacactcagaagaaggcttttacaccatattttatattcacaagtttatttatgttattttgagtccaacagaaagagtcacaaacgttaaactttagcaaccccctaatgattggaaaagatgggcaaatccttgctttaagagcagctgtatcgtatggagaagaagtcatctctgctgggaaaactcgcgaacagatgcaggctaaagcgaaagatcaactctccacaccattacattttgaagggctttgaagttatttttagaaaaactcaaaaatctaaatcaaaaatcagattttttctttttttttttcctactgcttccttttcctttttcttcttctcttgtcccttctcctttttggttgtttctattgctatttttacatgttcctttaggtggggggaagataaggtgtgaaatgtattcaagtgcaactttttcaaaataataaaatacatgtttattatgaggaaaactcaactgcctatagaaatgacaacggtaaatgtaaataagcaaaagatcagagatataagtgtatagccatcacttcctttagcaatcaaataatgagctgggcgcagtggctcacacttgtaattccaacactttgggaggccaaggtgggtggatcagttgaggtcgggagttcaagaccagcccggtcaacatggtgaaaccccgactctactaaaaacacaaatggtgtttttagtgttttgtttttagtttagtggttttagattttagtggtggcaaatgcctataatcacagctacttgggaggctgaagcaggagaatcgcttgaacccaggaggtggaggttgcagtgagccgagaccgtgtcactgccctccagtctaggtgacagagtgagactctgtcaaaaaagaaagaaagaaaaagaaagaaagaaagggaaagaaaggaagaaagaatcaaataacaaaaagcacagtcagcattataagatatcagacatacccagcccagaggcagggtggagttggagatcatctagtccatcaaccaaatcaatttaggttgatttttttttaacaatttttttttttagccaagtcaaaaaaagtatttttagccttacttatatataactgtatcttttttggctcacttagaccattttatcaaaggagatcaaccacaaattcctgccggtttttagttgtaagaagctttttttattggcaggaaaactgggagaatgtgtaagttgttaagcagccaggccactctgtgcccagtattctggtaactattgtgaaggatgtttaagaagcaggtcaaaggaatgaaagggcattggggagaaaggtgaagaaaatttattgaacacctatcacatttttccctcactagctacttaactcacacatccgcacaggagcccaaggttaaaccacttgtctagatcaccaaggagagcaaagataaaatcttgttcctcccgtaagccctcagagcctgtgatgtcagacaccttgttgagagataacattcacaaaacaaccagagaaccttgatggccatcatatattagtgacatattcatgctggcatgtggggcataagtgagctcccgtattgacttggtctgagaatgaagaagtctagctttacccataatgggctttaaagcagctctttgagtttggttggccccagacctaaagtcttgcatctctgaaccactttacctattttctttcccacagaggacaaaaataaatgtgtggaactgagcctaggtcctgtgaaaccttttattctccagatgcatagcattcccttggtgacacaatccagttttgtgaaatatatgaaaatattggaacttttcaaaaattgtctaaatttggggggatgtgccatgagaatgtttaaaatgcaaattcccacacagttcatctaattgattttaatctgattatgcctgccctgcaggatcttcctggcaggaatatgataggccacctgcttcttttaggggaaaacattctgttttgagggtaagagaagatttgagtgaggtttgctttggtcatggcttctgaagcttgataattgcagaagttccatctgtaagatgctcgattaaaattctagatgaattgagtaatctccacaaggccaagagaatctaatgttcttgaatttgttccatattcacgatagatctagtaaccatgtgtagtaatcagacaaattctccaaaacatacagccagctggattcctgaactttaacaaagtttttatgctgactgcttctgcaacctcactaactagccagcctagataggaaactcccttcttaattcattcataaagtaccttttgatatatagacccaatctctaataaaccttttggagatcaatttgcatatgtgataaaagtgaaaaagttggtcttcagatacctactacagaaaaaaaagtgaaaaagttcttaagcagatgagaaatttaaataagattttaagtattttctgaacattaattcacctcttgacttttgaaactttggtcagacggaaatgttcattccttctccctgaaagagttgatggttagatttcataacacagaagctagtaaagcaaatgcagtaagaaaagtagcctcccataggtattcaaacacgtattcaaaattaagacagcagaaagtctaaatgtttaaaatatgcttcattaacttctgattccttgaatctatccccatttattaatgtttatatagagaaccaaaaaaacagaaaaattactatgatgactattaattacatcattttccaaaagggggaaaaatattgtaatcaatgaaacctgaatatacttttataattgataagattaaaaaagttgtaattccacttcagtaactaaaagagttattcagaagataaagcatttataatgatggacctagatttctgcttcctatagagatttcctgcccacgtacacatattctggttacacaggaaggctcatgagttgactactttggccagccttctattttgtaagtattggcagagagatacttaagaaaaaaaatgatttcataagtaaacttataattaagagaatgaagaagaagatgtagctcttggggcttccattgcctcctaacagaaaacatctgctggacttccggaattttcctaagaccttgagaacacacccacgcatttccaacttttttcctaaccagtgagttggcttcagcagttttcagttttatagctgactgtcccatccaaacagttgttcagctttgccctttatcataaattcattcccatttgtttattgcatagtattggttaccttctgttaattgggaggtggggaggaggaccagagaacaagctcataggtacaaaccttgtcaaaactaaaacctgttttgtagatgaggattggttccttgtattgttagcattgcctttgctcaagagaatcaatccaactcattttagtaccatctgtatctttcaaaatgaagaagagtagttaaaacaatatgaagtatggcatgtgtcaaactccacaaaggtgttttccatataaacttgagaaaacctaattaagtgggttttgaagagacaatggagctctgtttatatgtttgcctacccaggggaactaaaacaaacaaaacttacttttaaaaagcttcttcaaagttctcattttgttttagaagaactttcagcttcattgctttctaagtagcttgatatcattagaaactgataatgctcagcacagtcagcgcaagataagttaaccagcttacatccacctatatgtttaggggttctcttggtctaaaacgtcttgaaaaccaaatttctgtgaatcagttactgtcttagtccacttgggctattataacaaaaataccttaggctggataatttataaatgacagaaatttatttctcactgttctagaggctggtaagtccaagatcaaagtactagtagatttggtgtctgatgagatccaggattcatagatggtgccctgctgctgtgtcctcacgcagcagaaaggacagatgctccctcctttataagggcactaatcccactcatgaggacatcactctaatgacctaatcacttcccaaaggcaccacctctcaataccagcagattggggattagatttcagcttatgaattttggagggacacattcagtccgtaacatttcacccctaacctcccaaaatttatatccttctcacatgcaaaatacattcattccattctaatagcccccaaaagtcttaactctttccaaaatcaacctaaaaagtctaaagtccacagtctcatctaaatatcatctaaatcaagtgagagtccaggtatgattgatcctgaggcacatttctctcccagtatgagcctatgaaatcaaataaattgtgtgcttccaaaatacaatggtgggacaggcataagacagacatttctattctaaaagggagaaacaggaaagactaaaggagtaagtgatgccaggtgagtccaaaacccaacagggcaaagaacattcgattttaagtcttgagagtcatctctgactccatatccgccttctggacacactggggtggggattggttccttgagtctcggggcagccccgcctcccatggcttcactgggcacagccttcattgcagctctccaggctgggcaaactggtcactccactgttctgggtgctgggggcagccccactcccacacctccccacctagaagaaacctacactgccatgaacagaatattattcatggtgttctgacagactgaggctttttctgcaactctcttcttcttatgagccctcaccttacggagtgaggagcccctctcccacaacactgcccttgtggggcctctgttgttggccctgctcctgtgtcaggtctgtgcctggtcacagaagttctccagggcatcccttggaagctgggtggaggtggccacattctcacagctcttgcactctgtgtgcctgcagagttggcaccacgtggaggtcacgaaggcttcctgcttgtgtcctccagagagaccatctgagctacacctggacccactggagccacagctggggcagccgaggagcactgcatccgattgcagggagcagagacttgaaattgttctggccccagggtcctggcattctgggcctaagatgggtggggcagccccaaagattgcctccggaggtccttcctcagttgtcttgattagcagcatctggcttccctctaccatactcatctctttatcaaatgtttgcttggctacaatctcgatgttctctgctgaacatgttttctactcttctactacctggacagtctaagaattttctaaatctttcagttctgctctctgtttcttgataaattccatctttaatttgtttctctctgtttacactttactataggcagtcaagaaaagtcatgccacaccttcactttgcttagatatttcttctgccaaatatcctattttatggctcagaagtctaccttccacaaaacacaagtagatgagcatgattcagccaaattctttgctgctttgtgacaaggatggccttccctttagtttcaataacatgcttctcatttctgtctgagacctcatcagaatggcctttcctgtacacatttctaccaacattctgatcatgaccacttagggaatctctaagatggttgaggctttctctacagcccccctcttcttatgagccctcgtcagaatcacccttaaggttctgttcatggccatgtaggtttttttctagcatgcacctccagattctttcagaccctacccattacccagttctaaagctaattttacatttttaagtatttgttaccccagcatcccacttttaataccagtttctgtctcagtccattcgtagtccatgctataacaaaaataccttaagagtaggtgatttatgtacaacagaatgttattgctcatagttctgcaggctgggaagttgaagagcaagtgaccagcagatgtggtgtctggtaagagctctctgcttcatagacagtgccttgctgctatgtcttcacatgacggaagggacaacaggctcccctgggcctctttgagagatgcactaattccactcaccagggctgtacccccaggacctactcaccttccagagtccccacctcttaatgccaacacactggggatcagatttctactcatgaattttggagggacacagacattcagaccataacagttactgctcaaaacaaagaagtaaaagctagcaaataatataagtatgatgtatttagatttattttagtattgctcattgcctttttaaggtaaactttctgggtcaattgagctgtttagatgccgactcatatttgaaggttctgctactcctctacaataccagacttataaaaatcaatatattgcaatcattcatatactcagcgaacatgctgacacctactgcgtgaagggttctgtgatatgggcagggggtgcagacttgtatcaggcagctactctctcagaattcactgcctggcagggggaggccaggaggctgtccccagctaagacacaaggcatggcttgtgctaggccaacagggaggtgccgggagtgtaatacaacaaggaggagccgccaaggctcacaggagggtccccatatggacccaccattgctgagtgtgtgtaagaagaagagcaggaccagggaggtgggtctgagaaacagtactgattaagaaggagtccaggaaggaatccctgaaaagaaaatgaagaccaagtggatagagagacaggaaaggagccacagacagttctcccagagaaagaggaggttaggaggagggagtggtccacaggacctagcgcctctgggagacaagggtagaaaccacaccatttctaaaatgagttggggctgggcacggtggctcatgcctgtaatgccagcactttgggaggctgaagcaggtggatcacttgagctcaggagctcaagaccagcctaagtaagcaacataatccaaaaaaattagccaggcatgatggtgcatgcctgtagtctcagctactcagaaagttgagaagtgaggattgctttagcctaggaggttgaggctgcagtgagttgtgatcatgccactgcgttccagcctgggtgacagagtcagacactgtctcaaaattaaacaaagaaataaataaaatttaaaaacgttaggaagagaggaagaagagggtggtacctggagggagatctgggctacagagaaacgttttagaaaatccatgtaaaatccaaatgcagcagattatttcagaggtcaccagggtgaattatggctgggaaatggactaacacaaaaaagatgctggtgtatattgtggaggttcgggaagggtgggactcatgatgtgttcaacaaggctgtatggaagcctgggttgagtctgtgtcccaggaaaggcccactagtgggtcccggtgtgggacccacccccggcccccaccccttcctgccccttctggctttctgctccactcccagacccgtcttctccatcacccgacgttttcctagaagggcataaaacttacaccatgaggggacctccacgttagacagggggagaagctggaggacatgaatggccccgcagtcagggcccagtcacctgatctcagctctgtggaggtgaatgtgtttgagttgccctttttgtgaagacgtggtagctgcaggcatggacaacttacacattgagcaatttatatactatttgaagccacctcactttttcccttggtttttggtttctggggttttctaagaggggagagtgactcatgtctttcccactagtaggtggccttggttttaatgctgctcaatggattctaagagagcatcccaggaacctgctggtatcagcccagcacatttttggggtctctgggaatgagcttgggaaggtgagtgaagaacaactgaaaacaatgaagcgcatttgtggctggaggtcatgttctgatgaatcccgatcgggggaagccatggctgctcttgcagtgatcaagtgtctgccgcctggattctttcctggcatgtcagatttgcagcttccgagaaagtgctactgtcttgcatgacaaagtaatatttggctcaaagaaaacactgccaaactgagcagccagtaaattctatgacagcattcaccataattcccaaatgtaaaccagatagtaaagtgtcgttcataaccagcggactgtcagaaatcagagaaatgtgggagtggcctgcagaagctgatctgctgcccctacggacactgatggcttccttcatcgatgcagactggggagaagtgggcgaggtgtaggccccaagcagtcccaggctgagagcccggcacaggactggaaatactcatcagggttcacaggctgtctggtcttaaggaagtgacagcataagcaggagcatgtcagtaaattcacagcaagaccctgcatgcaattctatttgcaaatggaccctctcactcttgcatgactggctccaatagaagcaaaactcaggtccatcctagagcacatcccaggagaagtttctctatgggggatgagcttcaaaagtaattgtaatttaattagaaatttagatgtgagtacctggtttttttagtgggactcttttttttttcttggtaatttatacattagccgagacgcttttcctactacactgccagaagttaacttctaatagagttcatacattttgttctctctcatgttttttctccgtcacctattcttcacaccttttaaatttaagaagcatgtatgtatacatctgtgcgtgtgtgtatatgtatccttggcagcagtcctcattcctttggtgattactaaacatttgaggactggtaaactgtgaggaattgaaccttgctggctgaaaggtagaggaccagagtctgccttgttccccttatgccttcaggggcccggcagggtctcctgctcctggggctcatcctgcaagaggcggctggtatccaagcagcccaccccgatcgcctcctcagggaagagggcagggcagttaggaggcaatgcttctccatggtgctgggaatctctgtgatataaacccggtgggatggaggagattatttcaaataattgatatttacttgcattgaccatgaaaccaacccttcacgagcaccctctctggcccagggcagcactgcgcccctcgggtgggaaagccggtgtgggagagtccaaccctgcaggaaacggcttggagaagctcccgcctgggacactgaagaagtgagcgaggaggaatgatgcgtcagttcagttcaccaggagaaacgtggaaaggccagtgtagcgaggagagcgtcacacagttgtggagatgtcagcagacacagtgagggaccatggatgcggggctccagccaccagagtgcagggtagagaggagctgcacctagaaagccgtggcacacgcagcaccaggaggcctgggcatcacatccaccgacccgagtttcactctgcagggagcagaggggccttcacgtttttacattagaaaggagtcggagaacacgttggatttcagaatttgaatgaaggcagctaagagaggagatgcatgagggtgcagtgggatggggtgcacagaggcagttccagagttaatgcaagcaagcaaggaggaagtccgatccaggaaggaggtgctgggaatgcagaggaaacggcagactccggagatgcttggcggaaagcccagtggaatcagtgccctcccagtgcagtgtgaggacgggggacagcagtgtctcccccatttcaggttctgaagcctggcttgtgggccttgcaattcaccgagttaaggagcagagaaggaaaggggggttgtttctgttttttggagttttgctgggagcaaggttggaggaaatgaggtaagaagttcaacttgaagcctgctgagtttaaagtatctctagaccctctagacagaggcgtccaggagggaggtaggagccatccacctctgagcgttcactgaagccgtttggtgtgaatgaagtatcccacctcatgagtttggaggggaagagagcagcaaaactccaatgttgagcagaacaggaatcaggaaggggccagaggagtgaggggaaacgcaggcgggtccgtggccaccagaagagcccattccaggagggagggggcagctgtgctggggccacaagggtccccagggcggggaggggccctcacagctggggatagtggcattgcaggcccttgaagaagagtgtcaggccagaaaccagctcaccatggttcaaggtgtgaatgggggacaggaagtggctttggaatgtgtccaggttctttttgaatagagaaaaatttcctccatgaccatgcttcctgaaaagagaatgaacccacactctgggatgtgaggccaggagagttggcttcaccgtcggctggccgtccccaagtcctgccccttctcccgctcctgtctgatgtgagaggtgttgccactgcagtgtatccaaagttccagacatgcagagccgccctctggccatcgtcggggtcatggatcctttaggagtgaggaagcgggatgcgctggtgtggaaggcctttcatatggtcgggcgtggacacagagagaaagcgccaaacatccttgcggcattgctcctgcctggtggaacagcacattcacagtgagacaaacacaggtcataatgagagcagaagaccacaacagccacatgacacgcgtacacacacacgcacacatatatatacacacacacatgcacacacacatacacgcacacatatacacacatacacgcacatatacacatggacacgcgcacacgtttacacacatgcagatatacacatgcacacacacgtacacacgcacacatatatacacggacacatacacataacgcacatatacacacacatgcacacacgcacacatacacacacacatacacatggacacgcgcacacgtttacacacatgcagatatacacatgcacacacacgtacacacatgcacatatatacacacggacacatacacataacacacatatacacatgcacatgcacacacgcacacatgtacacacatgcacatatacacatgtacacacatacacgcacatatacacatgcacacatatacacacattcttgcacaaaaatctcacaagaacatcacgggtgaagctttctaggaataatcttactaatattacgaagctgaccacccaggctgtgacgggtaaatcgcaatatggatattccaaccgcaaagaaagcaagaatgtaccgtgatcagcgcagacccaccccgggtctctagtttccctctcccagtaatgctccttgttcctaatgaaccgcgtgcatctttggtgtctgcgctgctgccgctacacctttgtgaacaccaaatgcgcaggaagcgtatcgggagcagcacggctgcactcagttgttgccttctatttcgtggatgaaaactgctattgatttctcttttaacaagtgctgttgggaagaaccagtgttctggaggctgttttcgcccatgtcatgagaacagggcgccagctgagtcacttctctggaatggactttaatgtcacttggtttcctctcacccaggacccgggcttcatgtctggacaaatgagccatgcattatctttccaccagactaaagaaagatcagtttcttgtggtttgttgttctttttttaattgcggatgtgtgttcagcattcgcccaaataatcattccaaaccggggagtcttgggggagtgcaggatgtccagatagcaccagccctttgttaactggagagacgacagacaataaccccggcgtggtgaaacccggcccacacgtcccgcccgccccagagccaatgctagggccatcaggtggccctggtagccagtggttccaggaccagcatcagacactcggtgttactgtggacagtagctttgtacaagttcctagcgaggtgatttccaaaatattagatacctttaaagacagagatgaggaagactgaattgggatctggcttttactgtccgccatttaaccttcctcacaccaagcttcaaggcaacagggagcgtgagacatccgtgagcaagaagccaggctgctcagccactcgtgggccacgtcccctgtcccctcgcagggcttgcagttatcacactcaaagttagcccaggttgttctctaggcgttgttgccaagctcataattccacatgttcacggtcaaatgtatgtttagataccttaagttgctgctaacatcctgagggtagcttctggctgtaaacaaacataattctgatcactgtgagactcattctgttcttggacagccccttggggttcagtgacatggactccaagttcaccatctgatgtatgggcttctgccactggtgctgtcatctggcaccttcctaaaaccttcccattcgtacatgacccccagcacctgttctttttctcccgtagctttccttttcttcttggcgtcaaattcgaagccactttcatacccttttgttttcttcacgacaaaatatgttactgatgttactgttatatcagcttggtttgttcagaaatcaaaacagtgacatctttcttccatctggtggaaagatcatcagaacccagctaggtggtatcagtgaatatttccatttcccaaataaagaaactgaggctcagggaagggcagtgacttgcctgtggtcatagaactggcagagctgggattcaaccccggtagcacttcaaatctggtactcttccttcttgactgcacggggctccaaatcacgtgaatctgtgtttaactgatcagtgttaaatcacttcggtttgttcacaaaccaaatggccaccattctgcccttttctcctctcagctgccttcttctcgatgctcttaagccctcactcacggcctgtggggttactgcagggacttctaccaccgtctcccacgtcccatctcagctcctatctgtggtcagcacccaggcctccctacaggtcttctcagccacgacagccttctcccaaggaacctgggcctctgcgaagcggcctcctgattccccacaactcccctggaacacaaagctcgtcttctccaaggtccagctaaaccctgcttcagaatatgcttaaacagccaacctttttagcatgcagaactccacagctgtttagaaaatcttcctaatgcagcctgttttcaacaacgaatctgttcagagaaggtagagaaagcataggttatgtctaaatatttccctggagtgtgttactacttcagagtattagcctgcagctccaggggcctcctctgcataccttttgaccagcattgctaaaaagtaacagaaatggcttgtttgggtttcaccttctttttctacccatcactctttagcagggagggggattaatgagccgtgaaatggctacatttgagcagggtagggttaaagcagagaagccatgttcttaaatcacctctgcaggactgtggctggcttggttttgtacggatttccatgaaccccaggcatacattgtttatttttgtagacaatttgtccatctgcttttggcttaattatcgcttcaggaagatcagtggaaaagatgtattcagagtccaaggtcatgtctgttcctcaagggaagtctgtgtggatgacaatgccctatggaactcttttgaaaagccccatatgactcttctctttcatataccagccaaatggcccaaacctctctgtgcctcagtttcctcaccataaaatgggtacaatgacagtacctacctcgtagaggtttgtgaggactacataggctgactgttggaaagtgctccgaacagtgaacagtctagagtaaaaatgtcagctgctgttctagcttagtcccaaccaggggtcaaagctaataacctgaaacactctcttgtggaccctctgcaatgggctgggcctaacaggtccgccaatacacaaatttggaacactttcctttaagcaagtcaaagggaagggaattgtccaaccaatcagtgattgagtttgttccaccaccctgtagaaaggaaaatggaattcgatgtgctctttcgacatctttggaactctgcagtcaggactttccccatgggaggtgagctccccgtgacaaatgagggagctgccctctctcccactgagatgagtcattgtaacccaaaacaatctcaaaatctttgacatcactgccgcttgcaaatctgtgcctccagccaagggccggtggatgctactgcctgccacctcgtgttcaccaccagaactgcacgtcactccgaatctgctgacctcataccctggcatagaaacagtaaaaagaccaaacaaaaacgtgtcttttttggacccaaggttgaaatctgattttaaaacagagacattcagtaagcattaaacatcttccttttatagctttctcacagacctacattgacaaactcaccccttccctccataacctttacgcccctgagtcacagtagttgccctgaattgcttacgcaggtctggcttatcaccgacagttgtcctcaaaacacttggttcaaatgttaccagaactaaatttggaggagggagtcctggcattccagagcccttgcctcattttctagcgcgatcccagcagatggtctgatgtatctcatcagatgctgagcgcgggcctcactggcccagccctcctttccacaagtctggtggtctccttttttatgactccacttgagaggcctgggaaacattctccctgataatgcaggtgataaaaccagatcatctggtggaacgaacaatcagaaattccactgggcgggcacagggcttggagaagagttgagattgcggatgatgttttccggtagatgaaggtgactgaaggaattgaatggagggtggaggggactaaaggagagggtgaagtcctccacagcatgacccactgctgctcggcatcagaaattgggaagtcattataatggtcagaaacgtggtctaaaaatagaagattccatgtgggaagaacatgaatttcggagccaggcagagggggtaaatagcagtgccataacgcatgtgtttaacagacagcacatggagtgtgttctgtgtgtcaaatcctgcaagagatgccggggacagagtgtgaatgaggcatggtccctacctccaagggcctcgcggtctcacgtgaaatgtgggtacagagatgtagtatggcagtgccctgcagtgtgccatggggaagaagccccggccgcctcctccagttgtgaggaggggaagatgcccccagagagcccatgcttgagtcacatcctctagtgaccctgagagcctcaggcagcgagggctgcgtgtgccatggccctgaggttccagagaaactggcccaaccgctaggcactcagttagactggagagtgcagtgcactgtgccagcgtgggaaggggtgtgccagggcagtgggggacaaaaaaacgcaaaggctatggcggggtggctcgcagagcctgcagagctgacacagtggcttgggggcaaggcagacaggtctctcagaggcccccttacctttgcttcacaaatgagacatgagccagcagtgcttggcggtggtgagcagccgggactgtgatgtgggaccctcagcatgtgggaccctcagggcttggggaacggtattgctgcatgcagagcaccactgggtccaggtgctgtgggtgagaggctcatctctctgggctgccccctcacctgtctacgtgagaattagacacactccatggctcccaaacctgcctgtgaatcttaagtgcttgggggccttgctgaaaacatcaactcctgactgggcagtggctcatgcctgtaaccccagcactttgggaggctgaggcaggaggatgacttgagcccgggagtttgaggctgcagtgagctatgactgtgccactgcagtccagccgggcaacagcaaaaccctgactcaaaagatatgtattccatatatataaattccctgtccttttgtgggtcatcagcatgatgctggggcgttcacactcgtgtgagacatgcctctctcaaaccttgttaagatgtcagcacatgacccatctcacatgaaaaaattaaaaagaaaaaaacaaggaaaaagaaaaatacatatataaattcttcccaggctccttcccttgactcccaaactgctagaccagaaaattcacaaggtctgagactccccgttgttggtactttggcggccagcccaggccagtcctgggacagggaccacttcagaacgatcacccggaaccctgttaaaatccaggacaggagagggcccaagtgccctgcctgattgctaatgagcccccaggtgactctcacgctgccgacccccccgatctctctcagatgccccagatgctctctgaggtcccttccaagtccaacatcttatgaagcctttgggaaaataatcagttaccaatggcaaaaagcagagatgtaaatgtgaaaagtgatattatattggtctaatttcaaatggctatcactgtctataatctgtaagactcttgctagggaatgaggcttgtgtttgcgtattaagcaagacaaaggttgtttttgtatcataatgtatgagaaggaaatattcttttatccaaaataaaatgaatccatactctaggtaagaactttggagccgtgtttctctttagtttctgtatggtagaattttttttgttaattatctttttcccctgtctttctgtagcagcagcactctgggggaatctcagatgcattgtgctaagtgaaaggagccaggctcaagactccacactgcgtggttctatttctgtgagtgtctagaaaaggcaaactacatggagggagaaacatgagggttggaccgaggtttggagaagggagcatttgataacaaaggggcaacacccagaatgttgggtgatatggagctttgctgtctcttgctgatagtggtggttacacaactctgttatttgttgtgtctgttaatgacacaccaaataacacaccaaaaaaagtgaattttattgtatgtaaattaaaagataaaatttttttaaaggagtaagaaaatgaagtcaaaataaaattaacagttaactaggcagtagccaaaggaggagaaggacaatggtggttatcaagcattttgtaacaacagaaaaggtggagttctatttaaagcatgtcctattcaggaacatttcaaataaagataagaggggaaaaaagctgtgcatcacagccagttcaaaccccctccccatgcccactgccccacttttggctcgtaaccttttttcttacttggccaatgtggtgtgtgtttgtattatcgtagcggaaccaactcaatataatgctaacttaaagaatttttttttctctcatatatatagaccgcttttcagtctaaatgcaaaatagatataactcttggtcctgtccctgggctgtgccacagatcctgagcagtcaccctggaagacaggcggcctgcttgctcaactcaccgggagcccgcctttggaaggccacccacacgcctttcctctctgcttccacctggggcagactctgcagggctgttagctgcttactacctgcagaggccccatggggtaatgacagtcacatggcacaatgggaacacaccatctcagccatgagtcatgccatgctcttgggtgtgaagatgacctaagaataccaggaaaatattggcacgtgccattggcacatgaaaattagtaacctgcgcctgtgagtgaggtcgtaagtatagacaattagctcttttaattgccaatcatcgtgtgatcctggtagctcagtagttgccgcctatgctaattgtcactctctaaccgtgtaagtggaggccaccagcacagcatccgtaacctcttcatgacatccaggctgcatgagggtgatgctctgagcattgacacattgcatgtcagcagtgctaaattagaaagagcgtttcatacccattcgcggcctgacagccaaagctctctgcatgctgcctgcagctccagaatctgcttcctcctggccctttcctcaggtgcagtctgggctctcagggccctgaactcatccacaatcagactccaagtcttcttagaggacaagcaggcttaggaaatcacatcagtctattacacaatgattcacatttagacaaatgaaatgcatttattgctaaaagcacagaggtaataaaaggctttcccagaaaatcaacttttccaacacatgccaggcaaaatcatatccagaatataaaaagtttgggctaaaagccattgagcacaaccacccatgtgctgcctatttttagaataaggagcaggggttttcagacactgatactatgggtggggaagaggagatcatccactttttctctgctttaaaatgtacatctaccccagtcaaatcatttcagataaaactatataatagcatcttagaattataggtggtaccttctgggatttgaaaatttgtctatagagataaagcatgacagaaaccagtggcttcccagacttcgccttcactcctgaatctaattcggtcctgacccactttcagttctgctgccctgtgggctgtgtcccagacagttttcgaaatttctgtcagtatcaccatcagacagaccagattccatacaaggaaagctaggtcttggtttcttcagattatttccctggcagacttttcttttttttttttttgagacagagtctcactctgttgccaggctggagtgcagtggcacgatcttggctcactgcaagctccgcctcctgggttcacgccattcttctgcctcaacctcccgagtagctggggctacaggagcccaccaccacgcctggctcatttttgtatttttagtagaggcaaggtttcaccatgttggccagtgatccgcctgcctcagcctcccaaagtgctgggattacaggcatgagccatcccgcccagcccctggcagacatttttaaaaagcattcggctaagtgtttttttccaaatgtcactttaaaggtgtagactctccttccttttcgaactgttctctatcacataagctcatttgcaggaaaacctggaagggacataatctcggtcgccgggcaacatgcctgtgatgtcacagcttgtcttcttcatctttgcctttactcagctcctcttttgtttgtttgtttttaggtcaaggttattgaggcataattgacatgcaagtcattgaatattgacaaatgtatacagcgatagaaccaccagaatcatgctatggagaaggtccattaccccagaaactttccttgtgccctctcagttagtccctcccctccacctccagtcctggcagccactcatctgttttctgtctttagtttcgccttttctagaatgtcataaaaatagcatcagacagtaagtagcattttgtgtctggcttccttcacatagcagaatgcctttgagattcagcctcaactgctgcacacatcgggcattttgttcatttttattgccaaatagcaatcccaggagtgagctaatttaataaaaccaggatgaacattctcatacaggtctcggtgtggatataggccttcgtttctcttaggtatatacctaggagtgggattgttgggtcctgtgaactttagaagaaattgccaaactgtcttccaaagaggctgcacccttttgcgttcctgccggcagcccatggaattcgaggtgccatccttcccagctcttggcgtggccacctttttctgtgtatgttcaccatttgagtccatcacagttatatctctctgtggatttaatttgcttttccctaatgaccactgaagtttagcatcttttcatgtgtacaacttatttggtgcagtgtctgctcaaatcttttgccaaattttgcagttggattgttcatatctttagtattgagttttgagagttctttatatgttccggaagaagttgtttatcagatatgtgttttgcaaatatgtctcccagtctgtcccctgcctttttatttttaactgtatcttttgacaatcaaactttttaaatctagctaactttttcttttataggttgtaatctttgtgtcttatctaagaaagctttgcctaatccaaagtcacaaagattttcccctgtgttttcttctagaagcgatacagctttagctcttacatttaggtccatttggagtaaatgtctgtatatcaagtgacataaaggtgaaggtgtgtttctttacatgtggatgttacttactttgtattgacattagtgctacagtctgcatcacataattttggagggcagaaattccaagggtccatatagttctacctcatataactgaaattcttaataaagaatagtacccaggggtgggacaaatgttttatatactaaataaggagacagagatagaaagtgtccaacttaacctcagctctgtgttgcatggaataggctgctgatagttatctgtgtaatatactgtacaaatactagcctttacattattgttaccttggaacatgctactaatttcatcttgccagggtagtctaaaaattgctcagaaatgctaactgaccatcctcaaaatcaacgaatatttctaaattttggccggtggaattatttttctagagcctaaaaagtagtcctttccaccttttgggacattttacgtatttgaaatgtgtggcaaagagctcacagaaattaactaggtcttaggttggaatccccggaggatcaccaggaattgcagccttggacaggccttgaaggtctggaacacactgcggaagggagggagggtccgccctggggaatggagaggatatgggcgtctgctgggcgccagtgcccataaaaggtgagacaggaagagtccgcttaggaaggagaagggatttcctactattcagatttcggctggtaagtcatgaaaagctcattcttattctaccagtaaaatactgtactgtagattaaaaatcctgatgtgtagtgaagccagttttatcctgggcaacactgtttttatccttctctgataaatgaaactctttctactcccttacccagggaatattttaaggttaatgaacaatgaatggaaaccacagggttgtgtgatgtggggccctgatgcgtcatccatctgtccacctttgtttaagtctgaagctgtagggctacactgcgtgtgcccgtatctgatcatcttttgcctcttttctcagaagtgaaattccccaattgatgaatgcgggagtgtcgggaccctgagcgcattctctccacggtcgtggtatttgagtaatgtgggttcaagtctggatttgttgccttttcagactgcagcttccaaaaccagcccggatggcccatgtgcgcaccagccatgacttcagagagggaaaacaatgggcagcccccgcgccccgtcctcacgatagtcaaaatggagtctgtcttgtagatatcactgaagtataaggccaagactgattgaattagagataatatttaacccacataaatactcttatgttcctctgcatgacccagtaagccagacctttctactgagccccaactccatgcttaagaggtttttcttattgaaagtcacctatctcttccctcaggaatgccaggatgggggttatggtggtctcgtgcattggttctcaaactgttatgtaccaaggagtatcctggggatcagttcaaatgcagattcaggagttctggggccaggcctgagactctgcatttatagcaagcccccaggtgacgccgacacagacctcccttggagcagtaagggcctggtggagtcagccagctccccagatctgagtgcaccccggccagccctgacactggtcccatctgagcccctgtcctctctcctctccactggagttcgtgtcactacatgcagttgccgtggggacaaaatgagagaaaccatatttaaaacttgtaacaacgcatcatctcaaaagatagaagcagttcaacgatactgttcattatcctgtttcttaggaaatagtacctctacatggtctggtggtgggagcagggcggggggcaggggacatgacattaccactcctgtccacagcgtctcctggcttctgagtactttgtggaaatatttttctcaaggatgttggaggaatattaggagctttagaaatttaggagcttttgagatttatgcaaagacatttaaactagactcttttcactttctgggagtaatttttatttttaatgtcacttatcacaaaaggaaagaaagagatgaaaataacttttcctgtcgggactttttgactgaggatggaagttgataaggacgatgattagcacagaggaaaacccttggcatgtacctggtcctcccagctgctctttatagatgcaccacacttccttagtgggcaggaaatcctggggagaagctccatcctgatgaccaaagcgtggcctcctcgggccatgctgtaaatgtccatttaatcccagcaaggcaggctttacattgtgcacagcggagagggatccatctgggaggactaaggtctaactcacattctgcccaggctcttcctggccctctctcagcggggaagctggatggaattctgtgaaatgttccatctcatcagaagctcaggatggactgtttagaagtgatgccatcttgacacttactagaatggctatagcccaaaaaatggaaaatcacaggtattggtgaggatacagaggaattggaacctttgtgcattgctggtgggaatgtaaaagggtgcagtcagtgtggaaaaagaaatttagcaatacctcaaatatgtgatactcgtgcacacatatttacagcagcactatttagcaattccactcctaggaacacacccaaaagaattcagaacagagactcaagtagtcactcacacacacatattcacagcagcgctatccacagtagccaaaaggtagagacaccccagatgtccacgaacaaatgaatgaacccattgtggtctatccgtacagtggaatattattcagccatcagtgaatgaggtaatgaaccccaaaaacatgatcactaaaagaagccagacacaaaaagtcacacatcgtatgactgattctatttattggtaaatccgtagagacagaaagcagagtgatggttgccaggggctgggaggaaagggaatggggagtgattgattaatgggtttggggcttccttttggggtgaggaaaatgtttgggaactagatagaggtggtggtcacacaacatggtgaatgcactgaaaggcaccgagttgtatcctttaaaatggttagctttatgctatgtgaatttcacttcagtaaaaagaaaagtttacagcatactccaggaaaggaaagactagagtttttcattccaaagtcagactccctaaccaagaaataaagatgagaaaggggtttactgacagtgaaaggaaaatgagttcatgatgtggttagccactttcccccatcaaagggaattgaggaagggttgacgaatgcagataagaatgtggttttcatcaataagacgtgcatatttccattttggttagtagcagatgttccctttgagttgactgtatgaaataatccccctggtcactgctgcttgtttggttggctaaaaaataataataatcccactggatagatatgtagtttatgggcaataaagcgacagtcctgataagaaacattttatcccccagaagacagccggcagacactaacaaaccgcaggcctcaacatagtgaggggagcgtagagcttcgtggcatggtatgtaatcttaagaaggttatagtctagcatagccacaaactaaacaaaattgagcaccactgggaaggatccacaaaagtcggaatcaaaacatagtttgttcccaaacttaacaacaaatgtcgtgtaggaaaccactaagcattggagatagaatgagtctgggatatcgtgcgtccagggccagggccacccatcttccatgagtctcctcgcctaggtagaaacacagtggcaatagcttctattgtagaatgttctccaaagacactaaagtgcacaagcttcaccacgacttaggaggcctgaaattaggctgcccgaggtgagtactgatgtggcattgacaggacccctctgggacacgtggagggcagaggagaacccactgtctctaaaactctgacttcggtccagaccaggttaccctgagggagatttcccagctccccttggtttgaggggacaggggtcccaagattcgggatacatcatcttccatccacagccttaatctgcatggatagcttccaccccaaaaaatcatcttaactacttcccgtgatgcctggggcctaacatctcaaggaattgccagttaggaacagtaatgaatttggaggtgagatcttcccacacccctccatgctactgcctcaatgacattaacactgtaccctgggctgcgtttttaaattcccatttcacttcaactgtgtggattgctgagaatggcattatgaacattctgtgaagacagacacgtctcagctgaacagtttacctaggaagttacctagaggcaacagaagaaaagcctagaaaaatggctcaagttcccccctcaatctcagggcaagacaggaatttgacatttcacagcaaatggggcttggcaagtaaaggtgccgtgtgatgaatcaacagcagactcattcgtctcaagaggaaattaggacatacgtttttttaagtttgggctagcctgtgaaatgttaaaatataactataatacaatagttagttccagccataggagagatagaacttcccctcccctcctttctcatttttaaaacatttttattgtggtaaatttatttttaatttttttaatgtaacattttaaaatttttcttgtattagaaatatgcatatgtcctcgcttatgagtgggagctgaacaatgtgaacacatggacacagggagggaaacaacacacccggggcctgtgggtgggtcggggggagggagagcatcaggacaaatagcaaatacgtgctgggcttaacacctaggtgatgggttgatactttattgtattaagttccagggtactaataaaataaaataaatgcataacatcgaaattaccttttgagtcatattggcgtgtctgattcagtggcattaagttctttcacgttgttgtgcaaccttcaccaccaatccatctccagaactttctcatcttcccaaaccgaagctctgtccccatgaaaacactgcctccccctgtccctctctgcccggcccctggcagccctcattctactgtctgtctccatggatttgagcgtgctagggactgcatataaggggcctctatacaggagttgtcgttttgtgactggctcatttcactcagcacagagtcctcaaggttcttccgtgtcacagcctaggtgactgcttccttcctctttaaaggctgagtcctattccattgtgtgggtgtctacccattgttggacacttgagtggtttccaccttttggctgttgtgaatcacgctgctgtgcgtgtaagtgtaccaaagctagcccctgctttctgtatgcccagaagtggaatcgtgggatcccgtagtgattctctttttttaatgtgttaaggagccgccagagtgttttccaaagcacctgcaccatttcacatgcccaccagcagcgcacggagattctgatttctccacatcctcaccaatacttataactttttttaataacagccatcctatttagtgtggacaaacatttttatatgtttcagaagctcttttttttccctctatgtgaacaaaaggagagattaaccacttaaacatctgagggtctttttgatatttgaatgcaatacacatttccacagttactggatgcattatattgaggaaaatagagataaaattgtagaaattcatttggaaaattttttatactgaaatgaccttaaaaagaacccaaataagttaattctttcatcccaacccagtattatcatttcacaatgacatgactttagtaatttaggataatttttttctcacattccatattttctcttcttaaactctatgacttcttttgttagctatcatggcagtagatgatagtttacatataatgttccctgtagattatagctctttaaaaacaaaaaaaaaaatgtagttttgaaagtaaccgtaactgatcatgagtatgtattgtgattaatcgtggaaattgaacctttgttgttcccacagggtcagcctgggccagtgggcccccaggggtacaatgggccaccaggattacaaggattcccgggactgcagggacgtaaaggagacaagggtgaaaggggagcccccggagtaacgggacccaagggcgacgtggtacgcaccgctggtgtattcccctggcctcatgagggtggcgggtatctcagccttggttaattgcatttgctttcttcatagggagcaagaggcgtttctggattccctggtgccgatggaattcctgtaagttttatggaagactggaattttaaaacattgcgtgcatcctaggcaatacattttgtgacttaaagaaacattttgaatgagacctccttttttgtttatgacataaaacacgtggggactatacgtgcgtattctccccgcggaattcagtcagacagtgaacaaattgtttgctttgtaaacgtccttatagacttggcttcagaattgagacgattttgctaaactgcacattgtttggtaataaaaagctagagtgctgtccagatactcgccctaaagagccagtcttgtgatctcgttcgaactatagagcaacctgcatataaagtcgttcagccaagagcatgggcagaatgaagccctgctgagcatttgtgcagcttctcaagttctttacagcaacctcacataaaacgaaaaacaaaaggcatggtttgttcatgagaaaaatctcaaaatgcaataaaatgtgtttttataacctagtttactttacttctcgtggcataaaaaaataaacaaaacagcctgactcacagccttcttcacagggacccacgagcagatttcccagggttggcttcctggccagacctgacctcagggatcaatgtgtttatcgcacgttctgacccacctcccatccggctactgctgtggttctgagacatctgcttcacaaacctcacacatatacacagatgtgtgtgcccgtgtcctgcagaggcaggttctgtatcaccacacacgcacacgcacagggagagagactccattcccaggctgcacgagtagggccatgccttgcagaagagaaggagggaatgagtgagtggagggcagtgccagagaactcatgcgtttccatgagatctttagtcccaccgtcgaggagacatccgcagagcagaaggagacagtcagggcaaaataaaggaagtcacatttgccaagacaagagctgcaagccagtgatctcggggctacctgaatggtaggctcaaacaggcacttgggtttaccacatggccctgaacaaataaggaaataatgttcacatcagtcagaatcttgagaaatggacagaaatgaagaatctgcacaacccaaagattaaacaaattaggaaagtattttcatactaatggcctgaatctaaatcacccatttttaaactactcttttgaactctttggagtgtctttcagttttgtctccagctgaaatctgagttaaaatggaatgacattatggaaagcaattgcaactcatctgtaccaagtttccttcatgtttccactttacactcacttaatatcagaggcagatgtctcacaaactagggaagaagtaatcataatttggaggaatgattgtggtgagcaggtgaagaccattttctactgaacctgctgctcaaaggatccagtctcttaaccgcagaactctgatactacaaattaagttaacataaatatcacctgccataagtaatcagttaacaaatgtagagtttgaaggacctggatcattttagctgattagaagttatatataagaagcgatatgcagtaaaatcttagaggagtggtctcatatagcagtgaatctaatttgatgctgagcagagacagacatttagctcaatataactgaaatttttctttgaagcacaatttcagactcagattagattgacatgcaatttcaaatagatcagttctaagcaagtaagaaagaccaacggcagacaaataatagagaaaaatttaaacattacagttcattttaagcaaaagcatcacagaatactaaaaatctggagcagaacatgtggagagctgttttctcaagctgaagtgcaagggccccttatgtctttatttgaaaggccactagagtgccagctctgcaaacagatcgagaagctgccaacaaacagggattcctctggctcaccagagagtttgactgagcctgttggatctctcatctgacggcaccagttcaaccaatggctgtggacatctgaagcaaagaaatgtgcaaataaaagttctacttttttattttatttcttaatatcattcaggttacggagaactatatgtaggatttgttgtgtgggggttttgaggtttgtttgttttgtgttgttttgttttgagacagagtcttgttcgcccaggctggagtgcagtggtgcgatcttagctcactgcaacctctgccacctgtgctcaagcaattctcatggcttatcctcccgagtagctgggattacaggtgcctgccaccatgtctggctaatttttgtatttttagtagagacagggtttcaccatgttggccaggctggtctcgaactcctggcctcaagtgatccacctgcctcagcctcccaaagtgctgggattacaggtatgagccactgcgcccagccaagtttgtttctttatcttgaaattttccaaatttctcaaagtaactgtaaaagacatcccaatgctctcaaaaatcactctggaatatatgtttggtttattatcaagaaaactaaagtttaaaagtaactacacaataacaaagcatatagctaaatatctattgtttaaagaaacagcaaaacaggctgtggccaggtactgcataaattatagattattaacccagcccctgtgtgtctcctggaaccagcttaatgcagtgaagatgcccacaaatttagcctgagtccctctagtcattgcagacacttggctgtgttgcctttccccacccccagacatttcagaaaacctgacttgctttatattcatgtttaaaatctaaaaggtcatgtttcctaagaaagcaaacaagaggcaatcagctcttctaaacatgacaaggccattgataaaatcacgttgcgggtgtgtcttctctgtttaggatgtggatctgtgaaactcactatctaaaatgcagttgggtacaactgataaggacctccctgttttccctgagaaggaggtagctgcttctaaaatctttcctagaatttttaaaatgtacctttacttgttttctacagggataaggaccttcctgttatccctgagaaggaggtagctgcttctaaaatctttcctagaatttttgaaatgtaattttacttgtccctgctgatagacagtcactcaactagtaagacagaagaaaccccgacagtgtacttcttacccaagcccaggtgaagcagaactttgcttcgaaatcttttccctgcttagaacgataccttatgccttcacttatttaatctttcattcattcatttgttcacttttgaggtgtcttttccttggattcatgccgggaacatggcttatgagaatataagactgttttatctcacagttacatgacaactagaagcctgctggttggctgattctctcactgctctctttcccagggacacccggggcaaggtgggcccaggggaaggccgggctacgatggctgcaacggaacccagggagactcaggtccacaggggccccccggctctgaggggttcaccgggcctcccgtgagtatccccacagcgcctgtgctccagggacgggcagacccctgctaagccctgcctttataacctgggggagcctcccgctcactgtggccagaacggaagcataactgtatgttgacgcccaagacatgacgtttctggattcaagtaacttcatttttcgtattctttaaatgttagatagaaaatcattgttgtggttgatgttgttcactctcagtctcccaagtgtcacttcattttctcccaaattctcatgcgtaatagtggaatcgtaaacgcaaattaaaaagctgaaaccttgacaaaattctgtccatcaccatctttatcagattatgaaatactttgtgacgtgggagtgcagttattctccagcagatacgatgcaggagtttgttttttaatggaggaacttttatataatcatctgttttgtggcctcatttattttttaaggtcttggtaaaacatcctgaaatgtgtcttcagtagtacgttgctaccttatttccaaggaaatcttgcaaattcaggtttagactaaaattttgtttggtgagactttttatttaaaaacaaaaactttaaagtggggagggaagaacagtcattaatcaccttcatcacgttttcacctgaagcaaatggagttctcctactcagttccacctccacctgctagttcacctttcctcggctgtttctgttttatgtggttcaatttttcaataaactacgtcatcttctactctatatatcatcaatttcattatcaagaaacatatctattactttaagtgattcttatagtagatgttgaaagatatttacacatgcacatatgtattatgtatatgcctactgtttatatttgacacaattccaattttaaagaatgacccagtatctattctgcaaatgggtgcttgtgttaatatgttcagtacactaatgccaaagaaagcacgtaatagtattatcagaaataaaaataacattggcatactagagggttggttgacagagcattcatttgggttttgaaaataatttaaatcctaaagtatttctgttttaactctaggaaagatatgattgggtcaataggaaattaaaggtcttacccttgttgctgaatatagggttggtgttcagaataacccccatcagccataagaacaattagaccttgcccacaaaagtcaatgttcagtcatccacattaccatagctgcaccgaatgttaatggactctttttgttgttttttctttttacaatatatctgctaattaggggccccaaggaccaaaagggcagaaaggtgagccttatgcactgcctaaagaggagcgcgacagatatcgggtacgtttgcaagagatgggaggggtaatgaagggacccagtgtaaattctcaactaacaaagttaattgccaagtgaactttgcatgtaagaatgaatgtactgaaggcatgcctagaatggcggcataatctaaaagtcatcttacttccgatcaggatgttttcaatcttatttttaattgtgtgtttatctctttcccatattcacaatactccaagccaaattagtacttgtagttaatattagtaaatattaatattactaaaatatattctgactaaataacaatattagtaaaaattaatattagtaaattaacattactaggtcctgatagggctgatctgtttgatatgcttatttccaactctgcaataaaaggtaagtaaatctaaagatggttaaaagctatcactcttaaaattatttcttctccattagggtgaacctggagagcctggattggtcggtttccaggtaagtttatttttattggacgatattccaaacaaaagtttaagagcttcagaactccaagtaccagtttacctctcttaaaaacattctcccgctgcctatccatagggacctcccggccgccctgggcatgtgggacagatgggtccagttggagctccagggagaccagtaagtacctggacacaggtgcccactctgggaccatcgtccggtcatcccttccagatgccacttcttcaatggttgactccagatgagagctttaagaacaactatgatgcttataggcgtagcagagaacatcaagacaaaacggaccattccttgcacactttgctgctgttaaggttgaagaataagggcttaaaattatggtcaccagctctctgccagttatgtcaaattttgacttggttccggcagggtgcccttccatccccaccccatacctacccagtgacagacagcccatcatccctgggcaaggcaaaccaaagtcccacaggttcataaggaggaaatggaggtctgcctgtgccacacccatgctagcaggcatatcacacctgggctcattacagcaggtgagatactggccactgtttaacacaatggccctagagggctcattgcaagtagggaagagcagaaaaaggcacttgctgaggcttgtgtagctctctggccactcccaccactgcacaatgagctggaaggtggattggccactgcgagagctcctgactcgctcattccccacatatgttagtaatcagataaataggccttaacttacacaaggagcgatttgggctgcaggtgagagagatcttctcacaggaagccattgctcaagactgagacaagctatcaagggacactaacaccagttccttgacagatactgagaaaaaaatgaagtcatatatgtctggggagactcagtcaaactaacagttggggggtactcataattctcttcagattataataaatgacaataataataatagattttgtttctacaaagcaaatttccccggtgctgtgaaagtcattcttgcaagtagccccgtctgtgaaagacctggtcaaggtggctgaaatcagggtcatacgaggcgctgttgctgtttcactccatagggttattggcttagtcacggcacacatgccacatggttggatttcatactttaaatgcaccactcggagaagtccggcacaacagattgtacttgctaggtcctcagctgctctgacagcttttggttcttcacatgagccatgcaatcatccacaaccccctccctatccactcctttgtatccacttatttgtacttaaacactcttcccctgcatctgaaatgctttaatcctaagcacagtgttgacactgaatgctctgcagaaagacacaccatgatactgcagatggactttccgctctgcagtgccagcttgtagattcattctgtccatgaaagttggccaagctaccaggaagaagtcctgcatggagtctcgtggggactcccagaggaagtcagggaagctgtcgctgcagtcacagggcctgggaccttgcaaagggatcagaacaaacacagagaggacatgggtgaagtcaaaagcccaaacacacaaaagcaaagcagaaacagctgtccgtagacagccggcagattctgagaactggagctgacccgagtccctctcccccagcatgtcatctctgccaagccaaatgcatcagaaacctccatgcatcctacactgtgtcctaaatatacagtcaatggctttcccagagctttccaccagatgttatctgggtcctggggtaaagaaaaccatttacacatttctttgtatttgtacagggaccacctggaccccctggaccaaaaggacagcaagtaagttggttttggggggtgaggatgagggaagggggtacttaggtgtttgtgggtttgtttgttttttaccataaaacttcttggttggcaactatttattgtttatattatgatgaaaacagttttggaggtttttaagacttaatgttaaactccaaggatagatccatggtgcctctggacattaaaaaagtaaacaggtggaatgatttgttgtttgcaaattaattaccacatgcctgttggtatatgaaaaccacactgaggaacatttgattgaaacgaagattagaacaatttagggacagttcacatttattcacatgcattgatttacgagaatggacaaaatgtaactctatctgttgtagggaggccaatgtcattcttcttatctggctagaattaggttctacaggagtctaatgtcagcctctagggatatattcagtgataatcaagttaggctagagcccaaagctgtatactgttttcatcccagaaaggttattaagttgattggaacacagcaaagtaggtggtttgttagaaactcggaggacagaactagggttccttattatctgagaaagctggataaatgtccaagacaaacgaatgcagttgacaagggaagtatttgatcaaaatgcaacataattcagaaatgctgggctgccagcgggaagcatctaggaacgtttcctttgccctgtgtcccgatggaggacgtgccaagcccacacgttgccatgcctgcccattgctgtgacccctggtgactacagctgccaccgcccatgcccccaggctcctgtcccctctgacacagcttccggttggctggagggcttgcgctggacgccccaccgcctggcagcctggagcaggatgagatgggccccaggccaagagcagcagaaataggaccaggcggccgggctgaggaggcagcagccaagccctgagcccaggcgtgagcctcagatctccccttgctgcggcaaacatcaacagccctcctcacccctgaccaagtcacttcctggtgactttgacgaccagctcaggaggcagagagggactgtgggggactcacacaaattgcattctaatccagcctggccgcgtttctgtgctttgatttcagctccccaccaggtggggaagaagcaaaaggcaaaaattcattgaaggctttgtttttattttcagaaaatatctggacattggagggggcggacggtagactgcagagaaagagagatcagatagggcttatgtgaccccgctgtcactgtgggaacacacagaaaccctgggaaagaagcaaagctgttgggagtagaagaggacagtgcccgtgatgtgcacaaatttgtcatcttgctttttctatgcacgaatcttagaggtcagcgttgtcagtcctcccacacgtggctactacgttcgtgaaattattaaatccttactatgatactgggcctagctttgcttcttaggtaaaaaaggaagacaaaaagtttggataaagcccagagaatcacgtaaaatcattacattctgattgattttaaatttccaaagattattaaaaagataggtaaagtttatatgaaatgaggattattttgccaaaatgagagaagactgagccagaagaaaagacgaatcatgatcttcaaatgcagagtccagggagtgaaatggggctgcttcttccatctgcaggggccagaacccagggacatgctcttagactacagtctgcagagaccatatactcacgatcgagggccagcaccacctggggtccaatctcagctcccactcattcactctgaggccttggtcaactgacatgacaaactgtcaattagtttctacaatgcaaagcaagaatattatgcaaatatagttgctcagtaaagttgccgataaataggccttgggtttctttttctaagaaaaataattttatttctctctgattattggctttttaaaacttacagaaattatttatcttttcagggcaacagaggacttggtttctacggagttaagggtgaaaaggtaaaggaagcctggtcaattccagcagaggcatgcagcatttctcagccaggaaataaatcattttaattactaagttctgtgctgtaaaacttttaccttgagttgatctgcagacagaccatttgcatagggaaataatcattgcaaagtgctaggttgtcacctacataccagtgataattctgcatcaacaagacggtaaacatagaccatctaggctagccgagactctgacacagagacataagctcagctcatcttcagaaggtggaggtgaggacatgtcactgagtgcatcttctcctgtgtggagcccagaggtgatggaggggactgagactacagccagaggctgacatggagccatctcagggaccaggggatctcagggaccagccctggtagggcacaaaggcagccgtaaggaccatgtggcttttctccttccttagagtgctaagatccaaagacctcatggcctttgagaggaacgtgtgagatcacgtgcatgacaggcttaacgcagcgccacaccccgcaagcaaaacctcaccaacacagtcccattgcgttcaccacaaaagccatgagcccactgtaaagtagacctgacccttggcctcatgattggaacatttctattttgttttcccttctgctttttgatggaacagcacagtaagttgaatcaagtcctgctcatgtgtgaagaagaaactcttccttctttacattaatgccatagaagaagtcaaaaaaggacaattagcaagcagtgggcttctgggaaaaaaaagaaagaaaaacattgaagatccaaacacataaaaatttatagccccatacaatgaaatataacaaaataataaaaacaagaaaaatctgggaagaaatcattggtgggagaagagaatagtcccgttagatataatggagatgaagttagagtctacagtctacaaaggacttatgcaaataatgaataaaaaacatcaggggcccaacaggtacaagggaggagaacaaacagtttgggtattttaagatattctattagtggacactcagcgtacactatggagtatcactttctgcagctgacccatcatctccatttactgctgtccgtgttatgtgatatctgggctcagacttgtatgatacagtttaatgtggaaagaaaggaaaagacaatgatgttcttttgtgtcaatcagtttctgggaggtaaacccagaatattatgcaaggataacggtccagtaatgttctagatagatcggtttcaccatctgtgcaccacatcaaaaagtgttttctgctaatgataaaaatgcaaattaaagcaatcttgggatattatagttacttaagattttttttattatataaaaacatctttagctggggaagtagtctttcatttcttcagcatttcgtttatctcggtgcccatcttggcaaccagtagagtaatacctgtcaaaaaccataaagacattcagccctcatacctaataattcccatatatagaaattcattgtaaggaaacaaccccacagaaacaaatgcagtccagaattgtaaacaacctacatggcttttatgcataaattctaaatgattgctaatgaaaggaggatataaaaaacttacattaggattactctattttgtggttattatactgtaaataggtatacatatggtaagtaatatgcaaacattaaaactgcagtattttggccaggttgtatttgtattcgagttttgtagtttcctttcgatttaaagacaactgcttttgcttaacaatatgcagggtgacgtagggcagccgggacccaacgggattccatcagacaccctccaccccatcatcgcgcccacaggagtcaccttccacccagatcagtacaaggtaaagagcaaaattgactcttttcatagttgaaataaaaaaaggagagtaaaagtacatttcttcaattgtattcaaccacattccaagtagaaaaagcctcaccaccaacttggcacattacccatgaaaacataaccgggtcctcccagaatgttttcaactcttccagacggttactagattcacagtgcgatcccgtcgtcagtccatcatctcaattctgatgaatctgaagcaacaagagaattcatttaaaaaaaaacttatatctatccttacattcagtgtaggtggaggctaatggtcataccgtaattcaaagccagaatcatggaactgtctagcaaaatgtgttcagcaaaataaaacctacttctttgctgacatgaagcacctttttggaggttcaaagtcagtttttgacagtttctgaatcattcaattaacattttgcttaattgaaatcatgctcttagtctgaaataggaattgccgcgtccactctctctacgtttggaggctgctgtgccacccacccactcggaggtcccacagcctttctagggcttcctgttccccctgtcaaatggggatggcgacactgacctcctggagctgacgaggaggttgcaggcgactgtgaaacactcagtaccatgtcgggcacgcagaatatctgggaactaaaatagaaaccccaaacggggagatcttaactttccaaatagaatctggttcccaactcttgagcagggtggggcttgggtcctgtgtcctgggtcctgcatcctggggcggatttggcaggcaggaccactgccttgtgggggaaatcaacccaggtggctgaggctcgagttatgagtgaccgttgacaaaaatgtcctgggagacggcagggagggcctctgtccagcttctggactggagcccagagcaggtttgatccacgtggaggtgctcaatcttccgagtcaagtttcccaccttttctacaacccaggccagggtgggatccggggctgggaatggccaacccgcaggggcagttgtgtcctgcaggaatccaaggtaccctcagaaatgacggggacaaaggacccgccaattgctgtttctttcaccattttagacgaagagaaatgggaaaaacgtagatcatgtttttgatctatgatattgacatggctttcaacagccacttttgcttcaagtttcaatatgttccatgtgtatctttttctcagagggcctcctagtaatgttttcttccgaagagtattttcattaaggcttttccttgggcacgttctcccaccatacggatgtaaacatctgcctggaacggtgtgggggataaaggaaaacagagagaaggaaagacagactttcacttgtaccaagaggaatacaggaattaatttatcttgtgaaaatctagaagaaatgacacctcttttctcttgaattttgaagctgcaaaatttaagagtcatgtgttgtaatcaatttatgatgattgtgtgaggattgattcagtactttcagctcatgtcatgaaccctgattgatttttacccattaccatcctcaaattaataagcgtttcttatttttcatattcttcacagggtgaaaaaggcagtgagggggaaccaggaataagagtaagtcgagtaatgagcatgccccctcccctgtggctcctgggctgtcggcgctctgccaggcatgacggggtgcaccatgcgctcggggcccgcacaccgccagtctctcatccccttgtccatagcagaacagtattagcatgcatttttacactgtattttaagaagtcagttctagaatttcttcctcttggcatcataaacactggctaatcatcttctgaggtttgggaagggagcatggagatggcggaggggcgtggcttccactcaggcgccaccgggttctgccctccgtcccctctgtcactgcctgtcctcagagctccagctctccctcgcggtcgcttaccacgtgacatgacacatgcagtcctggatgggtgacagcccgggaaggctggcgggtctcctaggaccgtgccctgcactgcgcctgagttgagcatcgccaggcggtctggacaccatcggggctgagaacacagagtcctggagcagaggatgacacgtgggccctgttggctggaggggccgcccctgggttgctccttacgccccctctgctctctcctagggcatttccttgaagggagaagaaggaatcatgggctttcctggactgagggtaaaccacgccttttataactgcagttgtcggtttggtttggtttttttcagtaggctttcctttttagagctgtttcagattcacagcaaaatttagcagaaagtatagagatttcccgttattactccccacccccccccacacacacacacagcagccccccagcacgaacatctagcactgggggctgcgctggctacaatccgtgaaccatcttgacacaccgtcttcacccagcagcaggtgtgcagacgcggccctccccgtggaggaggcgcgagtaccgcacaaaacctttctggttgtgtgtgttcagctcagttagtctgtagtaaccagaaatgtagaatatctcaaacacacattgatttccgactgtcccaagagcccaacaaaaatgtccctagtcgtaagggtcgggaaggggtcaccgtccacggtgattcagccacctgggagacagacctcaccttcagagccccagcctggactgaccccactcactccacgaccacacctagctgagggctgggacgggtggtcagagccctgggcccaggaagagaaagcagaattttggtggctatctggcagttgctaccactcaaaagaccgtattttacattctccaaaaataagaatagagagacacagtagaacattagagtacaagcctttttacatttttagtttttcattgtactatctttgtgagtttctctgtatttctttacgtggtagaaatgatgcacgttatgaaagtattgctaaaatgatgtgtctccctcaggaaatgagagtcttggggtggctctgacgtcttccacagggaagcagctttgagattaggatggattctgctttcttcgagcctttttatcatagtcattatttcccatccccacctccccacaactttgtaaaggggaaagaattgtattaatagttggtattgaatttggcaatttgttgctattcttcaaaatctggacctgagacttgttcaatctgtccatcggcattttgctgtgatcacagccaggtgccgtagtcaagccctctggaaatgtctactgcatattctgagctgtttgcttctgttttttgttcattccagggttaccctggcttgagtggtgaaaaaggatcaccaggacagaaggtaagttggatgcatgaactgcagtctgctctgggcccacgacatcccacagaggttaaataaataggccttggcatctcaggaaagaaaattgtctccagaaaaaaacattgaaaatggttcttgtatttgcagtcacaaagataatcctgcctcacaatacttgaaccgggtcattaccttggctctcatttttgcaaactatcttttgcttcctccctttcaaagtgtccgtcactcgaccccaccagccatggtttctatatcgtccaacctcacacccctcctccatgtccttgtcactcataggaagctcctggacttggtgacccagggtccacctaaatttttttatagattgacccatactgtgacacttcatttatgtttaatgacaacccaattatttttatcatgagttctgtggacagatttttggcttttttttaggagaaaaatgttatgtaagaaatgtattatgggccaggtgcagtggctcatgcctgtaatcccaggactttgggaggcctgaggagggtggatcacctgaggtcaggagtatgaggccagcctgaccaacatggtgaaaccctgtctctactaaaaatacaaaatttgccaggcatggtgtgggtacctgtaatcccagctactcaggaggctgaggcaggagaatcacttgaacctgggaggcagaggctacagtgagccgagatcgcgccattgcactccagcctgggcaacaagagtgaaactccatcataaaataataataataatgataaaatttttaaaaagaaatgtattatgaatctaggtcagatttagaaccgtctgaactctaggtcatacacaatgttatagttcagtggttgatgccttttcactgttcactgtgcctgcgggtcccaccccacagcacacagcacacgcctcctacggcaggcccggcaggctccccagacaccaccactgacagccccttgggtctcacatcacactcatgccaacatacacacaaagacgtgtagcttcacatgcatgtaacggagcaacaaaagaaatgtgtctgtgctgctctgcccagtgccccttagagaatgttccaagtcggcaggtacacatctgcctcgttctttaaagctgcagagaatggcagtcaataggtgcgccatatttccttacgccctcgaggtggttttcatatttccagcaaacatgcagtcacctcggtggtacacagggcttggctgcctgcccatgggctagtatgtccatcactcagtcctagtaggtgcacagagatagagttttatcaaaatcactagcctcagaatcacaactccgttgaatcctgctcagggctgcacagagagtagtgtggcgtctggaggcccatgggcttcagttagctggtacagaagctcggcaggcctggtgggggttccgccatgcttgttccaggaccacagatggacctgcctcccagactcgctttctgacctccactggctctagacacgggccgtcttgacccagcattctgcttttgaccattcaaacttaacaccaatcttgatgacttcctgcaacctccaatgatcatactgttcccatttctgttattttatgctaaactcagcccagggagccaatgccaggctttgccgtaatcacacccagcctttcataacatcagttactgatcggagtactcccaaaggcggcacacctagaacaagagctatccaaatgcaccccacccagaggccacattctagttcatggcttaggaaaagcaaatattgtaaagggacagaggctaaagcagacattatcgttcaaaagtaacccgtttccacctaccccatgtgattaaagtgctgctgttaatttcctaccatgtgctggtaaaattataattatctttagttttccatcttcaacacaagggacttgtagtatttaaaagtgcatttccaggtgcctgtaatcccagcagtttgggaggccaaggtgagtggatcatagaggtcaggagttcaagaccaacctggccaacatggtgaaaccctgtctctactaaaaatacaaaaaaaaaaaaaattacctgggtgtggttcatgcctataattccagctactcaggaggctgaggcacgagaattgcttgaacctgggaggcagaggttgcagtgagccaagatcgcaccactgcactccagcctgggagagacagtgagactctctgtctcaaaaaaaaaaaaaaaaaaaaaaaaaaaagggcagttccacagagctgctccctggaactccaaagttaatgaaagacaagatgctgtgtaaacagtggccacctggcagctccagggctggggcccagatgtgaggatggtgaggcgtcaggctttcatttcccagcttactttctgcagttgcaacaacttgcgaagatgcagatatttccagttaagtgggttacagggaggcagtttactcaactatagaaatgggaaataggcagacatacacaaatgacgcagccgccgtgcttgtgagcaccgatctgcaccacagctatgtccgccctctgccatcccactggccaggtggccatcactccatgactttcatttgttccccacccaacacctccccctagacaccaaaagcccctccaaggagcaactgctcggtgacataaacagtgcatcaaaatgggaggaaccagaaaagaaaagatatcctgggtaggaacttgccctcctctacataaacacagaattggttgcctgtcatccccactgagattgtcagaacttctattagttccagccttttctaaaaaggaatggagacgtagcatttatgaatttggttatattcaattttctgataaattagagatggtttcgtctcctctttctaggggaaacatatctttagtaactgagcaaatgctgtccacagtgttattttataattttgaaataactccacagagttattttataattttgaaataactccacagagttattttaaaaagtgttcgttgagacctagtctcctttgaggaatacatgccacaccaacacgcgtcgtgttgtgggaagtcccccctcaataggaccattgtcctctatgaggactgtccaggacttcagggatgttgcatttgcacaggctgcagtgtcgatgacttggactcaccagatgcagcctcagtgttccctgtggctgtgtgtaggtttcctctgcaaagcttgaagtggcagacatgacctcagattgagttcttttatggaactctcactgtctttagtcttttatactaaatcgcatctcatttgcaggctggcagggtttctttgcagaggcgcctctttcaagaggcacatgcgttctatttagcctaacaggtgctccctcggccactgcaatgaaaagggtacaacaggcaaatgaagaacagaaagataacaggccagttcacaccacgagagacagcagactgcttttaagctttagaaacatgcatctccctaaaaaagcctagccatacattcttttcatctgtttgtgtcagctagtccctgaggacttctgcccaaggactttccttactccagttatttccacccttgaaaaacataaaatcaaccttgtacttctaaaattgcataatcagaacttcctatgaatcatatatatgacctcactgaattcaaatgagtgataagttattagatttgggggagggccggggagaaaggaggttgcagtttcaaagcccttcacagttatccattctaaaatagtgatctgcatgtcagtctcctgacctcagctttccctaagggtgggctctgtggtgagcttgctagcaggagtacagaccttgcctggaagcggggtctcagggagcccggcggagcctccactgggtccttcccggggtggttgccagcctgactctgggagcgcctgggtgattcctccttggccatccctgcgcctccccgaccctgttgtgtttgccactgagaaacagagaggaaaaagttttgatcgtcattttgacttagggttcccgcctatctgggtttcactgccagtggtctcagatgaaccctgagggtgcattttctccttaagtcgtgcataaccctcagcctcccccgagtcagttgacctgttgacctgccgctgggaactcccctggaaagttttagctcattgctttggctcttggggttccagctgcctcagaggaatcctgagtgcttcttaagttgtcccccttccccaatgggttttctataatgcccagtgcatttcagatggttcaaagtgcccatgctgtcttggacccttcagcagagatggcaacacgtggtgtctggggtgcttgttttgtttgctgaggatgccacagcataggtgtgtgatgctcgtggcccagagtgaagctcagatttgacaaattccagggcaccctctgagctggccagtctgtggctgtgctcacagctcccactgagtgtccagctgccagctcctgtcatgccaggtacttgaggattcctagcttagcttatgacgtggcctctaaacaggacctcatttttaaaatcacagaagtttgtctttacttttgagtcttcagctccacctagcgtgagagaaagtccgggtccaaaccacaggaccacaacaacacacacaaagtgaagcccgtctcaattcagtctaaacaacatgactttcagcacacctgctcctgggtgtcaagataacctcgaaagtaatcagagaatggacctttcttatacctgtggcatctggcattctgaattttgagagctgaaccatgcatgttctttaaaagagggaatacattgctagatttttagagagctttactcttctgtccagatacctcatgatatgactcaatgataaactttttctttcaaaaaatgttcaagggaatgagaaaacaaaacttagtgttatagttgttttctatttttgaaacagggtcttgctgtgttgcccaggctggagtatggtggtaccatcacagctcactgcaacctcaaactcctgggttcaagcgatcctcccacctcagcctcccaagtagctgggactgcaggtgcctgccaccatgcccggttacattatgtattttttgtagaggcagggtttcactatgtttcccaagctggtctcagacttctgggctcaagtgatcctcccaccttggcttcccgaagtgctgggattacaggcatgagccaccatacccagcagagattttttttaatgaagagaaaaaactctaacttaagaaaccttaatgcgtctattttggtactaaatgaagattttcaaaacctaccctgggagagagtttcaacagttggttcaggttgtcaacacctgaccccacgatcaatcataaaagcaacccgacactcatatcttctgtaggagaagaggtgcccagcatcctccgcaaatgatccctgctgaaaaggggaacctgcacctagggcagcctccagccctaatgactcacgtggaggaaacgtggggttagaagaacagattgtacaacaccacgggggtgagactgactgcagcccaccacaaagaacatctgcagcacagatgacccagtgtcttcaacaaccacaaaatgatactaaaaacatagaaaggaagaagggactattgtgaattaagtgagaattcagaggcatagcatccaagtgttatatttggacttttttggctcctggttctagcaaagcaaccttaaaaagacatttttgagacccaagtcagggaaaattgagcacagactgggttaatacatgactttaataaactgttgttcattttgtgagatataataatgccattgcagtccctttttggagttatacatcagagacaaaaattaaaagcaaatatctttcttgcagggaagccgaggcctggatggctatcaagggcctgatggaccccggggacccaaggtgagcccgtttctcatgtctttgccacttatggtgtctcgcccaccctggctggccttactcccctcttgatggtgtcctgtggaggcatcccctgccctaaaaagtacaagatccccaaatacacggcctctgacactggacagacgaggtggatggtgacctacgagccacgtgtgctccctgccagggagaagggtgccacctgccactcagggccacgtaggggtgcgctcaggcacagaggaagccagcagccctggggaaggcaggccttgtagtaacaagagggtgcggtgcccctggtttccaagggaggatgtggcttgtgtgagtaattcctgggcttgcagggaggggagaccattaggtggaagaccaggtgggtgctgctggtctagctgagaggggaacgcacccgtggggaacctgggtgggggcacatctggagaggacttctgagccgggtgaggctcaaagaggtgaaggtggtgcgcgggatgctgccttatgacaaatgctgccttacgacacagatggcgctccacgggggtcctgcggccgcatcatctcccagcccaccctcgccaggcggctcggctatcactacccaaaatgtaatagtctgaactacagaaagcacagtctcctggcattcgacaaggatttcaaaatgagatgagcccctgcctgtcttgttctctttgggcacctgtggctggtggctgggatgccaggctctgccaccctagcatggggatgctgccccaggcactgtctgtggttccactggttgaaatagctgctctgccagcctgacggtccacgctcgggtttcttctttggaaatatgtgtactgtcaaaaactccaaaaggctattctcacatcctgtttttctcttttctttctctagggagaagccggagacccagggccccctggactacctgcctactcccctcacccttccctagcaaaaggtgtgtgaacaatttcacctgcatagttcagcatcgcatacacattctctcctgttagggacacagagctatgaactttcaagacagatattctaagcaaccctaaaacttaaagtataataataataaaaaaaataaaaaataaaccacgaaatttagaacataacttcatgtacaatttccctcatgcttaaatgtgtcacagggagaccttcatgttgcctgtgcctgagacagtcctcaccacctacacgtgagaaatcccctccgttggggaattctttcacttctgcttaacttgtagagttctagttctgccgtctggactatcgctgaagatatccagggcagcagccccagccgccttcggattttttctccaaatgcaccaaggttcttaagccctctgcttgccagcccgacacctggaattgatcataactcataaccagtgaacagtcacatgctttcaggcttcaaggcaactaaattcccagatatttacacataacaaccactccccactgtcacagttgaccttggagtgtaaacgaaggactttgcgcatgtcgtcactaatgctcatcttgttattaaggctcggcttccaaattggcgagatcatatggaaatctgatcctagtcctgcaactagagcacttggctctgaaccttgtagaatgcgcatccttctaggttaaaaaaaaaatgtttcgagaacctcctcctgataatcgtgcgtatatatctttgcggatcattggcccatgttatagtcagctctgtgaggacagacatttcagcccatcttgttcactgctgtattcccaatgcctggaacaggacaggcacagagttggagctcagcaaacgcctgactgagtgacgacgtgcagaaacatatcagacaggcattgtgaagggtagggttttttaaatacagacgctctggtgtttacctcttgaactcagcaggtcacctggtctccctgtcctctaagcctaggtgtcaagaattcacctccctgcttcgaagcgagccctctgtcagtttaataatggctttgcatgtcttcatccaatgctgatcaaaacgcaggacagaacagggccatgggcagtgcctccaggagcccctgagatgtctgtctggggaggcgtggagccgtgaatggggatattttgaaatccatgctcagcttccatgatgcccgtaactacgaagctggcatttcctgcctcatccatggcgcacacctggctaccaaacctgagacccactaaaaagagccatgagcccactttgacttgactcattattaataattttggtaaaaaggaaatatgctgtttgagattttaagaacataatttttaagttaatgctggcgatgtttcttttgcattttttaaaaatgttgctgactgagaacccaactctcaccaacccctcccttctcaccgtactatattcctggaattcacactgcaaaggcgggtgctttcaaaattcactttttcccacaagcggattcagaaatgcggaggttgcctgccgccttttctaccggacaacattcccgagttattggtgagctggaatgtgactgacttgcattccagggtttcttaaagtcaaaggttgactaaccagcagattccctcagggaaaagaggcagtaaatgtatctttttcaaggtaacattgcatgaacttgtcaaaagacaaaaaggatagaggggtttgtattaaaagaaatgattccaaggtacctagaaataaaagtaatcttgctattcttccaaacaagtgagaaggtctgtggctttcaattttgtgtctttttatggaatcaacaatggctaacaggagtgtaggtcacactgtgtgccaggcgatgctccaagttgtcctagttgtacttttcagtgtgtttacccctctgggtgaccctgtgaggtggagatggacttggctgcttttactgagggagagatggaagcgcagggcgttgagttccttgcccagggttgcctttaagtggaggagccaggttcaggcccagggcctctggctgcggagcgcagccccctgcacactcggcacgaagctgcccgagcaggagacgccatacacggaagtcaggccttctgtcccttgcacgtgggacttcagtgtgacgcccagcaaagccctctccttattttaaggaacttcgtaagacgacatgcagagtgaaagctttcctagaaattcctaatgcctacatgataaaaagtcctattttcttctcattcttctcatctttcccaattatagtctagaaaaaagtgtgttctacagtaaagcgttgctatttacacagcaaaggaacatagccatgccactttgtctttgtttgttcaggggtgaaagtttttaaaagccaaattttgttatgcatccagcagacagggatgagaagagcctaatagggttaaagctggggctgaggggcagagtggggtgcagggaagtgaggcctcctcgctcccaggccaccagcagaattggcaaccacattagttccttctttattcgagctttggactcacctacttcctcacccggttttcactaatcctgttcccctgctggagaatgagccccttaaaaagagagaccaccccatgtattaatcatcttaactcctcatcaggccgcatacagcatatggagcatttggtaaatatgtagtcaatgaaaaagtgaacgccagctgcgatccgtagaccacggtcttgttcttactgtgggacttgtttcccttccaggtgccagaggtgacccgggattcccaggggcccaaggggagccaggaagccagggtgagccaggagacccgggcctcccaggtccccctggcctctccatcggagatggaggtaatgtggcttcataatatcaacaccggagacccaaagcacctgcactcaggtcctagcacacacaagggagacttcgttgacgacgtagctatgtcgttgttacttttccccactgactagtcttagcagctctaaggagccccgcacacatgctttggacaccttcacagaaccctcgcacatatgacagtaactccccaactaggttagatggtgccacgatgggtaactggcatgcttccacctgtgggttgggaagagaacggagaatcatcaggtgttgttgcccagtgttgatcacaactatcaagccattatttgaggggcaaggagaggggtgtttttaatgttgaaaaaggataatgaactataccaatggcttctacccatcggagttattgacggggccatgaagcccgctagtgccccagtgggcccctctggacacgaacacaaaggcagcggtgtggtatgggagactcacgctgcaggtgaatgctgtttggtttcagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggtgagtggagggaaacaaaagggagggtgtagcctaatgttcagatgaagcccggtcccagccggatgttatttgggattctctgctaaatgactctgggaacgaatccagtaggccagtgattagggtgcagtggatccaggtagattagggtgtagtgggtgctctctggggtccacgcaggagctggggatggaagctgaagccctgtaagcctgtgagtatcacagccccgtggatgccacacagtgaggtttagttgctgcagcttcggtgaaatccatccttcagcgaaacatctgagctgcgcagtctggaaacagatgtgagctgacattgctgcctctgtgtcggggtgatacattccacaaacctaatccagggtgagggctcacccttgactggcagcctctctcctgtgttactccatcacgtttaagccaccttgataatctgccttctcagcccgtgcacagccaaagctacaactgaacaggtgagagtagctggtgacaaaaagagatggctgcattatctgcaaaaataagtgacagccgtcccccaaggcccagacaaatgcccatgaaagtcaataaagccggcaggcacaggagtgtggacccacctgccacccagtagtgcatccctgagtcagcaaagatgctctttcaggttataacgttaggtgactcaacttgagttgagaatgacctgtctcaggcagcagggaaacatgcagtcccgcctggagcttgctgtcagaaaaggctgttctttcagcttcagcattcagagagttatgctttaaagaccaagcttgtccaacccacgggccacatgcggcccaggacggcttcaaatacagcccaacaaaattcataagctttttaaaaacatttttacaattttttgtagctaatcagctgtattagttcgttctcacgctgctataagaacatacccaagactgggtaacttattaaaggaaagaggtttaattgactcacagttctgcagggcttgggaggcctcgggaaatttacaatcatggcagaaggggaagcaaacatgtccttcttcgtggcatcaggaaggagaagtaaggagtgaagaggggaaaagccccttataaaactatcagatctcatgagaaactcactcactatcgtgagaacagcatggtggaaactgcctccatgattccattacctcctgtgaaccaggtccccaccatgacatctggggattatgggaactacaactcaagatgagatttcagtggggacacaaaacctaaccgtatcaccagctaacattagtgttagtgtattttatgtgtggcccaagacaattcttcttccaatgtggcccagagaaggcaaaaaattggacactcctgctttcgatgttgtgaaatgcctaataggaatatttcattctctcacaagagtgaatataggagacattgggagaaaataagaggtcatagtctctttctgtgtgacgttgaccaaaagttaacagcctcttctttccaaagtagtttactttaaattccctgacattgcccctaataatctcttacagcctcctaccttcggggaggaaaaacaccatgtttgctagtggacagtgtttggtttcagtaacaggtcaaagtctctgttttgtttgtttgtttgtttgtttgtttgttttgagacggagtctcgcctgtcacccaggctggagtgcagtggcatgacctcggctcactgcacgctccgcctcccgggttcgttccattctcctgcctcagcctcccgagtagctgggacccaggcgcccgccaccgcgcagctgggaccacaggcgcccgccctcacgcccggctaattttttgtatttttaatagagacggggtttcaccatgttatccaggatggtctcgatctcctgacctcatgatccgcccgcctcggtctcccaaagtgctgggattacaggcatgagccaacgcgcccggcccaaagtctctgttttaattgtttgtttttggaagattacttctctttgacatatctagaaggaaaatcattagagttattagaggcaatgtcttctatttaaaaggtagtagtcacttctctgtgtctgttttatattataaagtaaaattttaacttaatatgctttctactttctcaatttttcttcaattagaaaacccacatattctcacattattctgaaaatttttaggtgcagatatttccctggatcatgaacctgccaaagagtctgagcagtgtgaactttatttttttattttattttattttattttgagacagggtctcgctctgtatcccaggctggagtgcagtggtatgatctctgctcactgcaacctccacctcgtgggatcaagcgatcttcccacctcagcctcttgagcagctgggattacaggcatgcaccaccaccatgcctggctaattttgtaattttggtagagacgggggtttcactatgttgcccaggctggtcttgaactcctgagctcaggtgatctgcccacctcggcctcccagagtgctgggattacaggtatgaatcaccacacctggcctttaatttttttcattatcctggactgctgtgataagagctaggtttctatgagcattatatttcctaagcaaatggtatcttttgagttttctttttctggagcagaacatgacatgttaaaaacaaaagcatacaaatattccactttaacggccaggcatggtggctcacacctgtaatcccagcgctttgggaaagccgaggggggccgatcacctgaggtcgggagttcgagaccagcctgaccaacatggtgaaaccccatctctaccaaaaatacaaaattagccaagtgcggtggtgcatgcctgtaatcccagttactcgggaggctgaggcaggagaatcacttgaatccgggaggcggaggttgcagtgagccaagaccgcacctttgcactccagcctggggaacaagagcaaaactccatctcaatttaaaaaaaggaaaaaaaaatccactttaaagaacggtgatcaaaggctaacgttgccattattcctgtaactaaattccattttgataaagtcacagcatatgccatcttgcttttcaagtcttgcttagtaaatccgtggtttactagcataagtcaactgcgaacaatttaatttctgatctgtagtgtgggctgatgaggaaagtaataaaatgaatggcatcagatcaatgttagcagctaaaaatgttaaaagcatacaacttaagtcctctaattatatatattacccctgtgagacacatggtttccaaatcaacatttttaaagcaagttcttatgcaaaaagtagtccaccataatggcctttagaaaatgtgtgtgtggttgtagtttagtaggaatgaccttgattcccatggagttctctgacttttcccctggaatgaaattgttagattcctctcttgttaactacatttcatcctgttttataggttgctactgatgaaaaccagagtttttagtcttttgcagctccagtaaaatcaaaccacgaagacagttttctttctgggtgaaatattttgcttccccctgttctagttcagttagctgaattgagttctgggaagttctgttccacgtagaaaaagtcaaaataggcctggcttgtttggccaggggctctttgtggaaatcatgttgcaaacatctaagaggcacactgctattctataggacttatttaaaatgactaatatattagagaaaaggagagcagcagggggcagaggaaggctgtcaccctcagagagccactgtgtgcctttaggactaaatttgcaaagcatccagtgcttccattgtaaggagcgcccacaatctctttgtcctgaatgaatgacgtgtctcagattgacaatggtgacatctctgaagtgtgtgtggttaaatttctctctacctgcgacactgcacgtctcatcacacagagggagagcttggagacagagaacaaagctcacaaaagtccacaactgaccggacacgcagctgacctggtcaccggtcaccctttgtccccagcagtgcggggtgcggccgcctctcctcctgagacgctgtcttctcccctccactcccgggaaatcccactggcccccgacatctctcccctgaagtccctgcccctccctgcactccccgccggatgaactcgtcctccacatgaaagtacatgcagtgtgtgctggtcactcgctcgtttcctctctggccctgttctgtgtgctgagctactaacagaaaccgttaactcgacacagagtcaaccctatgcacgtgtctcacaaatgcctcaagctctccatgtccaaaatggagctctgggcctcctccgtccccaccccctgccaccccacagacctctcccttggtcctcaccctcctgcacaaacccgggagctccagcagagccctgggctactctgcctacctcacccattctgtactggctccctcacaatcctggcgggtcctccactccagtgctgtgtgtgcccttgctatccaccaccaccgcccgcgtagcctgctaggatggcacccgttgttccttccctctccagcctgtcgtccacacggcagactcacatggcagaccgcgtagcctccctccttgatgccctttaatggcttcctactgccctcggggtaaaagccaagtccggtttcttcccctccctttgtgcaaatctgcccttcactcaccactctgcgggcgctggccttctgcctatttcagggccttttagaaaccctgtcctcactctggagcattccctcccgctccccacttcaggggctcctttttattctttgggctttaattgaagcatcacttcctcagaaaggactcagctgactacccccaaaacatttcactgggcctctccctgctgcttttcccctgttccccagcacgggccataatttgaaaatccgcattagtgtgtttcctgcattgtgtgtttaatgtgtgtctccacgtctaagctgtaagctccatgagagtccatcggtttcatttccagttgtatacacacagcacctcgcacacagcctggcacagcataggcacgggataagtgtttgatgagcgaatgaatgaatgagctatggtaaacgtgcagtgagcaaactacatgggacggtatccatgtcctcattctcatagacatttatcctcacctggcagttctctgacttgcaaactcccgtgctcttttccaagcagatagctgggttctttaaagttggagttttctcaccttcctgtgtgtaacggcctcatcccctgctcctctcaggttccatgtagtgtgtatagcaacatgccttttaatttgctgggggagtgccatttgcccattggagctctggccctattatttaacagtgaggaggacagatagctgcagggcacacctgcagagcctgcccccagcagcagcttgtgtgtcttgcagacacacaccctcctcctgccacgagatggcactcttcttctccagtgcgatggcgcgctctttgctggtgtgaagagcaccgtgtttcttgcaccgtcatcatcagggatgcccccgccgggatcattgagccctgcaggagctagtggggagaggtttacaaggggaaggtggtgggcgaggtcatccaacatggctgaccatgctgaatccagattggccacaacatttaattagcataacagttatcctaactccgtgtgtgtgcatgtaaggcatgaaagaggaaacagtgttctggagggatgcacacgtgtgcccccattcccatatcagaaaaagatcaaaatgggaaactgagttcatcttttttttagttttttgggggggaaccagaagtgtgtagcagtcttggaatccaagttacatgatcaaaaaatcaaaacttttctttggactcaatgtttctcaaaaggaataattgttatccctatagtttaatggaaaaactaaatttgcagactcttatatttctttccaaccctgaaggctatcgccacaaaatagtctaagttttcttttgaaaaaatgtgcttttgtttatgaaattgggtttatggatcatttggggaggcttggctgaaagccaccctgggctgggtgggacaccaggcgtctctgtggtgcccatgccctgtgtctggggggaccctgggcatccttgatgctggtgcctcacaactgggtgggatgccgggcacccatggtgccgatgccctgcgtctgcgtggaaccccaggcgtccgtggggctgatgccctgcgtctgcgtgggaccccaggcgtccgtggggctgatgccgtgcgtctgcgtgggaccccaggcgtccgtggggctgatgccctgcgtctgcgtgggaccccaggcgtccgtggggctcatgccctgcgtctgcgtgggaccccaggcgtccgtggggctgatgccctgcgtctgcgtgggaccccaggcgtccgtggggctgatgccctgcgtctgcgtgggaccccaggcgtccgtggggctgatgccgtgcatctgcgtgggaccccaggcgtcgtggggctgatgccgtgcgtctgcgtgggaccccaggcgtccgtggggctgatgccctgcgtctgcgtgggaccccaggcgtccgtggggctgatgccctgcgtctgcgtgggaccccaggcgtccgtggggctgatgccctgcgtctgcgtgggaccccaggcgtccgtggggctcatgccctgcatctgtggttgtctctctaggcttcctgtttgggctgaaaggagcaaaaggaagagcaggcttccctgggcttcccggctcccctggagcccgcggaccaaaggggtggaaaggtaagaacatctgggagggacgggatgaggacagcctggcctttccaagtccctcaccttacagaaggtgaaatccatcccccactcacgtgtttggacatgaaaatgagcctgcatgtctctcccagcctcctgtccccttggcggtggcactgagagggaggcgcatggagccagtggtgctgtctgagcactcggcccccaggctcaccgtccctgctctccatctgccatcctcgtcactgaccttcctagcagcagtgagcctgatgctgagtcctgtgctgggttaaaagggaaaacagttatttcttaggctgcactcaggtagtgtctcaagggctcagctccaaggcattgtaacagaggtctgtagagagctctgtccatagcaaggtgctggtatagtcaccatccctggtcctactgagactcggtagagtgacgtggtttgcccgggtctcccttcccgttgatgaggaggcgaacttggaacaggtggtctttgcacctgaccctttccagtcacctcagggactctgcccctagctcgaggccgtcctctgtgaggctctgtgggccctggtgtggtgcaggctgtgctcctgctcacctctcccctcccagaacatggggagcacttcctgggacttaccacgtcttggccgttttggcgtatgtaggatgtgcagtgcattcagcaccccgctgtggatgggcatgacctgagagcaggcaccgcaggacctggaggaagtggggcctccccactgggcatcctctgtgccctgggggagccaacccctgccgccagcatggtgctgccttgctgcccaactccctgggttcagctgtggcaaaacagaggaagagaggtcaggcatgtcttccctgctcacctatgacctttcatgaccttggcctctgaggccagggctcttgccctccctgacggctccctggagccggctcctccccttggcccgcaggcccagtggtggcaatcttcagctctaagcactgaattccttaacctccttcacactccccgcaactcaacctatgcctctgaatgtggtcccagtttttaagtatctttagtaaacatcagagtcaaattctgaaccccatgagactatgagtgaacacttgagtcacttagtctgagcctcagttttcccatctaagaaatgggggtcatagtgcccatcagaacaggcagtgtccataaagcaccaagtgtgccacccagctctccccgctgcctgatacccctctccccgccacgctaagaggaatgcggaacaaggaggccctcctctccctcctctgcaggtgacgctggggaatgcagatgtacagaaggcgacgaagctatcaaaggtcttccgggactgccaggacccaagggcttcgcaggcatcaacggggagccggggaggaaaggggacagaggagaccccggccaacacggcctccctgggttcccagggctcaaggtgaggagcaatttcatcatgaagctggcaagacactctgaggcctccccaggtgtcccgttcttgccttttatctcctaagtttacacagcttcagaccggcaacactcatggacccaaggcatggctaaaccattctaaaaacccacataccccaaggcggactttctacatgtccactggtgagactgagaaggggcgctgctgtgggaaccgcagccgacagctcttgaaagagttcaatagggggtcaccacgtgacccagaaatgccactcctggtgtatccccaagagacttgaaagcacgtgtccacacaaacacacatacaccaatgttcacagcagcattcttcaaaataggcagaaggtgaaactatccaaatgtgcgtcacctgatgaatggatcagctaaatctatacagcatctataccacagaatagccctgaccttcacgtgggagcaaggtgctgagccataccacactgtggatgaacctggaacatgttatgccatggggattgagacccacacagaaggacacatgctatcacatggtctctcattctattcttatgaaatgtccacacaggcaacctagaaacaggaagtcgattggtggctgccacaggtggaggtgggggtgggggtggggagtacctgcttaatgggaatggggtttctttttgatataatgaagatgttctgaaattagataagagtgatggttgcacaaccttgtgaaaatactaaaaatcactgaattttatgctttaaaacagtgaactttgtgctatatgaattatatctcaaaaaaacctatcatttttaatgtaaaggacattatttatttatcgaacattcgccttctgaagtttagcaagaactgattcagcattgttggaaggcttccttcacctgataaaaagcaagaccttttgatttttaaactgtgcacgtgcttgtgtggaggtgtggaccccacacacatcagctcatggcctttattctgtgccttatgcaaaggtcacctgcagcagacctttcttccgtggcagattttagctgaccaaagagttcaaagtgaatttcagatgtagacaaagaaagtatactttttgttgattttttaacttaaaaagagaactctgggaaatttataaagcaaaaagttcattatttaacatattcagcaatagaggaaaaacagttggtcaggacacttggccaaggaaacttaaaggatctgagcccacagcatggaaggaaccgcagccccgcagagctgtgttgctgacggccatgactcccaactgcttcatggcacggagctgtgcaggtgaaaatgagacccgggcacctcgctgatccatgccctaggttttctcagaaaacagataggaaaattcaacaaaaaatagcaggtgctcattttatcccagcttaaaaaggatgcgatctctgaatcatggctgtctagcagtaaaagtggctctagtattcagaaaaagtgcgtggggtgagaactgcacatataccaatggcaaagctagtaggatcctcagttgtttaaaacgtgaccgaatatttcccagaagccaaatggaccccattctgtgcccctgaaatgtctaaaaccttccaagcacacacgtccacagaacttttgttcacacgcctctggctgtgcctggtgtcctgcactgaattctatgattgtgtgtatggaaaccacactgaagtgggaatacctgagaccatttgggagttttttggttagtttttgtttgtttgtttttattgttgtttttggtttttaatatctgtactggtagagtggcagggcgcttgaagtgtgggagtgggtcaataagcccatccctccatccatatacccaacgtgtattgatcgattgggtctggtctgtgtgtgaggaactctcctagattctaaagtaatgttgcaaagcactaaataaatcaagaatctgtggaattttctagaagggaaactcccaattactttcaacattgcatttaattaaagcaactccacacattcccatattcttggaaatagcgtcaaccaagatatgtcaaaagctagcacagctcacgtttgaaaacacaacgctgatgggtaccctgctcatcgtggaaagagctagacgcgattttccaggctgcgatttgagagtccctgcaggcagcttctctctaaagtatctttttctctcaaccttaacctcagtgcaggaaacaaatttctattaaataccatttattgttctcaatattatcacaaaattttatcctccatacctggattaacctgcttggctcctaaacgactgtgttttagaggaagccaccttgacttttaattcagtgcttctcaaaaggcaccgagcccgtggatccctggggcctctgtggacacgaaggcaatgattcagctgccccgggctggggcctgcacatctgcaccattgggcagagcccagggacactgaagatgggcctaggacctgggtttccctgtccaaccacctgtggctacttccactgcattgtatttacttatttatttatttatttatttttggagacagagtctcactttgtcacttaggctggaatgcagtggcaagatctcggctcactgcaacctccacctccctgtttcaagtgactctcctgcctcagcctcccgagtagctgggattacaggcgtgcaccaccacactccactgccacactcggctaagtttttgcatttttagtagagacaaggtttcaccatgttggccaggctggtcttgaactcctgacctcaagtgatccgcccacctcagcctcccaaagtgctgcgattacagaagtgaatcaccgcgcccggccacattgtaattatttaaaattaaagaaaaggtaccatccagttcctcagtcccaccatccgcagttccagtgctccacagccactgtggccagtggccccacactggacagctggatgggggcgtatccagcatcgcagaaagtgctccttgggtggcgctcggtttggtgacgggtgactgcctgccagctgtgtgagatgaaaaagcttgccagccatcttctcagatgccctcacagtacaaagaaggaagatatttttttgtctgttttccacagggagtgcctggcaacattggtgctcccggacccaaaggagcaaaaggagattccagaacaatcacaaccaaaggtgagttcctctctggccacgcggcccctggggcactgagccttcctgtgggcacctgcctgggcagcttcacatgcaaatccctttctaggtgagcggggacagcccggcgtcccaggtgtgcccgggatgaaaggtgacgatggcagcccaggccgcgatgggctcgatggattccccggcctcccaggccctcccgtgagtagccacaaactgcggcagctccgtcctctcttcttcatccttcaggttctccaaacaccccagaagcaaacagtattgacatgagcactaaaccaacctgtgcataggacaggctgctcattctgctcattctatttctaatgagcagaaatcagactttttaggaaacggtgaattaagttagaagccaagctccaaatgaacatttaaaagtcaacaatcaaagaaatattcctcctggtgtaacagactaagaaccctcccccgccaaaaaaagtagactattctaaaatgggtggtggaaccctatttttccaaggtaaatcatgaaatatacaatttcatttttgcaacaaacacacactggtgttgaaggaggggctacctagtagcctgcagagaccccagcatcatttcctcaggggaggctggggtcagaggcgcgggaggcagccatggagggagacaagaccccttcctgtgcaccctccagcctctgagcctctcctgccaccacgcctttcccactgccagctctggagcattctcttctcagaaggaccttgcaaccttatttctcacgtctttttttctagattccattttcctccctctagtcaccaagcctgtacctccttaagctctttgtactggtttcctggggctgaggtcacaaactgccacagactgggcagcttagacatcagaaatgtatggtctcacagctctggaggctgaaagccgacatcaaggtgtctgcagggctggttccttctgagacagtgcgggaggatctgtccctgcctctctcccaggttcccggagctctggcattccttggcttatagacggctgtcttctctctgtcttctcatcatctgtcctctctgtgtgtctgtctctgggcccaaatttcccctttttatagggagagcggtcatattggaatgggcccatcctaaagacctcatctgaccttgagcaccctcaaagaccttatttccaaataaggtcacatgtctaggtcctgggggttaagacttcagcatcattggaggacgattgaagtcataatcctctttctcctcctcagagcctcacgcctgaattctattcgcagcttatttgcctcattccataacccatgtcttctctagttttaacgtgggtcatgtctgtaataacactcttgagtgcagtggtacaatcaaagctcactgcagcctcgaacttctggactcaagccatcctcctgcctcaacctcccgagtacctgggaccacaggtgcacaccagcacacccacctaatatttttaaaattttctgtagagatgagatctctctatgttgcccatgctggtctcaaactcctgggctcaagtgattctcctgccttggcttcccaaagcactggttttatagacatcagccaccacacccggcccacatttttacaatttaagtgcagttttttggggccagagaacacagataattctatgattgggtatcttaaaaatctcatctgggaggcaacagggttaaataagaggcaaagtcataattggtcactttagccagaagaggaggatgagtgatgattcctgtggttggaacagtctttggcctgttcagtgtcatgtggggtgggggtggtgagtgtatgtgtggtgtgtggtgtgctcatgtgtgtatgtgtgtggtccgtttgagtctggatttgttacggtagtggtggccttccctggagttggtgccttgtgaagttggtgaccaggaggtgcacctgtccagccatggggttcacccacccctgcggctcccaagcctggctgccagtcccagcccagctgggggcaggtggtcggagcagggttaggggtaggggtgagggttagggtcagggagaaccttgcagcctcagcttcccattctcggggtgtagggactttcccagtgcttgtgtgccttccttgtttggtggcatctctaaaccaagaatgtcaacttctgcctttagaaaactcgtgatcctgcctgtgccaccttccagtggcatcatccccactgctgtccactaagtttggggcatctgccctgtgatctctgcaacagccttgtgtccccctcccctgtgaaaaaaagctaaaacacaggggtacaccacttaatcaaggtctcataaatagagctggaccggtgtccctgccccgctccgtcatgcctttgacaaggaaggggctgtggtgtcagtggagagcagggtttgatttcttataagcagctgcctcattgtcatgagaacacccagcctcgtcccgtggctcagcagatgagcgggagcttatgcgcatggctgttccaccagcacgtggggacagcaccgagccgtgccgtggtgtgtgcgcagatcacaccagcatcactgctgccagcctccccaccccatccctgcacctcccaccagctcccccccgcaccctgcagctggtgctttcatccacagggcagcccctctccattcccaatcctgtaatctctcctgacttctgaggcgcacacggctctttccttgtccaaattagcttcctttcctttaacaacgtagcatctcttaaaataacagccattttaccgatgctaaattataacaacaaaatcatgtgtttctttctccacccacagtagaacacaaaagcctgtgccttcgctgttctggagatgaaggcccaggctgatgcaggggagctggcgggtgggaagagagaaatgctcaagcatgtacatgtgccttccagaaccggcttccgtggcattgcttagactgctacacagtctgtcactggctcctgtgacctggctgaccatggcactaggttcctgttcatctctgttgtctttctgttctggatccatagctcagaattccgggaaatgggaaaggaaacagggaagtcgaggcgatctttaacattagtatatattttaagaaataaactgaattttcacacagggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaataggtatgaaggaatcctcccttttacctttcacagtcctgagacattccacgctttcctttgtcagtgtagacgtttcccagtagagtcagatgaggatgctgttttgcctcatctgttctcgcacgtacaagggatgacccaactgtgaggtttctgagcccccaccagcctcccctcagcagctgaaacatgcagcctctcctgtaggactacagtgacagaggccttgcccggaagttcagagatggctttcccgttccctgcccatttcaaagccttcctgcccccaccagcaacatatacgacacaccttcacacacgtgcacgccccagacgagccagtaactcttatctgtttcaaaattgcctcactctgtccttatgtcttccccccagattgtgacacagatgtgaaaagggccgttggaggtgacagacaggaggccatccagccaggtactctgggaagtgcaggtggctttaggacactagagaactctcatttggtctgctggttaagctcttgcagtatgcgtgggataagaaatattaataatatgtgcaagccacgtttgatttccatggcacaacatagtggcctggtgagcactatacattgcatgaatgacaacctggtagagacggagagacatttaaccaaacccctcttgtcagaaatcctttttcactggaaagcaccagtgcattccaactcagctccacaggcacgtgtgctgccaggagggtccaggcagaggaggctgagcccagcccagacggtggcgaggatgtcaggccaagatgggagcctggtccagattcccaggcacacagacaaaagaaagctccaagagtgactgttcttgcaagagagcctcttagacaaagggctctcacaataccccagctggagtgtcactgctcccagccacaccaaccagaagtgcccacagccttgatttaattttgcaaggtggctgattgctgtggttcactctgaaagtaaacaaagtcacaaaggagaagtcaaataattcattttgaaatcgcaggctatctccattgctggcagatgcttccagacaaaagaaaagcatccacactgacttgcagggtagcagccagattaactcggtttgcacccaggctactgccctgcaggagggaatcaattgtttgccagcacagtgccagtttttatttgactagactggcttagtttgcattttatacgaatattttgatttcattacacaatgaaattaaacttttatttacatcagaaccaagatgaattaaatcattaagttactctgatcccagaatggtagccggtttgcacagctcgtgcttttgcccttggggatccccaaggccgtgggactcagtgtttaggattgcttgggctcatcttttctcctttctgtccccaggttgcataggagggcccaagggattgccaggcctgccaggacccccaggccccacaggtaatgcacggagggaacctggagtgcacccagccttcctcccacatcttcacactgctgtgtctcccccgcccatctttcctctggtcctgcatcccccaccccagacatggtcgtgtccagcatctcagcacaaactggtcttgcgcctacagggagcccactgtcatttgccactatagaaaaaggagtctggtagctgacacttagttggggccaggctagaagagaaaattcagccatggctgcaggggaacgcccccaggggcagagatggaagcctcgtgtttaggactggaaaggggttgcacttctatgtattttctttttatgcctttccatcccaggatctaggggaagaacctacaggagaggatgctttcatttgggttttgattaacaggaaacgggaataaacaaggctagagtgttttgtctctagcacctgggaggacctgggcttctatctgctggcccaggccatctctcagcccatgtgagaaagagtctgggtgcccttcacagagcccatgcctaaggccgcctgcgtgtccagtgttggcggtgcaggcctggctggccaccactgccgtcccgcctgcgctgcgattctgctgccctgcactccagggtctccgtgggcctgtgagcatcggggaacacagagccagggcttccactcaagcaggaggagggctggaccctgagaggtggctctatgcctgtgtccatcagcctgagaaaagcaagttctctgagcagtaggaattcccctttggatgtctcttccactcggcctgtgatggggccggggaagcatgtcacttgggtaactcagtgtcacaagcaccagacacagccagagctgttctcacttgtttcttctggaactaagtccccacctatgcaagatgaatagtgcagacaggtgttctagatgcttcctgctgcacaaatcatgccctcactgcttcccgtgataaactgtagagagcgacaccagtgtagtatgaacagcaatgagagttaggaaagtggacggacacattctatgtgccctgcaccttaagggggtcttcggagtgcaccgtgatcacagggcctggggagcacaggacaaatgcagaggtatcatttgcactgtgagcagaggtaaaggctccttgtgttgtcttctgagaactgagcttgtatcttccgcgttccattagacctgcccccggtctaattccatccatggatttcaacaccgtcactcatacagcaacccccaaaatggtgacaactctgcatgtctcaggtggtcagggagaaccagaggccagcacgctcagcacacacccagactacagccgtgtgccaaggccggtctccgggaaagctccagtgatgcgagtgtgggtttctgaggctccggggctcccccagccatacccagttatttccatttcatgcccaggcccccattactgggagccccttgctggcctcccatccgctcctccctctcactcctgctgtccgcactccactttctaagagtgagggtgggtttgatcacacacatccccttcccaagaggcgccaggaacggggataaaaaagtgtggcagatgggttttgtgacatggctgaggaacctcagcccttcaattatcagaaaacacttctggagcccacacactgggccaagcaggattcaagtgtttgaaaagagtcacctcatagtcctcgtggcgtcctcatgaggcaggcgatccttctccccactttacaggtgaggaaactgaggcacagaaagttgtccacggtcacacagatagaatggtagggccaaaatttatagccaagcatctgaccccacctccaaagccctcatttagagcactgtagaatctaaatattggatattatcattcttatggttccagtccgtaaacaggattttaaacactgaaaatcattctgtaagcctggaggtgctgtttcaggctgatattccccccagcctcatcatttcccggtttcatgagatccacattaagtcagatgccaagcatgaccatgcccatttatcctcgtggagcctgatgtggtttgtggtttatttggttatttaggtgccaaaggcctccgaggaatcccaggcttcgcaggagctgatggaggaccagggcccaggggcttgccaggagacgcaggtcgtgaagggttcccaggacccccaggtgagttgagatcagacccccattcagcccctgggttccagcgggaacctgtgtgtgattcataagcatccagctctattatcttccactttgtagaagctgttttaacaaatacttgacaacttttgcatttgtccttgggagattagaaattcttgatttttcataactgatattgtactgggtttttgcagaagctatctacagatcttgcaggaaaaaggagacaggtgtttcggaatggctgtcctccgcaacacctgtctcccaggtatgtcctcagtgttaataatgattaatattaaacattctaagggcaacacaaagttatcctctcctgaaagaacccttaaaggcataaatagccctctcacaatgtggctgcaagagcttaaggcattaatctgtatgtggaggaaaatgaggtttcccttaaccagctctggtgaggagtacccacttgcgtgtcagcatgctctggaatgcagccaggcgtctgcagacataggtgtcttgcagttgtgccacaggcgatgtgcatgagtgtgatggcactgccttgattgcaggggcatacacgtctttttttttttttttttttttttaatgaaatggaatctcgctctgtcacccaggctggagtgcagtggcacaatctcagctcactgcaacctccgccttctgggttcaagcgactctcctgcctcagcctcctgagtagctgggattacaggcatgtgccaccacacctggctgatttttgtattttcagtagagacggggatttcaccatgttggccaggctggtctcaaactcctgacattaggtgatctgcccgcctcagcctgccaaagtgctgggatgacaggcgtgagccactgtgccaggccgcacacatcttcaatagtgtttgtctaatgaaaccatggaagccattgtggacaactttccacccgagatgaaacatccttccacagggtcctgggcaggttcctgcagcctctgctggagtcccacttgtcacctagaacctgtggcacattggaaccctcttgttgctagaaagttcctccctggaatacagcctgcctcccagggagttctcaccgggctgttcctgagccacacagttgacttcctcataaccacacaccctgagagaggcggccacatctcccacagacgtctcatgaacaggcagaactgaccccgggaacacatactttcttttaatgacatcgttccatgcccttggaattctgagcaaccttctaggacccccacttatcaggattcttttccaactgggctctagaaactgaataaagcgctccccatgtctggaatatcacacagaacatcgggactgttgcgcccttaggttgaacatcttgcaaatgttcccagtgaagactaattgaaccctgcccctcccctgacctccactcagatagctgatttaagcctcaatgcagaagtgtctgtccgtccctgatagatggtatctttcggaattttgtgttgcagcccgtagggattgttccaaaccctgaccctgtttcctttcatatgatgcgtttctccatgttttgcaaaattgggaagcaggcttcctgtgtctgtatcaaggccctggtaaaaacaactctgcattcgaatgaagcaaaggaagtctccatgcctctgccccaggggttggtctctgtggttttgttgccctgctggaagtgtctaaatatttagaagtgtaacattgccactctcatgatttcatatatactaagtttaagcattcatgattttgagagaaggataataattcctgaacagcttcttgctgtgagtatgaaagttctctggtaattgtgattggagtgcccagccatgtgtgcgtgaacgccacacggggctcccctgtaggggggaatggatgggatgcacccattatcaggtgatttggacagttgcccacgtgagttgggagcctgttccaccatcaaatgtgagcccttacgtcatgaacagggaggctggggcaggctgggggtgggtggtgattgaggaactgatcagtttctgaaacgcatgtcactttttatggtgctgaaatatactgcccttctgtcgccacatgcagaagaggataaaatgcccaattcaaggattgcaaaaatcagagagtctattccagatctaagacccacacatgcaaacccaagtgcatggctccctgggtacagtttgtaacattgccagtgaaagtcatgtctcttcattgtgagtaaatcacaccgttaaaactctgagtacggtctagctgattaacgtcaggttaatccagatcctttattctgtattccagttactcccagctcccaggcagtgatggctttaccggcccaggaggtccccgggccctgctcattggatctttttggtgggatacaccccacagaacacagaaaacattcccttttccgtatccatacataggagtgccgagcctgccgtgtacttgatcttgtcccacagaatcacctgccagtctcatcgttgcaggcttctctcctgcatgcacagcgggggtggtggtgacctcagaagcctttccttctgagcactgcgtgactgtcagctgtgggagttcattctgaggccatgtcagggctgactgcaccgaaaaaggaagtgacctgatgagatcattttatccagtggcacccacaaaagacacaggacagctgccttccctccatccgcagatgggacttgatgattttcttttttctttttatttttttctcttttgagatggaatctcactctgtcgcccaggctggagtgcagtggtgcgatcttggctcactgcaagctccgcctcccgggttcacgccattctcccgcctcagcctcctgagtagctgggactacaggcatccgccaccacacctggctaattttttgtatttttagtagagacgaggtttcaccgtgttagccaggatggtctcgatctcctgacctcgtgattcacccgcctcggcctcccaaagtgctgggattgggacttgatgattttcatggtcaatacaacagaggggtgtcgttcctctttgaagcgtttcccaaccgacagtgacgggtttctaccagggagatgttacggcaggcagcgttttggctctgacggccctgttcgttcctgcctccctgggattttccatcccgaagtgctgttcctcactcagcacaacctagaaggtcccacaaaaagctattctttggggcttatttgcaaagcaggggaacccatgaattatgcaaatcgaggtccaaggaggcgttgttggcttgtccaccttcactcagttttagggctggggggccgaatggcggggcaagcagaagaaacataaccaacagaacgacatggcgaaggttgtaggttccaaaaagggcgacagggacaagggctcgagctgaggaatgccttctgaggaccccatagccaaatttttgctgtttccagcctctttttgactcttctcttagaacgtcaccatgctaacttgtggtttggggcccacccatgtttccttttagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggtgagtgccccatcggggagccgggggccccatcccagatgcacagtggcctccaagggcgaccccaatcccttccgggggatttggtaggaagcagcggtgccctatagtgctagccatgcgtaccttctcccatggccttccagcactcctttagaatgtgtctgtcacaacactgtgactacccacggtagccagtgcgatctggccatctgagaactttgacaggtgtggattcactgatgtaatctgttgtcaagttgcatatgcctggctgtgacaggggccgtgacaggctcactgtttgtcttggcagaatctgtacaggtggtatgaagaaaagatgggccctggccatgcttagtcagaggtgaagaaggaaaatagaaataatctggaatgcaattctattggtgtaaaaattaatacattttttaaaatgtcttaatgttgtttacagtgttatcaatgtatctctatcaaagtagacagagcatccctggtttcatgagtgacaaggcacccggtggctttaagggttcaactgatgccaaatcggctttgggaacccgagccccgagctttaatgaaagatgatgccatggacagcaaatgttcacactgggtgaaccccaggctggggattgctagatcattgcaacctgccattcagtgttccaaatcaaaaatgaggctgagcacagtggcttacacctgtaatcccaacactttgggaggccaaggtaagaggattgattgagccgaggggttcaaaaccatcctgggctacatagggagaccccatttctacaaaaaaaaaataataattaactgggcatggtgctgtgcacctgtaatcccaactacatgggaagctgaggtgggaggattgcttgagcccaggaattgtagattgcagtgagctatgatcattccactgcactccagcctgcgtgacagagtgagactctgtctcaaaaagaaaagaaaagaaaagaaaatgtgggttaaaactgtgactcggtgcattcactgtttatctgttgatggcattgtcgttagtccctgctgccaaccccagcccgaagaggcttctctgtggtgtgggaagcaggtgtcgctcccctgattctgccatcagcccacatcaggcatcctaagcgagatggaggctaggcctccactggcaggcgaacccatgaagctcaggagcatgaattggttttcggatgagcctgtgagattcctagcaaggcctggaagggttgggacccaggacaggggagttttgatgatgatgagactgatcagtgcccccagctgttgatactagggagcgcccatgggtgccacagttcactgagagagcaaggaagagcctaagatggccagagtgcatgcatgcacacacacacacacacattcacggtcacactcatgcacatgcatgctcacacatgatcacatacacacatgcagatacctacacacgtgcctatgcatgctcacacatgatcacactccttacacacgtacccacacacgtgcctgtgtacactcacatgatcacacacgcacgtacccacacacgtgccgtgcacactcacacatcacacacgcacgtacccacacacgtgcctgtgtacactcacacatgatcacacatgcacgtacccacacacgtgcctgtgcatgctcaaacatgatcacacactccatacacacacgtacccacacacgtgcctatgcacactcacgatcacacacatgcacatacccacacacgtgcctgtgcacacacgatcacacacacgtacatacccacacacgtgcctgtgcacactcacacatgatcgtacactcatacacacacgtacatacccactcgtgcctatgcacgctcacacatgatcacacactcacatacacacacgtgcctatgcatgctcacacatacacatccaaccctgaaccaagccagctagagcaggttgttgggtgaaattacgaggatggggaggcctcgtgctcggccatccagatctcccctttccagtcctactgactctccaggtcatttatggaagataagatgcaaatcagcgctgtctgcagaaactgaggactcggcgctgagaggtggggctctgtgtgtcagccttcctggaaggcacttaaatgagttcacagaaggcaaagtgaaggacatacgtaggtgactcgagtgtccaccatcgacctgttctgcaacccagctgtcaaaatcctgccccaagctctttgacataagggtacttctggtagaatttttttaaaacttaattacttcctgcaggcttcagaatgtttgagcatgaaaacaaatggaagcaggcttactttcgatgtcttattaaggtctttaccatgatcaatgttacctttatgacaagcttcatatgccttgttaggcagaatgttttggatggtaaaaatcctgactcccaaagcatcaacattccaagtaactacttcagtttcagttccgctcaccagtgctacaggagcagcgtgcagcgggtcctgcttccattcgactggctgtgcaggacggccacaaacacacgcaggtgcaccctgcgcttctgagcagaactctcggaatgaagtaatgcagacgtccacaaatgagatgtgatttcactgagggaggctgatttttagcagttgttccttttttaacagatagtctataagtggaaactgacctgaaacattcagctctaaagaaataatcacaaagcacctcggtgcctgatttttgcaaggcagtccttgccggaggatcgggcattcgtgcacattcacccggagaccgtgctgtccacttccagaaggggaggaagggcagcgctcagaagcacgcccagactgtctccagccctgctgccccctgctgaggccatctcgcctgctcagcccccaagttcccccacagtccatgtccctgggttatgaatgtcacctggtgtctgtcagatccccaccccattgttcttgtcaatgagcaggagtggggtggacctgccatcgctgcgaatcctttacagcctgcagtgctgcctgccaactcttcacaaccattagcacccactaacaatccatttcccctggagctcttcactctaaagatagaagaccaaaaaatagaagtgtcctcatttctcacagtactacaggaggaggtgagaaccgatgcatccgtgcatcttagagaatctcatttcagacctcggcttcgagtgcgcctcctgctcagtcagccctcttcctcgctgcaggttgacgtggtcagacagtgcgcagtcagcagcctgactctcggttctgggttggtccaagactgaccgggtcccttttgtcactgccccctcctgtgcacccccctggcttgtctgcctccctgtcctggaccagccctgcacacctgcagggtggctgtgaggctacgtgagtgtgtggactgtaaagtggtggcaggagtgtgcacctccggtgttaataatcggagagcagctgcgacaagcgtcaggctcacgaagagagggggaaatgcctgaatataaggaggtccagggagctagtgttaaaaactagaagaaaacagatgcccttagtgtctgaccactgggcaggacaggatattccaaacttaaaatgaagagaagaaatcacacatgtgcacacacacccacacacacaccatatgaagtttgaatacaaaggttagtatcctgcatgtggaaagcaaaattaaactttgagcagcagaataaactttacaatagatatgaaggaaaattcgtcagtgtatatgaggaatactaaaatctatcaggaaaatataaaactccccagaggaaaataggagcaaagaggccgggcacagtggctcatgcctgtaatcccagcactttgggaggccaaggcgggcagatcgcatgagctcaggagtttgaaaccagcctaggcaacatggcaaaaccctgtctccatttaaaaaagaaagaaagaaagaaaagatatgagcaaagaactaaaacttcaccaaaatcaataaccaggagaaagaaacgtagatcataatgaagaacaagcaagcggatcccccgacaccacgtttcactgcatcatgactgccagggttccattttgcttcagtgctaacgctcagtgctggggaaacactggtagaataaatgggtttagactttctgaatcagtgcgatgtatcttttaaacaacattaaattagtgtttgctttgatacacgatgtcagtttctcaggcagtttcctaaagaaattacctacgacatggacatggataaacatagcaaaaaaagaaaactccccaactattcctgacagtgctgtttgcaaaagtgaaaaaaatggggaggatgcgatggaatacattcaatgtgtccagatgatagagttttattcatgtagttattttaaatgtttgcaaagactatttttaaatgtggcaaaatgttcaaaatataatgtcaagtgaagaaaactaggttaaaactatacttatagtgccatgtcaactctgcaaatgtctagttatttataggaatagacaagggcaggaaggaaattcccagtggtagtcattaccgctgggtgatggtgtgccttacctgattttatcctttatacttctttgtgttttcctgattctctagagtccagaaaagcatgaattgctctttttacagaatgagtgtgtggagggagatgctgtctgtgatgaacagtccagagttggcccccacagctcttgtctctgattcctgcaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtaagaccccagccctcccataaacgagtggggtcctcactggtcctgccaagagaatgagcactgtcttcttgtggagctctcaaagtctgttccatggaaccccttaagaggtgcaggggttcccaaaccagaacatgtatttcacctaataaggagacacaaacagcctgagacatcggctcatcctctgtacctgttgtatatattaaggatctagggaaggtctcatcgggaaaaaagaaaaagaaagaaattccccctacaaaagttcagaatcactgctctgatgtggagaggagaaatggttttatgaaagtgcagggtgtgggttggaaaggcaggtggctccgtcagggaaacctggggtagatgggctggagcagaggagcggggaggggaggctcggctgcatgcccaccacacaggccaaggcaggtggcagaggtggcccagaaggcaggcagggcacagcatccatgggcattgcccaccactgcccaggccgctctcccacactcagtacagccagttcccagactcctacacttcacggtccagggaaactgtcagtgctggttggaggaatcaatgtactttcccccctttttgttttgtccagaaaaacagctttttaaggaagtgttgtatgtcaccaaaggacaccgtaactgtaaagtgggaaagacgcagttgcttaataaggagttgtctccatggaaactctcaatcttactatagttctctggtttgccacagtcaggcaacagctttgtccaggaccttagcagatcttggtagggaactgccactccacttgaagatacacactggcttcccccatgtggggcctcgcctgtgtccaagagctgggggctggactcaggtagggcccgctcccctattgccgcactagccactggcttcctggggtagcaaacctggaccggaggttcaggctcctatctcagtatcgacagggccgtgctggttctcaactactgagaatcagctgaacacagcgtcgtgtggtgcttacgagacccatgggaaagcctgtcctgaactaaagcctacactttaggtggggagagagacacacacattaaaaggctcccacttggcctgggcaagccagcagagtgacaaggccacgcggtccccggtgacccagaggaggcggggacaggcaggtcagagcaagcccaaggggagaagtacctggtgccagcggggagaaggctgggactggaatgtggggtgctctctaggaaagggggaccaccccagcagaggcagaattgcccagggaacactttggagcctgtgatccccaaaccggctggggaagagagcctgatttgagggggctgggggtttagataagaagattgagccaaaggttgggagcagtgaatgctggagctaaggagttggagccccgaggcagagggggcctttgggagtttttaacagagaaatgcattaagaagggattttagggacccagcaggcagcccttggacggcttggagtcgggggaggcgggaggacagctgtgggcgggagctgccaagctcacgacagtagcagtgatgagatgggagcacggagaccagagagggcagcagcagcaaatgggcagctggagggtcccccgggactaactccgggctggagccagtgatgttcgcgaggaacaggccagctcttgactaaccccagtgaccatgccccagccagagctggcaaggcccccactcacatcagcatccacacagctttgtcccttggcttctgaagactgcagtgggaaagccatgctggctggcaccccgccagcacagcctcaacctccagatacagacctctccagaaaggccagccccagggtcccgctccggccacactttggaaactcaccccaacatggtggttttccactttccttctaaggagcttttcttactgaacactcaatgccgtaaaagcagaagagaaatttcccctgtgtgtgtttgtccaccctgtttgatttgctcctcttcctgacaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggtaattgtgtgactgtgaccagggatcccttggcggggaggttgggtctaatcaactctgacctgagacagctctgctgggcgcctctgtgggccgtggggctggcctcacacttctgcagattggaggccttgggactctcctgacctaggagacagcagcctcaggacagctggttaatgctgcttagacgcgggtgggaccaatgtgcctcacaaagccagtttatgaatttaccaagacaaactgctcctgcctgggaaacatcgtcttattgtaaatatcaccatctgcacagggaaatttgtggagaggtccactcaggggcctagattcagatccagaggttatttggtgaatttgaaaccaaagcaaagcaaagtggttggttacagggataggtttatttcagcacaagcaggccaatctagaagcagagccctccagcccatgaacgttgctggagacacactgttcttccattgctggagacacacagttctgtccttccattgctggagacacactgttctgtccctccgttgctggagacacactgttctgtccctccgttgctggagacacacagttctgtccttccattgctggagacacactgttctgtccttccgttgctggagacacacagttctgtccctccattgctggagacacactgttctgtccctccgttgctggagacacactgttctgtccttccgttgctggagacacacagttctgtccctccattgctggagacacactgttctgtccctccgttgctggagacacactgttctgtccctccgttgctggagacacacagttctgtccttccgttgctggagacacactgttctgtccttccgttgctggagacacactgttctgtccttccgttgctggagacacactgttctgtccctccattgctggagacacactgttctgtccctccgttgctggagacacactgttctgtccctccgttgctggagacacactgttctgtccctccattgctggagacacactgttctgtccctccgttgctggagacacactgctgtgtccctccgttgctggagacacacagttctgtccttccattgctggagacacactgttctgtccctccgttgctggagacacactgctctgtccttccattgctggagacacactgttctgtccctccgttgctggagacacactgttctgtccctccgttgctggagacacactgttctgtccttccgttgctggagacacacagttctgtccttccattgctggagacacactgttctgtccttccattgctggagacacactgttctgtccctccgttgctggagacacacagttctgtccctccattgctggagacacactgctctgtccctccgttgctggagacacactgctctgtccctccgttgctggagacacactgctctgtccctccgtgctggagacacactgctctgtccctccgtgctggagacacactgctctgtccctccgtgctggagacacactgctctgtccctccgtgctggagacacactgttctgtccttccgttgctggagacacattggtcggtccttccattgctggagacacatgggttggtctttccattactagagacatatgagtctgtctttctgttgctggagacaccttgacctctccttccggtgctggcgacattggtctgactttctgcggtcctgtgtcgcatctccatgccaggtgcagtgttactgctgccttcctttccagcgtgctcctctgcctttgtcttgatgggcctgtgggccagtgaacctgcatcatcttcagatttccctcctagccttcctgcctgatctttgtgtgtttccttgttgccaatgtccggtctgaagacaggctgattctggaatgctgtctgttaacagcagaggtcaacagagagaagttgcttagaagatggtgtccccggaaatccctattttaggttcagaatcttctcacttgagttacattgccgaaatgttacggagacgtgagactgaaatgtcccatgcattttattcatgtctaacccagcacttttctcttttcctctgaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggtatgtccctctcttaacatcctccttacctggtcatggtggcatcctccttaccctttcttggtggcataacattgcccagaatgaatttttgaaaacccatgcatccaggaaccctaaagctagacaaaacaaacaaaatgagctaacaaaaactcaaaggctttatccctgcctcaacacactgaccatgtgataagggaataatcctaaccaaaggaaactcttgagaaccaaaatgatggcatcgctaagaaccaaatatgtcatgaaacatattccaccatgattataccgtggtaaacatgaagagggggcggtgaaaagcaggggacaggtgagttcccagagaagggagtaccaccaggcacaggaggacacagctttccaggtggaaggacataacacggtgccagagagaacgtggtccacacatgaggtgggttcaaaccctcacgcggacaggcatctcaagaccccccacgtaaggcccctcgttcattgagtttattactaacaagtcacattttcatgacttctgttcagatgcttttgttctgaaataatcacagtggtctctaaaaacgtaatgactaagagtgtgtgttggtgaggaggtggagaaatgggaaccttcacaggctgccagcaggagtgtaaaacgctgcggccagtgtgccaaacagtttggcagttcattaagaaactaagcatagagttacccagaagttctactcctagatgaagatcattgaaaacataggtacagacaaaaatgtggacacaaatctcatggcagcatcctttatagcagccataattggaaacagcctgaaaatgcatcgactgatgaatggatgagtaaaatatggcagagctgtgcaagggcacattcagtgctgaggaaggatggggctctcagacatggcgcgtgggcgagccttgagaacactatgccacgtgtcgtctgactgcatgtatatgagatgtccccagtaagcaagtttacagaaatgaaaagtggattcgcagtttcctacacttgatcttagccaaaaggccgagaagcgatggattcgcagtttcctaaagctgaagggttaggggagaattagggcatggctgccagcggctccagggtttcattttctgggataaagtgttctcaagttagacggtgctgcttgctcacagctctgtgagtacactaaagttatgtaattgttctgtttactggagcgagttgtagggtatataaattatacatcaataagctgttttggaaaaccttaattactcttcagacttacagcttttacaaattttcagcaaaataaaaattgcaatctagggtgctcattttttttaagatttttactcacacttgtgctttcaaatagtcttcctgttagcagagatttcaggctatttcaggcaaaaaaaaaaaatgacattttaagattaagtaattttcagctccatggtaattatttcctcgagcctccttagggtgaagttaaccatgggggtgtctgtccctccactggtgggcacgctctgtggggtcaggaccaatttatgattttgatcccatcagcctctagcctagtactgaatacacagtaaatgcttagagactgaagctcaattattttcactgagccagatttcacttactcctccagtgagcatggattccggggcatccccagcctgaactagcacagtttcccgcccggcccgcagctctgggcccctcccctcctgcaatttctcagctcctcagaaccccccggagacctcccttccatgcttctcctccctgtgaaggtgcctacaggagggcacggagctggcgcctgcctcacgggccttcctgcttgtgaccgaggtccatcatggtctcatcagagcacacacaacaaaatgaccttctcacaaagcatcctatgggagtcacactggctttgaccgctccctctgcatctgctggcaggcacgtccccctactgtggtgctgtgtgctcagtgacaccagccccaggcccaggaccctggagccacccccaactccaactactccgatggacacaggagaggcttctccggcgcccttggtctctctccaaggcttccctgcttgggggagacgtgcagccctatggctcagggaccaggccttcacctgtgttctcctgcgtggtctggagcccccagaaaatgacagcactctattcccttccaggcagccgaggggaccctgggcccccaggaccacctcctgtcatcctgccaggaatgaaagacattaaaggagagaaaggagatgaagggcctatggggctgaaaggatacctgggcgcaaaaggtgaggcttctgacctgcagccaggggcccctagtccctgccgccccagcccgcaccagctcgtgcccttctccgtccccagagacgcccgtgccctccacctggctttcttcgtgcttttcatctctgggcgccctgtgtgtccatagctggcgcagggttgttctctgatgcctgagtaacctcggtttcccatcttaagatttgcagcactggccgggcgcggtggctcacgcctgtaatcccagcactttgggaggccgaggcgggtggatcacaaggtgaggagatcaagaccatcctggctaacacggtgaaaccccgtctctactaaaaatacaaaaaaattagccggcatggtggtgggcgcctgtagtcccaactacttaggaggctgaggcaggagaatggcgtgaaccggggaggcagagcttgtagtgagccgagattgcgccactgcactccagcctgggcgacagagcgagactccgtctcaaaaaaaaaaaaaaaaaaaaaaaagattcacagcacgtaggacagcaaaatgcatccaggctgcaaaattgaaaactggagggcgggtgctgcgtcctcaccagagtgttacacaccagggtcttcctgcaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccgggtgagtgggcgtcttttactccccttgttctgtgagctcctctcccctttgcttgtgaatggacatgctttggtctggaatttgctagggtgagagtgtcagtggcaggttcagggcagcctcaggcttggtggggtccacacagccctggaaggagctgctgcacttggacaccatgcagatgtgatgtgagtccaaccggctgccgtggcccttctgtgggcttgtgctgggtgaagcatgttgtctgcatttttcatggtggccttgagagaacaaaacttgaattttcagggatcagagctctaaaattgagcacatcagtgacaccaggcctgagagcccatggccgaatcacagcgtagacctgggcccggcagcctggcttcccatccgggccaccgttcactcagcctttgttcagcggatgtctgttgagcacttgacatgggccagacacgctgttgtgatggtaacaatggtgagccctgaccctgggcagggctctcttctccacaccttctccctcagctgcagaatgaaggtagtagctaccttgcagttttcttgagtgctgtatagacagtgtgtataacatagcacagcgtggctccccatagattccgtttcctagaattccatttctagcctcgttcatatgaagatagtgtattctcacagtccctagcacacggctggccttcccagggggatgggcacatttggagcagatcagaaggtctgggccccttgatgtgtttcagtcgcgtccgtgtgaaaagaccaccaaacaggctttgtgtgagcaatcaagctgttaatttcacctgggtgcaggcaggctgagtctgaaaagagagtcagcgaagggagataggggtggggccgttttataggatttgggtaggtaaaggaaaaaggggggttgttctctggcgggcaggagtgggggtcacaaggtgctcagtaggggagcttttgagccaggctgagccaggagaaggaatttcacaagataatgtcatcagttaaggcaggaacaggccattttcacttcttttgtggtggaatgtcatcagttaaggcagaaaccggccatctggatgtgtacgtgcaggtcacaggggatatgattgcttagcttgggctcagaggcctgacagtgtgaacccttagtagcaggccagggcctgcctgtgtgtctgtctggcccaccttggtgtacagaattcttcaggggtcttcctcccctcactcccaaaatctgcagctgagagtatcttctagccagtctgtgtgtgctattcaggtcactttaaaaaagaaagatgccagccaggtgcagtggctcttgcctataatcccagcactttgggaggccaaggcaggcagatcacttgtggtcaggagatcgagactagcctggccaacagggtgaaaccccgtctctaccaaaaatataaaaaattaaccgggtttggtgctgcgcactcataatcccagctactggggaggccgaggcggaagaatcgctggaacccaggaggcggaggttgcagtgagccgagattgcgccgttgcactccagcttgggtgacaaagcaagactccatctcaaaaaaaagacaagaaaaaagaaagatgcctgtttctgccaaagacacctacaacatccaaaggacctttattcataacagctcgaaactaggaaacagcccaaatgtccatcaacagggaaaagaataaatgaacgtggtatattctaaccagacacagcattatctgtgcattttatctccatacacagcaataaatgagaattcttggtaaaatccaacaacctaacttcatttccaaactttatgttgaacaaaataaaccagaaacagaaaagtacacgattcagtttcatcgatgtgaagttcaagaactgacaaggctgttagatggggtatcgggagcacagctgctttaggtggggttgtcatagagtgctgacagtgttctgtgtctttcagtgacacacgagttcagatgcattgagctgtgcgtttaagatgagtggacattactgtatttaagttttgcttcagaaaagtaagctttgagaaagaaaaatagagcattacctaaacaaaggtgcagcctgtggataccctcccccttcctcccacaaaggagcttttgttttgttttgttttgttttttgagacagagtctcactctgtcacccaggctggagtgcaatggcatgatcttagctcactgcaaccactgcctcctggttcaagcgattcccctgccacagcctcccaagtagctgggattacaggcgcacgccaccacgcccagctaattttgtatttttagtagagacagggtttcaccatgttggccaggctggtcttgaactcctgacctcaggcagtccacccacctcggcctcccaaagtgctgggattctaggcctgagccaccacccccggcctagctatattaatactgcagcgactcatgttaggccatgcttgtacattgatgctgtagtactaaagtcccagtggcacccaggtagaccagaactctcatgctccctctggggaggaagccactctggaggggaaaactagggcttccaggaagccaccgagcaactcaggcatcttctcaatttccttaccagccacctgtgtctttctggagaagtctccctctgtgcacagatggaggcgcacagccccatatctgtgttataatctgcagagagcaagctctgcagtctggctgcccaaactgaaatcccggttctgccacttgctggctgagtgaccttaagcaaaacctttctgtgcttcagttcctttgcctgtcattgggaagtaacggtgcctgcctggcagggttttcatgaggcgtgaatacgctcttgagacggggtccaccatgtgcacgcgggaaagcatggtggagcgaggatgtagtcagagtcaccgccgccgctgacatcaccacactgtcgtgatggagacctgggccactgatgctcttcattatgatgcagttgccaagcttgtttcattgtatcacttcacagttccataagaacagcaaggccaggtgcagtggctcacgcctgtaatcccagcactttgggaagcagaggagagagaatcacttgaacccaggagttcaagaccagcctgggcaacagagcaagagcccatctctactaaaaatttaaaaactattagcagccaggcttagtggctcacacctgtaatcccagctgcacaggaggctgagacggaaggatgacttgagcccaggaaatcaaggcaacattgagctatgattgtgcttctgcactccagccagggtgacagactgcgatcctgtctcaaagaaataaataaataaataaacaaaaagaacagctaagcaaaccgcctatgatacacactaaaaaacacgagttttccacaaaatgacaagatcacaaaccttgagtattgtcgttagcatactggatagttaaataagtgagctaacttcagagttacaactgacttcgctaacagccttctaagatggttcatgtctgtctttagggtgacaaaggtgccccagggagagcaggcctgtatggcgagattggcgcgactggtgatttcggtgagtgttgcccgtccagtgaaaacagggagtccacaattcagagctctctgagcatgtgagccaatttcagacctgcaagtgctgttaggtattttaaaacaaattattcttgttaggaatataacaaaatagaagttgcaaaactcacaaagtcccagtggaaagtcctgttcttagccgtcttttttgcatgtaacaggtgacatcggggacactataaatttaccaggaagaccaggcctgaagggggagcggggcaccactggaataccaggtacgcaagttattttccttgtcttcatcttcaacaacagccctgagcctttgtctaggagcccgacttgccaaacagatcaaattcagtaacaaccagaaagcacttgatagtgaatgaggtcttcaagtccaatgtgcaagaaagaccgtcgtttttaattaagttaaatctgaagataaaatcaggaagtctttctctctctctgtctctctctttgatactgaaaaaagccagaatggaccctcggtggatgagaatcactgcagtccataaagtgtaactgatgaaaagccagctagcaccctgactcccggaacacctgagggcgtgcagcaggtggtcgctgacccgagcttctcagaaacagcgaagggtccaggaaagggggagtgggagtcaggccatcgcttgagagagatatggaggcagctgaccagcccgagcgagttgtgggggcctggggcggcacagtgcctcccttcccttctgcacatcactgaggttccactcctaaattcctgcctgcagtgacgtctcaaggggactgtgatagttttcttctttctggggattttcttttggggggaccccacactgctcaagttgctggagccccaggggcttgcagggctggccctggtgggagggaaggagtctgtccagggttggccagtggggagactgctgggccagttctttatctagaaattgctctggaatggaaagacgtgttcagttgagcacaggatcagagaaccgccgctgggaaataggcgcctctgtttaccagccctcccgggctcctttgttatctgtgacctgggctcccggtggcttcctcctgagtgacgggagctctgtactgctgagccatccggcgctgggctggctgtgtctgccaccctaggccattagtccggccatttggtttataaacacagaaacgtggaccatcattaccacgcgtctctaatgatgccttcacttgttcaactgaaaatgtgtcagggaagagacgctacccccacccaagaattatttttgctgttacctttgaacattttggtttttgttaaactctgggcccagaaaggctttggagtggagcctcccctgcatccatcaccagaagacggtatttcggagctgtggtcccacaatggaagggtggggccagctgtacccatcatccctgggggtgtcctgttttccctaagacagtgaggggtgcatgggtacatgggtgctgccttggaagctggctagtgcaggctcagagggaggaagtaggttaaaaatcagctaaggaaggagcacggttggatgcctctctccattcctgaaggagcagcagtgtggttctgcacatcctagagccggggttccagggaacccacaggggcgcggtgtctgtttgttccaagcagcatgtctgtggttgcaggtctgaagggattctttggagagaagggaacagaaggtgacatcggcttccctgggataacaggcgtgactggagtccaaggccctcctggacttaaaggacaaacaggtaaaatctcccgcagccacacagccttcctcaggcaggccctccggagaccccagaacaaaggcggtcaacattgtcaatttcctccaatcacacccaaccctggaagctcactcgtgcctgctgccagcttaggagctttcctcagtgctgatggcatggagagaaacaaccacctgggctggggggagacctgagaattggagagaagcatgggggtgaatgagaagtgcctcttcggttgagcctctgtctctcatatagaagccgacggtttgtaagggatccctttgcttgcattgaatatgcagaaacccctatgaacatcctaggttagagaaggagagcggacagtgggctggcttcccacgctgttgctgctgctgctttctgtgtttactcagcaccggggaatgccaagaggctcatctctccaggcactgcctcagggtcctctccagacgtctatttggataatagggcgacaattaaaactacacgctattttctctctggcaaggctgagcaaatcctattgaatttgtatgtggggtctaagaccacctgcatccccagcttgagggacagttctaatctctcctccaactggcactgcggcccttccggccctcggcccctcccagagcggctgcccctcctgccaggacctcaccacacagcgcccaaggtgtcctgtgtgctcagacttaatgctgtgttcacccccaggctttccagggctgactgggcctccagggtcgcagggagagctggggcggattggactgcctggtggcaaaggagatgatggctggccgggagctccgggcttaccaggtaaggtcacgtaaaacacgtggtcacccagacccagagtcgtgggctgtgcaggaggcaccgctgagcaggccagcctctctcagggcgacttctaaggcccatacgagagcaaaggcaggtctgctgtggcttacggtggtctgcaccaacatagcagcacagggtatactggcgccccaggcaactgggaatcaagccagatgcacaaatctgcccagggcttcacctcccagaaggatgaatgaaagcctcccagagaggcttcagggtccacttgtcatcgccacacagggacgcacagcaagatcagggtgcaggagcagcctcagtgtaccactgtgctgcacgggccacccccggggcctccttacagccccgagacgggccaccctgccatgctcactgcccatgtaacagaaggaattgccacctgtttgctgtgtcctgctttagaaatatttaccctcagaaatccagagggaatggaaatgacaccgggctatttgttccaagcagcttttacaaaccaaacatacagcagtggcgaggcgtcaagaagaggcatgggacatgtcactccccaggccccttctggcctagtgagtctgttaaaaagattctatgaagacagtgttccagttcaatggtgttcctaggtaacataagagtgcttagtttacatgtcgtgtaagttgagcgtgtggcttagctgcttcctatttgtggggctttagcaggattgtatgggtgacagtatcaggtgacagtttcagagccaacaaaacacatctgagttatcttgagggtttctcccacccagaaccccctgtgctgtcccacacatgaaataacaatgagtgacacccccacaggtgaaataacgatgagtgacacccccatgggtgaaataacgatgagtgacacccccatgggtgaaataacgatgagtgacacccccgcaggtgaaataaataacgatgagtgacacccccgcaggtgaaataaataacgatgagtgacacccccgcaggttttccgggactccgtgggatccgcggcttacacggcttgccaggcaccaagggctttccaggatccccaggtactctgtgccgtcccagccccgagtcccacgcagaggtgtcgagggtggggactctgtgctgagtctgccctccagacttcagggaatggagggtctcagagagcagggtgggcttcctgaagtgctatgcgatcggccgtgaggggcgggtccgggccctgtggtcctgtacgctgctaagatgtgatccctaagaatcggtttctcaaggcagttgctgggttgaatggactcatcaggcttttagacggagagagaaatagagtccttgctttttcagcagcaccgttgggagggtgggatgcacctgcgcccctcaggtgtctggagtgttcactctgcccattgcctgtctgtgatctttcattttgttggcctaaggaagccagcggtttccacctgcccctgggcagttctgatgctggagacagtgatagcgcttgggcacccacaggctgggagccaaaaacaaccaaaatgggtttcctcccagttctggaggctgggatcagcatgccagcgtggtcgggttctggggggggccgcgtcctggctgctcgctgtgtcctcacgagggagagcacccgctctcccctgtcacttcttataagggcagtaaccccatcttggggccccaccctcatgacctggcctaaccctaatcacctcccaaaggcccctgctccaaatgccatcacactggagttagggcttccacttaggaactttggggttggggagaatgacacaatcagtccatagcaaggtgaaccaagggcttcttaccacaggaaaaagaaactaacaactttcatagcactttctggcttattttataaactactgtagcacacatttttccctgaatggggatataaagactcattatttccaaaagccaatggcagaataaggtttccatcctgagcccttccagggtataataacagcaactggatgatcctcaaaaggatcatcagactttcccacagaaggcctccctttaaccctgtcctccccaagaagctgagatagcatagtgcaggaaggcttggcagcttcttggaacttctttattttaaattcagctattttcatcctaaattttaatgtccttgtcttttcatttaattttgaaatctattataggactaataaaataacatttgaaggacatcaggcactaagtggggaatcattttattattatgtctttttttcaaaagataaccttgttttcttttcaatttatacaaattatttatgttcagtggagaaaaaaaaattaacacatttaaacacatttaactcgggaggctgaggcagaagaatggcgtgaacccgggaggcggagcttgcagtgagccgagatcgcgccactgcactccagcctgggcaacagagcgagactccgtcttaaaaaaaaaaaaaattaacacatttaagaggaaaaaaagacccataatcctaaagctgcttttagaatgtgctgtttgtagacatttcatataaccaaatattgctctgtctacaggtgaatttgtatgtgtgtatattacacgtaaattcacgcactcctgcgtcattaacactccattacagttccagtgggcgagtggcgggaaatcctcgtcaagttgtcttgctgtttcctgccatgatggcgatgagcacctgataggagaagggggaagactttagatagtgtttactttgaaaacctaattaagcatagcctgaagagaagcccccaggagcctagaggcccgggaggggtcccagctccttgacccactgtttctgtgaatttgaaccctctgatgggcctcgatcctcttatccatagagccaagggcttccactgtgatctctgtaagatcccttccaaatctcagctcctgtgacctggaggccatatattgcaatgcaagctgaaatcaccatggctgcctctgtttctttgcttttgaggcaccccaagctgttctttcacttaggaaagtcaactgtatggttggaaacaccgacatcagctgctgttataactcttccacaggttctgacatccacggagacccaggcttcccaggccctcctggggaaagaggtgacccaggagaggccaacacccttccaggccctgtgggagtcccaggacagaaaggagaccaaggagctccaggtgaggccacacattccaagccaacattgccgtcccagtaaccagaacccacccagaggtggggccatggagtgtctatggggtgggagaggctgtgcagaagtgcaggaaagagctggtttttctggggaggactacctgttgcaggacctctcagctagtcttagtttgttaggcaatttattttatcccatcagtgttagtgaggcactgaccacccatcccgtggagtaactgataagctccctggcctagagaccccatcagatcctctgtgcgcctggggcactggcacaggccttgccataacaagcactctgggtagtgaatgtgcgaataaatgcattaaacctcctagcagagccacgctgacccatacttgggtaggaaatgcccagaaacttgtcttcccaccccatagcctccctgctcaccagccaaggtgggctcaagtctaaatggcagtgagaaacattcctagatagaaaccaggaccttcctgggagccagtctgccaagggtgttgcggtctcattgtgcatgagcccacagccccagagtctgctcctgagatccatgggcccctcccccaccccgcccacctcaccagcctgaccaggggcatctcctggctcaggtacgggagctgggcagcacacctggatggacagcctgggcaccctgggctccatgctggcaacagaaactctggcttccatccacaaaggcctgagtttttctagtgccaattccccatgaagctagaaccagacatccacaggagaggaagtcaggaccaaggaggccagcaaccctggcttttgctggggtgcagggatgtctcgaggcttgcagatcacatctcactctccaggatctgctgcctgccctctcccctcaccagcagctggaaactccagaatcccctagcctcagagctccacagcactgatctgaagataggagaaagaggaggggctctgccaacaggagccagactatcctgggaggctgcatggtgctgccagagccctagtcagggtgaggatccaggacagtccaccagcacagcctcagccagcggtgaggatctagggtcagtccaccagcacagcctcagtcagagttgaggatctagggtcagtccacgagcacagcctcagtcaaggatgaggatctagggtcagtccaccagcacagcctcagtcagagttgaggatctagggtcagtccaccagcacagcctcagccagcggtgaggatctaaggtcagtccaccagcacagcctcagtcaaggatgaggatctagggtcagtccatcagcacagcctcagccagggatgaggatctaaggtcagtccaccagcacagcctcagtcaggggtgaggatctagggtcagtccaccagcacagcctcagtcaggggtgaggatctagggtcagtccaccagcacagcctcagtcggggtgaagatctagggttagcataccagcacagcctcagttggggtgaggatctagggtcagtccaccagcacagcctcagtcaggggtgaggatctagggtcagcacaccagcacaagctccactgaggagtgagaatctaaggtcagtcccaccagcacagcctcagtcaggggtaaggatctaggacagtctaccagcataacctcagccagggatctagggtcagcgcaccagcagaagctccacccaggagtgaggatccaaggtgactccaccagcacaacgtcactcaggggtgaagatctaggtcaatccaccagcacagcctcactcaggggtgaggatctaggtcaatccaccagcacagcctcactcaggggtgaggatctaggtcagtacaccagcacagcttcagccaggattgagggtctagggtcagtccaccagcacaacctccactcaggactgaggatttaggtcaatccaccagcacaacctccactcaggactgaggatctaggtcagtccaccagcacaacctccactcaggactgaggatttaggtcaatccaccagcacaacctccactcaggactgaggatttaggtcagtccaccagcacaacctccactcagggctgaggatttaggtcaatccaccagcacaacctccactcagggctgaggatctaggtcagtccaccagcacaacctccactcaggactgaggatttaggtcaatccactagcacaacctccactcagggctgaggatctaggtcagtccaccagcacagcctcagtcaggggtgaggatctggggtcagtccagcagcacagcctcagtcaggggtgaggatctggggtcagtccagcagcacagcctcagtcaggggtgaggatctggggtcagtccaccagcacagcctcagtcaggggtgaggatctggggtcagtccaccagcacagcctcagtcaggggtgaggatctggggtcagtccaccagcacagcctcagtcaggggtgaggatctggggtcagtccaccagcacagcctcagtcaggggtgaggatctggggtcagtccaccagcataatcctcccaggagcccagcagtagagttgaccatgcccgtgacctttaaatcagacacctgttgggttcttgttctgcgtctcacgtgcaccatattttcaccatgtgaccttggccatggtattgaatgtctctggctttgtctgtcaaatgaaaataaaaatgcacttgtgagtattgggaggatacaatgagatactacaggtaaagctcttgcacacaggaggccagcaataaatgtttgctatctttaaaggccttgaaacatagcgttgttttcagagtgtcatgatgatcagtttaccagtctgtcacctgaaaggcatctgggaatgcagcaacggggaagacttggccaggagatgtggagaggagatcccgcacagggaggggcggaggaaactgagatgggatttcgacagggtgcacacagtggcccatagaggggggtcacagaacacagctgctagcattttgtatgaccatgcattgttaacgtttgattcacacagcatgatgttcaggccctgtacttgaccacaaaaaagatttaagatttccatccccaaggacagagatttatctcatttattttccacttaatacctcagcaaaatgcttgtccctgagtaagtgctcaacaaatacttgctggagaagaatattgtgaaattgtaggataattttctgacatcagtggagagttacgtgtagctcagaacacccctaaggtaacattgatggccttattacacatttgatctgtgtgggacccatttatcaaaactctccgtgacctcctgtggccctccttgcattccatcccagggacctggacggtgtccccggcttccaagccaccgtgcggcatgctgacttttgcaagccatgcccccaccctcgacctgcatgaacgtcacagtgggcccatgagctgatgacttcagagcaggtcctggaggccagggcagacactgcccagtgccattgggccttggcatatgaggccactgcctctggctagtgatgagggaaagacgaccttccatgatgacgttcacacactgatcataatgtcattcaggacacacactcttctctcaaaatatgggaataatttgaatccgtcatcttccttcgcatgagttgcatctcatttgtattagttcgttctcatgctgctatgaagaaataccagagactgggtaatttataaaggaaagaggtttaattgattcacagttctgcatggctggggaggcctcaggaaacttacaatcatggcggaaggggaagcaaacacatccttcttcactggcggcaggagagagaagtgctgagtaaagggtggggggaggccccttataaaactatcagatctcctgggaactcactatcacgagaacagcatgaggatagccacccccgtgattcaattacttcccaccaggtccctcctacgacatgtagggactttgggaactacaagtcgagatttgggtggggacacagccaaaccgtatcacagctcactgaagctagagtctgcaacctcacctatttctgcagctgacattcgagcatcagttcctgatttggccttgagtcatgcaacatgggccttcacggaacccctgttagtgagactcttttatgtcagtacttaggacgatccatgggggctactgagaaatcatagcggtttccgtctagattccagcaaactgactcatgtttgctaagtgttctcattaacagtcctcatcactgcagttaagttaattatgttttcgtgggaatctgccagtctgcggattgcactggatcatctaactcaggagtctgccattatttactgacactcaccatctgtttcgggtactttgtgacaatagctagaagcagttcaattggtgtcattttatatcaaactacagatggtggctcactcatgccctcagggctaatgaacccacttgcatgttgtctgtgatttgtgagacaagcctcacctctctaaatatttatcctgctgtttgttttgtcctacttggaagcacgcatgaatggaatcctttcccctgggatggataatggataccaggatcttccaaagggaaaatctcttcctgctgctgatgcgtgtagattagtcataaagccagaggggaaacagaaaaccactgttgctaccttttctcatttttatagatttgcactgtttcgcccagctcactatttcctgcagagcagaagtgatgccctccttgcccacttggacattctgacattttgcagggttctaatactaatcttggtccccagcccgaggtaaaacaaaaggctgaaggtgcttaggagagaaagtagacttaatccgcccactcaagtccacactgatttctacccaccactgccctacagcacataaagctccattagtgtcttgttggctgacagcacagggaggagtggaatttccacagatttccttatgtggccatttccctcttactctcctactagtgccaaagagctccagcctttgacccaaaaactgttggttctcattattcgcagtagttatgttctgaagtcaccaagaacactgacttagtgaatactgaaccattgctcctaggggaaatacaaggctaagttcctgcaagcctctgctcacaagatgtttgtcaatgatcagtatataagctggttttctgtgtaacggcaccttgtttagtgtggattgctgattcaggaacagtcaacatgcactcactcgtgcctgaatgcagcttctcttacatatgtgtttctccataagggacttcacagccttcttgcacttaccaacagtaggatgcacttcaacacaatacatggggggcatttgaaacagcaaaatcaccagcataaagcacaaaaatgtggaaaacagggcactacagagaccaagacaaggacacgtgtgtacagtatgagctgcagcaagaaggcaggagcgtcaccttgctggatctcagctgggactcattttgcctctgtgtatatctgtgaatgccagtgttgatttgggggggattccaagtgagttttagtgagtggacaaattgggaaacacagaatctgtgaataatgaagaccaactctatccaagctgggatccgaggcactggaggacagccgcagggagggttgacaatagtgatgtcaattgtaagcctcatttgcaatttttcaaccttctgtccatcacctgtgctgaccactgtccacacatatcaggatcagagtctgaccagctgtgcctcgcctggtgctgaggctccatctaagcatgatcgggcagcgccttggggaagtcgagcacaggcagacaggatcccagtggagggctcctcacaggagaaaggctggggtgggggaggggttcacatagcccctgcccccccaaccccgccctgagggcctccccagccccaccatgagatgttccttggcctgagggcacctcccatcactgtctcgctcgctaggctctggtccaccacaggtgatggtgtggagggaaaatagtagatttgaaaagttgggtgctaacgctgaaaataatttcttctgttttcatcctaaggggaacgaggcccacctgggagcccaggacttcaggggttccctggtatcacacccccttccaacatctctggggcacctggtgacaaaggggcgccagggatatttggcctgaaaggtaagcaggacttatacatctgtgcttcgacatctctaggggcaggagctggcaatggcccgcttaatgtagggggagaacagacgttcatttccacgctgtgcccagactccggtcaaagaggcaggagccatgatggctcctcctgtgtcatttccatcacctgcacgacctggtccctgggaagctgagacacaggccatgtcatttacttgctgtaatagcagatattcaaactgcagggggctcagaaatgtgcagtatgaacggctttcttcttcctcactgtattgtgtttagacaagtattaaatttaatttgcacttcctaatcacgaacgagctgaatattggaaagagatggcgtaaagatgaagtcacccgtcaaacaagtgtttgtgcgtcaaggttcacagcagcactactcacaagcaccgagtgctgaaagcaacccgagtgtccatcaacagaggaattaagaagcaaaatgcagtcagtatccacccagtacaagaggagtccgtcttttttgttgggttgttttcttgttttttgttttttgagacagccttgctctgtcgcccaggctggagtgcagtggcacgatcttagctcgctgcaatctccgcctcccgggttcaaggaatttttgtgcctcagcctcctgagtagctgggattacaggtgtccaccaccaagcccagatgatttttgtatttttagtagagacagggtttcaccatgttggccaggctggtctcaaactcttgacctcaagcaatcctcccacctcggcttcccaaagtgctgagacgacaggtgtaagccaccttgcccagcctttattcggtcttaaaaagaaggaactcttatcacctgctaccacctagatgacccttgagggcattctgctgagtgaaagaagccagtcacaaaaggtcggattctgtgattccacacatacgaggcccctgaagtcatcaaattcatagaaacagaaagtacaatggctgttgctgagggttggggggagagggacacggggagtgcgtgtataacggggacagatttcagtttaggatgagaaagttctggagctggtcggcggtgaaggtgaatatattgaatgccactgagcagtgcacctaaaaatgattaaaatggtaacttttatgttctacgtattttacgacaattttttaaaaacatagacaaagtcattccatgccacagacttgccagagactgtcgcctgaatgggtgacggtgcacctgactgcccccaggggccttggggccctgtttaaaccctcctttcttgtccctaatgccaacaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaaggtaacagtgcccatggccatgggccagcagccctggccacagtgagaggagccccctccccacagactttcgtgtccctaacgtcttgtttgtgttgcagggcccaggggtgaacaaggcttcatggggaacactggacccactggggcggtgggcgacagaggccccaagggacccaagggagacccaggattccctggtaagtgaccgtctggtatcttcagagctagtggctcagcccagcctctccaggcttggggacatcctggaggtcaaacggccaggatcctctctggcatgggtcacatgttgtaaagagcagggaggaaaccaaggctgtgcctcggatgttgtcacaggaccttggggaatggagagcttaatattcaaacggcaggcgctgagtcacggctcaggcccgttagtgtctggctcatctctagaaagcacagttgtctgggaagctccaaaagaagcctccctggtgagaaacgcagtagcactcggagcaagagagtggaacgaccttgtgtgtttactggggcctctctgtttcccttccaggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggtagagtgctgagctggggcctggagcccctcggggctgcccgggcaaggccagggcctgctggcattgcgtcctcttgtgttctctttgtggatcgccggccgtgccaggcgtggtcagtttccagccataacgcttctttggtggcttgcaggtttccgtggggctccagggaaagctgggccccaaggaagaggtggtgtgtctgctgttcccggcttccggggagatgaaggacccataggccaccaggggccgattggccaagaaggtgagtgacagtggggaaggaccttcccaggtcctagtgctctggatctgactcacagactgtggtctgcaggaaggggacacacgagagcccagaaaagccagaaatgaggcgctgccccaccctcctgctcctaatctgggcgtagcagctacactcctatgcccagcagaacacctggccccgagtcctgggacagcctccctccttttcctgggacacctgcggtgctgtggagtgggcggcagggatcagtagacttcaagggtcaggattagacaaggagccaaaagaaaccgactattaaaatgtacaagagccgcactgcgaagccctgtcttacttttttttcttttttggacagagtctcgctctgtctcacccaggctggagtgcagtggcgcaatctcagctcactgcagcttctgcctcccgggttcaagcgattctcctgtcttagcctcccaagtagttgggactacaggcatgtgcccccatacccagctaacttttttgtatttgtagtagagacggggtttcaccatgttggccaggctggtctcgaactcctgacctcgagcgatccgccagccttggcctcccaaagtgctgggattacaggtgtaagtcaccgtgcctggtcgtcttattttttaaaattatttgcacatatacagaatgaaataggccaggaataacagctattcatgaaaaaaaaaaacctcaaaatttgtcttaatcaacctgagctcagtttgagccaatggtctgagcattaaaattaaaattaaaattaaacataggggccgggcgcggtggctcacgcctgtaatcccagcactttgggaggctgaggtgggcggatcacaagggcaggagatcgagaccatcctggctaacacggtgaaaccccgtctctactaaaaatacaaaaaattagccgggcgtggtggcgggcgccagtagtcccagctactcgggaggctgaggcaggagaatggcctcaacccaggaggtggaggttgcaatgagccaagatcgcgccactgcactccagcctgggggacagagcgagactccgtctcaaaaaaaaaaaagaaaattaaacatgggtagtactattggtgtccaagtcaaaggaaatagcagtcccctgcccctggggacagatccgcagccggcaaattatgggtagtgtggggtgcacctgaaaacaaatgccagcaaatgggagcccgcccagggtaggagacaagctagggatggtggaggggaagtgtcctgggagaaagggccatgaccatgggtgtcccttggaaggggaggggacaatgggagaaagggtcactggggatagctgagaaatattcacagagctgctgtgctggaggcagatgagccacccccgtgtgctcctcgggtaggagttacaggaggctgcacgcagaaagaacattctaacccaggctgtggtcaagtgcgcagtcagcatggcctgcgatgagccatgtctcctggaagtgtccagcggagggaggccactgctgggggtgggggctggcctgcgatactcctccggacacttccaacgccaggcacgttgggcacatcctgaggggcacatgcctacctatggctgactgagtcttttatggaaaggacccctcctctgtgcccagtgccctcactgccatcatttcatgctactgagaacaaagtgtggatcaaatccttcccaagagtctcctgatctcaacagactgagccccaagatctggggaaggagagcgatggttctaggcgcacctggaaactgccctgcactcctgggtcccgaggtttctgtggggcggctgtcaagggggctgctctctctctctttctcaggctgcaggtgcactaggccgtccactctctctctctctcaggctgcaggtgcaccaggccgtccactcactctctctctcgggctgcaggtacaccaggccgtccactctctctctctctctctctctcgggctgcaggtgcaccaggccgtccactctctctctctctctcaggctgtaggtgcaccaggccgtccactctctctctttctcgggctgcaggtgcaccaggccgtccactctctctctttctcgggctgcaggtgcaccaggccgtccagggagcccgggcctgccgggtatgccaggccgcagcgtcagcatcggctacctcctggtgaagcacagccagacggaccaggagcccatgtgcccagtgggcatgaacaaactctggagtggatacagcctgctgtacttcgagggccaggagaaggcgcacaaccaggacctgggtaggtacctcccacccggcccccgttgcctgctcagggctggcccggaagtggccaagatcaaagggccacagcgagactcccaaaccctccacggctggtaagttcccctgacggaagggtccatctacattcctcgagtgcagaaagattaaaacggcctttgaagcagaagccttacaaagcccttaaacctcaggaccttaacacagggacctgccttttaacctggtattgacttccgcaggctcccatgtgacccgtctgacccccgacccctctccagtggagaccaccaattacttcacctccttcttgtttttgacccaagttctgtagacttggagtcaggcaggggccatgaggggctggggttcatgtaagactctcccatacagccccccgaggaaaatggacccatggacacgtgtgcatgctcttatttaaggaagcctttgaaaggcattaacgcgacttcgaatacagaaaatgcaatacacacaaattacaagtggaggtagcttagtctgaggtcctctttgagggggtgacgggaagggtctctgggatactggctgtgttctgcctcctcggtgcaggttacatcaggcgttctgcccccgggaagcatgttgctggctcatggtgccttcacattcctgcctgtgcgccccgcctccacaatgagtttctaaagaacaacggggcaaaggccgccaaggataagggccaaaaatagatctaggaacagggccaaggaggcagcctagcaccgggcatgtttgctaaaggtggctgcacttctgggtctgagcttttcagcaatccatgtgaagagggaaacctgcttagctgcagcattcgttgtggccaggagataaaggctatcttagtctccagaagcaataaagctacatggaagggagaagggccaggactccttctggggtggctccttggggtcaaagagcgaccccttggaggccatcagagttttcttggggccagtgctgttaagaccccactaaggtaaggctcacccaaaatgctattccatgaagacgccactccctggtgatccaacttggcccagtatgtgtgagaacttgtagaagaacagagctgttccaaaatgccagtggagtctgatcaaaaagagaaaaagaaagaaattgggaagccttagcctggccctccagtaggtggctaaactccaccaggtgccctggggcgagtccgtgacacacagcctcctgggcctggctggggctggcaggtgcgtcttctagccacactgcactgtgatctcatgacccctccttccacagggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatggtatgtggtatttgcccagttcccctccccaaccacaccctgctggggacacagcaagaacagctgcctttgtgagaagaatcagacacggcagtccagggtgtgcactgcacaagggtagttggcccaggaagcgagcgagagctggaacacagcttacacttggctaactgagccacatgctgggcacagggcttcctccacccagaaagggctcattaatttgccaccaggcctttgtaaggagtgtaaccaggacgaacttgcctgttatccgtcttactaggtacaacaccaacaccaaaggtgcagctgctttgggtttaccagaagtctaaatatatgggagacttttctctagaatcctgatcttatttagaatctatctggaacctagaataccctgaagaaatacctattaactggctggcttaaaatggatatatattcgtgaggaaaattctggaatacctttgggtataaaatagagagcctgtggatactttgaaagccaggagaaggtgcacaaccaggacctgggaaggcaccgcccacccttccggatcgcctttgggtataaaatagagaaccctcagctttggccagattaggtttagcttaacctccaggggagagaccacagcaccatagtgtctcttgcaatattgcctattaaagcagaggctcctcaacttggaatagggtcccgtcccgataaattcattgtaagatgaagatactataagttgaaagtgcgttttcaatttatgatgggtttatctggatgtaaccccaccaaaaatcaaatagtgaattgaatacatattgcttttgcaccatcgaaaactcaaaaatcctaagtctaaccatggtaaatcagggaccatctgtatactattgtagggagaaaagaaagtctcactgaggacagtgggtcttccagtgagtttatttatatgcattataactgtcataactccagctatatggattggatgcccagcatgttaaatatttcataaattatatatatatatatatatatatatacacacacacacacacacacacacacaacataaaatataaattacatagtgattgctaatctttcaaaacaacaggaaaaaaaatccggattctaggaaaggaaggaaaagataaacaagtattggcattttaataggtatcgttgctatgataagttggagcaacaggatgctaaatcctgggcagggacaggcacaatttctacctttccagaagcttatcatggaaggtgactttggagcaaccttcttttgtttcacagtgaccttcagggtgcccctgtgtcaggaagtaagctttggttgctcctgtttttttcactcccgttgttaaattcaaaataaatgagcctctcccttgtgaagggcatgattacacagtatccagaaaggtcaggcatcccctgttccattagcatcaggtttcaaatgactgtcacgagataagcagacattatcctctgcacacgtaactctctgcttacataaatggctgacagccccagcaagcctggaacttgacatccccaaaaggcatgggttgagacggctcctgggtcaggacagatgggccagaagtaccttgacttctgagaacagaaagtccccattgtccctgacaatggataagtgagcagacacatctgtgtactggagatgtgccccctccagatgtgccctgactgccgtctaggaggcaggacctaaaccaagacagctgtgtgcctcgtctgcactttaaatactctttgatcccttctgtgtggtgacaagcatatggtaccactagggctgctggcatctcagcataataagagctgactttggagaggagaggacagcttggctgagagcaactgccccaccgtccccagtgggtacgcagaaggcgagagcagtgctgaggctagcgcctggctcacccttcttttgtccgtgaggatgggtggccccagaggatgcattttctgcattccctacaagcgagcgccacgtgggagggaggacaagggcagagccccggatgcagactgcagcagcaaaagtcattttcctcccctcccctcggtggcctctctcaaagctgctctggcagaggctacaagtatctagccagccgttattttagttcctcttttttcaattctggctactatctggagccctcacagccccttctccaggtcagcctctcgtccaggcaattctcttaagatacatgagctgctatgagtaccaagccagaggtttgtccactgagagaagcacattggaaagggtgcgtgtgcctggactgtgtgcacttatgcacgtgtgtgcataggggtgtgtacacaagcatgcactgtgtgtgtgtgtgtgtacatgcgtgcatttgtgtgtgtgcatgagtgtacaccatgtgtgtgcatgtgtgcatgtatgcatgtgtgtgtgcgcagcaaactcagctcttacctggctggtgccagcctctaagacttctcacattgtgctcccttctgacctcgttctgggagtcccaggtgtctcctttgggcagctcccagcatggcctcagctccttcagaccaaagtgaagccggaggtgccctggaggacgtctccacttcttattacctgctcattagcagacaagagcaggcagctcagggctggacaggcttctgccttatgtgagcagaacactttttaaaggtttttgggtttttttttgtatttaaaggaaagcttaaactggggcccctgcccaaatatatcatagaacagccccttttttccctgcaaactgaactgagatatttctattctaagtaaacagattccaaagcccacttaccactcaaagcctgctcagccaagccaaatggcccttatacaccaactctgggatccaggaggcctgccgtgcgcttccataaaggctaaacatgttgatgcaacagaaagtagaactttaaaatgaaaaaaaaaaaaaggcttccttgaagacctcagccatctcccagccagcctcagaatcaactatttaacaacctctgattgaaaaaatatatatttaattacacaagtaatacatatttattgtgaaaaatcagcaagtacagatttaaaaaaaaaaataaaaccactcatctttcctccctgatcatcagcattttcagagaaggagctgggaggcctggctgggtgattatttttaacttattagcctcagatgccagcctacatcttaattttatttttttcttctaaaaagagtaaacattgtgttatctcttctgccaggtatttttctttgaatggatgattaggcagatgttttgttttgttactgaaatgcagtggattatatctaccgctcgtatctgctgtcacggctctagttcttaccgaacggccagcctggctgtgaattagtgtccatgcagctgcctctgcagcacgtcctggtgcctggggctgcctcctgcagggggcccatgtgtatttcaccagccccctcttgctgaaggcgcattcgcgaggatgcctcatgtccgtattgacactcatggtttgctgttcagtaaaaacaaatgcacagaagagggctatgccctgaccccgtgccacctgcaggctgtgattcctaaccctgtcctgcccccctctctgtgcagcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcagggcctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaa

SEQ ID NO: 537 - DNA, 178274 bp, Homo sapiens
gcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgtgtggtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcaggtaagcacctgggaagggggcgcggggctccgaggggccaggcgtgcgggcccctggttagcggctgctacccaacctcttcctcccgccgcggccccacacccgtgctgggcgaggccaggggctctgtagctctcggacggcaatgatcacctcctgggagccacctcgcccgggcgcgccaagttaacaaagtgctgggcggcgtgcggcggcggcggcggcatcatcccgctcaggaaagtggccatgttccggcattcgcacccggcctgttggggtggcttcgggcacctgctggcgggggaacgggcgcggcgtgaggcaccccccgccagcccggggcccgcgtatcccggtggggtcgttctcggctctcacagggttaagccgcccgcaccagcccagagcccctgagcgcacggagtcgcggaaatggatcaaaccgaacccacctaggcttttttttctttttcttccccgctgcctctgaagagagagaagtttatttcgtgttgcggcccttttagatgtgaatctctaggttgattttagtgtcgtcattcttcagctattacatctggtttgtttgtggcagacagggggaaccgagtggggaagcgcgtgttatactccggccgaaagctgtggggcgctcagtcctgcgtccagtggttaaattggtaaatgagttgggaagacgacccatccaaagtcttatttaaagttaccaaaaataagcaaagcggacacagtctgttccctttggaagggtatccaccgcgcggcatgtgcgagttcagtttcaagttacttgccaatataacccgtgcacttcagaaattgcggtgaaactgggtattgtgtagtgtgtagtgtgctctgtaacgaatgaacctgaagaactcaaaccctgacagggcaatctaactattcctacttgacttacgagaaagagaagcctagacgtgaagttgatatatatttttttctcttttgtgataacttaaatgaccaaagaatatccttgccattttttttgtgttatgctagagcaaatggcttgaatttaattgagattaaagtaaaaactttactggaattattgtgaaagtgaaaaaagacccttttatggatgctgtcatcaatacagagcactcaacatgttttgtcggtgagaggttttaaaaatcttgctgcagagagatgtatcaaaattttaaaagcctctgcttcccctaggtagtatgacagagaaaatagaaacaagcactgagggcatctttaaatcttgagctcagagcttgtccagtgcttcttgatgaggttgaagaaaacagttggaaaaaggtaaggagttttaagcttagcttgatatgttgtgtaattttggggttgaaattactgtaatttttttccctccagtaacctcattttcagattttcctccattacaggaaaatcataaaaagtgatatttttacttaaagtgttttctaaaataatgtcctttggctttggcttgatgatcacttgaaaatggtttatgcaaacatctggacctgggttttctggcaaccttgacattttctctgttcagaatctaaagacatgagtgactcattcagttactgagaaatcttaggcaaagctaattccagtattgtaatatctatccttagtcctcaatgagaggctgaagttctgctttaagcgtaaagcatttgatgaaaggtcaaagtggctgctggaggggaaggctgttggtactcaactgggaggtggaacattttgcatttaagattgcctttctcagattttctgtactggattttcactgcagaaagaaggtattctttaagtgcttggacggccactgaatcctcaagcagatagacattctaagacccctctgtaagcttaaccgttatgtgtgtgacattagccttcgtatcttacagggtaaaacttaagtggcgaggggactgaggcactgaggcacggagagattaattagcttgcccaagatcacacagctgcaagctgagatttgaacaggtagcctttgtagcccaggctcccagccactgagttgtcttgcctcttaggaatctgttgcctactgtttaggctgccatttgcttatggaaagatctgatgtaaaatatagagcagtgatcctcaacctttttggtaccagggactggtttcctggaagacagtttttccacagacaggggtggggatggggggagtcgggggtttcgggggatggtttggggatgaagctgttccacctcagatcatcaggcgttagattctcataaggaccatgcagcctagatccctggcatgcgcagttcacaataaggttcgtgctcctatgagaatctaatgctgctgctgatctgacaggaggtggagctcaggcggtaatgcttgctgacctgctatgccactcacctcctgctgtgtggcctggttcctaacaggtccatggccctggggttggttgccccctgtatagagcatgttgctctctggtaccttagcttatgactaaaggaacttttattttgaagccataatgaatatggtcctttttctgaaacatttactgctagagatttatacccttcccagaatgtctttgagctcatttcagagctaaacattataatgaaaaccattgtgtagtccagcatccagaacttgagttgattcttttttttttcactgcttctaacttattcttaataataccaaacatagcaaaaggaggttgcaatacatttgtttggcaagtttgggtattgaattcttgagttttagtagagccaagcaggtcggtcactatgtgtcattttttggtatctagtagaacggtttatttagataggtattgggttcctctaaattgcccatttagttggtttcagttgatacggaaccttcactaggctttaggtctatcttgtaaacaagatatttttaaagaccatcctagattgagagcaatctatttgttgtttttttggagagcgggggtttgttctttttctcttctctcacaactctggtgttttccaccatttggctggactctggggcaagagtgggctggccgagggtgctccagtttctctcaccccggaacagctgcctgcctctaagatattctttggaagtctatcctgaagcactccgaagccttgcttctgcttctgggaggaattccttggaggactagaggcaacagggggcctaatctgttgaaacttgtgtgtatatttcagggttaataaatctcagctaagaaaattaataaaaattccactgtgaatgagaggttggtcagagactaatgtcttgaaaatgctttatgataacttggaagaatttgagcagatggaaaggagaaactttgttaaggtctccctgaaattagtcatcacttcttacaagcagatttcacaaggtgcttactatctatggtgtgtataatagggttgtcttattaattagtctgatgtttggatctggagaagtaaattaatgagtcaggttttgtataacaaatgatcactttttaagtaattagtgtagcatatgaccgtagagattaatattaactcttaaaatatggaaattgagactccgatggaaaatgtgaaagtgaagttaaaactttatctttttgcctatgtaacatttatcaagtgagaaagtgagaatgcctttaaataagcatttgattgaaagccattagaaggtgagaacttgtatacctttttttttttttctttgggatagggttttgctctgtcatccaggctggagtgcagtgatggaatcacagcttactgcagtggccttgaattcttgggcccaagccattctcccacctcagccttctgagtagctgggactacaggtgtgtatgccactgtgcccagccagttttaaaatttttattttgtggagacggggtcttactatgttgaccaactggtttcaaattcttggccttaagctattctcctgcctcagccttccaaagtgctgggattataggtgtgattcactgctcccagttgccttttgtgttttttttttttaacttactgtaatacacatacagaaatgtgcttacatactttacatcagtagtacttaagagtccagcatagtagatgttattaatgaaagttgactcatggcaatacatataactaggactttgattccccagtttttttcttgctttcataaatctgtaaatcttacttaagaatgacatataaggaaaatatgatctccttccccttccttgagtgcagtctatttataaacaatagcacttggtgctggggtttgttcacgtttgtatgagggagattgtcttattttctgggatataatgcggagatctgtgctttttgggaagtgatggaacgttgatagtgcatccagcatttaggaatgcaagaacaaacattagagccttttgaggatggtgtcctctaactcctcttcagtccaacagccctgtgggtctcttcctgatcagcatttttcactaagacccaaacttatttcctgtaaaccaactgggccagatactcatgactgtctgtggtctgaagatagtagtttatgttttgttttttgttttttttaaattgaattgggtgtgttgttcccagatgaacactgttatcagggcctaaacaaatatttttgtcagggagatgtcacaattgtattattggaaggggattttctctcttagcttttaatttgcattaagaggtgtctgggctgtgggcaaaatagtggctaaaatgaccacttttatttgtttttgagtcagctattgctttttgtgataactgaaaactttagtcttttttgaaggactgaagtgttgagagtttcctggaatgagtggttcactagctgttgctgatcacctggtttattcttagctttttttgcattcaggagtcttagttttcccttgttctccaacttctgtaatctttaagaaaatgaaaggatatttagcagctctgatgacctgtatttgctggattgtaaaggccttattgcattttttatcccttctgtcttggtaaaagttcctgatagcagcagcttttataaaagtttgagcagaactaaggcaaggaggaagaactctaaaatagtgatttttgcttctcagttgttattagtaggttaatcaggagaggaagtaggacattttaactaaaatgggtttctgtttcagttatcaagccaagctgctatttttaagtttgaaaccatttttaaattcagacaggtttgaggattaattgtactgaaatggagctcacatctagtgctttagtgagtatagctaaatgtgcctataatagggaggaagtaaatcatttggtttgatgaactctgtcacttgaggtcatatcatagcttttctgaaagagtgccctgtttaaggtaattatattttatgcagacaggtggatagtaggtatctagtatatatcttttttttttttgagacggagtctcactatgttggcagactggagtgcagtggtgcaatctcagctcactgcaatctccacctcccgggttcaagcgattctcctgcctcagcctcccgagtagctgggattacaggcacaagccaccatgcccagctaatttttgtatttttagtagagacggggtttcaccatgttggccaggatggtctcgatctcctgatctcgtgatctgcccgccttgacctcccaacatgttgggattacaggcgtgagcctctgcgcctggttggtatctcttaaatatcttaatgttaaatttctaaatctaacatactgttttctaaagaagagaaagtactttagtttaaaactggacatactctaccatttgctgcctctatccaggctttgtaacctctttgctgttgacattttgggccagagaattctttcgtgttaagggctgtcctgtgcgttgtagggtgtctagcagcatccttgctgtctacccgatatctgccaacatcactgttctctctctgtacccctagttgtaggaaccaacaatgtctccagacactgctctcaatatcctctgggagtgggaatcatccctgttgaaactgtgttggctgtggcctcttctttatacccagtacatgtcgttagcacttctgtgttttaggaaggattgatcaaaaggccgaagctcaaaaagccaattagcattttttgatgggtgaactctattctttctcaggatgcctgaaattcacttacacatttaggattctagattgtagtatgttacaaaaaatttcaaggatagattatgttcataggtaagttgaaggaaaaaatggaagattcttataatggaacgtaaaaaaattcttttccaattggacgtgtgtattctgagaaaaacattagggtcaggtcattgtaaatagatcatcttttactttcttccagctgaattacaggttggcacttatccagatttattcctcttagcataggaagataagatatattgattaataaggtagtataaaaattgtctgcaaaaatgttttgaaatgtctgcagttttctcaggcagactgtttacttttcagtgtattgtttttatttctgttaattttgatgattctggttacaacattttaaatatcttcttgagatgagaaaaagcagggaaagaaactggaaaataaggagagtggatagagactttcctcctgatcatttcattttgtcctctaaatagcattttttacgaaagtggggtggaggtgggaggttagggaaagaatgaagttcttgacaaataatcttccttcttttgtctccaaggcctctggttttgaactctgctgagtcagctaactatgagtgaaatctgtctgccacctgtctttatagggccatgtgctaagaatggtttttacatttttaagtggtttaataatgtttcatgacatagccatggtcattcatctaccaattgtctctgaccactttcacacaacagtggcatagtttagtagttaagacagaaactggctcacaaaacctaaaatatttactctctggcccttttcagagtttgccaatccctagtttaaactatatttctctattgttaatattggaggcaaatagtattgttagatctgttaaagtagatgtgagttaattaaagacaaacaaaattctcgtaaattggttattagataagcattggtcaaactttgtgtttttagagagtggtttaaaacttgtgttatctacatgtttcatagatttccaggtatccttggggaactttgatgctagagcatcgacatgcttgatgagtttgtttctcttctttcacctgaaggttttgcactgtaggactgctctgggaaggaaggttctgggccatgaactaggcaaaattgatccatagcttcaagactgaaaaccatgactttatgactttttggatctgctgtaattcacagatgggcttaattctgagcccagtctgattgcttgggttagttagtcctgagaagggagagctcaggtataggtatcttcttcataagctgtaaatagaagatggaactcagccggtctctgggatcctgagcgttgctcagcttggaggcagggtactttcaggttgtcagcagaggtactggcctgctcttctgcttatcaaagagcagttcttgctaattttcatcattttcttcacttttaaagattatatgtcactttctttgctgtgttgctgtgacacaggctaacaccccatttgtgtcctcacagattttagtatcatctttaaattgcagtatactgagtccgaacaaaatgggggtaatgcgtctcatcgagtagtattaaggttagtgttaagtagagttttttaagtatttgtttttttgcatttaaaaatgtatgcatttgtgtatttttcacatgtaaatggatttaccactggcctcctttgcaggtggtgcctttggaagtccagagaaattaaatgctttttccaagagcagagaagactctaaatttgaccctgtcctatgttcttgctggtgcacttcattggcttcagtgaggagtccggagagctgggactttaccaatgattttttttttcttttaaacatgtaaaaggtataaatgcacatagaaataattcaaatgacatagaaaggtacacattgacaatagaatccctctcccttttttccccatctttagtccactcttctctgagtcccacttctgaccatttctttatgttccatgtgtggttccttctttaaatatatgcatatacctctgttttgatttttgtttcaattttgagctattgtttccctttataagagatgaagaatttaactcaataccccctactcttcccagtttttaaaaaagttttgtattcaatttctgtttgatatacattaacagctttcaatgatgtaattgcatttgttttcttgattcatcaactttaggcctaaagtgactccccactctgtcagtcaaggaatttggtacttctcagccttctcccactcaatttctcttccttctcatttctcaccctccctcagccatcagtttttttacatcaacataccttatatcatctacatttcattctgtgactgaatgtgttatgtactctgactataggttggttacaaaaattgaaaaccagtaaacaaggatacggaattttaggtaggaggaataagttcaagagatctattgtacaacatactgattataattaataataaagcatgtagttttgaaaattgcaaagagtagattttaagtgttctcaccacaaaaaagaataaataagtgatgtaatgcatatgttaattagcttgatttagcattctacaatgtatgcatttttcaaaatgatatacttgataaatatatacaatttttatttgtcagttagagctcgtttggaggttccagcaggggagtgcagctccttgtatacccttgaccgaagacccgtcctccatcagggatggtcatcctctacgactgagcatgcagcttcaggaggggctcacatagagtggtgagggaggaaggggacacccgcctagccagccagatcagccgaatcaaccctggcgatcaatggggtgacagatttcgcagccagatcgccctcacatcctatttgtcagttaaagaaataaaaaatgttaaaaaaaagaaaaccagtacatagtgttttcaattttatgatattaaataccatgcagtatatgtcaggtagtttggcttcataagaaggagggataatcttgataattacacctgtgccacttgaaggaaatattctgagcattagagcaagtggagtctcttatattccagctggtgagaatcatgctatatttcagtttccttaacttctggaccatgacttcctgatatgtagtttttgttttttctgtctatttctaattcctttccctttttgttagcgtcagaggaaatagaagttattgattcctgtctcttgaatctcattatttaaaaaatcattttacaactcattatgcaccaacattttggtcccttgtgcctactcaggattgaaagtatgaagttttgccggtttttttttttttttttggtcgttcacaattactgtttcctcaaactgccatgcttcttctagaactgatagtgctttgtttcctttgtgatgagaagcctttcccttcagggtgaggacttcggggctgaagatgtactttgcagcagttcccttctgtttcttcataccacagatgtagaggaatgtggcatttatgggtcctggccttggtggtaacattttacctgtagagcatcggaacattgaagactgagaatgtgaatcattcttagaatcattttctacataaagtcctgaattggtgtttttagaatccagtgaagcagtcattcttttaacagtcaccagcattccagaaaagtcatgaaaaattcaggcacagaattgtagagtaggctgggtccttccaggtcaggtaatttttagtctttgatttttcagataagggcaccgagtcacacataaactagacctcagcaatttgcccagtcacaggatacctgggacatgcatcctgacttataattcactggccttccactgtactatacccatatccaacatatatttgaaaatttactgggttaggtaatatggaaattgtggtagacatatgttacttgttttgaaagaactttttagttatttagggaaacaaaactgccgtttgtgaaactattagagccagttaagtgctattattcattagaagttaaagaggttagaatgttgcctggcatatagtaagtgctcagtaaatgctagttgttaccaatggacagagatttgtagcatacctattatgtagcaggcactgttctaggttctgggaatacaggagctaagactaaaacaagagtcaatgatattattttacattcctgatataaagacaaaggccttaaagagaactcaaaaacagaaacaagttttggtgatggcctggcttaagttgactaaaggagagggtaaagaagctaagctttccctatgggacgatactttgaagggagaaagaaaattgctagtgtaaagtacggtgcttatgaaggctttgaatcctggaggagattggcttgatttagaatctttggtgcctgtgaagagtagttgggaaaacactgtaggtagttcaggatcagattgcaaattgccctgagagtttgtctgaagagttatgagttagatggtagtgaatcactccaagttattgaatataccaggaagctgcttgagaaaagcagtgtgagagaattaattttgtagaaaatttcagacctggaaaggagctaagagaatattcaatctagattattctggtagctgtgtgtaggaagattcaagtaggaaggcagctgagaatctgtttgaggtaatatagacataaggcagtaaatccctgtaccagtattgaattggctagaatcgggaggatgaaaaatgtggagacattttgtaaagagaaagaccaaagctttttaacaggtttgatcaagggtaatgatgagtggcttgaatcagaaaatttctcctacctttttccattggggtgttggagactggttgtactatttgcagaaggagatagggacaagctgatctggaaagtcaagttcatttcatttatgatgacgtggatgttagtggaaataatcaagtgggctggaaagccagtgagagatcagggaagggagatgctgatctggtagtcatcagcatagccgagaatgaatgagctcacttggggactgtgcttagtgagggcagggccaagtacatttctgataaccaaaagctgcacatcttacattaagaatattttgtagcagatgttaatgaaataaagcagcttgtgttcaaattgtcagaaaccagcagctcatggatcagcttacctaagaaaagataagatgatcagaaggaaggatttcaaagaagcgttttagtagagtttaaaaaagacccttctcatctttggcacaaatgataagactaaattattttttttctgggttaagacagaacataaattgtgtgtgtgtgtgtgtgtgtgtgtgtgtgtgtgtgtctgtgtgtgtagggaggatgggcagcccggtggtggagagggagagagagatttattaaggatcaaaatgcaacaccccaaatagggggctgaagtttgaaagttgttctgaaagtcagacagatttctgagaataccctccaaactgcctcttgttgatagtaaagaaaaactcccttctgttgggctggtaggtgaccccatgaactggagaagtaaaaactgtctttgaccctgggctacctctggaaaatttgtagggtcaaataacaacacttgatgtataggatatttcttgctacttttaggtagaagatccaaccaataattgttttaaacaaaagagatttgagaagaactccagaaatttgtatccttaactcatctttgataaccaatggtatgatatttagaagtttgctattaatgtatttttatgtattatgttatgtcttactactgcatttgttgcttctgtgtctcaccttgcccttgtagaccagttgttacagatggatttttataaagaaaggcaataggaaagaatttgtaaaactttagagtctgtagtgcttgtataaagagtagtttggaaattcagaatttataataattcagatgagacttgcctaaatacctgtcccctgtcaataagaaatagaagggacttattcaggagatgattagtataaataaggttgaaggggggttgattatctacttaatacaaccctgccttcagaggctttccaaaactatttctgtatgaaaaacgatctcagacatgtcagttgcatttattttaataggccaacactgtttaggttgattactgacaattattttctttttgttttgaaattgtttgtcaaaattacttgtttaaaattataagatgttgacagaacttttgttagcatatcctaacatgcaatacatggcattaattcatggtaaatgtgtttaggtagtgtgaatggatagtgcctagtaaccttgtgtacaaagataagcatttgtcaaacatgtaagacagattaccaacatagaccagcaaccattgcctatatgatgtgttaacaacatgaccctgtttagctagctgagaattgttaaggcctgaaagcatatcacatgaaccttcatgcaagttcttgggtgggatacactgttgacagattctgtcagagtgctaagcataagaatataaattaaaaataagttttagaagtaaagtcggtgtggtttttaaaaaaaaatcctgcaaagaatagtgttccatagaacagattgggaagtgctgaattaaagaaagagttctgttagtcaacagttaatatgtttagtgccacttaattgcagttattaaatggatttgtaagtaataaaactgcattttattaaaattttataatctacacattttgccctagttatacacccttcttccactcacttttaagtggttatctgttttgcatagtctcattttatgtaatagcttgatgtctaaaatgttgcctcaacaggaggtagtttctgtgcagccatattgggctggtgcagatagggccatatggttctaatctaaacatacatctggaaactcatagggtggagctggtgctgtctcctggaacctgtagaaaacgtcagcaactggagtcctgaccacatttttggaggagggtggtgagggaatgagatgctattatttgaggtcagggcttggatcctgtgtagtgattctggcagctactaagttggtggcccagctgcagtagtcatgagtcccttgagtgctctgccagaacaagggatgttgggcttggagtcccagcttttcccttcacagtcatttggcactcttacctgcatctgagcagcctctgttactgtcatacctaggcaggtgtgagatttatgaaaaatgatttgcctgggcaaagagtatattgcttctgcaatttggtaaggtattctgtagctacgtattttttgtgctcacatcgtgagggcatttatttctttgaatggacaagtggctgcacaaagacaaattgcacaatttggaagaaattcaggcatgttaggctctgagtctggaaaataccattaaaaggttatttataactggcttgtggctcattgacagacaggtggagatacatacagaatcgtggccacagccccagttcacactctttttggcctcagcactacacatcttaaggggtggagtgggcgcttggagggttacctgtcattttatcaagcccaaaagccttcctgttaagttccagagatctgactaaaggcagggtttttctgtagagattgaatagtggttgactgaccagggactgcagcaataacgatgacacccctgctggaaatacagactctcttttaccaaatcgcagttcctatatttagctttaatgcggcgcttcttaactggggatgtgtgagaatcgcctggtgagccattttaaattataaaaggcagatctctgcgcttttctaggtaatcccatttgttcccattgcttgaaattcatatttattctggccactcaagtttatatatttagccctgacttctctcttgagttccagacttgcatgttcactgacaccaccattcagctatctaatagtttcagaatataacatttgcccttctgtctcctccccagtaactggcttgtgggcctgttcctctaaaatgccacccataatcctcccccttgccctagcaaaaaactcaatgccaattttttttcctttcctgcccctcccattcctaactcatctttcttgtcattctttcatgttccttcccttcctgtccaagctaccatggcttttacctggcaaactgcagtcttttactccatatgccctactgtggctccagaatggcttaaaattttttaattgattgattctaaaactcagtctaagataaagatgttgatgctgctttttctgaaaattactttgaaccataaagggtgactctgtcttttcttaactcctttattcaaagttaggtgtagagccttgttagaccaaattatgcccctggaagacagtttatgaggttgcacggcctcaccctccattgcttgggctcacagctccttagggtcatggctctccagctctgatgatggagatttgggcaagaatttctctaaaaaggactaagcataagaatataagctttatttttgtagggccaactatttgctaagtatattagtttcttattgctgctatcaccacaaacttagtggcgtaaaacaagaaaaatgtgttatcatacagatctttaggtcagaagtctgaaacaggccctactggactaaaataaagatgtctgcagagctgcattccttctggagctccaggggagaatctgtttccctgccttttccagcttctggaggctgagtgcattccttggctcaaggctgccttccagcaatagcatcattctgatttcttgtgtcctcacatctccctctctggcctgactcttccattttcctcttttccttatgattacattgggcctactcagatattctagggttttcttcccatctgcaaagccttaaaattaattacatcagtgaaattccttttgtcatgtaaggcaaggtattcacagatttcagggattattaggacagggatatctttgactaaacattattctgcttactgcaccaggcgctatttaaatttacttgcatatactaactaatcctcataacaaccctatgagttaggtattattctccccattttacagatgaggaaactgcagcacagagaagttatgtaactttgaacttgcccagagttacatagccagtaagtagtggtgccagaattcaaattttggttggcttcagagtctgttcttaattatgacacatactatctggaggtgcatattgtagtacccttcaaagtgatttttcaaaagccatacttttactatgtagcagcagctgcaataatactttcttcactgcttacttgttggcaggtcctgtgctaaattctttcacagccagtccaagcaatggatattagtatctgcattttgcccatagaaactgaggcccaggattaagttacttccccaagatcacatggccaataagtgcggaaactagtattggaagccagatagcctgaacaggagccaatgcttagccattaagctgaattgcttccacctttatctggtgaaggatgtcattaaagataaaggtaatctttgctcttacatggtgggcacatttgatgacataatcagagtccagaaagaacttgatgtgttggagtgatatgttgaatctaacacaattagatttgaaggaaaaaaaaaacataaatgaaaggtggtatagatcctaagtttcagatacatgcatacactttggggtaaagttttgtttcttttgaatgctgctatcggtgggtatattataaacatatatatcttctacagctcttataactagaaacttgatttggttgagtgcagatcttatatcactaccatgataggaaatagtccagaattatcttggggttctttttccaaacttccttcactccccacaagaggtgaaaataatagtctcttgagccaggttagtgatggtagtgaaaatggaaaacttttgattggactgtacagaatccataatctttgctctagaaagggagccacatattgtattctattcaccaggtcatggttgtcatcctgtggccaacgtgggtcccattctatgttatttcccaaacagcccatgaaaaccaccctattaattagctctttccttcccattcttacctactttttgggatgcagtgaagacttcttttggattttctttcttcaaaaatggtgtgttttgtttttatttgtattatttttggtgtgggtttgtatgccaaaacattgaatacttagaaaaaaatgttacatgccatttttctttctttccttcctttttttctcccaataaatacctaaggtcctgctgtgtgctaggtaggtaggcatcagggtacagtacattgagtaaaacagctatggtgcctgttgtcaatatagggattcatttagtgaggaaaagagggaagcaatacatgaataaaatagataattgtaataacactgtggaggaaacaagaaataaattgagataaaccataacatgaggaggcctgttttagactggctggggaaggctatgcagaggtgacgtttggcatgagagttgaagcattatgtaaacagagaccatgtacaaaggttttagggtagggtggggaggagctggcttggaacggagataagatgaaggtgaagctaagttgagagaaagagatattcagtccttactgactgtggtgtacaatgttttgattttgagggtgcctaactaggtagagattaaagccctttactggagatctgaggactgtaggtgtctttttgaggaggatgatttttggacttaagtttgaaagccaatttgaggcatcaggcaggtatttgaatatatgggtctgtttttcaggggtgaggtttcagcgggagatacaaatatgggagacatcatggaatttaaatcatggagtggatgagatcatgtaagagagtatagagaggtaagaggctcaagaagctaaccttgaggtgctctaacatttagagcttgggagagaaggagccagcaaaggagactgataaacagttggcaggaggaaaacctagggcatgttgtattgggaatgagtaaagaaaacatttccagagggaaggagtgctccattgtgcctaatactccctgagatgacggataaggtaagggcagagtgcttttcatcaggcttgaaacatgggagcctctgggaactttacaaggtcagttttggtggagtggtgagcagatgctgattgtaatgggcagatgaatgaatgggagtttgtaaggaagggggataatgagtagagagaaacttttgataatcccggtacatgaagtgggtggggccctggaggggaatgggaatgtaagatgttttattcagggttctccagaaagacagaactgataggacacacacacacacacacacacacacacacacacacatgagaagggagttattaggagaattggcttatttgattatggagactgagaagttccactattggccatctgcatctgcatgctggagaaccagagaagctggtagcaggacttagtctaagtctgaaggccttagaaccagagaagccaatagtggagctcagtccaaggtggaaggtgcaagagcccagggaccactggtgtgagtctggagtctaaaggctggagaacctggagttctgacatccaatggcaggagaggaaaagcggccaggctcttagagaggatgagaatttgccctttctctgccttttaattccatctgggctcccagttgattggatggtgactaccacatttagggcacatcttctccacttagtccactcacacaccgtctcctctggaaacactctcacagatacacctggggcagctcaataattctaatcaattgctaaaccacctgggtttcactttgagtagataaaggatgggcccagtgcctactgaagccctgaagaataatcagtgtttgaccagctatctggatattcattaatctagtcaagttgaaccccaaattaaccatcacatggggttaagcacaggagggtggaagcacagagtttgacttttttagatgtatatagcatataataaatattaagttcaaccttacgaaattggtgatatttgactatgttttacctatgagaatggcattttcgtatagtttgatctaatagaacatgttacattactgagaatgagttgcttttagaagtggaacttgattgagcaatattgagagggtttaatcaaaagggcaaagaacaaagccttggagcagttgagataaatgggattgttgctcggcagagggttggcctttgaagcagggagaaggaaaggcacacagttttccaggaaggcaggagaagatacacagattcagccatgctggaaggatcacagtgaggccaataccagcgggtagtgtcctatttgaggcaaataattatgtaataaatttacggatttagctgtagatacacattgattgattttgttcataggactgagtggtaactgagcctgttctaccttgtggtagactctaaatttgttctctcaaaggtatttgatatgtgattttttgcttggtttttctctttcactaaaagcggagtaaatcaaatatcatgacctccttccccactcctgagcggtgcaatgctgtggcctccctgtagaactgattagcaaatcaaagaataaagtagttttctcataagtgattttcttgccctacagaaaattgtctttttcaatgttactataagtattctttgacttctcagcataattgaagcattatctatgatttctgtttctttaatgcagactacaagtgcatccttttaaggtcattccactcttctctgtcacatgtacagaatttgcttatgagggtgttcatttcaagaatttcacctgtttggagggagactttattccaccgcataatataattttaaaaatgatgttctttagaccattgtgtgcatatatccctaggccataattttctccatgtacttaattcagtacagaattccaggtactgatcattaatgatatctttaaagctaaatgagattgaaagtcatctttaatggctgtaggatccttttttcatgaactaactcctctagctaatgtttattttgaataatactcttatccatggattatgggaccaaagccataataaaaatattcccaggaagggttgtcttcttattcagtgtgtacttgttgagctataggcagttttgctgtgtatatggctctaaaatgatcttttcctcaaagtacagaaagatctggagaaatgtgggcactcatgtattaagtttgtagtattataatattgtaagtataagataaaatgtggtatttttttttttttgagacggagtctcgctttatcgcctatgttggagtgcagtgatgcgatcttggttcactgcaacctctgcttcccaggttcaagcaattcttctgcgtcagccttccgagtatctgggactacaggtgcatgccaccacacccagctaatttttatttttttattatttacctatttttttttttgagaccaagtttcgctcttgttgccgagcctggggtgcaatggtgcgatcttggctcaccacaacctccgcctcccgggttcaagtggctctcctgcctcagccttccaagtagctgggattataggcgcctgccaccatgtccagctaattttgtatttttagtagagacggggtttctccatgttggctaggctagtctcaaactcccgaactcaggtgatccgcccgcttcggactcccaaagtgctgggattacaggcgtgagccaccgcgctcagccgctaatttttgtatttttagtagagatggggtttcaccatgttggccaggctggtctggagctcctgaccaggtgatccacccatctcagcctaccaaagtgctgggattacaggcatgagccaccgtgcccggacaaaatgtggtatctttaaaagctctgtggtgatggcattttagattaaggtaatgttttattttatgaagatgtgtagctgtactgctggcgagatgaatcaacatgttctaatactgcttgtaataagagtaacttgatttaccattacctgctgtggtaaatttgtatcttcagtattggaattattcaacagaatctatcagaagggatttcaaaagctgcagtctgtggtgttgtgataagtgaagaaaagcatttcccctatttcagacagcctttgatagcatatgtatttaggaaaatatatacagattcatcaactgtacctgactcaaatatttttagcttctttgggttgaactttgggttatgccaagggatcccctttcgtcttttcatggagaatcacttgtaaccaatgttgatgtgcacttacaaagaagggtgtaaaggtttataggacgatactactcgacagctctgaggatctggaatctacatggttcaactagcttctctatttgagccctgaactagtgttgcactcatctcccatttcctttgctttgccatttccagttgtaaagtgatgtgtgctccctctcttgcctttcactggtgcagtggggcttgtctttcaggatgggacctgtgctaaaactttttcttgtctctgtgtatgctgataaacaggctttagagttctatcttgtggtgacttatcaccccaccccatcttagagatgacaattgcctttaaaggactatagttttaatgtgtagaggggctctttctgttatgtgcttctaagtagagaggcctgtgagagcatctttcaggtctgagaaggtacatggctgtcttgtgctcctttcttctctagcatcaggctgtagatattcacccctagtgttgtattgcccccaaccactgccacccccagtgatttgctgctaattttggctactttttttttttttttaattccaaaatctgttgcagtctcttcggacttctgccaattctggcatagtttgctcaaatgattggccttttcttggtagatctcagtctcttaacttctccctttccccttgttgaactgaccaataacctgtgagtataaaccttatatcttgtgtgttatatggtctttcatattttttcctaaagcatatcatgtcatacatactatttttaaactgccttttcaccacttctgaaaatacctttccttactttatcttctgaaaatacctttccttacatttctattttaaaacaatttatatttctaaattttcagtggctgacatcccttccatgataatgaatctatcgtttgaccagtcccctacttttgggcgtttggatattttctatccttttctcttttctcttcttccttctttcctttctgctttcctgttatttcctggtaatgagtatccagagttgtttgttcaccatgcatgtagttttttaaaaccttaatgtgggttttttgaggcttttgctagttataacatcaccttgtgtgttcaaagacaggggcccgtatcttatgcatgtcttcctagcatacatgcctgacacagtggccattcactaaagaattattgttgagtttcagaaatatgagggccatttgacaaataaatgagtaccttctatgtacttggaacccaggatataggggtgaacaaggtaaagattgtccctgctctcataaggtgaggtattattttgtataacgaggtttatgttacagagatggcaaccctcttaatgtgaggatcaatgaaaaaaatttaagacacacagtatagcaaaagcagactgaatgacttcgggtatggttacttgggagatgttcatgcttatggctgaattgactaattgatttttccatagatgatatttcttatttaggattatccactagtgttaagggattgagatggaatgatctttttcaagttcatacttttttgacccttgtgagtaactccagtcaattatacttaaattaaaaatttcatacctgaatataatatgctgttgtacagtgattccagggacccaaagatattttaggactgagtttggggggaacagaaatatttcccaaaatatttttggtctttctgttgcacgtcttaaaatatgattaagcaaagattgcagccgcggagaagattttctgctgtaaattggtgtttcaaccctgccagctgttcatgctttctgcgatcccacttataaaagtggaaagtgaagggtgagtggctgccctcgtaggcaaccacataatttaaaaaaaaaaatgtgtatgcctcagcagatctatattagtatttcatatagctgcctttttcttttttattgtagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcaggtaatgtatacattcgttaataatcactggcctttttttttttttgttctttttaagatttgacctgatgtctgttctgacttggtaagttgcttaaactctttggattctagtttctctttttgtaaagtattttgattagtcacatgaacattaatgttctgtttagtgataaaattccataattctatttctctcagtttatcttactattttatacttacgtgaatacagtctttttgtatgcttttcaggtcttattttctgtaatagttgaaaacctttaaaggtttaaattttgccagagatttttttttaccttcctttggagaatacaagaaaatccatgttcttattatatatcagttgtacattatagattttgtacaaagtaaggttagacttttttttttttttcttaatatccttttgcaagagggaagggaaatattctagagctgtactttccagtatggaagcccctgtctgcgtgtggctactgagcacttgaaatgtgactaatgtggcttgatatgtgctgtaagtgtaatgtacacacacagtgtttcaaacttagtgtgcaagatatcttaattcatttatatattgattatgagttaagataatattttggatatactggattaatgaaattttaaaattaatttcaactgctttgttttactagaaaattaaaaatttggtttgtattatatttctcttggacagcgctattatagagggcaatggagtcgaaaaccagcattggaaaggacttctgcctttcttaaactcagagtgtttcactcacattggctctgcaaattagggcaaggctgtgtttaaccttgtgccttagaccagaaactggattttgggggaaggatcctaaggggtaaatattttaaagttggacaaaattatttggcttctggcctcgttttcgaatatgtactttccactaactgctgagggcagagaacatgatatgatcttgaggtcgtggctcacaggccaagctggaagctggggacagtggagctggccaggtcttgcacctgcaacctcatcagctagagtgtagccagattctgataggatcagaatcctgtgcttacagggatagctgtttctgtgaggtttggctttatttagttttttgttgagtacttcttgagtacctagccttgttgtcatccatgataagggaacagcaaaaaaaaaaaaaaaaaattatttttgttgtgtggtctaaatctgggctggacagaaaggagttgcagagcaaccatggaagtcaggcagagcaagtcaggagggtactgggagagctgcaggactgaaggaagaaacagacactgctaacacatcctcctgcccagcttgtttccaaagatttgtcagcttatccttgagaagattttattttatttattaaactcatatattccatagggagataaatattattggcttaaaatactttgtattgactttcatataatttgtttggcctttaaattttttttataacttatatttggatgtgatttttgcagtctagttttaacataatttaaattttacaaaaggttgtttggttgtgttgtcacatttaatattatagagactatgaagaacaaaagtaaagttttagtttttttcccaccgttttttcctttgcatcccaacattattagccagaaggaatgctgcattgaaaagctagaaaacaataggatacataaaagctaaatctcaattttaaaatttttctcaatttttagatgattatgcctggttgaccctgttgtagttttacttctaggataagataggtagatataacatatgctacatggcagaatagctatagatagatatatttttgttcaggcatagatttttaatatacatgagatttactataaaataaagatagcacaaagtaaaatatcattttcagaactgtttttgaaaatgctgaaatatctggtcataatcaaatttcatcagaaatttttttcatggttctttttctataaatttctattaaattgttttggaagtaaagtaggagaagaaggaatagaatgaacttttttttttattagaagcggatgggagggattatttgtcagggtagttttgtagcacaaatagcatttcaagcctttgaatggtgatggaatattttctactctaaactcctcaatgtctacagaaatagttttattttataaaatacatatgcagagtatagcagtgaataattttgagcaaatatttaccaacattaaattaataattgttaaactttaattttttttcttttacatttttagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggtaaaatttgcacttcaaaaagacaggaggttattaagtttctttaggcctagagtcttttaatgagaatctggtagaggccacttctcaaatttttgagacattattctctgacttttaacattaatatattccttttatgtgtcattatgttttagtgttctcattttatcagtttatgtgccattcaaggatagtatctgtgcagtatgaaatggtaataaacaaaaaagaagggcttgcctttggggacaaaacagtatatagttttaagagactgcttgttcattttagtaactttttaaaaaatattgcataggaaaattatttcatgtctatgaggtctacttttagaaaaggcagaatactcatgggaaagtttgaatctttaaaataaagaagcagtattaaatgctttaagaaccttggtgttgattggtttcaggcacatacgaatgtgagtctcagctctctgtatttatcagtgttagatgactttaggcaagttacttaatccctctgagaccaagttttttccctggtagaatgaggatagtagtatctgtttcaatagggtgcaaagtgaaagaatcatgtatggcacaacagtagctgctatcattattgttactgcatatgatggcgtttatttattgggaccacagattcctcccttcccccacccctgaccccgccctgccaagatgaggggaagttgtttcaattataatgggacataggatttgatatacatatttgttggtttgagtacccagtcacagataatttagttgcagcatttttttttttgtggggattggagaggggggtgtatttccaaagacttattttgaaggagtgtgttacttttcttaatatctcgatttcatgattactgtcagaagcactggtaacctaataatttgaaggtttttttctttgcttccagcattcatttatcttctacttacattttttccccattagtttattggcagatattcctatttttctattttgaagacaacaaaatatgttactttaggtctggacacatgatttagtgaagcattttttttgtgcgtgtgtgctgcttttggatgtgagaggtagtctgcaagcttggatattgaaatgcttggatttctagactacagtgcaatatttagtgtgcactgacatgtaaaatatatgaaatcaatattctggaaatttgtgatgagcagttattacacctcaccttctgacttgatttccctatctttgatcttaatgtctttatcttttcctacatatacctgttagtgttatgttttcctcatatatattttagattgtctttctccttaatcttagcctgtaccttttaaatcaaaactcagggaaggctgggcatcatggaaggacttcagggatttggagctaggcagaatgaggcaggtatcttggctctgcggtgtattgcctgtgtgtccttgggcacattgatttgtgtatctgtaaaatggagatcatacaggtggagtaacatcttaagccagggttagttataaagtaattataaaaggtgatgaaaattacatgtaatccaaatttctttgctatttattcacttgagtgcagattagttagtatatttgcatttaggggatgcatatgaaaaacacgtatctttgattactagactcacactcagtgaggtgaggtgctcccacttaatgtaggatctagatggcttatggcactgcagattttttttctctataaatctcataatcacttgactattcaattattgagtgaaatggtggcagagccacttgtaatatctaagttgttctcccttctctttctgccaatcatgtttagtttaattcttgttacttaattgggagagtgatgtgattccatagtgtaatcttccttgtaggcttataaatatacttcaaagtgtgtcttgtgagtcttcctcatatgaagcccacttcttcccttttcttgattttttaaaagacctttattcttttcctttttctgcaacttttaattctcaccaatctcatttcttgttattccatacatgggcacttaactgtaataataaaatccatggtttactgggcagaatgccaaatgttttacaaacatttagtgcatacgcatgaaggttagtgccatgattcacgatgaaggtgttaccaggttacatagctaacaaggggcaccagaatactttcctgacaatttacctggatctcccactaaagtaaattctagcggcaaagaacatatgcctcctattaaacacactctcctcatggcctagctgaacacttggcatatagaataattgccaaataaataagacctctttgacctttctcaaagcccctccaccacatactcatactgcacacacacgcctccacgcttgcaggtcttcgcagatgtaaacatttacagcacttttacttggtctcctcactagaatgttagctcattaagggctggaactttgttttattcactgctgtgttgggaatgcctagaatcataactggcacatggtactgagtcattagagtttggttaaataagttaatgagctaatgaatctgactcttcaaactaggatgaaacatttgacttattctttggcgtaggcttttcttttaagttccctccttcctgatggctacttatttctattcttaaaaaaaaaaaaacttatttaaagtactcttttgtaattttatgtactaaaaacaggcaataataagctctttgagggcagggattgccctcgatttttagattttttgtttgtttgtttgcattactattcctgcttagttagtaggtcatcttctgagtagacatccctagtaagtattcctgactataatctcttttggtatcctagtaactatagctgaatctttttgtcttagtaaaagatgttaatgaccctgactctcaaacccttctccacttggaaaaaataattgtcagaaacaaacattttaaaactacagtgatttttgctgtcaagcaaaatgctagagagaagaatccactgacttaataattttcactattccttaacttaacaaaagtaaaatattgacaaataaattattctgtgaaaaactgaattattcacatcatgaaaagccattcttttttaatagaggaaaaagagaaaagtgtgttcacatacactgcaagtcaaaatgtgacactataatgggaaatctttgtataatactcctaaatgaatgtgcaattaggcagtgttctttctaaatgagatttatagagatttgtttgcattttctgcagcaacaatttaaaacaagctttagcatagtagtttgtttcatcggtggattttcgtctattgggaatagaaatatttgaaatagatttttaaaaattttctatatttagttccccaactttgtgaatttatgttgctgtgtttttctatatatagatatttttctttttggactgagttggtaatatctctcaagaaaaggtaaatttcaaaatatgtttgtattttaataaaattccaaattatgttacagtctgaaaagatctaacaattgtcataaaatatttaagtgttttacatgagtaaaaactgaattggaaaagaattgtgaagtaaatgctgataactttgtactgttatgcttttgaaagttttgaatcatagaccatgaaattaaatgttagttgattgatacatgttcatgttgtatttaataagctgattaaaacacaattacagcacctctgtatctataatcttaattctttgcttcccactagttaaactgctgaaatatttggttaattttacttcaaagaagtcacagtgtgtggagagaagataaggtatactaaatgaaagattggacagcatattgttagttaagcaatttgtgaaatgaacattagaaaataatcccccttgtggtatgactctaaaatagtaggaagacctaggcccaagagttacactggaaaataattttcttttgtacatttgcaattcttttgtagaactttttattgactcagagggtgattaggactttttgcttttttgtgtgtgtaaaattaagaaacagatgtttgcatttagtattatgataattatgtatcctctaaaaaagtttgtaaaaaaagaataaaaacatgaggaaatcagtgtaatatttccaaatatttctattcaaatattttcaagtatagttagaatttgaaaatagttctggtcagtcatagttggctaatatctctattaggggtgtccaatcttttggcttccctgggccacattggaagaaaaattgtcttgggccacacataaaatacactaacaataggtgatgagctaaaaaataaaatcgcaaaaaaatttcaaaatattttgagaaagtttagaaattcatgttgagatgcattcaaagccgtcctgggccacatgcagcccgtgggctgcaggttggacaaacttgatgagaggtggtggagacttagaagtctggttgctaaaggaactttactgatcagaatgagatggtcatcggaaggagaagttgtacgtgaacactgtttggagagtactttatttggtttagctactgcaggataaagtggattgtttgattttggctgccatgatgggaaattttagtttctggagctaaaatcgtatgcggaacaactgagttctggcatttattgcctgtacggcatcaggggagttgcaggtctttgttattttttactttgtgtgattttttaaccctgaaaagtggtaaatgaagccacatttaacaggtgagggcagcgaggctaagttagggtaatttgttcaaagtcagttaatttaattataaattctcagaggttggtgaattgaagctcaggattgcctgattgtaaaatctgtgttttttccatttacctctttttattgcctcttaagatactttatttagttcaaattattctatttcttttcttcttgtgttgtaggcattagctaatttaacacatttatctggactttgggttattaatagggttgtcagatttagcaaacaaaaatatagaatgctcagttaaacttgaattttcaataacaatgaatagtttgtgtgtgtgtgtttgtagtttgtgtgtgtgtgtttgtgtgtcccaaatatcacatgcagcatgcttatactaaacatttatttgttgtttatctgaaattcagattcaacttggctgtgcattttatctgacaaccttaattgttaagaaaattgtagcacttgagttaaatggcgctgtatggctatttagaattctgtttttagagatctctaaaatatgtgtattgagattctgttttagaggaagaatagatggtttggtctctcattggactttattctttgaggagcacatatgttaagcagctgctgagaaatttagatgatcattaaatagctcttctttctcctcagtttcagttacctttgtctgtctttcaagcctgggtgcttcaaaactctccagtgccctggtaatacaaataattactaacacttagggaattattatgttctgtgcactattctaggcattttacatatatcacatccattactcctttcagcaacttcatgacagagtctgtaattaccctcccttcatagatgtgggagaagtggcaggagagagcataagtgatctgttcatggcagggctaggtttgaaatcaagtgatctttttccagaaccagtacttgtaacagtttttaacatattgcgttttttggataattcttctgaaaccacaggctgagcatataggagggaagtcttttaagtatttccaagccaaatgtcaactactttagtattattaaccataaaaaagatttttttcagctatcttgcaaaagtggacatctcactgcactatctcctatccttcttttccttctgatttatcttaattgaaatgaatgtctctgtccctaaatactatattagtacatgagatagtgagtgattttcctgattgccacattttctacaattagaaagtgatttacaagcaatattttccagcttttgttttgttttgttttgttttttgagatggagtcttgctctgttgcccaggctggagtgcagtggtgcaatctcagttcactgcaacttctgcctcccaggttcaagcaattctcctgcctcagccacctgagtagctgggattacaggcacacgccacagtgcctagctatttttttgtatttttagtagagatggggtttcaccatgttggccaggctggtctagaactcctgacctcaagtgatccgtccgccttggcctcccaaagtgctgggattacagacttaagccaccgtacctagcaatattttccagcctttaagttggtttcttttagagactttgataatttgcccagtatttgtctaaagctaagtagccccctcgtgtaccctaagagtaacccaccaaagaaagtcacttttctttctaacagtgtctgtcatattttagacagttttctcattatttcaaataaccaagctctgtttggggaagacttactatgcctgaagtattgtcagtcagtgttagatgctcatagatgggatcattaatgagggaggggaggagctttagcacagatttagaaattatcttggagattgatcacacaattgcagctatgagaaaaagtatgcaggtcttctaaggggcacttagaaaagcaatataataaggggtcacagttgtacattgtacgtatagggctgcaggatgaacaaaacgcctgctgtcctaacaataatgcaaataggttcctctggtgtggggtaaaatttccagtgacagcatcttcatatggattcaaaaaatgatctctctcaaatatcttcattgaattaaagctgatatgcttagaaaactattaaatgacactgaatcaactgagaaaaacaggttagattattttggaaacctgggttcaaaagcatttagaggcatcagcaggtttctaggttttccaagtctcacagatctctggaagcctcagcttcatctgtgactgtcttcttaccctctcttggaaacttagtcgattactaagttctcttcattttgtctccttgacctcttatttccctctgtttatttcaactgcagtccataaccattttttacagaattttgcagtggtctcattttctgtttctctgcttctactttgcctttttagtcttcacactcttagtacagttatttttgaaagcacaggtcagaaaaccctcatgtcctccctccaaagttctctgtaagaaacaggaatggtttagaaggttttcaataatctgtctcccacttctatttttatatttatttctcaccatatttgcatcatgtaccctgcaatgcagccataaccaacttcctgtcttttccatatgctcttccctctatttggaactaccaccctttttctctctccagatgatgactaatctaagaatctttcttcttttcttttggtaagactttaccatttctttatttccatggcattttattcatattttcactgtagaatctgttttcatttagctttattgctttgcccttattagatgcaaggtacatgtttgaatgaataaatcagaacgttaattaaaactctttcacagtttatcagggaggaaaagcaagcttaacttataatagaagtgttggaattaaaattaatcagcagcgtatttgagtaatagtaataccatttaagattgtatgttaccccataagtatatgactagaagttgcagttgaatattgaaggattaaggagtgatggaagaaacctgttcgtcattttttcatagaaaataccttaattactagatgagaacaataaacactgaggattctgaaaggagggagagagggaagggggaaagggttgaaaaactacctgttgggcactgtgttcactatttgggtgatgggatcaatagaagcccaaacctcaacatcatgcaatatacccgtggaacaaacctgcaaatatacctcttgaatctaaaattaaaaaaaagaaaataaattattagatgaaaggatatttctgtttttaatgaactttattttaaaatttgagaatatttatcacattgaaatggaaaaaaaatcttgaggcttaagttgcatgtgttgtttattaccaatgtattatttatctggatataattattttttattcaaaaacttttcatgttttcctgaagattggtgcttatttaacttttgagtggaattaatatacttaaaaaatcgttattaataaaaataaaaagaaaagaaaaaatcattattatagcaatcaaaaccatagcagtgtaacagtgctttgtggagcggggtgccttcttagggatgggtgttttaatcatcttagggctcacagatcctcttaaaatataagtattttggaaacttaaagataatggacaatgattattaggtatagcatcagaacagagagtgaacatattaaagctaatatggttgtattattttatctttagtttcatttctagctgaagtaataaatttgcatttgtacttttttcctagtccttttggctatacctttcattcatcttattaagtacttattgaactcttgctcttatatgtttgcagtagatactagattaagtttgagtggtatgtgtgctcaggcctgcttctaaaatttgcaggaactggggcaaagtacacagaggcccacataccctgtgtttaaacatttaagttataaatcaaagaaataaattactaaagaaaaataggtcttctcctcttgcctggagaaatagctcagtgatctagaagaccaaatgtaggtttagattgctgttgctctagttccccactggaatatggtggtgtgtatggggagagccagcctgtggggcaggccagctgccttctcctcccaggcctggccctgtcccaaaccaggaaggaccttgattgaagcggtcctggtgccaggtctacacccctacaaactacagcctcttggccactgtttaggctagagagggtcggtcccatttgttagggttaagtgccctgatggggagagacttataagaatcccagtaggcttccagtctggggctgtttagacagatttctggaccctggtactcagaagggcagggcaggctctgggtcagtttgtcctgtggatttatccaattgaaaggggtgtagtcagaagaatagggaggtccttctagagtccagggctcagggccaggtaactcttgcccacatcctcatggtggtacttagtgtatatgcccttgaaccaaataaaactaaatgttcctgaagagcatcagaactccacataatctctagatttccaacctatggctgagagctcaaaattttaaaaataaattgtgatttgtgaacagttactaggtgcttaattgttcatgaacattgaatgtagacaatagagtttccagctttattggctttttttattttagaacttaaaaaaaaatagtggtatcgaatttgggtttatgcctgctttgtggaacttgtaattatgcactctttgttttaaatatttccccacttatttaaaatagctattagcttttttatgggtggtaatagtgttagaatggaaaagaataaattgaaaggtattcttaatgctgttctagccctcgttcaattttcagggatattccaacagaaagaaaaaaagctgtgaattgaccacttaagtaaatcagtttgcaactcagtgtcctaagattattaaatctagaggtaggaatataattttatgtcatgaaaattcatcccctaccactttttataaaatactatatttctggttggtctcatgttaatatacaattgtagtttttacagtaatttagaaaacgaaagaaccaattcagtgtaaaaggaaatacttgattactctgttgtataagagcaataaaagctaatttactgttatattactcagtactgaaagctgcaagaggctatctttcagttcattcttcattaattatgctgtatggtggtgatatcagtatgagttttatggaacgctttcaggttgacctctctgagcttgtattttggctcatgtgaatgtctttaccatattttcctcatgattgttgaggggtgaatgaagtgttgaaggcaaaatggactaatcaatcactgtgattcctctgtgaaaactcccatgataaactcttttttgaaatggccttagttcattcatcacagattataactgttgaaaataaatagttgtgcttaacaaaaaacatacaaaaaaacttttacttatcaatcttcataaagactaacccttaaaaatttgccttttatgctagattactggagttttattatcaaattaatttggaggcatttcactatttatagttctttagctagtagccagataattaggaattagtttgaacctttaaatttaggtaaaagatatcatgtgatatcttaaagacgataattctaatagaaccatttcatttacatggtccttgttgcacgtgtataataaaagcacggtacagaaatagatttacttacgtacatttgaatttagctcagttttgcaatatgtaggtagatatagtatattcagttaaatattatgttgatatttgataaaataaattcttcccacattgcaatctttatttcttggatggtaatgacgctgatttgttctagggctgaataagtttgctagggctgccatagcaaagtaccagactaagtggcttaaacaacagaaatttgtttttttcacagttcgaggctagaagtccaagatcaaggtgttggcagggttgatttcttttgaggtcatctctccttggcttgttgatggctgtcttctccttgtgtctttgcatggtcttccttgtgtatctgtgttctaatctccttttgttataagtacatcaatagtcatgtaggattagggcgtatcttcatgacctcattttaccttaattacctctttaaagacctgtctccaaatacagtcacattctgaggtggtgagacttcagcatatgacacagatctgtccataacaagggcatagagtgaattcagtgcaaactgaaattttgggtaaccaatatatgttttaagatgtggagcagtttatataagtgttttaattgtatactttacaaattgggtgttcagaatattttttatttcccctttacctaatttaattgtacagatgtgggaaagggcagttaaagactgatgatgatatcagttctgagcacttgatgttttttaacttggtagtgttggtatggtcatcagggagttagggcatctgggttggttggactttctgggctattccctgggaatccagaggtggatcctggctcagtgctctgggggcagtgttccaggttagtactttggtgaagctaggtgggattctttgcagaccaccatttcatgaaatatctttgaggttttaaaaatagacacagttttttttagttaaatgtggaaaaattgaagtatccaggaggtgttctttggtaccaaatcaggttaaaagtgccccagatcaagaaagtcctataaagactatttgacattatatttctatttggcctatagcttcatacgtgccacattgtaggtgctcagtaaataattgtaggatggatgagtagatttcaattaaagcaagaggaataaataagtcatagctgcagtgctcttttcaaaagctcatattcacattgtcagaatagttttgtcttctctgccctggcaggcttttattttttatttatttatttattttttgccagcaaatatagtatacatattaatttaactatatacagataagaaacagccatttggaccctcttactctttaattctctcacatgtaagtttggaaacaatagaccaatagttcagcttggatatacaggaacttctccttatacgattttttagatgggaacgggttattttttagggggtctgctttgcctgccaccagtagacagaattggtggctgtgtacgtttttgcttggccgttttagtagtctgccttgtggtgctatgtttgcacctgttggtgttaaaaatgtttcttatagccaaattgcaactatctttagataaaatttccaggatatttggaaagtagaggaaaaaacaggagaagcaaactgtcaacatctacagttctctttttgaaaaattttacctatatgcattcgcatttgttgtttgattagtgttactttgtgcttctaaggaattgaataatgaacagcttttgggaacaaatgcctgtattttgcagaattctacctctcagtgttcatatttatggtgtaattaccttattggtctgctgaaagcttttaggtatagtttatacttgcaatctcttttttcttagtttaacttatttaatgggtgaagaattttagatgtggcatgagaggataaaatttggatcccctattaggataacagtactgccaacttgtaaacagtgtttagatttttaaaattcaaaaaaaattccttagagataaaaaattgaattagatactataattattaaaatataaataactgctttttggccttaggtcatctatcttatttttctcatttctatctgaatttgtgcagttttcagagtgttttcattgttttaatattagtgggtttctgagtcccatgacaactaaaatggagtttcattaattgaaaacacctgttaaatttaaaaatatgtctatgaatgaaaattctaacgatgtccaaagtaatgcaatggaatgtgactgagttgaaatcagccatacgaattagacctttgtggtatatttgtgtcttgatttaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaaggtttgttttaaaacttttttggaatttggtaatattaaagcttaattgtacaatgaactaagtattgaatttttagatggtgaaaattcttagctttatatttgaaacttaaaatatttcttcacataccgttttcgttgattttggttcatctctgaaaaagccatttgaaacttttccatttaaatcctgtgttccactggaagcagtggcttactgctgtaatcctagcactttgggaggccgaggtgggcggatcacctgagggcaggagttcaagaccactctggccaacatggtgaaaccttgtctctactaaaaatacaaaaaaattagccaggtggtgctcacgcctgtaattccaactactcaggaggctcaggcacgacaatgcttggacccagaaggcagagggttgtagtgagccaatatagtgccactgcactccagcctgggtaacagtgcaagactctgccttgggggaaaaaaatcctatgttacaactttgtcccacaaatggaattactaggtcaaagtggcttaatagtttaaaagttttttttaagtatataattaaagtgacacctgtatagtttgtttcaatgtatatttcaatcttccatatagaaagtatcaatttatttgctttttagtcagcaatataatttttgaagttgttggccaatttgatggttgaaaagtttaattttaattttaatttttgattggtaacagtgttgcatattttctcatacaggttaaggtttttgtgacttgcttattgtactttttcttactgatttgtaggagtatttatacatatactccttaactcatatttttcctcagatttttattttcatcttttagtgtttgatatacaaaattttaacatatttatctactcaaatctgttattctgttttcttcagatattgcttttgctgtcatgttttaaaaagttttctccaatctagaggtcaaataaatagtgctttttttcttcctaatttcattttttaccattcactttttaaaaaactgattaaaaaaaatacgttacgatgggaggttttctgatctccatgtatcccctggagttaagaattatcttataatgaattgttttctttaatttatttaatgtcacttatacagcgcttactgtattagtccctgttctaagcactttacaaattgtaactaataatcttctaaacaattctgtgaaataggtacaattgttatcattgttttacacataaggacactgagtcgtccaggatcacagggcagcctggcattccatgtagtccaggctgtccacctccagaggctgtcttctttgcacactgcgccatcctgccttcctaagattgaattagtccatccttttctagtgatttgaagtgcaatctttattatatttaaatatgcattagtttctgggcattttgacttgtttcatggacttttctgtttgactgtaattgttgtgcctttataatatacttcgttaactgacatttgacgttccttctcatctttttgtttttaatatttttagttattatggatacataatagttgtacatgtttatggggtacatctggtattttaatataagcatataatatataatcagatcagggtcattgggatatctgtcacctcaaacatttatcattttcttgtcttaggaatgttggaattctcctcttttagttattttgaaatatatgatacattattctttttttttttaagcaattgaccaatcaattttaattaactcattctgtatgactatcataggctattaaaaataggaaagcgtgtttcttttttttattattattattatactttaagttttagggtacatgtgcacaatgttcaggttagttacatatgtatacatgtgctatgctggtgtgctgcacccattaactcgtcatttagcattaggtatatcacctaatgctatccctcccccctcccccaaccccacaacagtccccagagtgtgatgttccccttcctgtgtccatgtgttctcattgttcaattcccacctatgagtgagaacatgtggtgtttggttttttgtccttgcgataatttgctgagaatgatggtttccagcttcatccatgtccctacaaaggacatgaactcatccttttttatggctgcatagtattccatggtgtacatgtgccacattttcttaatgcagtctatcattgttggacatttggattggctccaagtctttgctattgtgaatagtgccgcaataaacatacatgtgcatgtgtctttatagcagcatgatttatagtcctttgggtatatacccagtaatgggatggctgggtcaaatggtatttctagttctggatccctgaggaatcgccacactgacttccacgatggttgaactagtttacagtcccaccaatagtgtaaaagtgttcccatttctccacatcctctccagcacctgttgtttcctgactttttaatgattgccattctaactggagtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttaatttaattagatcccatttgtcaattttgacttttgtttccattgcttttggtgttttagacatgaagtccttgctcatgcctatgtcctgaatggtaatgcctaggttttcttctagggtttttatgattttaggtctaacgtttaagtctttaatccatcttgaattaatttttgtataaggtttaaggaagggatccagtttcagctttctgcttatggctagccagttttgccagcaccatttattaaatagggaatcctttccccattgcttgtttttctcaggtttgtcaaagatcagatagttgcagatatgtggcattatttctgagggctgtgttctgttccattgatgtatatctctgttctggtaccagtcccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaatcattggtagcttgatggggatggcattgaatctataaattaccttgggcagtatggccattttcacaatattgattctttctacccatgagcatggaatgttcttccatttgtttgtatcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgtacgttgattttgtatcctgagacttgctgaagttgcttatcagcttaaggagattttggattgagacgatggggttttctagatatacaatcatgtcgtctgcaaacagggacaatgtgacttcctcttttcctaattgaatgccctttatttccttctcctgcctaatttccctggccagaacttccaacactatgttgaataggagtggtgagagagggcatccctgtcttgtgcccattttcaaagggaatgcttccagtttttcccattcagtatgatattggctgtaggtttgtcatagaaagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgattagcgtatattgaaccagccttgcatcccagggatgaagcccacttgatcatggtggataagctttttgatgtgctgcttgattcggtttgccagtattttattgaggatttttgcatcattgttcatcaaggatattggtctaaaattctcttttttggttgtgtctctgtcaggctttggtatcaggatgatgctggcctcataaaatgagttagggaggattccctctttttctattgattggaatagtttcagaaggaatggtaccagttcctccttgtacttctggtagaattcggctgtgaatccatctggtcctggactctttttggttggtaagctattgattattgccacaatttcagctcctgttattggtctattcagagattcaactttttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcttttgaaaaaaaaaaaaaccagctgctggattcattgatttttttgaagagttttttgtgtctctatctccttcagttctgctctgatgttagttatttcttgccttctgctagcttttgaatgtgtttgctcttgtttctctagttcttttaattgtgatgttagggtgtcaattttggatctttcctgctgtctcttgtgggcatttagtgctataaatttccctctacacactgctttgaatgtgtcccagagattctggtatgttgtgtctttcttctcattggtttcaaagaacatctttatttctgccttcattttgttatgtacccagtagtcattcaggaacaggttgttcagtttccatgtagttgagtggttttgagtgagtttcttaatcctgagttctagtttgattgcactgtggtctgagagacagtttgttataatttctgttcttttacgtttgctgaggagggctttacttccaactatgtggtcaattttggaataggtgtggtgcggtgctgaaaaaaatgtatattctgttgatttggggtggagagttctgtagatgtctgttaggtccacttggtgcagagctgagttcaattcctgggtatccttgttaactttctgcctcattgatctgtctaatgttgacagtggggtgttaaagtctcccattattattgtgtgggagtcttaagtctctttataggtcactcatgacttgctttgtgaaactgggtgctcctgtattgggtgcatgtatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaattttccagtctgtgtcttttaattggagcatttagtctatttacatttaaagttaatattgttatgtgtgaatttgatcctgtcattttgatgttagctggttattttgctcgttagttgatgcagtttcttcctagcctcgatggtctttacaatttggcatgattttgcagtggctggtaccggttgttcctttccatgtttagtgcttccttcaggagcccactgtctggcactctctagtgagatgaacccggtacctcagatggaaatgcagaaatcacccatcttctgtgttgctcacactgggagctgtagaccggagctgttcctatttggccatcttggctgctccctgcacattattcttaactatattaaaaagttctttcaatgagtgaacattgaattttgccaaagtgctttgtaattaatttgttaaattcttcgtactccatcaaaaaagtaatctttttggattttgatgaaaattgatgtaaacatttaaagataatttggggagaattgactttttataatttccattggagtttttttttttttttttttttccctcttgataggaggcttaaaatgcttacaggtttgactaggaagtgaagggtatattttctaccagtactgggattaattaactacctcatccaaaggggctagccacatccactctaggcatgtgctgctactggaaccagagttgtcaggatatccctccagttactcaagacaaactagaattccaaaatattatgtaaaatacctagagtttttacactgaaatgttagctattaatttagattaatataccaggatatgcacacatatgcatgcataaacacacacacacagagttgcagacacactcacacagtgctaaacagatcacatcagcatttctgaatctgtagtttagatacactagtttgcaaccttttaaacattaataactgtcttggaaaaccacataagcattgatatttgttttataaaggcaattttttgattaagttttaaattttttgtcaagtgcagtggctaatggctataatctcagtgacctgggaggctgaggtaggaggatcaactgaacccaagaattggaggctatagtgagctgtgatcatgcccctgcactccagcctgggtgactgggcaagaccggaactctaaaaaaaaagttttttttaggtctttaggtgttaccttacttcttgagcatgaaaaatatttcgtattttctaagaaaataattttatagttactcagattgtttctgattttaagaatttatcccatgtgtagttatttttgcttttttgttacttgttttgggaatctgatttttttcttcattttgatttacttaattttgttggtttttgcccaccttaccctcctagaacctgtttatattttaccagtttttactcttgacctatctgctttcatctttcctaattccttctactcactttcactaatgctaaatgagccagtccacttaataagttcatctgtgtgtttaccttttagcaatagtctgactagcttttatgtttttatatgctattttctcattattgtatttttcctacatatttaataactgtactactgttttctttttgacttaggtatgttagaaaaataattttcaatttgcaagtgctattttttcccagttatactttattataaactagctttaatgtcttatggccatagaatatggactgtatactctttttttttttttttttttgagactgagtctcgctctgtcacccaggctgaagtgcactggtgtggtctcagctcactgcaacctctgcctcccagttcaagcggttctcctccttcagtctcctgagtagctgggattaaggcacctgccaccatgcctggctaatttttgtatttttagtagagacagggtttcaccatgttggccaggctggtcttgaactcctgacacctgccttgaactctggtcttgaactcttgaacacctgcctcagcctcccaaagttctgggatcacaggcatgagccactgtccctggcctgtatactttttattctttagagatttttgaattttttttttttttgttacttaatgtgtgatcaatgttgatgaagcttctactggtgtttgaaaaggtggggtttgtagaatatagagtttggtatctgctaattccgtattttacaactactgtttttatcttcgtacagtcagttttgctgtcatattgcatacacgttcttaaaaataatgttatgcaaaattgtgcaatattaaacccagggctcatgaaaaagtatcgttagagtgtagcactctaaaacttcattagtgatgtagacacacacagaacatggaaacctaataaagatgctaatccagttttacctgtgttaaattggttaaaaaatgcataaatatatatgtcagtttaccttgaaaaaggcctaaagtttgcttgtggaagggtgtattggaaggagtatagattcgagttattactgagaagtgatggcaagtaggttagctgaaatcttttggaaagttgaatagcagatgtggatgactgtggctcataacccttgatgaactgagggagctggtagatgtttgaggtgtgtgcgtgtgctttgtgcattccttatacagctttgttcagctgcgtgaagttttgtaccttcatctaatgtttcttggagactaaattgtgcataagcaaggcaaaatttatttcctcatgtaatcaatcacctgggaactcattcccatttttgaaacaagtgtttatggcagaactgactgtacttattttttgctactgttcccctatcagcttttattttttgggtattttatgttttttttttttttttttccattcttgcctgatctttgttggcttctgtattagctcattcattcattcaacagacacttcccgaacgtctactatgggacagggactgcaaggtgggcactcctagactaagatttatttttcttcattgtaaactgtatgtatcatcattgataccatcttttctcttttttataattaatattgttatactaccactcttttgttgttcgtttgcttgagtttgctgtcctttttacttgaaggacagtcagcttggtggttctaaaggctgggaactggaaccagtccgcctaggttcaaattctgccaagtcccatctactgtgtggctttgagcaagttatttaacttctctatacctcagtttcttcatttgtcaaatgaggataatattgaaaccaattttatttggtttttgtgaggattgaattaattcagacaacatgcttagcacaatgcctggcacattttaaaaccccaataaacattagtgcttttttaacttttatttgagactttgagtatttctcctggataccatatgtaatttttaatgctgaagtcttctataatgggagacttttcttttagtttttgtttttttttgaaacagggtcccactctgttctcaggctggagtgcagtggtatgatcacagctcactgcagtctcaacctcctgggctcaggtgatcctcccacttcagctttccagtagctgggactacaggcgcacaccaccacggtggctcatttttgtattttttgtagagatgagattttgccatgttgcgcaggctggtcttgaacccttgggcccaagtgatccacctgcctcagcctcccaaagtgctgggattacaggcatcagccactgtgctcagtccgtataatgggaagattttaactgtaatttttttttctcttctctcttaaagctttcttatataatgcttcattgaaggtaactttttccccatgctcacttactttatttatgaaatttcaaattttcactaagttatatatctaggtagtataacttttcattaagatttccacctatcaattcaaatgtttctttagcttatgtgttctgtacttactgatttactactgcttttgtttcatttgttttagaattcaagtacgttgttattgtgtctctagtctctctttttcatatgcatttttaatttgttgtatttactgtgttttgggagatttttcccaagagtcttccctgccactccctcggttcagtactctggtattgagtcttttctggctttgagtatttggttctaactttacttctgtgctttttgtattgttgtccgtaagtccaagtatttccctccttttttatttatccgtgagcagcaacagctgtatccacacctggaatttgtcccaaaacatggtgtaacttgccttgaatccctttcttttctaaccatatactttcagtttccttgctgtgggtactagttattactggctgaccagcatccacttcacctgatttccttttgggaagtggtctctcacccaaggaagtcagctcctcttccttgttgcctagcccagacaagtcagctgtgacctgagctcagttaatcagcatattatttcccagggctttgaatctttagagagcgaagtgagggctgacagatggagggagggaagcagacacagaagaatgtttactggtcattcctcacagcaccttgcatttgcaagactcttcctgtaataagatccctgtgttccctgcagcatgatttctcattttcctccagccctttgttaagcctggacttttagcctgtcttcagttctgtgtgttcaagacagtatccagcatcagtttgtattgcttgcaaaccagaaagctagctgataggaacttacaacgtctccttagttcctctgttggagaattacatcctgcaagattatatgagaatcagggatcagcagttggggaaggtgtcctggttgtaaataggacagagtgagagaagagaggagctggggctatgagaagatctggaaaaggagtgccccatctatgaaaggttttctgtttctttggtgtagctgctgagcctggggctggctttctccctctagctttgtttttgtgtggcctgtaagccaggtaggagatgtgtgtctgaatgtgctgcttcacagagtccagccacctcagaaggaaactgggtctgctgctggctgcttgtggtcaggtgaggccagccatgcttggctctctcccagcatggcttcattaaggagactgcctctgcagcagtcacagtgcatgggcagagagacttctgcagagggggactcacacaagtgccatgagggcgaagagtctgtgattagtatctgtcccaagactcagctttgcctcagcccttggcccttcagtttaggagctgttgaccgaatctctcagaatcttcttatttatgctgggattccatgctgatttttcatgcagggcagttgcaggtcagtacttgaattatttcagttttacttttaccatatctgtcagaaatgctgccaattttatggcctgcggatggcctgtttctcctgactctacctggatgcaaattttcctcccctctctcttttttttattctgttggttatttttcttaggttgaaccatataaaattgccaatatttgactacttttgatatacaaaaatggcaatttcatgcatcagtccaatattacacataaaatatggtaagatattggaggggactgcagattagaatctagtgctcaatctttgtctcactcagatttgtctcactcagattccttctgagtgagaacagcttttttggcattggaaaatattctggaatacaggcttgatcgtgaacagtatcattttgcttgaaggaaaaatggttttatagccagattagtgcagatgaattctgtttctggtcaagatttgctaaagttctctctcttctagctgtaataattcacttttattcacttattacatttgtttttagaactagggtaatagcattcccccccacttacttgaacaaaacattcttagtgttagttgcttaaatgtatgtttttggaggaaaacttaatagatatttaagtttgctcctgttatttaaattctgagcttgtactaagtggcattactaatagatttttttgtgtgacttctagtgtaatgcttatgcagtggcttttctctttttgaagatgagctatggattaaatctgtacctaaatttgcaagctagctgttgcagagcagaacctgttaattccagcagagttccacgtaagctttcattgtccctgaagaataccaattgattgtgggaacttaacagaaacaaaactcaaatgatccttataatctattctagcagtgacttgtttgattcttatcccctcccccagcagcattattattcaactctataagcttttaaaagtgaaaatctagttaactaaagagagatctacgtaaacaacatctatattttctgtttttttgtgtgatctgaaataatttaatcaattataatcatagtacctactggtaatacatatccagtggatttaaaagaagctgccttccattaaataatcagtgtattgttttctatgcttgttttattttgaaaatgactggtggtgtaattttttaaaactttttaggcttcacatttgaatattttttggctaaatgcagttaaatactgcatgatgtttataatacatcaaaatgtgaacccttattgagagtcaggcagctgaaacattagccttagcatttcctttgactagcacacagcatgttacatattcattgttcctctctgggctctgagatattggaacagcttttatattgcatctgctcttgctattgagaccagtgttgagtggagaaacccacgaattattagaacctaagaacagtttatatattcaccaaagtcttgaccagtttctctttgtggatcttttagtgtgaaaaggggctccaaatgtgtgctgagatgaaggtaccatcagttagtatagattttttatcttcaccaaattggtgggtttcattgctttagcaagaatgcaaactctttatttatataatctttgtactatcttcttacaatttttcccctaggtttatatttaagtgaaccttccactgtcttctcaactatctctgcttgcttcttgaaatcagagaaatatttgatgttacatttttaaataagaatccaaacttaactaatgtgcatcttgggttttctaagaaattggactattaatcttcctaaacagactaattcattatacgttttatacaggttggattttatggtatttaactgaaggttgctgtaaaatttatagagcaatgggaagttacagtgtgtcttgtgatattcagagtcatttgcagatttggattgagtttagaatctaaagatatttagcatttcatcaaagcactgaaagcaatgcaccagggtctaaaataactttagttctaatagttgaagcagtggtttacgtttattttagaaagcatatgttctatccctaccttttcaattccagttcgtcttgagtgagacggctatccttccacctctcattcccttcaaccactggcatctatttatgtcatggagacctgtaaaagccatgagggacttctcaggtgctctgcccatcccttggatactttctcaagcctcagagaggatttttttgcagcattgacatcgatcactccattctcctcgaaattctgtcctcttttggctttgaagtgaccttgagctctttcactttcgggtctattctggcactgctgaccattcatttttcatcacctctctgatttcctcttctgcttacttccccaatgttcctgttctcgcctgttggggaacactgcttagttttcttcattttgcatgcttttccacactgttgttttaattaccaggcatttggactacttccagatctaaagatccaacctggacttcttgttctctagttagtggcaatagtaagagataagcactcgtttaattattcagccaatcctgtagcattctcttgagttaaggttctttatcatcttcattctcctgttgaggaatctgaagcagaggtgttaaggaaagtgcctaaggtcacccagctagtaagtgtggaaataggacccaagccaggcagtcttgccccagaaatagtgggcaaataatcttcacctctgtggtgctctgcctttccacctccctttcctgtgacatccagttagtccctaaactctgtgacttctgcctcttcagtgtctccagactctgacccctgcttttcgtctccattgctcttgtctcgtactattgtgaaaacctccaaatggcctttccatttccagctgtgccacttctaagtgtctgccatttcatcaacagagttagttttctaatatgtgagtcccaccatgtttgctttaaaatgctttgtggtgcttcagtctcaaaaggcacaggccactatcctttgcctgacacatactgactttttctgtctgattcctcccgacttgctcatccttatctccagtcacttcctgcttcacactctactcaggcattctgagccacgggtgtcctcagacacatgccgttttgtgcttcttaggaatttgcctgtgttcagcttggatttttatttttttccttttgtgcagtggataatttcagtcttactcatttttaacactcagctgaaatattacctcatctctgaaaccttcccttatttacttctaccattcattcagcaaatatttattgtgttatgctccagaaatgtaggaggtaagcaagactgacctggtcccagccctcagaaaacagcagggaagacatgtaattaaacacagtataataataaagggttttcttctatagaggcaagaagggggtcttggaaggcctcctgaagcaaatgatattcaagcttaaacctgaatgatgactagaactagccagtcaagaagtgggtgtcagagggcagagaaggaattttaggttgtgagaagagaatggtgattatgggccagggattaacaagggcatgtttgaacatctgaaagatgtttattagacagcagcagttggggagggtgggcagcgagggtgtgtgtgtagaagctgggtaaatcttggccatcagggagatacatatcaaaacttctagaagatactgtttccaacccttttagaatggctaaaataaaaaagatgacaacgtcaaaagttggcaagaatgtgtagcaacagaaactcatatgttgcgggtgggaatgcaaaatgggggcgactttctgaaaagcctccaaagagttttccaaacttaaaatatataccatgtgatctgggggctccactcctagcaatttacccaagagaaatgaaaaaatgttcacaaaaagacttgtacagacattttcatacaggctttttcctagtaacttcaaactgcaagcagtttaaatgtccttcagcaggtgatggattaaaaaattgttgtatattcatacaacagaatacctagcagtaaaaaaatgataaattactgaaatacacagtaatatggatgagtctcacaaatgttcagcagaagaagagagacagaagagtaaatattgtttgatttccattttatgaattctgagaggagactcaactgatctattgtgatagaaatggaatgtcagagtgttttttgggggcagggtgagtgggcgagcatggattggaacggggcatgagggaactctctgaattggtggaagtagtctatattattttggatagtgattacagttgtcacaattcatgagactgaaaatatgtgtattgtatattgttatatctcaattaaaatattttagaaaatgtaatacaatataaacatacaatacaataaatacaataatataatacaatacagtaaacataatgatatatgtctctcttgatatggaaagatgctcatggtataatgttaagtaaattaacttggttaaaaactctggctcccataaccctttgtgcatatatatcaaggtagtgagtttttaaattttattctttaacgtctttcacatttttcaacttattttgaatgagtattttatgaataaagtattgtttactatacagtgaaagatttaaagtacatcccctgcttattaaaactttgcagaaattattgaaccatatgagaaatttatttttatttctattaaattaaattaattaattaattttagagacagggtctttgtcactcaggctggagtgcagtggtactatcatagctcactgcaacctcaaactccgggctcaagtgatactctacctcagactcctgagtagctaggatctacaggtgcaggccaccatgcctagccaatttttataattttgtagagataggttttactatatttcacaggctggtcctcaaacccctggcctgaggtgatcctcctgcattggtctcccaaagcacagggattataggtgtgagccactgcacttggtcccaagacatttttaaataaattttcatgactatttttaagctacagttctgttacttttttttgtttgttttgttttgagacagatctttactctgttgcctaggctgagtgcagtattgcagtcttggctcactgccacctctgcctcccaggttcaagcagttctcgtgcctcagcctcccgagtagctgggattacaggcatgtgccgccacacccagctaatttttgtattttttgtggagatggggtttcgccatgttggccaggctggtcttgaactcctgacctcaagtgatctggcagccttggcttcccaaagtgctgagattacagatgtgaaccaccgcgtctggcctcagttttgttagttttcagtgcttaggagacacaggttatagcatttatagttcagaaaaaaatttagtttaatttactttttaatatatgccccaatatatacaaaggatacacaatgaaaagtaaggtactcagccactcctgtctccttgtcattttgctcttttcacaggaggtaactactatgaccaggctcttatttattttatggatgtatgggaaaacatatgcacatgtacataaaggcataggcatatatattatacaatgatagcatgccatgcacattgtgctggttttttttttttttttttgagtgggtctattttttaaattgtaaataagcataacataaaatttactattttaacaatttttaagtgtacagtagcattacaacatttacatcattgtgcagctgttactaccatccatctctagaactttgtcatcaccccaaatgcaaactttgtacctgttgaacagtaattcccgttcctcttgctcctggcaaccactgttctgttttctgtctctacaagtttgactactctattaggtgccttatgtacgtagaatcatataatttttgtccttttctgtctgccttacttcattcagcatagtatcttcaaggctcattcatgttgtagcatgtatcagaatttctttcctttttaaggctacatgatattcccctgtatgtattgaaagtagtgacaaaaaccacaattacttttgcaccaacctaatacataccacagcttatttatccattcatcctttgatggacatttgggtggtttctacgttttggccactgtgaataatgctgctgtgaatatgagtgtgcagatatctgtccaggtcccttctttccatctccagaaatggaactgctggatcacataataattctatgtttaatttttttttaatcactgtcatttaggtgtatttttttggcagagtaaaacatttaaatattttacatagacataaatatgagcatgataagcattgacatgaaaatggcagtaattctgtatgtgtgcttcttgtatttttgttatatttttatgtcatgcttttttgcaaaatacattataaacatttatgaatttcactagttttctgtgatatcgtttttaatggctgaataatgttctgtcactgtatggatgagttaacttgactaatctcttacttttggagatctaggtaattttttaacttttatctttgaaaacatctgtttgtatccatgatctctatttataatctaattttatacaaaggtaacaaagagctggggggagagggtgggtacagcagtttcatttgactgacaatataatcaacatttagctgtatgattttgtcctctttgttgcctaaaacattattctctagggctttccccaaattgttttagaacaagcaagttgacatgctttttctatagggtatactgcctgggaataatgtggaattgcaccaaggaatcaaagggcagtataaggacatgtgtaatacaagattcgtgcataattttttcatcaccatgctgttttccatactactgtaccattttacatcccaccagcaatgcacagatttctagtttcctcacatccttatcaacacttatttgctgttttattattttaagtaataggcatccctaatgggtgttgtaccgtgctttttaaacatgtatcttggagaatcttttagtaaagtctgttatgtgaatgggacttgttatttaactactcccgattttctggcctcttggtaatatatttagtgtatcttttgtctttagtatatataatgctcttattttaaaatacaatattttctgacttattttcagtgagcatggatgaaagtacatatgcattttacagtttgatagttattgccagcagtatgtgagactacttatgtctacatccttaacatcacagtatgttatacaactttttgatcttcttatctgataggtgaaaagtggcatcttaatgaagttttaacttgcatttccttatgagtgagattaaatttcttgtcatttttatgagccagttatttctgaaatatctgcattgtatcttttgccttttttttttttttgcattatcagtacccatttcttacaattttatgctaataggaacaatcagtgttaaatgatgaacaaaactgatgtgattcctgcgctcatggtacttacagcctgttggaatagaaagatagtagacatacaaatatgcaattaaattttgttgtaaatgttatggaagaaaagttagattttctgtaagataacagttcaggctggatttgggtggaatgtggtggccagtaacagcccctaatgaacctgtaagaaccaatgaggcaaatatttgaagggaaaacattccaggcagatagacagcatggacagctagctgaaagaagggcatgtggctggattgcaatgaggaagaaatgatgagagatgactgatttgccctctgttcctcatacactaatctgtatagatatgtgtcaacaatgttcaaaagtatacagtgagtttctcctatcattatataaggggctttaaaacaaatctttttccctgcctactagatattctccaggaaaggaatatgaatcagacaatctgattagcagaatgtctttaggatataagttgattcattgggagcttctgtgtttttgaatttttcatttaaaatttttttaaaatttaagaatgaaatactgtatgtcatcttgtattatttcctgtttctccagatgtgtcattagaaattcagctggttttctcatgtgaaattaatttgtgattctttgaagcttgctaaatgatgcattgtttgctactaagttgtctgtaacaatttccccattagggagaaaagctctttgagtgtgtccttctgtgtgtgaccaaattccaaatgtctgatgattctacataggggaaaaagtgacactcagagaaaatgatttgcagcttgttgtgctttgcagtaaattctgcattttaggtaaaatgcggaatgacagatatgctcagcttagttttgatcagtaattttcttaagctttctgtatcaaatttctcatcattgaaatagaaacatggtggtattttaatgtcttttaccattagttacaagtcaactcagtgtaaaaagtgaaagacaagtattgttaattttgaaaattagttcctggtttcttagtttctggatttgttagataaacatatacctttgtttcccttacttacccaatatcctttcactttggcctttaggtttcatgtttattaggaaatatcatgaagtgtacatgtaaaatagacagagaatgtcttggtagaaattaagcaatagaccctgtggtgtgggcacatcttttttttaaattttaattaaattttaatttaaattctaatgtttttaattaactttctccactaatattcccctgcttgtcagagaaatagttcaattgatacctgttgaacactgtgaatggaaagacttggaagtgcctgtattcattctaagtaaatttttttatagatacgggtatttctcattacttttaaaaaattgttagtcttgaatgtacagctacaatccatcttcatcttatttttatcatcactaacaacagtggctttaagtatggtccttttttaggttaacatagcttttctgttattgcttgtaaatattttttaaagtatttccagacatattgtttctgttaagacttttagtcctaggttttgtagttatcactaaatgatgatggttattgctatgcttctcagtaattaggttgacaattttctttgttttttggggactatttcttgtttttctttcactcatcagatgcttccttaagtgcttatcatgtatgttctagaattcagggcaaatttgtgtccttctgatgtttttgggttttgttgttgttaatggcaagtgtttttgctcaacacagtaaatattttatatcagaccaaatcttcctgcttgtaagaatcttctggtttattatctgtttttctattcttgtggatggattagagggtaataccctaggaaaaacaggcagttcaatgaaataggagtactcactaacctgattattctaccaggtatcatactattacaatatggtccatattaaaataatgttgtctcttttcttccatgggatgttttgttctatcttataaaagaaactatgctaagaggaactaaaagctatgtgctttctggcctactattatgatgtcatttatatatgatatgatatatttgcctatttttgacctagtcatgcaatttttctgaaaaacctgtatgagcatagtattttgaaatatgaatcccttggcttccatgacataatatcttggcattttcttatgagctggttttaagtcactctgattgagtcttaaaaagaaaaaatataactcattctttctccactaaatcaatggctgttttattgtatttttatatttttaattgatgcaaatatttgtacatatttatggggtataggtgatattttgttacatgcatggaatgtgtaatgatcaagtcagggttggggcgtccatcaccttgagtatcatttctaagtgttgggaacatttccagtcctcttttagctgttttgaaacatacagtacattgttgttaactatagtcaccctactctgctgtcgaacattagaacttactccttttatctaactgcatgtttgtacccattaaacaacttctcttaacccctcttcccaatcgctaccctaagtcaaatactcttcccagcctctggtgtctgtccttctactctccacttctgtgagatcaactttttttttttttagctcccaaatatgagtgagaacataggatatttgtctttctgtgcctggcttattttgcttaatagaatgacctccagtttcattcatgttgctacaaatgatatgatttcataggtttttatgactaaatagtattccattgtttatatatataccacattttctttttccattcatctaaatcaacacttaggttgattccgatctttggtgttgtgaatagtgctgcaataaacatgagagtccaaacagtacatccctttggtgtactgatttttttccttggtatacttgagtttttcccagtagtgggatggctggatcataaggtagttctatttttagtttttttttttaaataaatcttcaatgcctattttaataatgtaaatgttttttaaaaatctatttttcaacttcctattctgactcactgatgtgtttatttctaagtcacagttatggtagctttttaatggcttacaccaactggaaggacagattgctctttattactcttctctagactgtttcaggctaaattcagatttattatttttgtcatttaacatttcttatctccatttctcttatattttccttcagcttgatctttgactctccttttgcttgttttttgttaacttctcatcattccctattttctcttttgttaatagttctttgaaacttaactttttaattggccccttttcttaaacttactcttctttttcacttaactccttttggatgtcacactgtcatcaaaaagccctgtccaaatttgtatgcattactacaaagtgacttcctttctcaacgcaattgcactgtttgtgtattaatactaccattccgttagacacctggaattaaaactgtaagtcatatttgcattaatcttttcatctatcttcagtcattttctaattaccattgatactttttcatgtgatgtctcccgtcttcctcctcctccatatttcataattactactaccatgttctagatcatatcatctcatacctagataattgaaacttcattctgactgacctttctctttctattttattttgcaaatatctgtgagcttcttctaatataaaaactgtaggtaaatactaatattaaactgatggccttattcattaattcctcatttatgtaataaatatttgaatgaccattatctgccaagcaagcttctgagtgccggacgtgccaacgtgaacaaaacacattctagtccatgctctcttggagcttacattctaatggtgggtagaggtcgggagggaaagagtggagatctgacaatgaacaaggtaattttggtttctgataaagactgtgatggatagatagaatggggggtacagtgggagtgttagtttagcttgggtgcacatgaagacatctctgagctgagctatgagggcagttgagaccagccagactgggaaagatagggtagaagaaaatagataaatgctggaaaacattttaataagtgggaagtttttcatgcctcctcaaaattaatagacagaatagtctttaacctttaagtacagataagaattcagtctttgatgaaagtagcatcccaggcatcatggaggagaaatggattattaacaaatggagctgggaaaattagttactgtatatactgtaattcttggctggttgactttcttgaagaccattgatgcctgtgggacaggaattatgttgtaaattaaaactaatatagatgaaaaaagttctatcattggagtaaattttttccacttaatttttagttttcttaatctgcagtttttttctctattcaacatcagcgaagagtttatttttgatttatatctgaacttatgtctgaaattttccaaaagatctatttattgatatattgaaataatgaagtcaagtttccgtatttgataattagataataaatctcatactgtcctgacatctcaggctgcgaagcataacgcataaggggcaggtttggtccatagcctctagactgtggctaaatcaggcaatcaccagaaagataagaaaaagaactaattgtatgcataggtctattgacagtaaaggtgggaccggtagccttgaatttagttgtgttcttaaagaagggcgttttttagaaatttccagcttcttcattgtagattcttgatttgggcctttgagaatctgaagtttgattggatattgtgtttctttagacattctaatgagtcatcatattctccatgtgaaattatattagttggtgatccccatggcaacataaatttatttctttaatttttgcagggaatttattatttgattgttttttagaaattacgtccattatccactctgttactggttatatgatcatgcatatgtttgaattacatgttgtgttaatgttgtggcttctatcatatgctttgtaggaaaatagttattcatcctctgtgcctctggtctgcttcaactaaatttggcttgagagttggctgttagctgtaggcatccagtgatgtatgtcctttttaaagctgctttgcttctttctgaaattttaccccattttccaaaccatcttgttgcaggctggcaagtctgtggcacttaagatagatacttgctcaatttttttttcttttttctttttctttttttttttgacacaatgtctcactctgtctcccaggctggagtgcagtggcgtaatcatagctcactgcagcctcaaactcacaggctcaagcaatcctcccacctcagccttccaagtagctgggactacaggcatgcaccaccacacctggctaactttttaattttattttgtaaatatgggatctccttatgttgcccaggctggtctagaattccttacctcaagcaatcctcctgtcttggcttcccagagtgcatgaactacagggctgagccactgtgccagaccttgcttaaattcttgacttttatgcttccttgggcactatttcaaatttttaatagttaatgattttttttttcttctcaggggaaagtatcttctcaaaacaattttattaggattagggatcttgttacctggtatggtattatggcaaaggaatacccaatagacaagtaatgaagctgttagagcctttcactcaataatgaaaaataaactgtatagcctatatttcaactgaatctggggcaaagtactttatgatgttatctgtattcccagagtcatgtggtatttactagctttacccttgttattttttagggtagtttgcatgatcaacttatcagtgtcagaaggactaaagtaaatattgattttttgataaaagtatattgaaataaataatgtgcttaaagtgacagccctccaataaacactcatcaagcatatagtctgtgtaaaacacctttctaggtgctctgcaagattcagaaataaactagatatgggctgggcgtggtggctcacgcctgtaatcccagcactttgggaagctgaggcgggcaaatcacctgaggctgggggttcaagaccagcctgaccaacatggagaaaccacgtctctaccaaaaatacaaaattagccaggcatggtggcgcatgcctgtaatcccggttactcgggaggctgaggcaggagaatcgcttgaacctgggaggcggaggttgcagtgagccgagattgcaccattgcacttcagcctgggcaacaagagtgaaactctgtctcaaataaataaataaataaaccaaccagatgtggcttttgacattaagaatctttgaggctgtatgggagtttatacccatgtggaaggaacctccagaatgacctgcgtggcttttcctgcagaagggcaggggttacctgagacaccgggtgctatcatgaggtcttgaagttgaaattcattcactggtttaaacacattttttgacaactagtatacatactggttatatttaaaggctgttcttaatgtttatgcttgtttagtttttcatttgaacttttcttaacatttattaatgtagactcttgttattttctctctagtttaatagaaaatggtcagcttgaaattgtgacaggtggctgggttatgcctgatgaagctactccacattattttgccttaattgatcaactaattgaaggacatcagtggctggaaaataatataggtatgtattggtatattctttatttgggctattttggacagttaattttcgggatgtgaagtgaggctctgttcttttttcgagtaactattttccctgttagtcattattgttgaataatttattcttcattaatttatgatatttcttagctcataaactgagttacagagatttactatagtcacttttaggatcatctaccttgtttaatgtattatttatctatatttttattggttttgggattattttaattgtatgttaagacttgatgacaagaggcaaaaacctaattatggtagcttaagttttttttttcagcaaaaaaaggaaagaaagatattcattatgtcactgagtgttccagagatacggtagcttcaggtattgctgtatccagggatccaggggacttaaattatgttgtctgggcactgtatctttgggctctgcttgttttgctgggtttcttcacaaggtgagtaagatggctctaggcagccgagactaatttttccaacctagcaaccaggaattctctttaatactttatctagttggcccaacttgagtcagttccttatgtctgagccagttactgtgtccagaggtataggagttcaaatcactaaggtctagtcattttggtggaaatggtcttgggggaaagggaattgtggagagcagggtcagctgcacctaaaggcatgagaatgggtcctccatatgagtggcctcatggaatgggtccagttcaacagaataattctgttgctacaagaaatgggaaaaaagatgctagactgatagaatcagatgtccactataaaaacttgggactaatagaaaactatgtgatatttaatatttgcattttgtaacatggtatgtaaatcctttcaaatattttatatctcagtataataatgtagttttttatgtaagtatatgtgttttttattgaagttatttttagatatttccttattttaaaaaattgtcccttagagataaaattcttaatccctattttttctttactttttattttgagataattgcaaatttgaagaaatgtataagaatactgcaaaatattctcataaacccttcacccagatttaccagttgttaacattttgacacatttacttaattttttctgtttccgtgttgttgtagtggtgctggtatttcttattatcagaaccatttggaagcatgttgcaggtatcatgcccgtgtagaaaatagttagcatagcaggtctgctatctttagaaaggccttgcttgcaagattggcccttggttagtgtctgggaacatggatatcctaacgataagagtggctcactgtttttaatctgtttgtacaaacaaaatagtttgtgctaaacaattgctttccttctgggagtctgaattcttagtatgtgctgaacagagggtgcctacatgaccagcccccaacattggacactgagtctgtaatgagtttcctggtcaacagcacttcacacatactgtcacagtttcgtgctggagcatttaaacacatcctgtatgactccatggggagaggacgcttagaagcttgcacctggtttcctctggacttactctgtatgctttttccttttgcagatttttttttctcatttcactgtaataaattataggtgtgagtacgacaatatgttgagacctgtgatttttcttaacaaatcaccaaacctgaaggtggtcttggggaccctctctacacaatgccctttttcttaaatacttgatatgctaacccaagaatattcacttcataaacctccgttatgaatgttttttatgtttttattgaagtgtaatttacatgcagtggaatatataaatcttaaatgtagaggtcagtgagttttaacaatgtacatacccatttaatctatacatttattacccaaggtctctcatcccctcatctttccacttgcagccaactgctctttgatttctgtcattgtccatgagttttgtttgaagaagaatttattagtatatgaactcacataatattattttgggtcttgtgtcttttgcccagtgtaattttttcttacaactttattgagatatatttcacataaattcatagatttgtgcaaccatcaccacagtctatttttagaacttttttcaacatcccccaaagaaaccttatacccagtagtagtcactccccttcctagcttcacccttccctgccccagtctcaggctatcactagtctttctgtatatatggattggactattctggacatttcacatagatggaagcatgtaatgtatggcctttggtgattggattcttggcataatattttcaaggctcatcatgtattatagcatatatcagtgcttcattcctttttatagctgaataatattctgttgtatggatataccagatttgtttatcccttattcagttgatgggcacttaggttgtattttgcttttggctgctgtgaataatgctgttatacacatttgtttaaaagtttttgtgtgactctacctttcttcctaggagtagaattgctgagttatatggtaaaaatgtttagcattttgagaaactgtcaaacttttccaaaagagcggtatcgttctaccttcccaccagcaatgtgtgaggtttctattttctccgtatcttcaccaacatttgttactgtctctcttttttattgtagtcattctaatatgtgtgaaatggtaatctcattgtgattttgatttgcattttcctaaagactagtggtactaagaatcttttcatgtgtatatcagctgcgtatagatcttttaaggataaatgtctattctaattattttcctatttttcagtagagttatttatctttttattattgacttagaattttttttatatattgtggttaaaagttctttgttggatagtgatttacaaatttattttctcattctgtggttttttcactttcttgaaggtgtcttttagtgcacaagttttaattttgaggaagtttttcttctgttgcttgtgcttttgatgccatagtaagaaactgttgtttaatcctgaattataaagatgtactactgtctttaaactagttttatggttttagctcttacatttatgtcagtgattaaattaactaaatattatatttagttaatattatatagttaatatataatagttaatataactattaatataattgttatattaactaaaatattaatttttagttaatatttgtatatgatgtgaggtagagtttcatatttattttttttgcatgttgatacccagttattccaatgccacttattggaaaagatgattctttcctcactgaattgtcctggcacacttgttaacagttagttaaccataattatgagagtttattcctggactctcagttctgtttccttgacttatatttatgccagtaccgtactgtcttgattactatagcttgtataagcttgacattgggaagtctgagttctgcaacttccgttctttttttaaacttgttttttccatgtgaattttaggccagtttatcaatttctgcaaaaatatcagctagaattttgctagtggttgtattaaatctgtaggtcaatctgggggaatattgccgttttaacaatgtcacatcttctgatatagcaacatgggatggctttccatttaagtagatcatcgttaatttctttcaacagtgttttatagctttcagtgtaaaagtcctgtactttttttgttaaatatgttcctaggcattttgtttgttttactgccattataaatgggattgttttcttaatttcattttaggattattcattgctagtatgtagaaatacaattgatttttgttagtgatcttatatcctgtcaccagcatgaagtttttgggattcattcttgttgtgtatgttggtaatccatttccttttattattaatccagtttcctgttgaacatttgggttgctttcagttttgagctatggtgaatcatactgtgataaacatttgtgcacaggtctttttatgggcatatgttttccttctcttggagtgaaatgtttactagcactagaattgctgggctataggataagtttatgttgcagcttatgtgaactttgaaagagttttccaaagtggtggtgctattttatattccaccaacaacgaattagagttctgattgttccacatttttgccagtgtttgctgtgtgagtcttttttcttagaaccatgctagtgggtatatagtgatatttcactgttattttaacatgcatttctatgatgactaatgatgctgagtatgttttgttgtgcttattggccagtggtataccctattttcaagtttctaagtcttttacccattctttttatttgaattgttgctatatatatatatatatagatagatagatagatagatagatagatagatagatagatactttaagttctgggatacatgtgcagaacatgcaggtttgttacataggtttacaacatgccatagtggtttgctgcacccatcaacctgtcatctatgttaggtatttctcctaatgctatcccttccctagcctcccagcccctgacgcccctgtgtgtcgtgttcccctctctgtgtccatgtgttctcattgttcgactcccacttatgagtgagaacatgcggtgtttggttttctgttcctgtgttagtttgctgagaatgatggtttccagcttcattcatatccctgcaaagacatgaactcatcctttttatggctgcataatattccatggtgtatatgtgccatattttctttatccagtttatcattgatgggcatttgggttggttccaagtctttgctactgtgaatagtgctgcaataaacatacatgtgcatgtgtctttatggttgaatgatttataatcctttgggtatatacccagtaatgggattgctgtgtcaaatggtatttctggttctaggtacttgaggaatcaccacaccgtcttccacaatggttgatttatactcccaccaacaatgtaaaagcattcctatttctccacatcctgtcccgcatctgttgtttcctcactttttaatgatcgcttttctaactggggtgagatggtatctcattgtggttttgatttgtatttctctaatgaccagtgatgatgagctttttttcacgtttgttggctgcataaatgtcttcttttgagaagtgtctgttcatatctttcgcccactttttggtgatatcccctttatcattttttattgtgtctatttgattcttttctcttttattctttattagtcttactagctatactagtaaagggttgttgccttttttaaaatttgtagatattctttgtatgttctaaatatgagcactttgtcacatatatgctatatgaatatttttaccagtttatggttattcgtttgtttttagtggtatctttttcatttctcttaatcatttaataccagtatataagaaaatttttcatatgcatgtgtatatgtgtggtctaaagttgtataaatcctatctttttattataaatattttatataatttcttattagttataaatatgtaataaaatcataaaatgaaaattatctttttaaatacttatagtatttagactatatgtctgtttagtattttattgcatagataacatctcttatagtaatgacatagggtagtggtctttcttgttccagatttttaatagaaattgtttagctgttctgtattaagtatcatattatatagtatttttatggtaggtgctatttatagtgtttagaaaattattttcttcttagtatttttcacttaacagtgaatacgtaatattactggttttcttatagccgtctatcaatactgtatggtttttctcatgtttccgtggatgtgacagcagtttgttcagttaaaaagtcattgacttcctggaataaatcccttttggttttggtactattgaatttaatttatttagtggttttatgattttatatccattttcatgagtaagattagttttcttttttaatgtactacatttgtattttttttattggtttgtgatacttaataaaatgaattaggtagtactgaattcttccttgtattacgtgacagcttatgtacattagaaataatttattgctcagatcctaggcttagaggggtcttttattggaggtagattttttgataatgttaaaaatttctccaaagttattaatatccaatttacatctaaaatgtaaattgtattatttttgttagaaacccagccttcttatcaacattttaattacttggagtataaagtaagaattgtatatagtattctttgttttaaacagtattttattaaataacatgcagtcagtgtgggaaaataggaaaaaataatatactagcagaaagtaaggagaaatccttctgtaccctttagagataacctgttttgtgatatataacattatagcattctggactttttcatatgtatatttaaacacagtataagtttttttccacaaggataggatagtattttaaaacaaatttattagagatagtaaagtgtttaaagctatcttctctacaacttttgtatctatcttctttatagttttctgtagggcatttttatttgactgttagtctgtgttatttattttttaaagagcaggttaaaattttttaagctaaaaggtattttgtgtttcttcatactaccttatctttattttcctctttctttgctccttttgtctgttttttgtttctttttctctcaaggagttggcaacaggtgcatgtgcacacatacatacattttggctcatttgttctttttctacaacgtgaaggtgagtggcagcgaggcctcttgtgagagagcatacccatccatctcactcatcctgtggagtcagcataggcaaactgctgaaatggagttggagctcatttctgcagtccaggcagaggacaatggcaatgtggcagggtcagtctgagaatgtatgttcctcctacctcaaggtgccttggagaagatcagtgctggccttcgatgtgctcaggggatgtacttatgactcttagcatgtgatatgaggtatctcactacttcactctttcctccatcccaaatagtgaacacacttaacaacacttacaacatcataaaactgttcagttttagaggtataattgtcaaaagcacaatgtgaacaaatgcagcttaaagattgaattggctttattaagcaattcatgaacagggcaacatcccatctaaaaaataatattctgatgagcaaagcagagaagactggctttataggcagcaaaaggctgcaaaagcagaaataggaaacaaaaagtaggttggttatttcaaagttacttcccttacagggttacaacagaggagacttcgttatcatgctggctcaagtagaccaggccccttctgattgtggatcagattgcttcaaatctcctggtttttgttgttgttttttaaactggtacatattcaagttcagtttgattatgtggcacctagcacaagtgactgtattctggtttgatgtggtcttttggggtgtactgcagctgctcagcctaatacagtggccttccataaattttatttaacatagacctctatgaatttaattagtaggcttttgagcatcagagtgagactcactacatgttccataaagctgagaaaagccaggttcagggagattttcccttggcccagttactttctttttaaatataaggaacatatctgaggatatgacatttctttgtattgtagctttggctgcatcttatgaattagtgtccttggttttgttttcttttttttttatttttaagttttttttaaaatttattttagtattattattatactttaagttttagggtacatgtgcacaatgtgcaggttagttacatatgtatacatgtgccatgctggtgtgctgcacccatgtagggacatggatgaaattggaaatcatcattctcactaaacttggttttgttttctaaagaatttaggacatgttattttggagactgtttttacatttgattatgggatgcatttttagttgtttaatctttggctattaatgtctgcttttaactttattataaaaattgaccattataactttttttttttttttgagacggagtctcactctatctcccaggctggagcacactggcgccatctcagcttactgcaacctccgcctgctgggttcaagtgaccctcctgcctcagcctccctagtagctaggattacaggtgcttgtcaccgcacctggctaattttgtgtttttaatagagacagggttttaccatgttggtcaggctggtctcgaactcctgacctcaggtgatccacccacctctgcctcccaaagtgctgggattacaggcatgagccaccgtgtccggcctattataacttttttgagcttttaaagttgtcttttgactaccatatccatattacaaatatatttcctgattcctcttaaactatagtattaaatatacttagaataatccagttttattaggtactattcgtattactaatgttctaatttttaaacctattaggtttgccaaaaattgactgatgttaattcttcttaatgttttccatactttgttcttgtattttgaacagtttttacttttatacttttacttttgataatcttgttcttgcatgaaggcatgaaatctttttgatgagctttccagttttattagcaaatgtgccctctttataaaattttggatttttcttatattgtactttttcctaagtttgccccttaccctccttttaaaaagtattgccaagaaaaaccctagcaggacactaggttcctttttaagtctatccctagttctccactcctttcatatcaaagttttaaaaaatatagtttacactttctcttttctacattatttagtctcagggactctttattccattgcagctaggttgctacccctctggatccaacggttttgatgtggaaaagattaccagtgatgttataattgttaaattgaatggacactataaactctttgacatcactgcagtgtttgatactgatttttatctttttttgtaagcttattctgtccttgttatttggacaatacatactccttttttaattttataacttaattttgatataatttttaacttataagtggcatcatagtacttgggaaggactcccatgtatcttgtacattgattcatatgtatatttttctgaatcatttgagagtaagttggaggtaccctgtacccttatctctaaatacttcattgcatatttcctaagaaataaggacacttttatacgtaaatataataaagttatcaaatcaggaatgttaacagtgatacagtaggacagtgtagtccacaggctgtattcagattttgtcaattatttcaataatgtcttttataaaagccgcttttccccccacccagtcaagaatggaatccatggtcgtacattgcatttagttgtcatgtctctttagtttccttttatttgaaactgttccttagtctttttttggggatttcttgatctttatatttttgaagagtagatccacttttgtagaagtctctctatttgactttgtcagtttcttgatgatgggattcaagttatttatgtattcttcctatctacctgtttgtctgtctagttacaatatcactgcagtaatgtgatgtcccattgtcctcactgcatcatatcaggaggcatgtgatgtctctgtcctagtactggtaatactgggaacaactagttaaggtttgtctgctaagtttctccactgtgttaaatttttgccctttctaattaatatgtgggagatacattgggaataaatattctatacctcagccatctctcatgtttatgttttagtgtccattgatgattttctaattccttctataattgctagttggcattctactaaagagaagagctttccttcttattttctgtttatttatttatatcagtatgggctcatggttaatattcactgggttataatgcattatttattttcacacctcagttgtcccagatttggccattagaagcctctttggtcttttcctgagttattttaatatgcccccatgatttcttgactgtctctttgctttatgacgcaagaatatattccaggctatcatgtactttcctggcttcagccttggaataagctatttctttcaggtttttttttctttgtaaaatgattggtatgtagaggccaagatgtgagagctaaggtgtggtcattggtactgaggttttattgcatctaggtccttcaagtgcactgagttggaaaatttgtgtatgtttgtgaatatacatacagatacctgtatctatatttttatatttcctcatgaaaaaccataagttagtaccgatatctcctgttgtaatgcaatatcatagggtacattccagtcttccacatttgtagttacttatcttactgtgaaaattctggctcccttgttctcatttgttcaatcttagaatacatgaaagctgccttcagaattgttaaatccgtgctaccacaaaaaccaaagttactaaatagagttcaatatttctttttaatttttggatgtaaattacatatgtgaaatgcacaaatcttatgtggtcagttcttttagttttgacatatgctctttttgagttttgactgtatactcttggtcccctgtagatcctgacttttccttattgtcctttactggctccccatgtctatgttcttctttagtgttgtttacaaagttctagttctctttgttgtcttgtgtgttactttgtgttacacttatttgaatgacagcctctgcaaactagagtcaagatctaatttaactcgtttttgtaactgtggggtctttcatcatcttaggtaaggtgcttaaaaggtgtttgaatgaaaaaaaatacacacagcaatattacttatgtcagtttataagttgtaagtagacactttatttgagaatcccaaataattaaaacatcagatttttataatgctagatgaacaatcttattctaaccagtacatttattatctttttcatttttatttttttacattttatcctctgtgaaattgagatatatctttagtcagtagttcacattattggtgtgagccagctatgagaaatcactggcacctttgtaggtagagtgaaagcaccagcatcataatgacttaagatttaatgaaatatggtatagttattttggcctgttctgccactgtatcataagatgatttggggcttttgtaatgtgtaaaagacagactaaaaaagtccttaatgttggtgttgggaaatgtaagttgaaataggtacgttacttttctttatcatgtaatagttccagagttatccagctccacagatcacaggactgtgatatccttccaggaagggccctggtcctgtttattctctacctctagttaatggcagtggctttataataggtaaaagatgttaatggctaaaagatggcagtatttatttgaactctaactgattaatttcagtgagcatcctctgcctatgtggataggcagtggcacaatcctcccttcatgatatcttgctgggaatacttggcagaggataatgctgggtagatccttggtctgatatctctaggagactatacaatgacaatgagtctgaatgtgttgtgacttctttttatttcatatatcaattaaaaaaattaacacttatcatctttatccacaggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattggggtatgtagggtttgatgaaagttgatcccatttggcctagatactatttcacaagggttatgaactcatgccactgtgggttttgttcactgtcagtcttgaaaaatcaggtggcctaaagatagtcactctcgtaattatttttcccatgtgcctgtgtcaagattcttttaagtaataatgcagatatttatagagcataggagaatctttttatgtttaaagaaagtagataaatataaggagttagtattttgccaataatgctttcacttgcttctgttttagaaagcacgttttatcacaaatttgaacatgcattagaactgatatccagtcatatatcttatattcagccagtgttccttccttctgtctctcgtctctacatcttgtaagaattgctttttaaagccttaatcctgtcctcctaaaacagccctaatgtcaaaataccacctgtcttcacagtgtgttctgtggccacgcaggcattctaaggatatacttgtgcagctctttattaggagagaggagaaaagatctaggcctcttgggaggcctttgcctttctcaacccctatttaattcagaccaccttattttctatttatttatcgagcctttattatgggccatgtattatgttacctctgctttatattcattctcatttaatctttttaatattattctttttttatggtgaagcaatggaggcttagatatgagaagccatttgccaaaagtcatataggtcatgcatagagagcagagatttgaatgtagttctgtgtagttcctgaagcccaggctcctaacctctgtcattgtgttctcagtaaactttcatctgaaagaaatattttgtttataaaacagtgtttgagaaattactgcattacattatacttgttttcttgtgtaatctagaccccttaagtgtttcagaaaaatcatttgtaaatttagaccgtaactttcttatatgtactcctgtttttttcagtaaggaaagcattagctatacagtttcttaattctagaaaattaaacctgtagggagaacaagaacttgtaggggattgcattccatatagtttgatcaaatgctaaggagcatattaatttgaaaaacaaagaatttgaagaagccctacttaaacaattgcccataaatatcagttagtatgaaattattgagtacttttatgtatttcagtattgtgctaggaagaaatgttgaaaacatccttgcttatagggaaattccagtctaatttgataaaatacggatacagccaaatgtagcagataaaattaagtatgcaaattagctgcaaaagagtagcgcataaggagaattagtggggtatggagtatgtccttatccataggagagaagagttttaggacttgtgacaaccttttgtggcgactatatgctcatagcaagcattagtgaccagcatctacagtgtcaccgttgtgaatatgattcagtgaaacagctgacagcactgaagtacatagattttaatagttttaaatttggaaaataacagttaactaaattgataaaactggaatattttaggacttacctgataaatttgaacatgttgctttttaaaaaatgttttcgaattaagttgagcttgttcacgtgttcgagttcttaatgaagcagttattttcacttattaaaaatgtaaatttttttgtctttctgttacgtaagcagtacatactcattgctgaaaattggaaatccatacataaataaagggcgggggctatttaaaagctcaggatcatattcgcaaagatagcttttaactactaggtaggtcctccagtctcacttgttggtaggcttctcacctctccaggccaacatgtgataacattgtagttttaattaaaagtaattctgcatcaggaatcagtgctcattttccatatcttattcgttttgtttttatttttgtttcgctttttgaaaattactttttcttttcctgtgcttctttgttggtgaaaagtcccattgactgactcattcttggtaaacatggggtgagactgtagattctcctgggttgcacatcctctcctcaccataagaggaaattttctccaagagtgaatttctccagtgtttttataagtctatgctccacacttcctttgttcttccatcccttttttactccgttcttctcacccagcctctgcagctaatatcatggtatctctcagtgaattctgttacctgaattgggaacagttacggcaggaactggcagccagggatggacatagttttggatgagccagctgtaacttttacggctgctcagtttgtatccctcctggtcagctggcgctggttcatgctggggctttcctgtctctgctatgcttagatagaagaggtagatagagactgagatgtgtgagtatcttccttcagacaggtggccattaaataccgctggggtatatgtactggaagttaaaggggctgctgatttagcacagagctaaatcagcattactttgtgtaaagtaatgacattttgaatattttttgggaaaacagattttataaatgcaggtttgtgtgttggctctttattttagatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcaggtatgaaaatgcgtatttcataagacaacatcttgaataaagtagccacttagctgctagttgctgaagggttgaacaaatgggctttattagccaacattatccttgtttgaagtattcattcaaaccagatctaaagcaacttaaaaatgccagagccttgactatgccggttatgtgttacattttaatggaaagtgaacaatactagatcaatatacaatggataacctataatacactattattaccatctcctttgccctcattataaaagccttctactgtgtttgattgatttcatatacttttgttgaataaaacttctggtccctattgtacaaattggtaagaaaagcaattcaactgcaaaaacacatttattgaaatggagcacataaagagtgtaattatctgttcccttaataacaatttcaataatagtgaatgcttcccagctctggtgtatacacatctttgcatcattctgatgtttttgacttacagtaaactttaattaggaatatttatacttaaatacatttaaataaaaatcaaaggtatgaatcatttctttagaagaaaattgtgctaatgatggaagcatctcattaaaccaacttacatgtagtttctaatattggtacttttaaagtttaatttcttcacttaaaaattagtagtgtattaaaatgaaacattgtggtgtaatataaaaacactaaactctgctaggaaaataatatagcccattaaataaattaaataaatttatttttgcactattaaatcagtttattttcaaaagagaagtcacttaaaaaaaagtgtgtgaggaagaaggtgaaatgagatctttttaccttcaatgagtccttagaatcacaaagattttctttgtgagcctctcactgtggcagacatgaaggtgttttagcatggcagccttcttaaagtcatggagcccttctatcaaaatgtgactttaatagttatttagaaaaactgcccaaggttagggattgacttgatttcattttcttggttcctacagccatgagaaccactgaggaattctgaacaacctgctttctagctagggttgggttaagtaggcataagagaataagccagtatattgtgtggtggaaggtgtaataaaaaggaagggttgagtgtgggggcaccctggcctgtgtaggtgggcaaatagctgtttatatttacaggtatttacactactctctgctcaggtgaccagggatggggaagttcttaaaagtgaacaagatgtttcagctggggagtcccagtgcattcatagtattgtgagccctttgttctttttttggggggtgctactgagactacctgaggcacattattgaggaaaaaaaggcttttttataatccttttgctatgtcatctaacctttcaacaattgcccctcaggatgataccttgtgctcatttagttccagtggttttgaaagtgatttccaggcacctgggggcatactgttgaatgagtctatataatacttagagattttttctttttaaacttcttggccgggcgcagtggcccatgcctgtaatcctagcactttgggaggccgaggcaggcggattttctgagctcaggagtttgagaccagcctgggcaacatggtaaaaccccatttctatggcggcgtgtgcctgtaatcccagctactcaggaggctgaggtaggagaactaatagaacctgggaggcagagcttgcagtgagccgagatctctccactgcactccagcctgggtgacagagtgagacttcgtctctaaaataaacaaacaaacaaacttcttacaagtattgaaatgttaactctactggttacctcagatccatatatcaccttcgttttgacctgatgatgaattgagatcaaacacaggcattccagctcattggcccctttcaagctccccactttttttgagacaggttctctttctgtcacccaggctgaagtacaatgacacaatagctcactggagcctccatcacctgggctcatgcaattctcccacctcagcctcctgagtaactgggaccacaggtacatgccacaatgctcgactaattgttttaaaaaattttgtagtgacgaggtctccctgtgttgcccaggatggtcttgaactcctggggtcaaatgatcctcctgcctcgccctcccaaagtgctgggattacaggtatgagccaccatgcctagccctgttcaatttgttaacgtcccaaagaaaatgaaatttaaccataatgtacagatggcatcttttgatatgtccagctcagcaggttcttctactttgcaagtaaagaaatatcattctttgtcaagttcatttttggtcaagtactatatattttaagttggctttttctattgaccgtcacgtgatttgatgtttcggggattttatttttcttggttacagttaagttgacatttcttacctggtaaaataaatcaggagcaaattgcatctgtatgttttcaaatgtgatgttgggtcaattgatttgttattggttccatatatttaccatattaccatttaccaattaccattggaccatatatttagtgagtgtcttcttcctgccaggcgttacaggctggttacttggctttcccagtgttgacactttctggacaggcttgagagttaggatagatgtgaagtgttaaaggcatgccattaacgtttgtgatttcttttctttatatgtgctttacacatatgtatacaagatactctatatctaatagtaaacccttttttatgctggctgcctaggaaatctagttggagctcaattatatcttatatctatgatttatatatttgattatttttactcatttttttttggtagccttctttctatgtggtcaatctcattcttcatgtgttttttatcgtaagtaacctaaaagtgttttggcaaatgtggaatgttagtaaattactagtaaagataaagtaatgtgctaatgtcagaaaactaagcattatatgttacataaggacgctgtggttatattttactcaccaaggtattatgttactgctaaaattttatatttgcaaagcaatttcagagattacaaatgtaaaaaggaccatatgagatttaaatttagttaaatgtttataatttttataagatgcttcattctgtcattggtgttctttgagatactttcgtaagtttttatattgtgaattagaatttacttttggatgatccttgaagtgaaaattataaaaatacttgtcgtttaatcactgatttcttaagctttgtctttgtaaatattgtgaactgctttgggttcatccacttgtataatttcattttcacaagccctttgtcttagtttgtattctcagactttcttaaatgatgccctaattcagtgatttccaaaggacattctgcagaatactataatagaatatgaaatacaaaagctattccatcaagctattggttagagtccagagaagtagaaaccaaaataactaattcaactcctaatccttatctgatggtcagtattgaaaaggacactgtgacaaatactcagattattggtggcaggtgacaagtgtgtggatttttttttctttagaagaggaaatatgactctataaaatgttacagattaacatttattcccttttggttttgttcaaagtacacttttttctatgtttaatcagataattttagattagagaaaggaatattaagacaaagcaaacttcaaagtctgtatatgtgggaagtccttattgtcttactagataaatcattttaacacctgggctatctggtattcaatctctgtggctgggctttaggaagtccttggtaccccacttattatatgccaagttggtacatgaccatatttctccaaagataatccattggaaacctatgagtttttccttctgataagaatttatgaatatttttaaaggataatgaaaattagtatgatagttttaaaaaaatctgtctttaaattatactaaccttgcagatagataaaatatacagtttcttttaataaaatgtacttttgaatttggttatttcctttttaatcaattgtcacattcactttttcttagtcaaattcatatttgctgtttttttgtgtttgttttttttgtagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaaggtaaggagaaaatatttatgattccgtatttgaaattgaacctttattattaaatgagactataaacagaaatccttagcttctttgtcctacatcacagtgcttcttagaatatataattcttgtgtaaaatataatccattaggaagaaaattattatatgctatagttccatatctaaagttgtcccgttcctaacactccttgaggattaaagaggaatttacttttatgtgattgaaaatatgtacctaccaagttgtgatatttagtcttcagggacttactgtttttgttgtgcttgttttgttttgttttgtttttttaccaacattgaaagtctgttatttctctctgacagctgcatccttgtgatttagtagcatgactggcagatgcagatgaacatgtcatgaattttgcaaacaaatgtcctatgtccagagaatacactaacatttttttttaagtgagaagacttctaaaattaatcgtttgcctatggttcttactctttttttttttcttatggaaaatttaaaatgtactgtaaagttctgaaaatagcaaaaattgttccccttctccccatatccatggctcagctgcagcattcttcaactcaagaccactcttgtttcagccatgccacactgctgtctcactcctccccataggattatattgaagccaatctcaggtttcatatagtttcacctgtaaatatttcagtatgtatctctaaattataaaagttctgtttaaaaatataacgataataccattatcacacctaaaaaactaacaataatttcatgatacatatctggacagattcaaattttcctcatctcataaaaaacaattcttttaacacatgctttgtttgagtcaaaattcaagcaataatcatatattgcatttgatcaagtttttaattacaaaattgattttttattgatacataattatatatatttatgggacacctatgaattttgatacatgcggagaatgtataatgatcaaatcagggtatttaggatatctaccacttcaaacttttatcatttgtttgtgttgggacaacaggcttttaaagtcttttttttttttttctttttaaatgtgtcttagagactctacataagaagattaattattcagcatgtttattatttcacatattgacatgtaaaagtagaacatctgtgaaaatactatagaaaggaagtgatattactgtttaggaaatttgaaagctgatggtgaactatagtttagtaagaattcaagtttattaaataaacctaagtaatatcaaatagataaataaacctaataaaatatcaagtttattcaggattgttacagctgaatttttatcagattatgaactcggatcctaggggtatgtttaaattatccgtgtattttcctgagagatgatgctcatacatgaatatgtgatcagaggaagggatatatatatgagtatcttatctgtaattacatcttactaggaagtgattttggttcatagaagcatctggtctcctgtctgactgaaaaaattagaccctgattttagtattctacctatttcatcctttgcctactagaacagttttttaaaagtcatttaaaaaattgaagtgccacatacatagaagaagtggacaaaccataagtgtgcatagaattttgcaagtttaaaagtctccatgtaaccatcatccagattaaggcttagaacttttattgtccctcagatctctttccagtcatcaccaactgccgcaaaagcaaccactactttcacatctgtcaccatgattactgttgcctgttcttgaattttatacgatggggaccatacacatgtactttgtgtctggctttttcttttcacattatgtttgcgagagtcatccattctgttgcaggtagcagtagttcattcctttttagtactgtgtagtatctctagtattcattttttgatgaatataccacagtttattcattgtattgttattgggtatttgggattgttcccagtttttgtctatcacaaataagtctgctttgaatattttgtccatgttttggttacttgttatgagtttacatgggtataaaatgggatgtaattttttggccattgagtatgcacatgttcagctttagtatatattgccaaactgttccaaaatagatgcatcaattgtgttgtacaagaggttcagttgttccacaccctttctcagtttgtattgtcaggatttttgttttccatttttatccttttgatagatgggatggttttattttttatttctcctgtggttaatgaggttgagtctcttttcatatgtttattgccatttgagtatcctcttttgtgaagtacctatttaagtcttttgatgattttttaattaaattggggttgtctttttcttactgtttatagctctttggtacattttgaattctatcttttttcatataaaagttatgcaaatgttgtctcctactatgtagcctgcattttcactttctcatgctgtcttttgatgaacagaaatttttaattttaattaatcaaatataactatttttctttatgtttagaacttgttctgtttgaaaaatttttgtttatcatttggttctgaagctacattcttatgaagctatcctctagaagcttaattgtcttgccttcaacatttaggtctataatctatctgaaatggattgctgtgaattgtgtgagggtagggatcaagatacattttggcttatatagatatccagcaccatttattgaaaagaccatactttcttccacagcaccacagtgtcatctttgtcattaatcatgaatgagactgcatttgtgtgtgggtctgtgtctacactctctattcacttttattggtctgtttgactcatctcacactgtcttaattattaacactacagttttataataggttttaatatctgatagtaaaagtcttccagtttgttctccttcccaaaattgcattggttactgttagtcctttgtaattctacataggtgtaggtcatcttttaaatttctaccaaaaaaaaaaaaattgaaggggattttgagtgggattgcattgaatctttggtttgatttgagcacaaataactacaattattgggccatctaatcgatgaacgtggtgtattttgtgtattaatgcaattgatttttgcattttagccttgtatccagtaactttgttaaatttatttattatttttagttatttgtggattctttatggatttcctatatatgagtaatggcatatatatgtcttcctttccaaagctttaaatctttccatctactttcttaccatgtacaatggctgtgtcctctagtataatgttgagtaggcgtggtgaaagcagacataattttctaagagagaaaacattcgttagtcataatgtttgctgtagaattttgtagattccctttatcagattatggaattttccttatattcctcatttacagagtgttttttcatgaccagatactaaattttattattttcttcttctaggacattgctttgtgttaggcctttatgtcttgtgcaatgattgaaccagtaccccaagatgaaaatttggtagagtatagggtccaccttaatgcattttctttctctccaacatttttatcccttaagttctggctgctttagttctttaatgtcttcaaagctttttctttctacagtttatctagttatatctgtttcttgtgggatacttaaagttactttgtctgaactggaagcataaatttaatattttcttttaatgaactggagaacaaaagtaaataactgagttcagatggctgaaaaattgacgtggaatagccaagacagtcattttgccatttgatcatcatttaacaatttttgtaatttttcttatgtgttgtcctgatagaattcttacatttaagattaaagttgttgccttttaatgtaaaaaccatgtgaatatttttatttggttattcttaaaggtgtcctaaatatttactttttatgagctaccaagagactttctagagaaatttactttaaataattactttaaaaaatactctagcacaggtactgagttatttttctacccttaaagattgaattaagtttttgagaaagcctactaggctacttatctaaactgctctgggacattgccaagaaggaagtatttttatcttggctcataccaaaaactaattgaaatattttcaaagggtatactttattgttaatactaattctgtagcatgctatagatttctaaactttgaagttcaaaatggtttttattgtctaaataaaatcctttgttttatgtttgaggaaagtgagactcagaaatatttagatcgtagactattttgtcactcttattatttatactttcctgagctcatctgtatctgctggatatgaagttaatgccatatttccttctattcgtgactcatttcttttatggttacacacacacacgcgtgcacacacacacacacacaaacacacacagtcttcttcctagtaatgcttgtgagtaataatactcttagtgttagctaaaacatattgagtgcgtattatttgctgtaaattgcttaaagtactttatttaacttatttagttatctgaacattttctggtaggtcctatgattgttcccattgtagatgaggaaattgaggcacaaatagattaacttgcccaagatcactctctgtttggtgaagccaagatacattggctacaccaaattgaatacagttgaaaattgcttatctttaatataaacataaggatttagaaataatcatctattttgctgtaaaaatatattgcaccacaactagattacagtcacttatatttgccttatcagtatcattgttgtaaatgttccagtcgcaattttgtctttgcagtgaataagtgatagctaaatttataccattattggccagtcatggttgtaagtttttttttgtttgtttttgagatggagtctcgctctgtcacccaggctggaatgcagtggcgtgatctctgctcactgcaaggtcggcctcctgggttcacgccattctcctgcctcagcctcccgagtagctgggactacaggtgcctgccaccacacccagctaatttttttttgtatttttagtagagacggggtttactgtgttagccaggatggtctccatctcctgacctcatgatccacccgcctcagcttcccaaagtgctaggattacaggcgtgagccaccacacccggccagttgtaagcttttttcttagagccctattcactgtaacgtggatagacagagaagttatgtaatatgctcaaaacacatgtcagataagtggtagagatggaattcaaagctatgctattgctaccttgaatcaaaatgacttgcaatatctgtgtgtgtgtgtgtgtgtgtgtgtgtgtgtgtgtgtgtatgtgtgtaggaaacaacaaaatccgcatctttcttttaaaaggaacacattccctgttaaataatctgtttatttttgacaggactgccttttaatatctgtttacaagatttggtatcgtgtttctttttgtctttgatttgtagaatagtttgaactcataaaaacgaatttcttactgctgatttaaatcattagtcagaaagaccggtgtgtttaagcagccagacttgccattcttagcactccttggatttaacttctactcagtgttacctactggtagagtaagttcatttttttaaaatgacctgctgttcttaaagtcccttctccttcacaagaactcaactgggggaaaacggagatagaggagggtatgatatatgaaataccttatggctaacagaattattcttctagactttatggctaataaaactgttattgtagacttctggaacactttaatatgtcttttatttttgctgctgccctcatctttcatttatgtggattaatccatgcccaaatcattgtacactttgaaattctagagatatgtaggagttttcatattcactgatttgtagatctaaatagctctccttttaactgctgaagtgtataagttttcccttagtttaatttgggccttaatgtaagtaaaaaaaaagtcactattattttcttccctgcttctgatttttataaaatctgagctatgtattcatcttaacttggaaacacatgttaaatatttattattaactttccctaacagtgtaagaagtaaataattttaagatagaatgaataattgaagtgcatttttttaaaactagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaaggtacttttacctttctatagctacatgtattttttcactttatattatcataatctttttgtagagttttacgtaatatacatcattcatgtagtacattatgtagtgttaagctctaattaagcacttagtgtaattgtgaaattttaatgcaatcagaaatacgtctccaaactacaatcaaattattacatgggtttttgttctggaagaaaaaatagtttatttaaattagatttttaaggagttgtattctacattttgtatttttctaattaatttacctgtgttatttgcacaccatattaatattcagtgacaccatcatgagtgtctgcaggctggtaatctgataggcttctcattggaaacataggtgagcatcaaagaaggaaatagggcctcccagcagccaaacgtgagcttcaaagttcacagtccaaaactaatgtattttgtatgtgggagaactttagactaggcttcatctcagttcttacatacttatttgaagcacatttctataggcacagtcatctgcatagaagaacaacatttgaaaaaatgatgactgatgggtcagatagtgattgaaaatgtaaatggatacagagaagacagaaaagtctgtagaagacataaaaacactaaactgacactatccaggagaactttcaatcactgatagaatgttctatagtgataggttctatttctgcactgtccaaaatatagtcattaggtacatgtgactattgagcacttgaaatgtgcccatttaattttaattaatttaaatgtcaatagccatgtgtggctatggctaccatattggagagcatggtcctaagtaactaacggaggctggttgttgataaagttaaaactactccagaggctcccaaagttttctctatgtatagaccagtaaagtaattcattttcatgatgaatcttgatgtttgagttagattgtacttaccgtcttttatatactagtggacattggttacattttggaaaggctttttattaaaaattatgaatttaagagttgtatttttatatggtagttttttattgttaatattgtgctgctattaaatactatttcaaaagcctaaccttttactgttactcgtaatatgccagaaaaatgtctcattttaaaaaattattttcattattatagatacatattagttgtacatatttatggagtacatgtgatattttgatataagcatacagtatataatcaaatcgtaatttgtatattcatcatttatgtgtttcaaaataactaaaagtagaattggaatgtttcttacaaagaaataactgcttgaggtaatggaatatatcttattaaatttaaaataatgtttacatattatagtgactatccattcttaccctacagaatatcaaccagttatctcttatactattctaaacttttctgttataaagtgggttatattctcaataatgtagagatcgttttggaccactgaattagtgatttttaagtgccaaaaagaatattggtttatcttaatttattgaacatattcaaggcattgtggttactgctagtaatatatttggaaaatcctgctgcattaaaacaaaccaaaaaaccatacaatagttatgactttccaaatgtatttatttatacataagtttgtctgaaaatagtaatatttcatctctctgctcatttgcaaaatgtggataaaatataaaagtatagggaagacaatatttcccaaatcttctttttaacattttagggtgtctggatatgcatatgtactccttttaaaaccaggaatatttgccatggatatacgttaacatagatacacaatttagttaattcaagcttagtgattgttacttcatgatttttggaaggattagaatttaaaagtggagattgtttactctcctttgattatttctacagtttagagaaatgcatcattttacaaacaaagtatttctagtgtctcctcttttctgaatcttgataacattttcaagttgccttgattctgtctgcattgtccttaaaacatgtttcgtgtatagaaccttcttatactttttacttcatcaagccatgtctccttttaaataagtttttaagaaaaacttatcttgagccatatcctctgatgaaaaaacataaaaggtggaaattatagcccccatgttcttcttagactgaaggttttttcctttaaaatatactacaaaggacattttttttttaagagacagagtcttgctctgttgcccaggctggagtgtagtagtgtgatcctagttcactgcggcctcaaactcttgggctcaagtgatcctcccacctcagcctcctgagtagttaggactataggtgcatgtcactacacctggctaagatagagtctctctatgttgtccaggctggtcttgaactcctgggttcaagtgattttcctgccttggtctcccaagatgctaggattacaggcataagccaccatgcccagccgacatactgtttatcatctttcagtttgtattgttaaattctctgtatttgttatatgttatcattcaaaactgaaactaaccctttcccctgaactattcttgggccattattttctgcctctcctctcctctgagtgtcccgctcaccgaccatgcctttctttctcatttctcttaatgtgtatatgtgagagtaaatgatattctggtgatgttcatggtctatgtgtgtgttgctcttggagagaagaaaggacagagaaatttatccaatttttcagatttttttcactgtgctattcataaataagcctgtcttgctgccaacaggttctggcttctttttcaggatcatctagaacaaggactcctgataccagtgtagacatggtattctttgatgattgagaacgtaaatgtgttatacgggatacattggttgttttatatgaactattattaccaatatctttttcataaattgcttgtactgcaattatggattaaaaaatttgtaaagtatcaatgtcacaagttttagattataagctaaagtgtttgttttaaaataaaaatatgacttttatgcaattagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccaggtaatctaattatagaaaaatcatctttaaaaaaatcattaaaattatgggtaataagattatatcttttggtgaagttgttagtgtatatcaaaccacattaacaatgatatccctcataagtattactgtatcaaaacagcactgatattcaaatattaagaaatctgttgacagagtcccagctgcaccaactttttattgcaatgcatttctgcaaatagggtagtaaaatattattactactgtttaaagctgatcctattttcttctaaataacagtgtggagactggagttatcttcttgaccaaggacttggcatcaaataaaacatagttataatgtagagagataaagattcctacttcattgtatgtcagtttaatctcatcctatttcatatccaattgttcttgtatacttctttttttttttttaagaggcatattgacataataagctgagaagcatagccaggaaggaaaaagacctataaaccttatcatatgtggatgatataagccattgggaatgagaaaggatgacctgggtgttggtatcaaagccatctttaactcattgaagggctctcagatgggcaagggagtagaagctaagttatttctatattaaagactttgaaacaatgagtataggcatggtctgagataacagaggacttggcaaacagagcttcctaataagggggaagaaatcttaccttttgtagtagggagttctctatcctcacgccagcctttggatgaccattcattcattaggatcagtgcagggggcattcctagattggggaaggagttttgactattttatttactgtagtttagactattcttcctgatactgtttatcagcagtgttgtgctttgataacattttaaagtcatttaaaatatactgtgattttcttaaagaatagattttaaaagtgaatatccttagtactactccttgatgagaaaagcgtatacaacacataaaatcaatgttaaaaaattgactcacgacttatattactaattgtagtaaatgttaattaaatttttagttacaatattttgactggctttctagaaattgggggaaaaagatattcttgggttttcattagttgatttcagtccttaaaaaatgcattcaaagtagtatcttgaatatcttctccattttttaatggcaaatatatatgacacccacctgtcgaggttgatctggggttaaagtagaaaaccctcattagatgataaagatggtatttctcccacagaaaccatttttgaaagtaaggtcagatcctccttttttccttcttacctgctcctggcctgcttggtttgttgagagtttaaaagtgagactgcttagaatcagaccagggtagagctcctaagaggacatagaaaagtcattttcctacaccgcccacttgctatctctggctgtcatatcgaaagagatttgcttataggtcattgagctttggctacagaagattttttgtatcttgacctgtctggaagagctatcattggttcctccatatgttttgtgttgcttttagcttataaaaacttccccgtgtagaattgcgtgttagagaaaaaaaggtagtaagtctcaaactgtacttggcatttgtaaatttgctatgttagtacttcacagttcattgaaaagtcataaacaattaccaagtcattagcacagacattttaaggaggaaatttcaaaacataagttagagaattattaacaaagaggtagttagtattgggtgttctcttgaacttggactgatgactactattcattcaaatttggcagaaatatcactgtgaacaagtttatgaattaggggtgcatttggctgcgagtaatagcaaccagaaacagaataaatcctgtcctgcttatttttatgtcatatgaaaaaaatctgtagacaactggttctggtatggcagctctgcagtgtcatcaggcattcaggcccttctttctcctctgccatagtagggggaatctgagagcatgctgtcaacaatagatcgaatgtgtatatagttacaaactggaaagcaagaatacatcatggcatatttggagattaattctaatcatggcatgaaaaaaatgaattagattgggacaatgtttgtaatagtcagcttaaaagtattaatagataatgtggcttatgtagaagggaagaagaaatggtaatgaggtcatttagagaaatgttttagaattccgctaattattcctaacttgtaattaaggtaggtgggagaaaacggaacacagggtgagcgtgagggtcctaaaatgtagacaaactatatagtggcagacatgctaacatctccttaatacaacaaccataacagcaaactaagaaactgtgattcccaagtgatttttcccgaaccgtattccgtattaataggataagtgtatgtttggaaattagaggccctgaaaaaaatcctgtattaatgaaatgttgaaacgtttagaattttgttttacccaatgtttcccaaatgtactgtgtttcattttgttttgttttaagcaaagcagctctatacatcctgagaaaacatttggggagtgatatactgtagtctttagtactcatcttatgagaaggctgcatgtgtgcctttaggatgcagacattgatcctggctttcactcagtttaattaggactctttaatacatctggttttaggtggtggagaacatgactttcactctgcagattcaggctgcctaataaagatagccctgtagacaatagaaaggaacttagattgagggtcttgctgtcataactgaaccatattcgtatggtgttttagtatggtgaaaacacttaatgctgtctaggaaaacatttgaatatgttgggaagtttagttagattatggcatgaactcaaatccataagattttagcattaaaattatagatttgccatgtaaatgtatttaattaataacattgatcatgatcacttacatctctgaaggaaatattaatgctctgcaaaaaagaagttaacttcttttataggttttcttgttgttgttgcatgacaacaaaaatgtcttcaaggcatagatccaaagttgctttctgtattggaaaaaataatataattgaaaacgtgattagcgaggagtttctacgtacttctccaatatgaatttgcctatggatgcctggtctgtagagccttcaagaaacgtaactgaattaggaaaaaaaaaaaaaaatcttcaagcaagttctttttccatgagtaatgcttcagcagtagcggatgtatttcagaattggtctggaatcagtagacttttgattccttagacataaaaatacaatttgaatatagttagtaatttcagtgaccaaaaaatttaacagggataaagacaatttcattattcacatctgtcaaaaactcttgttctggttctcttgaacaagaacatgaaactaaattaaacaaaacatctattttaattcttggggtatgacttgtatacgaattgaattttcttgtgagctgaattatctcatgtttttattcattgttaaaacccttgttagagctttttctaaagtagcaaatcattgtttttttgatagaatgcttcaaagttattggggtgatcctactggatattattatttggtgcgatattcatagaaagtatacatagtttgattatgtttatgtgtttcaggtgtgtccagaaagctttcggttttaaatggattcttgtcagttatatcttctgatgtacttagttctaggggaaaaaagagcaggtttgtcatagattcattataggtttcactttgaatacaagatgaagatactggtggtttggctattagtaatgaaactgaaaatattgtatgcagatttttaaattgtttctcagactaataaaatttttgatttacagactttttcattcgttaatggttttggagaagataattggaaattctgcatttcttcttattttgaaggacaaactcacatacgactcttactctcctgataccttcctggagatggttagtaatttcatctatggtcatcataaaaatgtgtaattccattgttcttgcattagcaaagaggatgagaagcttaatgaaaaaagacattgaaatataattttttgtacattatttgaaagaatttttatcacttaatataaattacctgtatgttcatcttttctataaatatttcaaagtatgtgaaatatgtagggttttagaatactattaagatgttagtaaggcaactggggcattataactagttgttttgcttggctttaattagaaaccccttgatatttaactttttataagtccttaatctgttcctcctaaacttgaatttgaatggtcttctggtttcaggatgagtccatggagtgttaagtaaaattaaaaaattactgttcatttttataggatttgaaacaaaaatcacaagattctctgccacaaaaaaatataataaggctgagtgcggagccaaggtaaattcataatttcttacaaatgtttaccactttctggcttaatagtttttggttttatggttctggtttttagttagcgtatattttgaggcaatcaatttattaattaaaaaactcctaaaaaatggattttctttcatgactgtgttatgctcagtgccaatagctaacacagtgcttagtatattgactgctgaataaattattataacaatatttctcacagatataaggtatagcatgataaatatatagcttataaaacattttcttatctctataaaattttcagattatatcctttcttgattaacctttcatttaactaccttgttttcattaatccctgatcctatttttatatgaaagaagaaactttattattattggaagatcaaggtttctactgtaaattgtttattagataactgtcattttgctggtgaaacagccttgttttagcactattgatttatgctaaagtaaatgggaagggtgttcagtgaccttaaaccagggcatttaattggtggctacctaataattataaagaaatgcattatgttttattggtatttctttaaacagcaaggtatctgtttttaataaccaaatatttgttggtcatttcctagttgacccaggcacacagtggttattttttgtaatataacctttaactgtcagaatcaagatatttagtacctcctcttgccaattataggataaaacaataatttcaaagagtaattcattatttcaactaaatatattttattaaaattatttaaaaataaatggaatgaatgtaaaaagaatttatagttgctagtaaagttgagactttttgttaagcatagactaaagtcttagttgtctaaatttctttagtaagtagagacataaggtgtatacagcttattccttagaacgagataataagtttttttattttagtaatactaatgttctctgtaacacggcagaagccttaggagctttcagattgccaggtcatagttaggatgaaaggataatgacactgaaagaaatatttcttataaaattacaaaatgttttctttgtcttaaaataagttatgttttgatgcatttggggttatatgcctgttccttaaatattgtgttcctagtaaactctggcattagtaaatctatttggctttaggcatagttctctcatctattaacttttctttctttttatattttggtggaggaagatctttgtttttgctggttataagaataatatatgctgatataagtgatttgtgccccatctctgggtgctcttatgctgggtgcagtgaggcagggctggaaccataataggtcagaagaaaagatgttccctttagtttatctccttccttcactgtctttgccttagcaaacaataattgataattttgcctttctaatgccagaagaagaaagttaggaaatgtagtatattaatgaaagagaaaaatatttttaagctttcatattgaggagttttaactacaggtaaacataaatggaatttcgggggctattagtaaaatgattgctttttgatatttctttttaaatagtttttatttaaatagtatagggtttatcttcctattacttctttacagttctttttttatcaaatattgacttcctatttctgtaggttggtaaattaggaatacttctgattggcagattcttatttgtttttatgcttattatccattttataggttagggcttcttagattttaggttttaaaatctctattttacttgttagctgcaaattattttagttactgatctgtcagtaaaaatagatgaacaatgaaggaatgatagtggcctttaaaatggaagaatttgattgttttatttagcaggtactgaaagtaaaataattgcccttttcagtttttaaattggaagccttagaggtgtggctgtgagtctttgtcatattcttcatgagtcttctttaatgttgtaagggttggctttttttttagttataaacacagttcctgtttgagtaacaaattatctctctaaataaaccatgcattctcgatgggggagatattttttccaagagagtgaaaattggtttttggggatttgaagaaaatcttactctttttaatatataaagcacagatatagtacgtaacaggtaaacagtttgtgtgtggcattaaaattgtatgtgggtgattagtaaatgtctaaaaagagtccttagggaggtgataatgtaaaaaagattgagaaatactaacttaaacccatagaatataaataatacacgtaaatttgatcatgctgttggcaatattagttatagcaataaacctaacataactttgtaagtatttaaaaagtagtccaagatctgtttaaagtgacattagtacatgttgatatgcctaatttagttcacacagttatgtgagctatatcatgtgtggattcgtagtttttgtgtagaaaacagatacttcagaatatcaactaagatataaaaagaaaagccctcccataacgcattgccattggcttgtttaatggttctccctggatgacctcccagcaccaataatttaagttcctctgattttctccatacatgctttccttttggatgccagtcttgattaaaagtattgttatctttttagttatctaggttctgaaatcccagaacctactttgacctctaccttttattattccttaaatttcatcacttggagagtcttttttttctcatctgtgaaatgcatcttctcttttcctgttactttttggttctaagccatacttcgtgcctgaattacttcaacagcttcttacccttttgtcttcaatttcctatgccccttatttattacatgaagttatcagaggaatctagccaaaaacagagctctgagaaagtcacttctaaattcagcattctctaggtacttcttcttacctattgaggaaagtctgacctgatggtcaaatgttttagtagactattgcctaacaaactaatctaaaacttaatgtcttaaatacaatttattatatttcccacgtttttgtagaactgctggtcagttcttgcttggggtctctcataccattgcaggcaattggagattgggactggagttccccaaagatttgactgggctcagtgtgcaggagggctcatatacattgctgaaagttagtgctccctgttggctgagggttcagttggagctgttagctgccagtacttacacatggcctctccatatgacttgggcttctctaaccatagtggctggttccaagggggagtgttttaagattgaaagtctcaaaagtgagttttctgggtagaaacagcaagacttcttaagacctagctttggaagtcctagaaggccattttcattacattctattggtcaaggaagtcattaaggttagccaagattcaaggggagggaattactctccatttcctgatgtgaggagcatgtataggaagcagtgggaatgatggtagtcatcttcggagactagctatcacagttcacctataggctacctcagttcacatacctttcatgtacggagtaacctcacccacctcccaagatgtccaaagtctcatcccattatgctattagccccaaatttctacctagatcaggccaaaatgggtcactcatatggctggcagttaatgctggcttgtttcttccagtataattatttaaagttaatcacagtagattgtaaactccttgagagtaggaattatttctttatttctagcatcatgcctgtggtattatatgcaacatagcaagagtaattacagattcattgaaatacatttaaatattgactgaagagaatattaagcttcagacaccagatatgcatagaagaacatggttcacattctatgtgaaaatgtggtatcctggtatatattctcctcaggtggttctttggtctcatatttggaggttgggtgccagagtgcttctaagtaaactttaagaccgttacaaataaagataaaccataattcaataaagcttggaatttgtataactgtccatttaagattttagttttataccatgagacctgaaaaatttcagattgcatctcagcatcattgcattcttacagagttaacttcgttaagattggatattgggtgaatgttcagaatggatggatataaaagatagttccaaatagctgaatgaattggctttatcagattggtttttatatgtaagacttattgttatgatcaacatagcctgattctacattttgtatttttaatattgttattgtaaacaattcttctggcactaattatctattagtttaatgggattcaaggctagcttttttcttttcttatgttatcaatatatttttataccaagtaagaatgtgtcttagaaaatatctaatatctctaccagttgtttacacataagttttaaatgaagaagccaaactcgcaaccttatttttattgtttggaaatggaatttctaggaaaatagaattctgaccactcagattgtggcagcattatttgatagaggcatttggagcttaacggcggaagtgagattccatgacttgaaccaaggcggctctagtctgagaagtgagtctggtgaaagagctgttagtgtacagagggagcgcactttgtgctcaactgtggaggagatggaagtgttagctgcgataattagtccaggaactgtccttaatagctcatggattatgatggtttaagcttaaaccttgacacgtactagaaaactagtatatagaaatgtctttccattagttaacagaaaaatgagtgtaaaaagtcagtaagattaaaggttttctttcttgaaactggtcggctatattttttaattatcctaaagaattcaaggcaataatagaatacaggatttgacatcctggaccctctccagcttctgttattttgagaaaagctgagatatttttaccttttaaataaagctgttttgaacttttcttttggtgagggaattagtaactgatggtcctagagactcttaaacacataaaaactaagctattctgtattccagtctagtttagttgtatctaggcattaatagtacagtgtatttatgaattttattggatttgaaggatgagtttataaactgtcctctaggatgcttttctgtttaaatatatattgcttgtaaaaggtatttgtatgttttcacctatgttctgtctctgttatgtgttaactctgatttttttcaaggtataggttggctagttccctgattatccagaagcacttttcatcttgtctgtagtctactggagtgttttcagaaaggatgctttatccaaaagactgaatggaatatgttatattatgtaaataaccaaaagtttcttaaggaattcaaggtacctgcaagatgctacgttagttaattttatgttaaaaattatttgcattgactagtggttggtactagtgttggagcagtcatggcttggtagcaatacaaaataatcttatttggtgtttgccattccaattcagtcatcacaggattacattttgcctaatttttcaagaaaatataaaggtctcttggggaggaaatgaggagaaaaggctccacctttgttccagtccctcccacccttagcatttctatgtattttatgacatcaggaatgatgagtattaattcctgacatactgtttcaacctcacattgactgaaattaaataacatctattatattaaaaaaatagttgacacttccagtttacgtgatggctgactagagaccatgagactgactcttagtttcccattaaagctcatatgaaaatgtagaagatgatgaacagttgtaggaataccaaaaccttggcttgacagtcagtgtattatcacaatctaagatgtccacaaactacaaagctgatagaactggtctgaaaaatgcaattacttgctgattaatgataagcagttagaaataaaagcaacctgcatgtcttttaaagcaagtatggagaatgattccttttccttttcataatgtctacccccaaggctttcaaattctggtattatatcaactagaaaagtgaacaaatatttttctattggaagagtgctacttttgaggctattaggaagttaggtagcttttcttttttttctcttcttcctccctgcctaaggtctctgttgaccatcttcatttaattgaccaagtagatcaactgacactcttcattccttttcagtgcccatggtaatgtggccttgtagctaacaggctgttagctagcaggccaatgtacttccctccctccagtctttcagttgtgtgattatcatgaatcagttatttattcctaaacaagttgttgttatttttttctcataaaccattttattacgctgttgaattacataaaaacccttttttatgaagttgaggactttggaaatattcagcaaaggtgagtcactgataaatgttggcgagatgactgcaaaagatttgggaagaaatcataaaaatatagaagccggctgcactcagattttcttaacatttttgagtttaagttcttgctatactttagagaaacctaagcttggaaccacagaagattatcacatgtttggttatgcagaaaatatgaaaactccaattactggttccatagtcaaaggatttgcatattttgaatatgatacatgtatatatttcatggtaaagtaaaatattaagaataacacatacatatcataatgatcttctactttaacttttattttcagctcaactttaactctttctgttaatagatctattgccagccttgatcacattgatgaaagggcttccactgtgtccatattttgcaatcaatttggagactaaatctgccagaaataaagtaggcaggaacaaggaaacttaacgatagatcattgagctaggaaagtccgctcaaggaaattgctgttggtggtggcatgggcaagaatactgtgatattctttgttgaagaaagaagccttccctttgttcagaatcagagctggtatagaagactgaataccaatcaggcacagccaccttggatattaaaccttttggaaacttgcgatcaggctggatccatgcatgtgagcctattattcacccactctttttctccatcactgaatcctctttacatccttcatgacattattaacaaactggccatgtcatttattccttattgtgtgtctcacttggtagactagcagctccatgagggtagagagcttgtttggttttgcatcccctggcaaatacctggcacacagtaggtgttcaacaaatatttgtcaaataaactaactacgttagagaaggacttcagctaatatcaaaataaaaaggaccaagggtagttttagcaaacacagagtctaggtaaatgtctacttctttgaggataagtgattgaaaggttgtcataggagagctgtgaaaaagctctacagactgattaaaaaatagggtgcagcatgaagactcagaagtgtagcttacttattaaaatgatttattacagagaccagatgaaaatttttttaaaaaaagaggacctggaactctcaaaaagttttgagttataatctctgagaaatatgaaacaaggtgaaacactgaaacaaaaagatgacaaaaaatgaaaatgaaaatatttggaagaggagaggagtgagataaggagagattgttggaggggcaataacagaccatcttcactagtgatgctgaagagtaaagctgacactgaaagagggtatggatgtgaaaaaaaagtccatgagatacttttttaagaatgtagacaaaaggaagacaaatgccaacaatgagaaggaagatgatgatcggtatggaggacaagattccaacaaaagaattaaaaaactttaggaaaaaatacagcagaggcaatgatcaaagatataattgatgaaaagttttctgagctgaaaaggcctccctttatagatgaagagggataagtgctgggtaataaaaatgaaaaaagagccaccccgagtacaccatggtaacttagttcaactaaaaggaaaaaggacatattaaaaaagtgcccaggcagaaagactatattgtataatatagaacaaacgctagactgacttagacaggaagactatgaagttttgaaatcattttatactcaaagttatctttcatatgtgaaggtagtagagagacattttcagatatgaaaacacttataccacaggcacacttcccatatttttaaaaagaaattttaaaaatttcttgatgaggtcagttcagctgactgatagatgaattaaaattagcaattaaaaatgaagaattaaaaaggcattggaaacaattagacgtagtgaaatctaaatcattattgtcaattttattgtcaaactaaaggtagaagtgtccatttagttttgatagaatttaacagcaccatggatctgcagcttcaggttatattaatgcctgaaataggtggagaggcaggagcatataggagatcctaaataatagtttttcttcaagaagatttaaaaaataccaacttctggtgagagtgatatttcgtattccattgccttcacttactatcagtgtactgttaactcctcaaacatctgtctctgctgagaaaagtctcctaagttctagacccactggccaagtggatagctctcttgggatggcccattagcagctccatttcaccgtgtttaaaacggaactcctcttccctgcttgaacctgttctgtggtcccaagctctttcaattttagagtgaccagatatgacagttttttcactattagcctctttcactctcaaaattagtttggacaataaattatggggctaccctgatcatcttgtcttttttactttcaactcgtatccaaacacatgctagaccttttcattctgtgttttgtttgtttgttttgttttgttttgttttgtttttgagatggagtatcgctctgtcgcccaggctggagtgcagtggcacaatctcggcttactgcaagctccgcctcccaggttcacaccattctcctgcctcagcctcctgagtagctgggactacaggcacccgccaccacactgggccaattttttttgttgttgttgtatttttagtagagactgggtttcaccgtgttagtcaggatggtctctatctcctgacctcatgatccgcccacctcagcctccaaaagtgctgggattacaggtgtgagccatcgcacccagcctcattctgttttttaaatgtgtctcaaatttgtcctcttcatcttcaatgctactaccctgcttcagactgctactgtccctccactgggtgatggtaataaccctgtgacagatgtccctgcctcacacatttgttggcggagtttaatacggttatgtgtatgaacttcatagtatgggacctagcgcttagcaggcacttaactaatattagcaatgatgtaacttagctcaaaacccttcttttttccattaccctaaggataaactctagactctttaacgtggcttgtgtgcctgtatttttgtctctcgcatcatctcttgcatcagctcagtctgcactatgtgctccagccccacaatgactctattcagaacacaaaaattcagagaactatcaattcttggacactccattttttgttatattacctctacatctttactacctggggggttaaaaaaaacaaaaaagcaggccaggcgcagtggctcatgcctgtaatcccagcactttgggaggccaaggcgggcagatcacctgaggtcaggagtttgagaccagcctgaccaatatggagaaaccccatctctactaaaaatacaaaattagctgcgcatggtggcgcatgcctggaatcccagctacttgggaggctaaagcaggagaatcacttgaacccatgaggtggaggttgtggtgagccgaggttgcaccatggcactccagcctaggcaacaagagcaaaactccgtctcaaaaaaaaaaaaaagcgaaagaaccaaatcacaacaaaaaatctccaatcttggccgggcatggtgacttaccctataatcccagcactttgggaggccgaggtgggtggatcccctgaggtcaggagtttgagaccagcctggccaacatggtgaaaccctacctctacagaaaatacaaaaattagccgggagtggtagcatgcacctgtaatccctgctacttgggagactgaggcaggagaattgcttgaaccggggaggtggaggttacagtgagtcaagattgcgccactgcactccagccagggcaacagagtgagactgttgtctcaaaaaaaaaaaaaaaaaacaacctcagacttcacctctagatgcacccgaatgtgcacacacacagacatgcacatgcacacatacaccatttgcctgataaatttctgattgtcttttagaactcagcttagatgttacatcttacatcctctggaaacttggttgagatccttgaagctaggtagtgttctcatatgactccatgggactgtgtttacccactaaatgcctgcgtaatagtcctctgaagagacttgctataaacctcttgccggtatgggttggtcttgttcattattccaaaatggtgcctagcaaatctttaaggaaaatgacctactgccagtagcatttgagctaggaattgcactagagggaatctgtcctgcagaaataatcagatatggaggtggagagaactctggaaaaggacgtgcatttcagctttgtttatcatgtgaacaaatattttaaaagacttaaatgtttatcagtaatgaattggtcaaatattctacatgtgtaagttatatagaaagatttttaaaagatgcctaaattagcatttctttttgtaatagagaacatagggctggtaaattctgggattttaacttaagtttttatgaaatttgtgttttcaagttttatggagtaaatgaagatgacttgtttgaattgaagttgtgaatggttgagtgaaatatggaagaagtgcttggtacataggaggtgtttgctaaactaataactaaaaattggaggtggagagagtgaaaattatgagaaaaagtcatgtaatcattaggcaattaaataatttatccatagtgatgaacccttatgggaaaagttttgatttagaatcatctcgcattcattgttttcttctttaaaggtgaagttttttgtacttgttggctttcctttgttacccaatatgacttcttgtatgtatagtgtttcattttgtattgcactgaactgcatacaacagaaaccttattacaatggcttctgaagaaagccttttattattcttatggacaagtttcaaggcaggtagttagggctcatgatgggttccatggtgccgtcaaaagtccaggctgcttttacctgttagctctaccactgttagcctgtggctcttgttcttgtgaactcaggatggttcctgcttctacatacagtacatctgtgtttcgtccagaaagagggatgagcaaaggaggaaggtcatggcagttgggataaactggggactcagtaactttgtcagaatttccacatactggaattctaattacatgtcattgtccagaactgtgccacatgtctgcatctagcatggggaagcaggttttttttgttgttcattttgattttgttttttaagctatgactgttgccatcctaaataaaattggctttctatcaataaaggagaaagagataatggttgttgggtaggaaggagcagcatctgcaaattagattcattaactagatcaaaaagcagctaccagattttctgtcagctactcttccttgcccacttcggctcagggactggagttgtgttctgaatactctaggagcaggtctatactgaataaatcagtaatggttgttagaaatgtctttaaaacatgttctcaagacttatcagttaggaaaatcataccaaacacaatgaaactgaaaaattttctacatattctaaaaccaaaacataattagatgctgcaaaattaaaaatttaaagagataaagaaaagctcataaaataagagcatatatatacaattgagatttgggttatttaaatattaagaaaatagaatatttattcttaaacatttcctgtttatttgtaggactatgtgggcctatgttaaaatatagttccttattctttgattcatacattcattcattcagtgacaaatttactttgtatttctgtcttgggcagcactgtactggtatgtgttcatattttcttgcctctttcatttcttcttgattctttcttgctcagaacctacacaggcaaggtctcttttctaagtgacctgtgatttatactgtactgtgtagactgcccataagacaaaccctcagtgccttacctgaaatcttcaggggtagatgtatgtgagggttcagaattctttttaattttaggaaagtactgtgcatatgtggcatattattgcacagtctcctttgaaatttctgaatgttccgatcaaaaaataaagattctataaagcttcatgtcagttctgtttagatttactaccaaatgagttataaaaaagcttttgattttttcagagctttttggatttcacagtttagagattgtagttctgtagagtattggtttgggcgaattatgaaattgcttaaaataattagcaagcttcctaaaaagatgcattatagcagaaaccattttgattcttctaaatggcattgattgttactatcatccatacttgggtgcctcagcttttctttgttctgattcccatcatttcaaaaatctgttcaaaaatgtctgtctcttaagaaatctttgctagctgagcagtgcttttcacccttttgtaccacattctctaaacatgtaggtatttaggtgttgactttttttttctttgcgagaattcattccttgactttactgagtgttgtagcttcctaattatacttcaagcttccctcatcatctgaattcattttttcaaaagatttatcgttctattcttgcatctcctaaaataatgctttttgcatttcttgcatcaggcagtttaaagtttatgataggctacctaatacaatataattaaatatatatttttactgtcatttagaagttcgaagaaaagtgtttgtcattaggctattaccagtctcacacattgatttttaagtgatatgcagtgtgggatttgccttagtgctttaacagcataggattttaaatcattcttttcttcaatttcacatgaactttaaaagaatcttccttaccaggcccttataatttagtctgctatgattttgttcttaggtacaaaattcttttagattttatttgtgaaagtaattaaacagatagattgcatttaaagttatattttttatttttatttcttgaaaaataaaggcagagtagcttaatgttctgagaccacctgctaaattgcctggttagtctgtgttttaattgattttgtttatattttaagtcaaactttcttaattaactaattgcatggttctagtttattgtcagattattatacagtgaattcagtttgcaaagtgtgttttaattgtgtgttttgtgtggtgagattaaacttattttgcttgtttcttataaataacatcttcatccatcaaggaccataatcagaaaatgcaaatgatggggaggaaaaacaggtgctcatatatatagaattatgatgaggtattttgatatattaaaatatgaaggcagaattgtcatggaaagtaccatgtataatggataaaggattataataatttctagttaagatatttggaaatacataactgtatgtaactgaagaaaaactttgaaaagaagacgaggtggtgtcaaagaatagctggtgttagttttggtgtgtttgctagataatataaattttgaatgattctgttttgctattgctgtagcaccaacacttgaagttgtataaagtactgtgaaaatgttaaagtaaactaaatatctggagtatgagtgatttttaaaaaatgatttctattggggtgggagtaactgatggttacgtgagattacttcagtagcttattgttttcagtttcttgcaaacttagttctctgtccactttccacttcttttcctcccagtgtccatcatgtcttctgaaatagtaacataaagctaattattaacccaaagcagttcagaacatagactaaagtgatgtggcatatttcaaagtcttccactcttctgaactagattttttttccttctaaatgcagattaataaagcgtgcacaacaagaggaacaaggaaaaggattttagtgaaggtatcctgatcctgaaaaagtcagggagggcttcaagcccatcttggacttcagaacacctcacaactttgtggtaaaagaaacattttaaatagagcctttggacttatttatttcatccttattcagagagtagcgctttttttaaaatttttattttttttaggcaagacaattgtatgtgaaatcgcgttacttttcaaactgaaacatagggtttcagatttgttgtaggtacttaatatatactcaaaatattacaggtagttggttggcttgtgtgtttttctttgaaatgtgttcttttatcccttgtgacattgtgtttgcattcactgtgagtgatgttttctctagtgttttgtatctttaatcggttcattgggttgtatagtagggagtctttcctaggaccaatattgtttctaaaaatactttgaaagtagaaagtggtttgtgttttattgttttcatattttttaccagtcatatgatggcttactaatgtgaagagatgtagcactagtaaaaatttgttgttttctcctctattcacctggaaacctcacacaggatagatttcatttgtcaacacagatatagacagtgaatacaaacatctttgccatttctgtccttaacaacaaaacagtcttattttactttgttaactttttaaggtcctttttatttgtgaaaattaggttgtttatgtactatgtgttcttccaaagttacagagttatattcattggagaaatgaattttcttccagtagatgaaaattacattttgattgaacatcattccttatgcagtcacccataaatataatgtcttttgctgtcttttcagaaaatggctacagatgtgatttctgaattgacaaggaaatagaacatcttaatgttttaggtaaaacagatggtatttttgtttgaggcaaaactcagagaaagcaacttaattggtgacaagactcttggggtcagccaaattatatacaatttgtgtttgtttttgttgctttaatatcaaaagttttagaatacttggaatatttattcttttatttgactttactattttctgttgtgtactggaaatagttgtaaaatttttcaatcttttctttacaaaaattgtaagtccacatatttattctgcttcggttacatttatggtcttagaaatgctttttgcattgtgaaaagttcctgaaatttgtagttctacttttgagggttaacattttcatttgtagttttaagttgcatttgcaactacaaattctgtggacattgataccaactctgttctttccatgcctttgagctctaggcagatctcactgtcagatgcctggaatttccggagcacagtgttgtgaagggacccttgcatgagagtcagaggactgattctagccccatctctgtcactaaccagctcatatttttggaacttcagtttcatttgctctctatatttggcgggtattaataggtaatccccgaggtcacatccagttaacatttggttttcttgtctaagtattaatcatttataaagcaatcatttggataaacaccaggaaaggaagttttgaggaagagactactgtggacaataaccaagtgtttccagtaactgggacataagataatctgtcttccaaaatatctccagtattccaaaatgaagacctattatgtagcaaattttctttttaccacctcttacagaaattcagaactgggtagtgaaacaaccgcttgtgttgtcatcatagcaaccaggggaagtagcctaatcctcacctccaggaaaactcctttaccccattcctggcactgcaggtggggaggctttggagtgaaggttctctgctggggtgaatatagagcagtctgataaggctctgttcagagaggcagggggagggtaatgggattctgagtgctctagttgctgcatcagtgcttctagcacgtgcaccctgactgccttacccactgaagggagacagcaggtcaccttccctgtctctgactccctgacggattgagtttgaatcctggctgtaccatttctatggctacataaccatgagtaggatacagaaccattctatgcttctgtaaaataggcttgtaaagtaactgctcagcactgttttaaggctaattaagtgctagctgttggtattattatcatcatagctgctaagattaccataacatctgaaaaactctgctacgagctaagtcatttacttaaatatagcaaaaatattcctttaatacagttttatatttgacttactgctttgtctgttagtattataaacaaacataactgtctgccccagtaatattttctaacatagagctttctagaatatttacttaataatatcatactttccttgccattcttagtttagaaactaaaagtttattagtaatattttgtggaattcttgcatttgaggagaataaggtatttgcagcaatcacttagttgccaacagcaattttaggtactgtggtcatactgttttgtgaaggacaactttatatttgcatttgatcacacatgcagcatgcttgtttaccttccttttgaatcttttccttggacaaatggctctccatgggatgataggctcataatattttgtccatgattttaagaatgatttctcctaaatatagagaaaggtgtgaaataaactttcatatattaggaagatagggtagcatttatgtactactatatccaagtaaaattctaatttttattgctgaaagagtgttctgtaccttagcgttgaatttttttttcttgtaagagcaggccatatttgttacttaaccagctagtagcttccagaaaccatcatttaaaatttttcccttgtgaatacaggagagagggcaaagggctagacccacttcatttaatctttgcttggtcccagttccaaggaccccaagctcttcttgcttgttactctttgcccacctccatcctgttttccaggactcaggattttcttttatatatccttggtggtatgaaactggaagttagtcctcattttcaacaggaatagtgtaacctggtatattagtttcctgttgctgctataataaattaccaacaaacttaattctactaaaaaatacacacaaatttattatcttatagttttgggggtcagaagttcaagaccattttcactggattaacaaaatattggtagggctggttccttctggcggctctgaggggagaatcatttctttgccttttccttttctagagatgacctgcattgcttggcctgtggccccttccttgtatatcccatccacttggttctgttgtcacatagtcttcttctctgttggatcgtccctctaataaggacccttgtaaatacattgggcccacctagacagccccgaatgagctccccataccgtgagctgtaatttaatcacatctgcaaagtcttttctgccatataaggtagcattcataggttatggaattaggacatggacatcttggggtcattatgctccctatcatacctggaaatctgatttttaaatttccagtggaaaaatggatctatctgtcttcacctttcctgcctaagctatcaacttgaagctatctacttcgccgtcctgctttgagccttcaccccttaagttctttctctgcctggcaactagaaataggtattaaaaaggaaaatttgaccatgttaaaccttttccatcaactgcacaaaaagctccaagctccttgtaatgactaaaagacaacccactccccactatgacttgagttttatctacttttctaacttcatataattgcattttagagatgcactttactgtgtagcgtctagtggtagtggcctgtatatcttgaaaataacattatttcccgtatatctgtgtctttattactgaaaaggatttccctgcttcctttgccctttaaaaaatttgtttgtttttgatgttgttattgttctgaatttttctaataaacacgtaacttcctgtagaatagtgtttacatccaaagctattaaaaggatttctagcatattcactgataaccctagaacctagaggaggtaactattaacaacagtttctttttagaattttatatatttttatatttcactgcttattctttgtatataattcagaatattcttttgtatttaataatgcaacaaacattttcttgtatttaaaaaattctttataaatatttaatggctattagtattctagtacgtaagtatacttttaattgttaatgtgttccctcaatttaatattatattgattagctaatataatgttttgaatagtattgtttagatatttacattgcttagctgtggaaatagtttaaatattttttgtttactatatttctgtttttctccttacactaatttttttttttttttttttgagacagagtctcaccctgtcacccaggctggagtgcagtgatacagtctcggctcactgtaacctccacctcctgggttccagtgattcttgtgcctcagcctcctgagtagctgggactacacacacgcaccaccatgctggctaatttttgtatttttagtagagacaggatgtcgccatgtttgccaggctggtctcgaactccttacctcgggtgatctgcctgcctcggcctcccaaagtgctaggattacaggcatgagccaccacatctggcctccttacactaaatttctaaaagtaggaatcattggattgaaagacagactatttctaagttatagttttttctgattataaaattataaatgctagatataagaaatgtataaagtatgaaaaataattataatgctgccacctaacaataagtattgctaatattttggtaagtcatcaagttatttttctcttctttcttgccatcttttatagatgattttaatattcttttagtatttacatagaaaagcatagatgacttattatagtttaattgaaattattacttttgtgtttttttgtgttgtcatttatattttcttatatatttacccctctttgtgctcttcatttttccctgcaatctcatgtttccctctgatattattttctttctgcctgaagacttaacgtttctttcagtacaagtttgctggtaacccatacactcagtttttgtttctctgaaggcatttttatcattttctaaggatatttttgctggatatagatttttaggctggcagtatttttttgtttcctcaccacctcaaatatataattccattttctcctggctttcttaattattttgatatgtcagctgatgatcttattgttgcttctttgaacagtgtaatcttatttttactggctgcttctcagattttgccttttcataggggatttaacatgacacaccaggtgtattttctccgtttggggatcacagagtttttttgtatctgtgggttagtccctttccttagttttgggaaattctcagctattcaggtaattatattgtgctattttctcttttatttccatctacacatatcctatttcacatattagatcttttcactgagttccctgtgtccctaacgttcttttctatattgcatattctttttttcaccacttccatttgtatgttttttattgacttctcttttgctgagttaaatatatttattctgctattgttaaagatatctttggagtttttaactgtaaatatttatccttttagaatttcatttgattattttgtaatgtgttaatttctatggtaaaattctctaccttgtcctctacttgattcatgtttttctctttccttggccatattaattataattttaaagtcatgtcagctaacttcaatatctgggtcatgtatagttctagtttctttttttcttggtgtttagtcacgtggctctgtcttttgtgatgcctcttaatttcatattgagtactagacaattgtgcataaaatttagagagactctagaaaatatcttcttctagatagatgttccaatcaaggactatgttaaattgagactgatttattcaacctgttgttcacctggctttctaagtaatttttcaactaatagcctgcttatattctgtaggccctatcccctggtgggttctggaatgtcatgagatgtctctgctctacttttcagaagctttctgttcaggttttaagcttccctttctgcgcagcctcagtatttggcacttgtcgtaatgaaaaaatcaactgtgtacctgaagcctcccaaagtctccacaaaatgctcttttgatctctttgttccccagtgatttcttccagactttccactaggttttgcatggaactcacagcctctcccttgctgagaattggcatgccccagagtgaaaatgactgcagaaggctggtcacttttctgaagttttttcctctcttcagcagtttttctgttgccctcaggcaaatgattattattttttatctggcttttctagttggctagtagaagtgagagctcttgtttgttgacagctactccatttcccctggaagtggaaacatcatttatttctcaacttcaatttgacaaaaataaagtgctcacctttttttcaaaagagtgtttatatttctgttgatttataagagcactttacaagttttactattttttttttttttagtttttgttctttaatctcatttttaagatagaaaaatttttagttttttgttaccaaatctgtcagccttttacttcattgtatttttcagttatggctagaaagaccttttgtaccacagattatatatttattttttctactaactttgtatcttttttatgtttcaaaatttacatttatctggaatcagtgttgacatattgttttaatgcatctagtaaccatttgtcttgctcatctattattaaggatgtatgtatattatagaattgttttgcccatctcatgatcattttccttccctcacctttcttccaagaaatgaaattcagtgggattttggttggcactgcataagacttacgaatgaattttgggagagttgtgcttttgcattattttagttttcttatttagaaagatatgtctctccattcatttttatgttctactaagtgacattttttcattttctgcgtatattatacattctgctcattttgtataaaattaattttctgttttgattggtctcctgaagattgttaatcttcctaacagccgtgtgtgtgtgtgtgtgtgtgtgtgtgtgtgtgtctgtgtctgtgtgtctgcatgcatacgtatgcatcccatgacatgctattacatacctttgtcttattgcctaccctgttatattgaacttaccagtttgtttctgtgcctctccctcctaaactgtaggtactttgttgactgggattatgtattcatattcataagtttataactacacataccatacagcatctttctctcctttctttgcttgctttttaacttagccataagccatgtggttactttgaatgtgtattctcaccactaccatgttatcagaattcttgtttcaagatatctgtattatcacctgttgttaatttcctttatttagatttatacatgccttacacaaaaaaaggatttatgacagctcattgacctgggtttgttaaatcgttcactgtactacccagtgtgatgatgtgccagggtccttggtcaggataccatgagagtcttgtaagggaaaggagagaagtgaattgttattgagattctttttttgtgcttggtctgagctaggtggttttctaaacattttataatttaacattaacaataatcttgtttcccgattttatagatgaggatattaagtcttggggaagtgaaataacttgtccaaagcctctgaaactctaagtgacatggtggggatttgagtttgaatgtgtctgactcaagagcccaggaatcacacaattgtgatttttgaagatctagtataactcaaaaagacactcttagtttttaaggtcttgaattttttcctgtcaatatggtaagcattatattttaaacctagaaaacaaaatggtatatatcaaaagaacttcaaatctagatattgcaacttctgttaacatgtaaattcatgtttccatattcagaatactgtataaagcttaatgtttttctttaggttatattccactaatgaggctacttagagaagatgaatgcattcttgtttgaaatgatttttttaatatgttgtcattgattaagagtcagacaaaatgagctctaatttttgctttattcttaactttctttgtaatattgaatgtgccatttgccccatctttacaaagggactaattatataatttatattttcgaagaattgaaaagcactttttaaggaattgaaataatcaaaatggaactgctctgataaaactataaagccccacatcagtagatactatttacaagtaataaattctcctagtggtatttttctgcactgatgattcattaactactgaacattattctgtgctaggtacctatagtaagcacatgaaattacagttatttttcatatgccttttggtgtttgcttaactgattttaaagtgcacttataaagaacttgaaaaaatatgtatttttttaatcttcattacacaatcataaaaatatgtaagttgcttttaaaatgtttcctcaaatatcgtttttgcttacttcatgcagtgaggtcatgagatgaactccttagtatatattgcaagtttttttctgttccagtgttccagtatataaattttctttcacaaatataatatacttgaaatgtaaatagcttattgcttatctgagcttcctgaggagagaggctctctggggatattggccttgctaaggagaaagttcttcacatttgaatttggatgcaactaagggaatctccacaggaaacttcagctgtcacaactgtcacaaagatccttatatgcctggcctgtgagtgaagtagttaagaagatgggtgtggaggtgaaattgcattataagccctattgtggcactttttacctgggcctgtcttggcaacattcctgctcttgttgaacctcagtttccttatatgtccagtgagaagaatgaaaggttgccccacaggggttgcccatgcaggtctgaggaccagcccaggcatgcaggatgcactctgaatgaaggtccctctgaccaaggggcatgttccttccactttgtactgcagccagtcctagaaggaagcctgtgtgctcccagtctgttgttcacattttagtgggcactgattagatttacctcaaagagaaaattcagtattccatagttgtcttttttaacatgatatgaattacttctatgaaaggtgaaggaatttttagtatactcatcctcagtagaatcttcaaggacagccacgtttacactgggattcttccataaagtgattcccagtttgataggagcatacagatgttctttcatttttgtccattcgtttttctccagccaaagtagattatcttctgccctctagtttgattggcaggtaacatatgaatgctttttcttcatgaggtgagagtttttccttgtatatggagaactgagataattgctcataaccctgaattatgggggcccaatgtcacagtgagaactaggaggctggacgtgacttggtgacagatgatacgtaagaagctaatgctgatgtggtggaaattggagaagaaaaaagcactgaccttacagctaaaattgaaattaaccctccccattctgaagatataaacataattcttttgttaatgtggatcaaatattgttaattttcagtaagtgagtatgatattatgatatactgaaacctattggtttcattcacaactagagggcctgaaaggactcatgtttggggatattggcagtataacaaatgtttgactaccaaatgtgatgacaatgaaaattaagttatttatgattgtatacttatttccaaaggaaatatctatatatgatcatcctttctctgtactctacttaaaatgtacatagataggagttcgtgtgtcagataaatttgttctgtgatgcacataaaaaacatgctgtgaatctctaatcatgttaaaaattattttcttagtgcaacattatactcattatatactctacacatttagtctttgaatagattcctggcatgataattacataatcattcagtacagtagaaacatcgttatggtcaaatactaattagctactaaaatgaaacaaaatagaacctagttcatagcttattataaaaagtgatttaatagggtgcaaaaccaaatatatggttaaaattattgtttgcattaagtatgagtacttttttttcatagaaggaattagtgttctggatgcttattatctaatttattgcttggacacacattatagtatcacagtcttcatgacctttggctgtagtggagcacccaaagaacatgccagtagggattctaggcttagtgtgcctaggtatgcctcagggctactacagaattaggagattggccaaagttttcaggcaccattttctcaagttctttaaatactagctctgtaagcctctgggaacatgggtttcagtagtaaatcactcatttctggggttctgctttgaacatctttggtacagagaatgagtgatccaccactgtttttcttccccattgcaccttagaaatataggacagtcccattggtaataatgaatcctggccgttgcagttagccaggtgtgtttgtgaatggggaacagtcaggcgaaatgtaatctctggtaggagggctgtgggaggctgcaaatagattgacaaatctctgaggtaagtctgttgagtatacctctcaagagggcatcaccctccctcgccttgagaattgcttctgtgcgtaaaatgggattttatctaagtactaggaggattcgttgctctttgtaaatatgtttgtgactatgtggtttcatctgttcatctcttgtatacatatggaatctcagtgaacataagtaatacaagttaggtcctgttatcctgatgcatactgtaagcctaataggaattagagacattcttaatgtcattatcacctttggtatctcagaatgttgctttaacataaatgcttctgatgaacaatttataagtctagtgtcatggattttgtgttatatcctctttctttttcttcatttttcctgttgtcttttttccctttagttttggcccctgtaggtattcattttatttcttaatgaacactttgtaatgcaattaaagcaaaaatatatagaacacatatacaggatggaagaatactggtaagcttggtgctaccatctatagctacaatgtattgggggagaggtggttgttatccaactattcagtgtgttcctgcggttacaaaattgtataggaaaacaaaaatatttcagatcatgaaaatatgcactagtgaatcagtgagttatattattagtccaacatcctctttgaaatactcttcatttgaagacaatatgatgcaaattgattataaattataaaatcataaaccttgcagaggatgcagatttcatgaagtctgcaatgtgatggtctagaacgtctctgctcacaggcaaagccatgaaagaatgacagtctggcagagttatgctagtaagaaaatcaaggctgttgggtacctcaactgagaattatttgaacatcagaactgggagaggattttaggaaaaataaagtccttaaatattttttcaaatatagtttactaataaaaccatcatgtaaaaattaaatgttatgtgaaggatgtcataatatgctggtataaaatattggaaaaattgtgtcccaaatttcagttcatttatgtttttgttcataccaaaagttgcacgtagttgcaaatattgcctaaacttattttaatagtttgcattttcctttttctacctaatcccaatcaattttttttttcaccattacttactataaacatttggggccctgttacaagtggattcacttcaagtgaccttttttagaatcaactttctttaataataaagtcccattgtatataaaatatatgtgtgaattatgtgattttccatatatagccatacattcttagtggtctaaaatgaatattagatttttaactggaactcattgtgatgaaattgcaaacaaattgtgaattttttttattctgtgagattaggtaggaatcagggtattagttgtatggagctcattcttttaaacagatgaataaaaccgtatttatataagtctttttctggggtacagaaaagctttattacacatctatgaatatcttccatttgtaaagcattaattctttagaaagggcttctgaatcattatttaattaccctttgtactgtgtgatatttgttgtgatgaaattgcctgttctctgaaagttctcacagaatattcctgttaattcttctccatgagttgactctatgactgtccatgaactgaagtattatgaagggtttggaaaaaattagccagatgtagtagcatgcactacacctgctactcccagctactcaggagactgaggtgggaggattgcttgagcccaggaggttgagactgcagtgagctataatctccccactgcactccagcctgggtgacagagtgagacgctatctcaaaaatatatatgtatatgtatatgtatatgtatatctacatgtatatgtatatgtaagaagtaaaaatattttgagatcccaataatgaagcagctgtttttgcaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgaggtatgttgtagccatagaacttaaggaggcattgtaaaacaaacctagccagtatataatttgtgtatgtacagtagcccccatttagccatcatgttggtgtatgtgaggtgatgaaagttgtaaataccagagagtttaactggtgggtcaaatgacactaaaggaaaaatgatcctgtgttccctaaaatgttaatttctttgttagtatatatattgtatcttattatatgttgttcatatgtatattgtatatctttgtaaggatgcatactgtttattctaaggtaatgcagtaattattactcataaaattttgaatgttttgctctaagtgaatttaatgataattatgcatatcgaaagtgagataaataccacccttagtaactttggatagttttaggttttcattgcaaaggtgacataacacaccatggaagagaaatgccctaaaataattaagatgcttcttttgtgagatataattgtggaaaatctgtgctcaagttaataggtattttttgtgccaaagtttcttaaaataagcaatattaaactgatcactgtaccactagaaaggttagacttttaaaatctggaatgtcatttaaacggcatttctggagatacagccataaactaggaactctaagaattgtttctgcttgacagaagctattgctagctacttttattattattattattatttttgagacagaatttcgctcttgttgcccaggctggagtgcaatggcgcgatctcggcgcaccgcaacctctgtctcccgggttcaagtgattctcctgcctcagcctcctgtaactgggattacaggcatgtgccaccacgcctggctaattttgtatttttagtagagagggggtttcaccatgttggttgggctggtctcaaactcctgaccccgtgatccaccttctagctactcttaaatatgcatcatcttttagatagaaaggtaaactataataaaaattttggtcagattttacaggaagctttccatctagaaaatggaacagcaacagctcctggaaagcaggggtcatgtcttaaactgtgtgcatcccccatgctctgttcagtgtctgctgaacctcaagcatttgatggctaatgctaacttgtttaatatttatattatgtttatcatttttattaaccgaaatatcataatattgcaaaaaaaattaataattaggaaatggcattgttgtaaagcccttacattcatggaaaatttccttctctaggcattctagagtacagccaaacaattgagaatgatcatacaggttcacatattggataaaaacattagtgcttttgataggcctaccaactttaggttattaggttctctggataaactgagacatgtatggtttacccataagatatcaaacatttatagaatattgttacacagccatgccttggtatctgtagaggactggtcccaggaccctctggggataacaaaatctatggatgctcaagtcctttatataaaatggcatagtacagatgatccctgacttacaatggctcaacctagatttttcaattttataatagcgtgaaagtaatgtgcattcagtagcaaccgtacttcaagtacccatacaactattctatttttcgctttcagtatagtatataataaattacataagctatttatatttagtataaaatatgatttgtgttaggtgattctgcccaactgtgggctaatttaagtgttctgagtacatgaaaggtagactaggctaagctatgattttggataggttaggtgtattaaacacctttttgacttacgatattttcaaattctaattggacataacccaatcatgagttgaggagcatctgcatttgcatataacctgcacacatcctcttgtgtattttaaatcatctctaaattacttgtaacatctgatacaatgtaaatgctatgtaaatagttattatactatagtttttatttgtattttttgttttttgtttttttttcaaacattttttatctgtaattggttgaaactgtggacatggaacctgtggatatggagggccaactggattctctttttaaaaaatatgatagtttgttggttttaccaaaaatataaatggtttgcctctcagtagataacatttatctttaataaattcccttccctatcttttaaagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaaggtatgttctgaatagttctaaaattcatagaatgcttatcatttttgctacaatgtgtgtagattaattaggcaaaaggggaaaaaagtcttaagtagagctgtatcaaatactcttgagtaaaaggaagcatgagctttttgcaccttcattgaccacttgctgctcacatgtatagtctgtgggtggcgctactccgtggtctgtgtgtcactggtccaccagataagtacagaaattatttttttaaattgtcatatacatagaaccagatgcaacatgcttaacatcttagtggtgagttgcttattattattttttttaatctttagcaaatgatgactaaagaagatggtaaacaccatgaagtaaatgtgcaattttcatggtatggaaccacaattaaaagagacaaaagtggtgcctacctcttcttacctgatggtaatgccaaggtaagtggtactgatgagatgacaaatggaataaacacttattgaaagagtattgaggaaaaagataagtgagtgtcattattttatcatctgttgatttattagggatagatgaacttttggttgcagtattatctatcaccttattgatacttagcaatttgtagtcgaaagttagataaatggttgggcgcagtggctcacacctgtaatcccagcattttgggaggccaaggagggtagattgcttgagctcaggagttcaagaccagcctgggcaacatggcaaaaccccttttctacaaaaaatacaaaaattaggcatggtggcctgcacctacagtcccagttactcaggaaggctgaggtgggaggatggcttgagcccggaaggcagttgcagtgagccaagatcacgccactgcactccagcctgggttgacggagcaagaccccgttagataaatagttttttagagttggaatttgttaagatgctacaatgaacaatgttcagttaggataaacaatgaacatgggaagaaactagattttacgtagagttagggagctttatatgtatgcattttatacagacacaaaacctctagccgtatgggaaaaatagattttccactggaccatttttctccttaactttcagccctttaaaaaacaaatctttctcactcttgactataaaggtagtaatacgcaaactctggcacattttgaaaatgccagaaactaaagaaaacattaaaatttaccaacaggtgcacaatcccatgaaaaccattgccaacatttggatgtatttcttattgtcttttattttatgcatatccttttctccccgttctcaagtcttgacttattgcatgtacatattttgtttttcatttgtgacagtgctcacaatctgatggtatgttttttaaaaatccaattttaatatatactgttgtgtttaagatgttgcttatattctttttctcccgattcttcactaccataacattgtaataagctttctttgtagcattcaaaaagaatgctacaatgcaattctgattaattgctgagaataactttctagaagagtcattttgtatcagtgtctgaagtcttttaaggacttttgctgtgtactgcttatcttccctctagaaagactaggtaaatgttcaatcccaccagcattttttgagattaactctaaaatcccactccaagcactgagaattggccatattacaagctttgcctataatagtaagttagtagaaaaatatttttctgttaagatttttgtggttactagtaaggttgaacgtttttgtaccttcatttatctttcatatttcttttgtgattttcctatttctattctttgactgtttttctgttggtgtgtcctgatgatctctgagcactctatatgtggtaaaattaatccttttccctatatgttgtaaaatttttcttattgtgtcatttagtttgttaattattttattgtatttctcatttatagtggttttaaatttttgtgtagtcatttcttttttttctgtagagtttcttcctttgcttttatacctttataggttttctatacctcaagatcagtgaaatgttatcctaattattgtcttgttagctagggacctatctcctgaaaaagttacttttgttccacaagttatgaaacctgctaactaaaatccaatactggattttaagggattgtgtaggctacagtaaggactctaggttttttgtttgtttttgtttttggttttttttttggctgtttggggtttttctttttttttttttttaagtcagtgaagaattaaagacaaactacaactcatatgaggcattccaggatgggcagtgagtcccaaatatgagctgtttcagtgttttctcattcaccagcttttgtcattggacattttattttgattgactgtatttatacttaaaaaagtagttgtgctatagaatttcatgcgtagataccaataactaatttatttaaaaccattttatctttaaatagctctaatgtcagatagaaagataaaacaattgtcatttttacagagagaaaataaaaaacatcagggaaagaggcagtctagtgcatcagaaaaaggcaagagcccagaactcatcatcccaggttctcatcccctccctcactttctagctatttggtaattaggtacaagaaatttgtaaaccattaagcattttaataactccagaaaattttccctagccaaagaggtaaatttggaagaaaattacacaattctgaaaaaaaaattttttttttttggagacggagtcttgcactttcacccaggctggaatgcagtggcgcgatctcagctcactgcaagctccgcctcctgggttcacgccattttcctgcctcagcctcccgagtagctgggactacaggcacccgccaccaagtctggctaattttttgtctttttagtagagacggggtttcaccatgttagccaggatggtctcgatctcctgaccttgtgatccgcccacctcggcctcccaaagtgctagggttacaaggcgtgagccacggcgcctggccgaaaatcttacactgtttaagtagttcatattgcaagcctaactttctatgctattgttgagctaaggtatctaatactttaaaaatataattactcataaatgttttaaatttgcttccatgtcacataagttatgtgctttattaccattttttaaaatttaaataaaaactaaactagtggtttccaagtagttttttcaagtttgtgaatttatattcagctagttctttcaagtaaaaggacagaatgttttatagtttagtaaaccgagctatgattaaactatgtttctgaatcctgctttcagtttgcttagatgactccctgtagtcatccttgccacctgtcccaaaccctgaacattagggggctgggaccatggttataataattatttacctgggaaaatgtaacttctgtagaatgattgctgtttctaataagtaactatatggacaaatagaaggattttagttagaaatttgtatagctgggaggaatgctttctagaccagtgaagttgtaaacatttttatttcctattttcagcatttttaaaaataaaaaacacgttcagtttttatcacatgcatattttgttaccttgtaagatctggtttacacttaaaattgcaaatatcaggtgatacgtattttctatttttgaaaccataataaacatattcttttaaaagtttggaagccaaaatatttttcttaaatatattattttcttttcagccttatgtttacacaacaccgccctttgtcagagtgacacatggaaggatttattcggaagtgacttgcttttttgaccatgttactcatagagtccgactataccacatacagggtaagaaaataggaatgcagttatgaaacatatgtattatggtttttgaattcttgcttttcttatgccattcttaaattaacagttggtttttgtagatgatgtttttctaaacttgacatttttaatatgatttaaaatatgaaacttaccctttgataataaaaaatggtaaaacgtttcaatccctacatatacatgttcctctgtatatcttctcttaattgttgccatattggtcttgagctcattaactggtaactttatttttaacacctgaaaacaatacagtgttttgattttatgaaatggaaattatattaaatacgactttcagttaatagaccacacacatatatggggcctgcttccttaaatatagcctgtatcactggaatgtaactttaagagaaaaatgttctaagctggttctatttgtttacagctctttacccagtagagtataaaacctagcaattgtttatcatttttagaacagtattgagcagcatctttatgaacccaagtgataggaaataggcttttgatccttttgagaacttaaccctgggcaatggaactgattccatggggtctgagtggagctgtggtttccaaagacttgcacatttaggttggttgatttagaattcattgtttgtagaatggtgtgcttttccaactacagatttaatcctaataaccagggtatttaccatattatcaacactcttagaaaaagacctcataaaaatgccatttaaatttatctttgctgttagctaagttgaacaaattagaaaagaaaaaatactatttccctgaatcttcatacaggtaaaaaataaaggatttcacaaactaaagataaatgtataggtaggcacggtttcctttttaggtattgtgggaaagcaaagggatactatgttcagggaatctcttaaatcacagaagttcaattttctgatttcatagttaaatttaattttgcttttatttaacttttttattaacttcaaatttcattagtatttgctttttgttagaatttcaggtatggacaaactttctcatgcaacttctttaggtaataatatgataggtttttcagaataacccatgattcataggatgaatcaagaagtaaaagttctctggcaggtgggaaaaataatgctagacactaattttgtgtcctaaatgtgacttctgaagttatctgtgatcactttgctacctacaggaaaacctgtagttctgaaataatcttctattgagtttctcaaaacttctggtaagtcagaaactgtttttgatcatctgtttgtactcttgtgtaagccattatttaatacccctgagagctctaagttacatcttcaactttatagcattaccccacagaagatatgctgatctatttttaagtttgctttaaactattgttttttagtggaaaagtttttcctggagtacaacatggcacacactttggcacaaacttgtgtcatcaggtttgatttaccattgtttttcatcagttatatttagagatgggctatgtctcagaggaaatgctgtagcaactcttcctaaaattccaacttctcaatcaggtatatttgcataattgcttttgcttttatttaattatgtcactgtatcttctgggttttccttggattatccaggacctctagttctcacatcatagggcagtttgtgtagactagatggccctgttctgctgctagtggctgtagcttagtgcttgacttggaaattaataggctctgacttgcctatttacttatttgagcaaactacactcatcagaactaaatgcttgtcatttttcctttccccctctcttcctgtttccctctgggcagtgaactgtccagtggctaatagtgttaagcaggagcccgggccactgaggtttgactggctcctggccttccaaaggggctctcaatgtagcccatttctatttgctggtcttgcctctgcctcttttctcttttttattctttagttttctttctttctttccttccttttttttttttttttttttttttttgacagagtctcgctctatcgcccaggctggagtgcagtggagcgatctcggctcactgcagcctctgccccactggttcaaggattctcctgcctcagcttcctaggtagctgggactacaggtgtacaccaccacgcctggctaatttttctatttttagtagggatggggtttcgccatgttggtcaggctggtctcgaactcttgacctcaggtaatccacccgccttgtcttcccaaagtgctggtattataggcatgagccactgcacctggcttgattttcttttttcatgtgtttcctttctagattatttgtcttctcttccttggtgttctcgggcatatgaaaaaaataataaatgatggataaataagtgtaatgcaaacttagagcgcctcactgatgagttttacagtagttgcctggattaaatgagaagccgtcatatataaactggacgtaacctgtaaatcttttttcattctagtccggatcattttttttttcaacatgaaagcagttggtaggaaatagagataccagaatcacctgaaatgctttcttccaaactatataccttcccgtgtttgtatttgagctcctcttaacaaatctccctctgggaaaagataagcccggttgtggagagagtctttccttagtaatcttcatgactcacctgtctctcctgtttttcacataccattgcctgaacactcgggttgtctcaatcctggctgattgtggttttaatgaaatcactaatcaaggcccatgatagatatacgaagtcttcagggtatttggctctatcagcgttcacgctgcctgaaagggtgatcagtcttcagggatctgttatttagtgccaagtcttccttattaagaaatactggaaagttgtttaacattctaaactttggcctcctgtaaatcagacacctggatgattgatcaaaatgcatagacaaaatgtggcttttcattttagatgcaaaggaaacgtcagccaacttccatgctgttgtagattggcttttagctagtattgcataaaataacaaaaaatatttattcttgaatttaatttactaaactagttttggatatatgctacttttgtcccccttaaaccaaccagatgcagttatttgcatgagtattaatgaatagagcctatttgttgttagtaccagattttcaatccaggaagaaatgagggtttggggagagagactattaatgttttatgattacatactgtaattgtattaggttactaaaccagttaattatacaaaagattttgtaatctcagcaacaaggaataaagaaacagaaaatgagttagtattaaagattgtctttgttgggtgtctatttttgttaaaccttacaaatccaatttaaaaactaaactaacgcatacctgacaaaatattcttacatttctcagtctctactttagttgttctttgacccttttctccccaaagtaactattgcccaaattaagcttcaggagaaaacaaaatcaagaacgacaagcaacatttccaaaattatataaactttttggtccttaatgattttgaaacagagttgagaggccgtatagttcaacctacttttgtttttggtttggtatttaacttttgtttctctatctgcattctctccagattctgaaaatgatcagaagtgcagttgaagggctctctctttcttaacatcttttaaactaataaaagaacactctgttttccttttcattatcgttcagacatcgcattcaaaaggtttctaaaaatactaaattagaagaaatcttgtgctcactagccttaaaagctctacaagatcagagcagttcagaatttctaatgaaggcgtggcacggtggctcacacctgtaattccagcactttgggaggccaaggcaggcggatcacaaggtcaggagatcaagaccatcctggctaacaaggtgaaagaaaccccgtctctactaaaaatacaaaaagttagctgggtttggtggcacgtgcctgtaatcccagctattcgggagactgaggcaggagaatcgcttcaacgcaggaggcggaggttgcaatgagccgaaatagcgccactgtactccaacctgggcaacagagcgagactctgtctcaaaaaaaaaaaaaagaaaaaaagaaaaaaaatttctaatgaaatatattgttttgcccatgtcaggtttaataaatccattttatagcacccataatttaatgaaatgcaatttatttcatttgtagaaaataacactcttctgggggaaaagttgagggaggtgggaattaatttttcttgcagtataatcatctttcatttaattgaagctttaaacattaccatataggctgctactttagcttttttggttaatctgtaattagaagatagaatataatacaaacagaagctcctgtatcctcttgtgttttatttaatactgcacctacaaggaaagtacataccttgcaataatataataccaataagtgacattgttaactgtggccttatttgtcttcagagctgtaattattggactttagtgtcctagtttctgatatcaacagctactttgaagaattaggtcactgtgggtaacgagtatgtcgtgtacatttcattggcgcaaggactgtgttctcctaggcaggtgtttgttagcgagttagtatgtatgtgtgtgtaaaccatgttttaacccttaggggaaacatcttaaatgcaatacttctgccctgttttccaccaacatattataaagtattatatgtaatggatcttactcaaagaaaacaagcagcctggaggtaaaatgtaatgaactgacatcaaaaagtatggaaggaaagactttcctttgactgaaatgactgattttcttgcatatttagcaatcgaacagagttgcttagtttttctctgagcaattttgaatatataaacataagtggatttataacctgactcttggcttttagagaatcaaaatgagcttcatctagttaaacatattaggggacttcaaaaagtttgtggacaaatggaattaaaagataaaaattaaaaatataaactatttctcaacataagcttcatcaagttcatgacgcttttgtaagcaatgaatccagctactcagtccatccctaaggaacagagggtcctggaaatttaaccatgtcatttcagtctacttatattattaagtaaaatgagtgcccattaaatatttttttaagattaggaaacaaaaagaagtcaggaggagccaaattagcactgtaagtgactgcctaatgattttccattcaaactgtcacaaaattgcccttgtttaatgagaggaatgagcaggagcattatggtggagaagaactctgatgaaactttcctgggtgtttttctgctaaggctttggctaatgttctcaaaacattctcataacaagcagatattactgttctttgggcctccagaaagtcaacacaccaaatgccttgagcatcccaaaaagctgttgccatgacttttactcttggccagtcttcttttgctttgattggaccatttccacctcttggtagccattgttttgattgtactttgtcttcagaatcatactggtaaagctgtattccatctcctgttacaattcttcaaagaaatgtttcaggatcttgatcccacttatttaaaatttccattgaaagccctgctcttgtctgcagctgatctggacgcaatggttttggcacccattgagtggaaagtttcctcaactttaatttttcagtcagaattgtataagctgctaattgttagttctcttcagttagagcaggagcaaacttaatttttttcttgaaaattggtgtagtcttcgtcttctacattgtcccatcccttcttaaaacaatttatctgttttgtaaagtgctgattttcttggaccattgtctccataaacttttcataaagcatcagtgatttcaccatacttccacctaagcttcaccataaatttgatgtttgttcttgtttaaattttagcataatttatattgctctgataggggctcttatcaaatccaagtctcacccttcttagtgctcaaactagatcctgttcagacatgttacaataagtaagtatgagtttattttgatgaaatccatgcatagttttttcatgatatgcattttccatgaaacttttgaagacccctcttataagggaatcacattgggatttggagatccaaatccttagttttgcctctaagcaaactagaggagtatgggtttgtcctttaatttcttagggactcagtttcttaatctataaaaaaggtagatgttcaattaggtataactgtcaaagagtcttcatacaacttagtttcacataaaatctcttgtgcctgactccctgcttctaaattcatcttctacacttggtcttagccaaaaggccaagaagtgattaaattcatcttctaagaatgcctgaatctggggcttccatccctggagtctgccccacttgtaaacaaggtctcagagcttcactgaagttctttttattttcataaaaagattcatgaagacattaagatggtttgcaatcaatctctcatttttttccatagctatattccatatttagtttgatttaaaagtaaaaagcattaagtaagttatagctaggcaggcttaggtaattaaaacatttttggaatatcataatatgcaattgactgctaaggatttttttccctgttaattggaacttttaaaaattgaaataagtagctatgtgacgaatctgatcattccctacaggcatgaaagagaaggttattttaagggactgcaagcacattctggttacacagattcagaactcagaggttatctttggggctgtttgagagcagctgattgttgaagccataactccttagcaaagaagcatcatcccctacaaaggtgggttgcactgaactcaggtgaagggcacagggatgggggaaacacaggagatatgtaatggctcagagttgagactccagagccagttctcttgtgttttattcccaggcccatcctaggtctgccacttagcagctgtttgaccttgcacaggttactgccaacctggctttggttttatcatcctgaaatgttgacagtagtaaaatcagcttcagaggatgtttggagtattcaccgagtaaatatacaaggaaccttacccatagtgagtgttgtatctacttacaagagtgagtgagccagatgggttagatagtttactattataagacaaagcatggtcattaaggattgggggaattggggaggatttaatgaaggaagtgagtcactgagaggctaggtcttagagaatgtcacatgaaaggcagaaaggaggaaaagaatatcacaatgtgtgaaataaggttgtttagaaccccactataaggatttgaagaactctttgtcccttatatattttttaattgacttgaagtttttctttatacatttaaataattgcaaaggatgttattttggtgtattgtacatggtgacttttaaaaataagcatatccaatgggcagtggtactaaatcatgtgttttttaaaagcctgcactagctttttctttaactgtcggaaacttcacatcattattttctccttataattacattctatttctccacagaatgttatcttaatgtagtatttttgtggttcagagccttgttattggtcagtctttcattacttctctaaaacaaaaatcatgtgtgtgtgtgtgtgtgtgtgtgtgtatttatgtatacagttttaaaagtctgttataaggctctaagtattttatttcttctggattgagatataaaaattattatttgtatgcagttggtcaaaaaacataaatatgttcctattttaataattttattttataaattttaatgaaaacatttttctcagtgggttgtacctttttaattcctaatggataatgtatccattgatgaatgtcactcattgctagaatgatatatgattttattcttaatttttatttatataaatatcagtgcaaaggaaagttgttcacataaataagtagctggtaatggaaggagttttctttttttttttttttttttttttttagtatttattgatcattcttgggtgtttctcggagagggggatttggcagggtcataggacaatagtggagggaaggtcagcagataaacatgtgaacaagggtctctggttttcctaggcagaggaccctgctgccttctgcagtttttgtgtccctgggtacttgagattagggagtggtgatgactcttaacgagcatgctgccttcaagcatctgtttaacaaaccacatcctgcaccgcccttaatccatttaaccctgagtggacacagcacatgtttcagagagcaaggggttgggggtaaggccatagattaacagcatcccaaggcagaagaatttttcttagtacagcacaaaatggagtctcccatgtctacttctttctacacagacacagcaacaatctgatttctctttcctttccccacacgtcccccccttccactcgacaaaaccgccatcgtcatcatggcccgttctcaatgagctgctaggtacacctcccagacagggtggcggccgggcagaggggcccccccacttccctcccggatggggcggctggccgggccggggctgccccccacctccctcccggacggggcggctggctgggtgggggctgtcccccacctcctggagggggcggctgccgggcggaggggctcctcacttcccagacggggcggctgccgggcggaggggctcctcacttctcagatggggcggcagggcagagacgctcctcacctcccagacggggtggcggtcgggcacagacactcctcagttcccagatggggtcacggccgggcagaggcgctcctcacatcccagatggggcggcagggcagaggcgctccccacatctcagacgatgggtggcggggcagaggcgctccccatatctcagacgatgggtggccgggcagagacgctcctcacttcccagaggggatggcggctgggaagagacgctcctcacttcccagactgggcggccgggcagaggggctcctcacatcccagacgatgggcggccaggcagagacgctcctcgcttcccagacagggtggcggccgggcagaggctgcaatctcggcactttgggaggccaaggcaggcggctgggaggtggaggttgtagcgagccgagatcacgccactgcactccagcctgggcaacattgagcactgagtgagcgagactccatctgcaatcccggcacctcaggaggccgaggctagcagatcactcgtggttaggagctggagaccagcccggccaacacggcaaaaccccgtctccaccaaaaaaatccgaaaaccagtcaggcgtggaggcgtgcgcctgcaatcccaggcactcggcaggctgaagcaggagaatcaggcatggaggttgcagtgagccgagatggcagcactacagtccggcctctgctcggcatcagagggagacggtggagagagagggagagggagagggagactgtggggagggggagggggagggggagagggattgaaggagttttcttataggaatatcattcagtactttgaactcctgagttagatgccataagccacagactgatctatcgtcaaacattaattttaatcaattatttttaaagatctactgcctgacaacctgattaggtatgctttcaattttggtgaaagcaagcaattggaaaccatgtgttttgcagaaatatttgttgcttagtcattaaagtccagtcagacaccaatatgttgaactgtttttgttcagtacccactaaagaaggtgagagatatgctgctgcttgttttattttttttataagttgggagaagaaatagagtggtggaaaagaaacatctgtcatggaggcaggtcattatgaggaatcttttcctgcctaaaggtgccttagaaaggagcatgtttgggaaaacaggaagtaggtaagttcagagtaactgccagtgccacagatgtgcagatcaaatatcatgattagttcagccaacttctctcctctgtcctagaccagcccaagcctgggacacggggaaggcaccaaaaaactccggtgttgtgaggtattttattcacctcgtaggggagtgttttagttagaccttatttattttatctattttgaggttaaaactgatgtcggtattatgatccctccaaaacagagcttccaaaaaattctgttgtttcataacattagtactttaaaaaaaaaaccaaaaagcctttcagttttgttttatgtttttcatttattatgtcttcttcaagtatatcatagtttattggtataatctttacccaacatttgcaattcatatgatcaaaatgccatacctttcctattacagatttagtttttgacattttcatgagaattattgaaatgaaaggcataaagtaggtacactagtgcctaactcataagttattggtaagtaatagtagctgtttatctagtagtgttttatgaatggcacaaagcagtatatcatcattttcttaaatttgtgacttggaatgaaatttactaaaatttgtattcatgaaagcagatgttaacattttcacttgtggagaaataatcaatatgaacatttacagacccagaaatcggcagtgactcagacgataaattagatcttataatgaatggtaaattgagtgagtcaacatggaaaaaaagatcatccagtagtgggaattattaccatttttattttggtactttcagatataagtacagttttttttttaaatatggtcacgataatattttctttttagaaacatttagatgttgacttactcagtttgtcattgttgtgagaatttcatataagcatacttatcgaattaagcagtatatgttaattaataaccataagcttgagctttaagctaagttggataaagtttacaaaaacatcactaaagtaagtgcataatagcaaaggtatttttatatttttgatgattaaaatacaaaacaaaatgtttcccatattgaagagggaatattcaaaatcagaagccctagttttttctgatagctattattatcctacttctgcaacaaaatgatgattctgtcatcctctctgctcagacacagattggaggaaaggagatgagagcaacaattagatagataacaaggttccctttgcctgagagccagtatttttaagacactcagacatttctttgaatcttagatgggtgttttggagatttattttatgtgatttgatagctatgttaaatttcagttaaacttttatttgcagacttaaatatgccgcttaggattctcgccatcacttgtctttttcctaggtgaccgtgggccatttgctattgtccctcttgatctaatgagttgtcctaatcacattaggtgccactgataagatactggactttgctgggatatgagtgaggttcttttttgtcgtttttcccaagttgttgcctctcactcctataactggttgagtgtggtgagagtggtgtatggtttatgagtatattccttggaaaagtatactttgcatttcaaaatagctagaataaaatgatctggagaggtggagagggttgagctaactctgagattctgcaattcagggttgaattaggcggcttcagataaattgttgaaggatctgagagagttggtggtacagaggaagtaaaagcctgggattttccaaaggccgtcattagttgttgctcagagctatgactccagggtttccatttgcattttttggagtccttacaccctcatggatgtttcttttacctcatatttcaggcatggcgtgtgtcgggcttgccctccagtttttcttttaataataacaataataataattattgttattattatttttgcgatggagtcccactctgttgccccaggctggagtgcagtggcgcgatcttggcttgctgcaacctctgcctcctaggttcaagtgattctcctgccttagcctctgaagtagctgggattacaggtgcccaccaccacacctggctaatttttgtggggtttttttttagtaaagacagtgtttcgctatgttgggcaggctggtctcaaatcctgacttcacatgatccacccacctcggcctcccaaagtactggaattacaggcatgagccaccgcaccggcatgccctccagtttttctctccccacacgagggagcacgctttttggtttccttagactggtgctaagcaacagttaaaagggtgatgccttttgttttctgttctctctctcctgatccacccagtgggggaaggctctgagaagagcaacatcattttgagagtggtgctaaaaccctgtaagcctgagtgttctgtcctcccaaagctgtgatacggctcagcctcctgacggtgacctacttggttttatttcttcttgctgtctcagaaaatattctaaagatgcttaatattattttacaaatacaggtataaataatatatatgtgtactcttctgacttcacacattacagatataaagtaaaattcctctggcatctgtgtctgtctccatccactcttcaggagaggaattcagatatatgtgcaagcatacgtgcaccacacggtcttacaactgtagaaaagtatagtattgtgtttgtgtcgattttcagcatagtttatcatgctatacaaatgctacatttagcttttttcttctgatgtttctctgccaagagagacagttacctcattcttctcatttgtgacacagcattccataacatgggtgtatgtgattttatttattcatttccctgttgaagggcatctagtatgtcttcccatttttttgttcctagtgccagtatgcagtgaacatgctggtgtgtgcctcctgggctcaccattatgtacatctcagctaggtacagtggggaggaactgctgtgcaatagagtatctgtctttaatattaaatatgtattactttcttggcttctaaggtgagtgtgccattttaaaagagagttttgggttgttttaaagagtttttggggtctggaagcctcttgtgctttatttcactcaaatagctcttgcaggatatcagatttcagttcagtgccctctgcccttaaaaacaaaaacaaaatctggaggtcttctctctactcgcttactacaaggcctctcccagcccttggtcccagagtaacttgagccttctccaatagttggtctgccagtgagacatgatgatgtagtagtttagtcctggttctgccagtcttgtccttgggcgagtgatttcttcctcagcttagggtcaggaagaaaggagtcattatatgtaaagcttgtagtaaacatatggtacatagtaagcatcaataactcttggctcctgtcattgcgacatagctgccacccttcactcagcatacgtttaccacccttcactcagtatacgtttattgtacatgtctacgtgctgggaacatgaagataaataagacatggtctctagccttagggaacttatattctaacatgcatgtaacatatatgtaaaatgaaagttcttattctctcatctttccagctacttaaactttatccatagcccagtttactttcctcccatgtcagctaacttctgcatgataaaggacaggctttcatatcttagctatttctgtctaacagtgattcagtacttaccatgtaccccaaatgttgttaagaactggaatgcaaagatggtgtgtaagacagtctgtatctgtgagaagctaacattctgtagggagattaaaaaaaaaaaaaatcctagctccgggtgtgagactggaatctacagcatctatagaacactctgatgtagtgggaccttctgaaggactctttttggcctttttattaccacttttcacctgtgaactggctctgttctaccttgcgttgcctatgcaaataaggataaacaaactccattctctcttccaagggggagagaattagcagcaagagggcacatatttctctttgttaaaacctgggaatggcatcactcctttctttccctagtgactaatcttgtaaagtgttaaagagaagtctaagtcccccagagggacttagaaagccctggccattcatgcccaggtggagccactttagtaaaaaaaatagcatttttgctgccatgtgatgcacaggtaaaacagaccactggatactgctggtttgcattcctgcttcctgggaagttctcccttccatttcatgagcctctttgggaaaggtacaaacttagggaattactgacacagaataggaacaattggcaatcctttcactctttcacatatactgatctttaaaaaaataataaattatcattgagaactcagggatacctccttgcttttatgaccattacaggttttgtttggcttgttcataataagcatattaagtttaatcttattttaaaagtctgtcctgatacaaactttaaattgatatcttgctgaattgtgaatggacataaaggctccttttaaagagctttaagtgtttgttgccacaacagggtctgagtataatactgaggttgagaaagatgattttctcaacagaaatactttattattgctagaggtagtgtgaaattatcattttttccttgaagcatgttcttttataaatgctttctggagatacatgaattaaaattaatgatgttctcttttgttaaggctttatttcatttcatgtattctgttgatctttgagacaatatctaatctagagagaagaaaacataaaatagtactaaaaacccaatgaattcttttagtgaattagagtttacttcttgtcatcagctaagctccctagtattacgtgaatactatcatgcttggtgctacattttgtgttttggatgtttttggttcatttgtagatgcttatcttttgttattaaaattccatatacatttcattttggctttacaaaactattttggttaatgtaagcatactgaaaagagggtttgcatttagagtgatgcatttcgtaggtcagagaagatactgttatttatcatcagctatatgtgtgatttctttttcaacttcccaatagtggtggagatatttgggtcatctatctttgcaggtccttgtaataattgtcatcaggaaatgtacatgtgtaggtaactggcaggggttagtggttcagactatggccattaaaaaaaaaaaaaggcattagctgggtgcagtggcacatgcctgtagtcccagctactcaggaggctgaagtgggaagattgcttgagcccaggagttcgaggccagcctgaacaacatagtgaggccctgtctctctcttttttttttttttttttttaaataacattccgcatttcctcacccatggagatggtactcataatagttttatgaatgtaggaagaaactgaagttagctccattcaagttggaagagcagtatataccggaaagaaattcagtgagcattctgaaaattctgatcctagaggcttcagcccatttaagtgttaatttatcactagattgttatttttattttagaatttccattgtacttttcagataaatctatggtgcctacactaacagcatttacattctttttttttttttttaacagaaatgtcttagcctctggaaggccattttattcactaacacatgctaggaggcttcagcaatatcctgctccattctagaaaacagcaatttgatccttttttcctcctcagtcattaacaagattatgcatttgcggtgagatgatccttcttgaacaagtagccagaaatcatttgttccagtttcttctcaaggtgctgaattaagtctcgtctcataaatcttgtggcttccttgatgatggattcaaaaaatcatttcttgacttctataggtccttgcagtccttcaagcaatttgaagagtttttcatattttcgtctaaagtgttgaatttccttcactaattgacattttatatcagcattaatttcttcttgacattttggaaaagggagtatttctgtgacttttaggtcatctccagagaaattgctggtaatgattcctcctacaggtgcatttctaccaggtttctgcatcagcccatctttgctgcaaccactgaagtcatcaaaccgagaatccaattggcttggtggaataccatctcctgccataagcttcttttccttggacatggcagagcctccaataaggctgtctcctgctctttgtttccttaacaacagggccatcttctgccttttctgagatgaaggagtctcagattccctgggacgtttaaacacattttcaggttctacagcaaccttctctgctttatcagtcattgtttccagaaggaccgatccagtatggcccaagggggatggaagggaaactgcctgctatggcgtgccctgccccagccaaatactgggaacactgggaacctgtgtggtgcgccggagtcctgaggagaagccttgtgttcagtaggatcacgggtgccagccccgacaatcatggggcctgcatttacactctttcccacaaacctcacagagttaaacttcctttctttaactctttgctgtcaccttctgctaagctctggggattctacttgtgtcctaggaaaaagtcttccttactcctttcctaccttatgcatttttccttttttcctttctgaacctcagaaagcgtcagctttattgaatagaatgatgtcactctttcttcttatgaccactttcctaattgctctctttagaaggtcctgtaatatctctctcgcaccgtttttaaaaaaaatttccataggttattggggtacaggtggtatttggttacattagtaagttctttagaggtgatttgtgaaattttggtgcacccatcacctgagcagtatacactgcactctatttgtagtcttttatccctcgcccccctccaacccttcctcccaagtccccaaagtccattctatcattcttatgcctttgcatcctcatagcttagctcccacatatcagtgagaacatacagtgtttggttttccattcctgagttacttcacttagaataatagtctccagtctcatggaggtcgctgcaaatgccattaattcattcctttttatctcatacacccttgatctgtattaagtgtgttggatttcctcttctctatctatgaaattgacccaaggcctcactgaggacctgaagatacaattaaagtagaatgacagaaactagtaaacacttgaggcttatccaaatgaatgtttgatatgttagggactttttaaagctgtcctctgttttacataacaaaggacaaaatggatcatttcataacaaggagtcctaagagataactaaactcaactaaaattgatttaacttctggagagctttccagattatagtccacaaatactaatatgttaatattactttcagccataaaccatctcattagatctcctgtctcttttcctagcaataatacactgtcacttgaaccagcagaatgtaaactttactggctcataatttctggtctataaggagagaatggtgaaaaagtgggctagaatggctctttggggaatggtggtgcagatgagaagtggactggcctgtagctgggcagcccttttttcatttcatgtcctgtttctcctctagaactcagagaatcatttacatgttatacatcatctacatttttctcatcccagctgcttcattctttagatgaataatatgctcccctgaataagtgctatctaccttctgatagtttttaaaaagaaaagttaaattgtcatagcatttattatatgagagatgttaagacaagaagtagaaaacaagaaaatgtaactttggaaagagttctgtatagtatatttcaaaaaggtgaggcaagtaatttctttctattaatccatatatatttttttaaatttaggaatagaaggacagtctgtggaagtttccaatattgtggacatccgaaaagtatataaccgtgagattgcaatgaaaatttcttctgatataaaaagccaaaatagattttatactgacctaaatgggtaccaggtaatttttcctttaaaatgtttaagtaatggttgtattggtgtgtaattcttatatataacaatggcccagttaattttggatcctttgaaaaagtatacttaaagttgcaaattatatctaaaataaaactgaattttgacagaaaatttcgggttctacagttagaagaaatatttgggagaccatttttttagaacatctttttgtaaggatttatttgttcaaagggtaaatttggtgaccactatgaatgttaaatatcttgatgctaaaaaatatatatatgaatttatctaccagaaaggaaacataattagggattgatggattatacttattgggtttttttttttttttttgagaaagagtctcgctctgttgcccaggctggagtgcagtggcatgatctcagctcactgcagcctcttactcccaggttcaagcgactctcctgcctcagcctcccaagtagctggcactacaggcgcacaccactacacccagctaatttttgtatttttagcagagacacggtttcaccatgttggccaggctggtctcgaactcttggactcaagtgatctgcccacctcgccctttcaaagtgctgggattgtgggcatgagccactgtgcccggtctgtttttgtattagcccactctcacactgctatagcgaaatacccaagactgggtaatttataaaggaaagaggtttaattgactcacagttctgtatgactggaggggtagcctcaggaaacttacaatcgtagaggaaggggaagcagacaagtcttacatggctgcaggcaagagagagaaaagcccaggggaactgccatttataaaaccatcagatcttgtgagatctccctcactgtcaaaagaacaccatggggggaaccacccccatgatctagtctctgcccaccaggtctctctctcaacacctggggattacaattcaagatgagatttgggtggggatacaaagtctatattagttgtcctcataaggaattgatccatacctattaagtttgttccctatatattggtttaatgtatgatctaataatgggcccttgtaaatttcaggaaaactcttcctctatatgtgtgtgtgtgtataccattatacatacacagacacacatgtatacatatacataggtatatctattcagaaatgggcaggtatatatttaatcaaaattttcatgaaatgtttcaaattgtagtaaggaaattgatttatacaatcttatcaggttgtcaattctccaatttaatagagcacttttgattgttacctaaatctctgttttctgagtgtatgtgtttgataacatatctttgaaataccattaaaaccatgagcatgtttttaaaacaagtgttttagaaatttctggctgtgaatagaaataattttacaataaacactttgattttcaactgggggtgggtgaaaaagattttaataattttctcttctatgatttcctgcaaaagttaaatttaaactttttccaaaacataaaaattgcagcatacattctgaattagcatgttaattcgactacagccatttggattccagataaaatctcaacttcatggtgattcatttttttatgtacaaaagaaagtattttcttaaaattatacaaaaccagttatttgtatttttgggtgtagacatgaatgagaaacttagtaaaaccgaataactaaaaatgtgaattttctttttgaggatggaacgtttgactaaaaaagaaaatattacttttaagtctgtaatatttctgcttttaaaattgaccattttttaagctttggatatagtagtacttgggcaaaactaggtatctagctccaccagtggggaatcggggtagcaacaacacgattgtggtagttttacattttttaaaataagtttacatttacaagttaattgggtttggaaaggagaaatagagaattcttttaaggtagctttacttttttttttttctttaaacattttacagttgtagctttatcagtttattaatttcccaaggctgccatacaaatggaatcacgtaaaacaacaaaactttattctttcacagttctggagactagatttctaacatcagggtgttggcagggccatattccctccaaaagctatagggaaataaccttccttgccctttcccagcttctagtggttgcctatgcttggcattccttggtttgtgtatgcatcactcccatctctacctcttttgtcatacagcgttctccctatgcctcttgtatctgtctgtctgtgtccaaatttctctcttcttgtaaagatgccagtcattaggttaggtcccaacataatccagaatgacctcatctatttctgcagaggctgtatttcaaaataagatcacattcatgggttgtgggtggacaggaatttgagagagggaggcattattcaacctagtacaaccagtaatttgagggagacattgcagggttgctgggaagattaaagatcacatttgtgaaatactccggaccatgcctttcgttaatgggcacttaatacatgttaactattacggtaactttgtacctcttcttttcttcacttttatatccaactttcatgagtttaaatgaggagatgacatttttatgtggtatcattaagattcactgataatagggttctgagcttagagtcagtcactgtgacccagatgggctttggggttaccgacagtctttctcaaaaagtagagtcatatttcaaacattcaggtactaggctgcaaggaattggaatttggaactatctacattgaaactaatcaaaaagagtaagcactgaatggtttttaaatataaatatgcatttgattttaacataatatcttagaagatttggtgcagagacctgtggtatttattaaaaccaattcaagaataataagagatatttcttgaaaggggatagagaggtattatacttagcattcattacaaaagcagtttgttagatttagatgagaaatgaatacttaatacctttataatttgttttatgcaaatattggagagctagaagacttttaagcatttttattctgaatttaaataggaatgcctattttaaaaatctggacaagttctacctttcccacctaaaagttgttttctaatatccttgtggtttttcttcatattgttttaaataatgttttaatttttaaattatttcttccactgaataaaaaggaagctttgtctttttctcttgggaagaaaaatcacctgtcctcaagtttttaaaagaacatatgtaaatatcactttttgtagatggaattgttgtgttttatagattcaacctagaatgacactgagcaaattgcctcttcaagcaaatgtctatcccatgaccacaatggcctatatccaggatgccaaacatcgtttgacactgctctctgctcagtcattaggggtttcgagtttgaatagtggtatgtattgcttacactcttttccactctgaaaggtttcaattccaactgtatactttttctgttggtcagatgtggtataatctctagttaaaacctccctgtcttcttttcagcttttttctttcaacaaccagactattagttaagtttgggttttgtgagaacaacataaaaagatgaatctcctaaatcttcagatgaagaacaggagacctaaaattccatgtcaagatttctttttaaagataatttgcttctcctaatagtatgtattttgcagaggtctccatcatcattatgatttaacggatgtggaaactcagattcagaggtttagataagttgcctacgtttgcaaagttgggaagttgtggttcaaacttaggtccttttctgaatcatggtctttctattctgctaccacctgaaagaaggaagggagtagaaatgatagagatatggggataaagaggtgtggctttgaggattccaaaagagagaaagtgatgcgcagaaagtgagagaaaatagtcaatagacactgattaatttttgcaagtctttctattgagaggctttgatcctttataatacatatttttaattggttatcatacatggtatcattggtcttcttacattctaagagttggtagagatacatatctgaaggagccagataataactgagtgcagattcctggtgtgtcctttgacacaagcccactttttacatgaggcgtatacatgcattctgtatcttacacacacacacaaaaactgctacttctcatttttctttgtggccttcattagataagatcatataaactcatgccataaagacatgaattcgattttgaaagtagtaatggttccacatcagggatccagtagggagggttagagacttgagcaaactgaagagcatgttcccgatgtgcagtggggcagcattgttgctgtgtggttaggggcccagtgttgctaaattcaatttttttttgaagaagagtccagaagtctggaattttacgtgaagttgttcaatctgtaaaatattgatacaattttttaaaaaacactatgttgagaaaacataaaacatctttgtgccgtacatgactcttgagccactcatttttaaacactgccttaaattctcaaagctgtgccctaaatagaggactagacagtaagactcaagccgtggttaacaaagcagcattatctcacttcctggaaatgtgatgtacatttcctaataaacctcataagcatttttgattccaaatggtgctactaaaagtttcggagaacttaatttactctttaggttaatgttttggaaaaaaagtttcatttaaattttgatctgtcctgtctcacttttaaatttcttatcagatattgtgaaacattactaaagaaacacagaaatactatcctgttttatgaatttgtagtagctactttgagctactatcaagagaaagcccatggtgtagtgggttgtataaatccacctccttgactagagaggaaatttagagcaatacatcatgactgctacttaagtgatgctcaatgaatgtcagtattaaattattctggtcagttttgcttgtttgtttgtttgtgtgttaggtcagattgaagttatcatggatcgaagactcatgcaagatgataatcgtggccttgagcaaggtatccaggataacaagattacagctaatctatttcgaatactactagaaaaaagaagtgctgttaatacggtatgaaaaaataactagcatgatctgatattgattgttctttgtcacccaaaacttgaaattatgactttccacttttaaaattttaaaaatcatttccaatattgagatttctttatagtagatgtggcccacattcacagaaagagaacttcagttataaatatcgtgtaagatttgcacttaggtctttttattttttatgtttgcttattatgtagataaaaaataatgacaggaaatcactttgggtaaatattcctgaaattattttgaaagacataagaattgaaaaattgagctaaataaaagttaaagaatagaacttagtcatatacttaggagattaaatttggtaaactttatttgaaatcttagtaaaatttatttgaaatcttagtgtacttattctagtcttagactcttcagttgaaaatgtatttatatgtaggttttctatgaggtttactcctcaaagcaaaaatctagtactctgtgttgaatggtctggcaaaagcccagctggacctgaatgacctgacgatatgcttgttcaggcaaagttatcttcagagttctccgtaagttattgatccacccaccttggatagccctgagcatgggctttttctttttgctctattctcctttctgcacctgaccattgcaagtcctttctgctcttttcagccagtgatcgtacctttcactttatagagagaacagccattagacagggctctctgttccagttatctaacatctactcccacccttcccatctctcctcctgttacatttaaaagacactttacagtccatcatcctaggcaggtcccaccacttgtccttggaacttactctcttcacccacctcagcatccttttactgttcattctctccctctctctttctcccttgctcctcatatccaacacttcctgggagattctttctgttagcttttgaacactctgttttcttctattaaaagtagaaatggaatacagccttccttcagactcttatttccatttcctgtaagctgctatcctcttctctcctacccaattgagtcagagtttatgagatgagtttatttcatcacttccttctcacaatccatttgtttcagtctggctttagcctccatcatattctgaaagagctctttccgatgtcagtagatccagtgcatattgactttcgtcatcttacttcacctttcagcagtatttggcactggccattgtcactctctaaaatactgccttgccagggcttctatggagctatgcagtttggttttcctcctacctgtctggcagttctttatctctctaatagttctctactcagccattaaatcttagagctctcaaagcatgtcccctggccttctccttttcttattttttatgctatcccttggcaatctcttctactcctctggttttgtttgcatcttccacacaggtagaagccactaatacatatctccaacttaggcttgtgtctgacctcctgatttatctatctaattgcttcctgatattctctgtttagaaggacacctcaagtttgacatatccaaaacactcataatctctcttctctcccaaacctggcccattttcagtgttccccccagtcaacagccaccgccatccatacaactccaagacagacatgagttctgcctgatagacacttctccccatcagccttttctcacagagtaattgccatcacctatctatctcattgcctgaatatttcaaatttataatcttctttacttccaccaccctaatctaaagtgacttcctgtatttcctgggtctagcctatacacatccaccctgttctctttctgccgtatgtctgttcttaacccagaaggcagaatggtttttttttttgttttttttcaaagccacatctaactttattgcttcctgttgaaccctctgatatcttctcattgctatcagtataaaagtcaaaatttcttaccacggcctccagagcccctcatgatatgggccctgcatgtcccctaggcattggcattggcatgccttttactgtgtctgctttaggcccactggtttcctttaagtcccaagtactttccatcccctcctccccaccgcacttttgcacatggcctgttatcctctgccttagagactcttggtgatagttccggttagtgcttacttcatcagctgcttctggaccaggttaaaagcccttcccctatgctgcctccaaactgtgcatctcaccttcctgcaagtgtgcgattatttgatcctgtcttctcccctcctttggaccataaactccatgagagtggggaatgtgcctttctttgcttctaggattgttcctggcagaggacatgcctaatatatgtcatatgaatgaatatcgaaatgcatagatgaatgagctgttagagtacattttgccactgtatttattgcaatttctgcctattaccttgtcttcatatgcatgttgcattcctcctactagattccagggacttgttgccttcattttcatttgtccttatatttggtagacattctttaaacaaaatactagttgattgaatgaaatagcaacagctaattaaagcaaaaattcttccagtatttagaatattttagaaaaaagaattagtatccactttagatgtcaagagccataccattcttgagactcatattttaaatcaatcactgacaagatagcttagttttaaggactaaatctgcataggaaaatcattgtctgagtgctgacagctactgtcttttgctcctcctgaaaaagtttctcgcttatatgactttatattgacactaatctataaaacttctgttaactgcaataataaaaattttcacatcaaatctataaagctttgacttagaagtgaaataatttgtttattcccattcagaactccttggatagtaattgatttaaatttaatttaatgtttttatgttgattaaatttttcttttactcaagtatagattctgggtcttcaattaatggtttcttttaaataagaaatgaactagagaagagaaaatacattttaatgtctagtgaaaataattaaaaagacacttaattgatgaaagttaataccatgtaacttgaattttctagaaagagttcttaatttcaactcagactcaaatatctaaaataatgatggagggaagtgaagtagggggatactccctgaataggaagagattttaatgggaagccctgagcatgacagagcctcatggaaataatcccgagctgactaagtggaagtaagtcctgtcctcagagaattctgcagagagtcagtaaaaacaaggacttggatgatatccactgtgtaatatgtgcaggtgtccagtgaggactgtggctgcacgaggttgaccatcatttatgctaatcatcctcaaagccaatagaaatggaaaataggattcatctctttggcattgccagggtttgaatgtgtcccccaaaagttcatgtgttgaaaacttggctaccattgtggtaatgttgggagtgggacctttgggaggcttttgggtcatgggggatctgcctcatgaatgaattaatgccattatcatcggaatgggttagttattgcaggagtggctttgttataaaaatgagctctcttgcactctcttgccttttcaccatgtgataatgcagcaagaaggccctcaccagatgccagtgccatgctcttggaattcccagcctccagaactgtgagctgaataaacttcttttatagataaattatccagtctgtggtattctgttatggcagcagaaaatggactaaaaacaggcattgacggctttaggatttgtttctttgacggtttatccttacccctttcctgctactggttggttaatgaggcactgagctaggaaccctgtaagtgttcaagtgttaaaattgtgttgttgtacctttaaatataaggagaagaaattgggagagatcagattaaaatattaaatacttatatggtttagaaaagtgacagcataagggagatcaaccaggtttaagggtaaatacttaggtgaccagaagatctacagtaaacttgaggacatatcccaccaagacccacaactcagctccagctgattgtttccacaataggactgaatgcctgcccagggtgacacagatttccagtttcttgggtaaaaaacaaaaaatgtgttttgggttttttgaggttgcttttttattatgaattttttattaaagagttggcttaaaaacaaaaaaaaaaaaacattttaataccatacagacctaccaaaatgtgtgatctacaaatctgccccacagtcttcagctacagatacttacctccaaatgttatgattcaatgtattattcttcattttctctcctccttcctctttgtcttttttactccacccttcctctctagtgttcttctttcatttatttatattgcatttgcttattaaattaatagatttacttcaacagacatttattaagttcccaccatgtttcaagtcaaactgaataaacaagggtaacttaaaaaatggtctcttactatctcaccatgatttaacaggatcgtttaactcaaagtgagcttaataaagggcaccaagaagtctggcaagaagttctgactcatggactaagggctggaacccagtgaggaagagctgtactttgtgtggtttggatcagaaggtgctagaaactttctttaatgtcagacaggctgcagagagaaagctacacttatacagtctgaaaccttccaaccaacaagaaattaaataaggtttatagtactagattagttaagtacaaggctggggtattcatttataacttaaacacataaaatttcctgtagaaaacatgtttttaaaactttgggtttatcatatgatttacagtggaaaggttacctttgtagagattaatttaaatattgatggttcaacagttaatatcttgttgagcctcttgttgctgtaaatatgataagaaagtacatgaatggcagaactctgggtgagactttgccactccaacctggccagcctccagcagtgttattttttcatggtgctcttagggtagtgaaccacaactcttctataaacttccttatctttctaaggacagtaaactacacagtttttaaattcttgaagtccttaatatccatgacattgtttccttttagaagactcccatcaaaatgtctttgaaactgaatcttgtttttctaatgcaaaggtagttaaaaggtaaagtttatcttttgattctaaagggagctctgttttctctataagattggatgtctggggtggcacttcccggcacagggtcatggagcagtgtgcggctaactccatgaaattcacctggggaggcttttcagctttgcattttcaggaccccacctctcaagattgtgtagatttgggataggacccaagaatctatgttgattagaggtgccccaactcattctgttgtgtggttaatttggggaaacaccaacggttaggaagaactaatttggtttggaggattggtatatatgcacgttattgcttctggagtatagaagattaatcaggaagtgttctggctactcactggagtggtgaggaattactccaagagtgtggaacaaagccagagctttctctgaatgtttcttgacctagagtggacttaatacttcccagatttgatgagggaggtgttttcttttctgtttgaatcttttatgttttattactcgtgagtgactttgtcagcaatcctaacttagattatgaagtcctttgatcttggagtacatttaaaatatcttgttgaaattgttccctctctattcatgttattctacgagctgcattaaatttcagtgttgttggagaatattattttatatgctttatttaatctttcttttaatacaattcattcagacccgattttttatcagtatcttaatattgcagtgtccctctgctgtcttaaaattttttttttctctctccatagtctgaaatgtaatgacatctaatgttagcttctggcacgatgctagtcactttttgctagcacccttctgtgcaatgctaatctgacattctgaattttaagctgtatatctctataaatcctgtcttttcacacagatcagtagccaagccttttatctgagccttatattacaaaaaggatgcaaaatcagaagatgtcaatggagtaatcattttaagaaataagatacaaaattaaatttggttcaaatgtaactggtgatcaaaggacctttctgcataaattattttctaagttatttgtgtctgtttttactccttaggttaagattctactcagtcattgatttaattttgcatgtcatctagcatatttaatctaccaacattagtagattatttaatgtttgaacatacagaagtgttgcttttaaccatataccatagcaaaaactaaagcattttaaattatatggaataatcatatactatgtaagtgtgtgataactattcagtaacatatttaacacttctacttttggaataaaaatagtgaaacaattggcaatgatttaccaagttgaaagaaaacaatcagatgatctaggcatgccgcctatgttatttatatttaaaaattggatttattttgagagttttgttttctttaaattctgtcattgggtaacatttagttcctatcatttggtaacatggatggactttagctttgaatcagtatatgcctttatggtcttgttaaggggtataaatgaaactacaagaatatggtggatgaaacctgagaagggagataatatttgatgatgcacaacatataatctatgtacagcccaatccttgtactttgagagttttgtgataggttgagaattttcataaaaaggtatgccttgtcctgaaatgtttgtaggaaatgttttcagtatttttagtattaaatcaatggaagatatattttaaacatatgagttagatgtgtgctgtttattttcttttattgcttacaactaaacttggtagtttatggagtattttctaagactgttatttataaaatgtaatgaaaccaaattattcatatatttttatattaaaccctctcagataattctgttaatatgatgagaactggaaatatagacctcttaaacatttttgttttttcttgataggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtatgtctcaaaatatatcttataaaaaattactgtttattatgtacttgttttaagggggtaaggaaaggagaaaaaaataatgtatgctttactatgctttgaggaattattaacagggcttcacctttagccaaaagcttcatgcctttcatttgactattgctgtatattttagagtatatcctgatactaatttactcttaagttctgtatggcgagcaggtcaggaaataccattagtaggtgggcaatctgggccttaagtttagcactagtgacttttcccattcatttctccttgttagacaatatctctcagaagctagagaaatagtacttagttatttctatatcagaggctttgtattttcgtacctttctcttgagaatcactgcaactcagtttcccattagaaaaccaactgtttagaagaaatattagaggaaaagcatggggaagttttattaggtatgaaatttaatttagttagactgcagttatatacatacctgtttttaacatcaaaaagattgcatttggaaagaataagaattagacatttgacattgttcttatgtgttgcaaagctgttttgatattgcaaattgacatagatttagctggaaatagtaagtggttatggattctgtggaaaatatctcatggtaaatggcctaagtatgaaaagaagaggatgctcatgtttaaagacaatataagaggtgagaaatgtttaatgtagaacaaagaactaaagcaataaagtaaggataaatgcctataatttggatattagagatttacaactttatgtctaagatataggagaaaaaatataatttttttttctttatagatttttagttgagacaattttgaaagcaaaggtcagataaacaggggaaaaatagcaatagtatattgtacatgctatacctgtcacttgggagaggcctaagttcaaaagtatttttttcccaaggcagtggttttggcaccttgcctaaataatgttttaacaaagagccataaatcctctagagacaagacaaagaagaaagcaccttcaggcttccaaaaggtaggaaaatgtgggaggataaatttatgggaagagtgaagtctgctcctagatgctctggcactgctgtctcttagctaattagcaagccttgtaaaggggcctgtctttagactagaaaaggcagagaggaagggatgaagacctcttgtatttgtaaattgctgtcctgccatcaagcaggcagaagaagggacagaatggccccctggtttttttccttcttcagctcaataatcctcagttttttgagagagaagtattttggtttccttcagagataaggaacttatgcttggctatgcaggcaaacatatatgacttataataatgactacaagcaaatgctcgaggcgtgtgtgcgtgtgtgtgtattgaaaggctttttaaaatcattatcagtgaacttgcaggatttatttcctacccactacatgtcagttactgccataaaacacacaaatgcccctgcccttctagagcttagattctaatgggaggagaaaaacaagaaaaagtaagagaaatatgtaatatgttagatggtgttaagtgttatgaaggagtaaaaagggaacagccattcaaaggaggtaacacaattttgattaaggtgtgtagagagggcctcacagaggtgataatggagtaaaaatctgaagaaggtcagagaataagagactcctgcagatttctgggggtagagtgctccaggaaaagagcaagtgtgaaggccctgaggccggagagatatgtggccagaacagaagctccatgagagctatgcttgtcctttattcatggctatatccccgtgaagaagagtgtctgcacataggatctcaaaaactattttgaatcagtgaattgtgtagatgttttttctaggattctgctgtggttttttgtaggtctacattttggctccccgaggtgtcgtgtcataaattcatgagctaaaagaaacagaaagaatagagtggagggcatcaaatactctgggcttgaggttaccaccacccagcatagatggtagaggacatcagcgacctgaagaacccagaggcttctggggaggatgggcggtcaccatcccttagcctcacttctaggtggctcctccactgtagttgttttaaatgtgattgttttctggaagcagctggagctgactagagtcagtgagcatagggttttaccttctgtaaacgaagcctggaacttgttttttatgtcacctttttttgtggttactcacttcttcacatccttcctgcttttgactattttcttgtaatacaaatctaatcacttctcagatgaaaaatcccgttgcctactgaattggttcagacactgagcattcaggtcctctgcagcctggcctctacttactgcagccacctggcttcccgttgctcttcgtgcctttggacaggtgggccaccctccctacctgtgggctgagtgactgctgactcagctaccatttataacatgaggctaatgtcacgtattgctgtgtcaggtcttttgctaaaaacagacgaaatcctattgtgaaagccttttgagaacaaaggcactctgtaaacataccttgttatcctaatgacacttactccaacttggttgcagattagggttttagcagagggaatagagagcaacttaacaacataaagatttgaccaagaagattaaaaactgaaatgttaataatgcctattgataactaccatgctggctcataatcagaactaaatacttggcagttttgcattatcatatcagttggtgccagttcctgtgttagcctttgactcttagcacatatttataacagttgtttaaaagcccactagtaatccaaaggaaggactggtccattcaaaaccacttctttaaagaattccctaacctgataatagaaggataatcattgaagggaactgttgtgggtattgattcaaagaaagctgtacttacaaaatgtccagtgtaattccatgcttatactaaaaaaaaagaccaaaatgactcaatgaataagtacagaagccagacctaagcattttggtttgggttcctgtttctgtgtgctggaagcttccaatgtgcaataatgggctgttcatttggagaatgcaactcatttttccccttgaaataatgtcaaaatagacataggttccaagcaagacctgaagtctgcattggcctgtatttaagtaagcatattcctaaccaccacagtatttcatgagaaatgtgtctgaaggccaccttagcatgataaggacgcatgtcttcctgcctgaccaactccttcagcaccatgatagagagtgcccttgcttggccctctgggccgctgtctaaaggtttctcaattctaaacctcagttggttttcttgactcctgggataaggggttatagattcgaagaacagtgagggaggcgagttgcaggctgcaggtatgacaacccactgaggtggttcagcagttccagctactagtcctcaaattcactgtgcccggatcacacaggggagattttaaacatagagacttttacagatttccagatctctgagattctgattctatagggctggggaggagagcctaggaatttgtaatttttaaaaatgtttctcatgaaattgctgagttatctccatttcctaaattaggaaagtgagagttagagctaagttaaatgataaaaataaaatcacccagtggtaaatggcagaatcaggcgttctgaatctcagtgctgtgtgtggcctcagagggtagcatttgacttttttagaattactaaatttgtttctaaaagtccaagctttcagggattgctctatattagtagatgagtttacattttatatagacatatcttgcttttagacagacatatcttgcttttctgctttatatcaatttttggaaaatgattatatgccgtatatttgtattcagatgaaaaggggaacaaacatctctggaagccctgcctcacagcatgctgcgtggccttgcccattccagccactatctacaaacttacccattagctttcctattctgttggcctgtctttcaactcttttccttgatcacacctttcccctacactatgaagatcttgagatactaaaaagaagcttctgtaaaggtttgaaacctagggaacatgaacaccactgaaatacactacatgcaaaagccttgtcatcaggaaaggaccattatttaagaagaagggagattgggtagagaagatgcagggaggatctcatgggaggacagatgatgagtcaggcttctgaagctggagctgctggttcagcctggaatagagggacaaagaggaagctggataagctcagcttcatggagccattctacttggaatactttagaaatgtgatatgtagttcagcttttttttttttttttagattatttccacagcttttatatttagacatatttattttatataaacatgatatatatatatatcttaactctttctctatgtaatttattttgatttgtgtttaactgtttcttgcaaatagttaaccatcatttcaatatcagcaccacttactgaataagattttctctctccacttgttcattctgcctcttcttttcttataaaaggcagtttgaggattttactttatttgtctttcttataagaattgattggtgctttattgatctccctagcttctggaaaggtgaaaattgtgagaaaaaaaaattcctttgttgtacgtatctcagaacagccatttaccttccctttctttctgtcattttatcttgttgatcaaaacaggatagctattattggacattttaatgagcaccctaaaaaatgaatttctactggttataataccatcttaggacttataatgaagcatgtaattttctaacctttccagctgccagaatgcactagggatgagtgttaggtattttcaaagaatctgagtgggttggagaaattttcccaccagatgtgtagccgtgccttaatctatgtgcaccttactaaccgtgtgaagagggtggggtcccatgcatcctggagaatttggccaaagttatggcccctctcttccccacaaacggtggttgcacacataatgtttactacagtttccaaaagtttactgtttcttttggtgcgagagaggaatgacataactcacatcttaagatcttcagtagaggactattcacctgcttttttccttaaaagagactgtcatgtgtgtataattttcagaatggctcaaatcctatttgaagtggggtgaatggataggtggataggtggtagatggaaggaaattacaatttccaaagcttggtttctgaattgatatattttttgataagttatagttttatctctgctggaaccatcagtcaatactctcctttttcagccataaattggaggggttacctcctttagtttacagtattttgttattttacatcaaaaatattttttatcttttctctcctggctaggtatctatgagcacaaattcatagctagtgcaaaggtaggagaaggaagctgttaaaagcttaaactttggagtcagatgtcctgggtatgagcatgtctcctttgctttctaaccatgagacttagagcaagtcacttaactctctgagtgtcaggctactccttagtaacatggagatggtaataatactcaccttagagatgttctgaggattggagataattttagtgttagtaaagcacttagaacagcatgtggcacatagtaagccctatgagtgcttgacaagtaaaggttctcacctgtgatagttcagtcatgaacaacggcagttgtcactaataatgaggtaaaaacattgccagagtaaatcttgatgtcactttgacttattcctgatattttaggttggtacaaaagtaattgcagtttttgctattaaaagtaatggcaaagctacaattacttttgcaccaacttaatactttgttaataattcctcagatatttaaaaataacatatctaaaattgtctgtttgccaggcattgtgccaagtgctttacatgaactttatttaaagctctcacaacaaccctaagaaggtaggcaatattttcatcccatcttacagaataggaaagtaactgacctagagatatgatagataactgtcaagggcacacagccagtaatgtggtcctgggagcacgctcaggtgtgtctgagtccagatggcttctcagaaccttatactgtcttgcatgggaacaagaagggagagggagcactgaaaatgtgagggaatacactgtctatttttcttgtgtcttcagtaataataggacacctacagaggatatcccatccattggcgggagaagactaagggctaatccaggatcactggtggtcattgctatttgagtataagagagaatgctttgtgatagagattttctcgtatatttacatattttaatacaaacttatatatcacctcaactatttcaaaggttgttgtgcgataaaatgagttaattgatgaaaagcattctgtacaggatatggcacacagcaagtgctcaacaggtattagcaatgactgatattgtcactgcggttgaccctcagtcttcagagggactcttcacaggtccagcttagcttgctgaatttatagaggtttactcaaagtcacataaatggttcatggtagaaaaaatcattggtctgatccagctttctctaagcccagctttatctgatggcttcattctgcaaaccaaatcatctttccccatactccaccaagttgctggaagagcctcagaggcccagcttagtctatgagctgaatgttggttttatcccctgaattaagtttgcaatgggttttctctgtgcaactttagaatacgccagccttacttcagtaattcagcctcgaaagtgatctaatctgttttacaaagatagttacctaccacagtgcttggcacaatttcaaaaattgtaaattttcttccccacatcctcccattttatggggtccagatattactaatgcattaatgaatgtaaaagcagttcttccaaaatctgtttactctcctagagcatacagtgtgactgcttgaaggtatctgttttcctgcatgcatattcaagttaaattcacagtttccctactttgaaaaacagttttcttggaaataaaatgtctagacagactttgaaactgaaaaactgctgctttgcctcaggtatttttgcttgaaaactgatactttcatgaatatttgattttttaaaaacttggacaagatgattgctatttcagttcgtttttacaaaagtgatgtaattttagttttgagagaaagtataactttttctatcagtgaaagttaatttttatgacttttatctctatttttgtattgtcggtttaaatctcttgtagaattcaaatgtagaattccaaaggtgtttccctccccacattttttgtccccttctgttgctataaaggccttacatattcattattccaagagcaaatgtgttgcaggaattttagccatgcatgctatcaagtgatatgtaaggatggacccatgagttaaaatggacaaatgctttaggttagtagtgatatgtgcttttaaaagagcttaatgaagagggtttctaatctgttaatctgaatccagactttgttatgactttgatgtacgactctagacatataatttaggagttccctgagtctttagctacaaagttgtaatgtcaaataaaggaaatttatgctaagggcttcctgtgtgccagacatttggccagatctttgttaagctatttcatttcatttcatcttcattttatggaaaaggaaaacctggttttgctgaaacccacagctagtaaattgcagagcaaggatccagatctccagctgtctgactccccactcaggctctgaaccactcttactacacagctcgtgcactagcgcattctgccctacaaggcagtgtgaagctacttacatagtattttcaacaggttaatccacacagtgactccatgaaggaaataatacaagcattacctccattttacaggcaagaaaatagatatttaggaagaagaaattactatcctaaggtttcacagttggcacatgatagagtcctgtttcttattcttttggagatctaatgataccataaatgaagggttttcctatgtgttatttttatagtacatgggcagggtgttttaaatgtattgaaatgaattagaaatttttatcatatgatttaaaattgctgtgtgtatcatgtggtcttgtgatgactcagaattccttaaatgactcttctcttccttcaaacaaaatcttagcagtacccctacaaaatatcagtgtgaaacatcataacataggttattccagccaagactctgaggtgaggacagctttaaactgttcaggcacattaaaatcaaatcagtggtggagattctggcagctattcaggaaagatgtctctttagtacattaaaaaatcttatcccctagtgaggatgatcaggcgtttgggcatattcctgtctgtggccagagaacagaggaaagaatcagttttatcacaatgtcagtgctgagcagcacatgactcttttcaaaaactgtatgtttcttaatttttccagggatttttaattcatttatcataaacaccttccaactttaggaaacaaaatttattaagataattgtattttaaaatattcagaggcctaaaccattcatgacattgatacttaaatggatatgagaaattttattgcaagaaaaggtatactgaccctcttagctgacttgtcatgtttagtatttttatttttgcctgcctatcaacaatagcttctgcagtatcaatttaaatgatacatcaagctggtaaatgtgagctggcctaccaagtgaaagcataactaaatttaaatagctctgatataaaaataatgaatcagtacatcaaagattaagaatgcagttagcaaaaattaatgttcaataaagaagcatgtgtgacttttaagttagatggtatgtcattcaatgaccagataaggactaagttcaggtgcagtttattcaactgatgtgtgtgtttgaaaaataagacgaaaacataatgctttatttgaataaactttaataaaacaatatataatgtatggacataaggaaacctaagtcctcggggattataggggaaaccaaggcatgaggttacctaacaaggaaccttagaacataatcttacctggctcagtacaagtaggagagaatggtagcaggtgaatgggcagtgagcatggacctgaggagaaatgaatttgcctaactttcttgctaaataaatgtgcttttggatgctgacatcgagagagtggtgtgtgaagtaccataaatatttgctttattgtctgcgcggtgtgactgcattctgctcatttgcaggtgggcaatgggcactccaatgaggcagccttgatcctccacagaaaagggtttgattgtcggttctctagcaaaggcacagggctgttttgttctactactcagggaaaggtaagttgaaaaggttatttttgcttactgttagtgtgctttgaaatcctctttctgcaaaggatcttgacaataagatcatgtttcattgcttctttactgtctcagtttcatcagtctgcaaattagtttgaatctccccatctgaaaaatgcactttctcaaaacttcagcctcctttccttgttgacatcaaaaggcatagctggaatttatgcacatttgaaggcaatgctcttgttatttcctaggccttctatttccagcctacaaagtgccttgctcccagtcccccagttttctcctcccctgaaccacacatgctcacatatcatctagttcagcattggtaaacctaagtcctacagaggccaaggcaagtttataataactgaagcttatagaggtagccataaagaagcaactgggaaaattgagactgtaggctagtgggataatccacccacagcccaggaggcagctgtacgtagcgccaatcagttgttttcccttgggaaataaatgtaggtcttggtcttctgattaatgcagatttgcatatgagtcaacacaccgtgcaggccaaacagatcctcagtctgaacacagcttgctggctgcctattgtttatttctcttcaagttggtctttctggcagttccatcaagcctgtccttgaaaggaaacaaacctccaatctcctgcctctgtcactgaaagggccatgactcagagaaggcagctgggctgatttaggtacacaggcaggtctgcctcaccaggcagctcagctgacccagctttcctccaaaacctcataaataatgctgtagaccagactcaagtgattcagttccaaccctacaaattagcatgtgtgtggggtccaaaaagataagaaaaatgtggtaggagccctgaacctacttagatagattagcttctacatttcttttaccctaccctgcttggagctggtgccaagaaagcactgatatttttattacttttttattatactgtatttgcactctattgtattgttgatgatctaagtttacttggttctgagcattctgacattaaggccttgagtcataagggggttatacgatccagagagacagataacatggcagcggtgagggaaatactttccaaatgacctgtccacctctatagactgggactcaatgacataatgatccctccttgtagtgagcctgtgtgctctctcttaactctgttggaacaggaaaaagtggttgaggactaccattgttaggggtaagtattgactaaaagagaatgaggatgtttttaaagcttcttggccattggaggtcctttcttttattgaaaaagcccctgtgcatgataaaattctcaagcaatacaaaaaggaatgcagaatatgttgctcatgaccattactggtttcctgttcccttccaagcgtagtctgtatgttcaagcatgtatatatgtatatttaattcacccttttttctgtaaaagagaacttatatatgtatatttaataacatatatgtatatttaatccacccttttttcctcaaaagagaacttcaacatactgttttattccttctcatactaattttcacagaatatgtagttgtgctgctaatcttcaaagttgatctaaatatgtaaattttatcatttacttttcagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccat

SEQ ID NO: 538 - DNA, 175902 bp, Homo sapiens
tattaggttggtgcaaaagtaattgcggtttttttgccattacctttaaaaaatcacagttgccattacctgcaaaaaccgcaaatacttttgcacctacctagtattttctatcagctgggtggttgccttctgtatttgtttgctagggatggcataacaaaatactaaggactggctaacttagacaacagaaatttattttctcagtctggaggctagaagtccaagatcaaagtgtcagcgggtttggtttctcctgaggcctctctccttggcttgcagatggctgccatcccaatctgtcctcacatggtcttttctctgtgtgcatgtatccctggtctctctctcttcttataaggacaccagtcagattggattagggccttactaacagcttcattttaacttaatcgtctttttaacttaatctcctctttaaagaccttatctctaaatactattacactctgaggtactgggggttgggacttcaacacgtgtattttaaagagaaacattcagcctataccactttccttccatggccacgtgattggtatgaccagtccctgcaacaatcactttgccccttttcccccaaatcctaaccattgctaacccacaccatctgtttggattcatctctcagtgactcagtggttttgtcctcatatagctttaccatcctagaacatatcccacatccgaagtgaccactttagagttgtcatctcatactcaagatcattatctccttctctctggttcaaatatatattattacagcacctaaaatacttactaattcctgctcatcaggtccaatcagcataatgttgtcaatgtagtggaccagtgtgatatttgatggtatgtcaagacaatcaatatctctgtggactatattaaggtgaattgacatacccccaagacaatactgtgaaggtatcctgttggccctaacatgagaaagccaactgcttctggtggttttacaaacagatatagagaaaacagcattagccacatcagtagctatataccaagtgccaagtgctatgttgatttgtttcagtaaaaataatacatttgagacagcagcagcaattggaatcacttcctgattaagtttatgagtccacagttattctactagatgtatcctgtactggtgaattaaatgagagtaagtatcaccactcctactccttttaagacttttatgatagcactgattcctgcaattcctgccagccatgcagtgttgtgtttagtgagctaagtggaagctctaagagctcctggagcttccatttagctctccctaataatagccctcattctatggctaaatcccaatgtggggatcctgtcagttgctaagtatgtctgttacaattattagattggtgcaaaagtaattgctgtttttgccattaaaattatgctgttaatacatattccaattacactgggaaagtagccacatagttggtatgtggactaacagtggtgatttctgtccccaggaattagcatcaactcagagccagtgtttagtaaacctcaaatgatctgtgtatttccttttcgccaatgcagtttcactagtaaatggccacatgtcgttttggggaaagcttgaaagaatttgccatgtgtactgtagccaaggtgcaagatccttcttaaagggaacacagattctctttcaaccaagggactatgggtctgtgaattgacttaggtctgagaactgagagactgtgactatccactgtggtgactcaagtcaggttttggctacctgacttagatctttttacctgttataaatatcaagcaataatctatttcaactgcctatctattttgttctcagagcagctccgtaagccaaggcagtctgatttcctgctgccctttaaggtacatgtgcgcccaccttgtctttgttggttatgtgctgcctggtttctgctattctgagatcgtgtcatccccattgaaatcagggagcccatctagatagtggcatcctctatagtcaaggttttcaagcaaggctagtctctttagacactggagggcaacctacttccactgataagagaaagagttggcgtgtttaagattgtcggtttcatctgggtccaacccatttcaagtattgagattctattattaaaaaataacaccattttacacgaaaaactcagaatatgtgtgaatttaatagcagttataattcagtaacatgaaaattaaaattttgtttgattctcagcataattcttgttgctacaataaaccagagcttttggaattctgcagaatatctctggttctcataccataactctgagagttaaaaaacctgtgcttgtcatttctctttataaccactcaaaagcacgcaaaagaatccatcccacaccagtctttctagtcatctttataaccatagcagtcaagtgtagcagccacttggggccccaaggcacaggcttcagttggcacttcatcaggatcaaccacaggtaattgcttaattgagatgcccagcatgtcatgaattacatttccctttggcaaggagctaaagctcaaaacctcaatcaaactgacctttaatcccatctttgcaggtctatttcttgggactactcccgggacagggaaggcttaataaaaagaattgttaactataatagaggattagagtaatgaaggattcactagcaagaagagaactttaaagaatatagcaacagcagctataaggagctaaccttataactaactcttgggttgagagacagagtgcccaatgaagaacctccccaattcctcccagggctaagatctagacgtttttggagagggcatgacctggctcactgaatggcagagaagtcaccattgggctacgtctgcaaagcttgtggaagatgtgccctctgcaacttgctgcaaatgcctctagggtgccagggaagttattcatggggtagtgtctcacctcctctacaaagctcctagagttgggcatgtgagaggaaattgctagttactgagcactataggaccttggcagtggagaaagccaggtatgctgcaaaagcttatcaatacacagaaatcaggaagcaaaatcctttttttctgtaatgtctcttcagcgccctctgctgataaagcttcagtcccagaaggcaaacgaaaaactgtttaaaaggctcagatccgtttttacagtgcagtcaaaaagggcgaatttggagctgagaggcaataaatcaataactggcagaagcatcacttctcagattacactcatggatttcgtagtcagatgtttctacatgtgcctggacggccctttgtcagtctcctttcccccaggttttaacaggctgtcaccaaaggaggaaatagtgagcccgaagagaatgtgcaagccctcttctcttgcatttcctccagcccgtcaccaagtactcttccaggcacgccaggcccgagtgtcctaggataggaaacctgagcaacaaagggaagtggggtgtaagctcaacccctgttggacgtgggggtgctggcgcctgaacgcccccgaaggcctcaactcccagaaagctgcctgccaggtcacaagagccctgtgaggtcttcctatcgccgggacactgggaggcaggcgcggggcgggtccgccgggcgacgcgctgtgattgggcgccgtggggcccgccccctcatctcggagcgtcgggagggggcggggccagccgcccgctcggctcaggcgctgcgggcgcctattgacccagcggctgctgcgccgccgctgtctcctcctgctcgtggcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgtgtggtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcaggtaagcacctgggaagggggcgcggggctccgaggggccaggcgtgcgggcccctggttagcggctgctacccaacctcttcctcccgccgcggccccacacccgtgctgggcgaggccaggggctctgtagctctcggacggcaatgatcacctcctgggagccacctcgcccgggcgcgccaagttaacaaagtgctgggcggcgtgcggcggcggcggcggcatcatcccgctcaggaaagtggccatgttccggcattcgcacccggcctgttggggtggcttcgggcacctgctggcgggggaacgggcgcggcgtgaggcaccccccgccagcccggggcccgcgtatcccggtggggtcgttctcggctctcacagggttaagccgcccgcaccagcccagagcccctgagcgcacggagtcgcggaaatggatcaaaccgaacccacctaggcttttttttctttttcttccccgctgcctctgaagagagagaagtttatttcgtgttgcggcccttttagatgtgaatctctaggttgattttagtgtcgtcattcttcagctattacatctggtttgtttgtggcagacagggggaaccgagtggggaagcgcgtgttatactccggccgaaagctgtggggcgctcagtcctgcgtccagtggttaaattggtaaatgagttgggaagacgacccatccaaagtcttatttaaagttaccaaaaataagcaaagcggacacagtctgttccctttggaagggtatccaccgcgcggcatgtgcgagttcagtttcaagttacttgccaatataacccgtgcacttcagaaattgcggtgaaactgggtattgtgtagtgtgtagtgtgctctgtaacgaatgaacctgaagaactcaaaccctgacagggcaatctaactattcctacttgacttacgagaaagagaagcctagacgtgaagttgatatatatttttttctcttttgtgataacttaaatgaccaaagaatatccttgccattttttttgtgttatgctagagcaaatggcttgaatttaattgagattaaagtaaaaactttactggaattattgtgaaagtgaaaaaagacccttttatggatgctgtcatcaatacagagcactcaacatgttttgtcggtgagaggttttaaaaatcttgctgcagagagatgtatcaaaattttaaaagcctctgcttcccctaggtagtatgacagagaaaatagaaacaagcactgagggcatctttaaatcttgagctcagagcttgtccagtgcttcttgatgaggttgaagaaaacagttggaaaaaggtaaggagttttaagcttagcttgatatgttgtgtaattttggggttgaaattactgtaatttttttccctccagtaacctcattttcagattttcctccattacaggaaaatcataaaaagtgatatttttacttaaagtgttttctaaaataatgtcctttggctttggcttgatgatcacttgaaaatggtttatgcaaacatctggacctgggttttctggcaaccttgacattttctctgttcagaatctaaagacatgagtgactcattcagttactgagaaatcttaggcaaagctaattccagtattgtaatatctatccttagtcctcaatgagaggctgaagttctgctttaagcgtaaagcatttgatgaaaggtcaaagtggctgctggaggggaaggctgttggtactcaactgggaggtggaacattttgcatttaagattgcctttctcagattttctgtactggattttcactgcagaaagaaggtattctttaagtgcttggacggccactgaatcctcaagcagatagacattctaagacccctctgtaagcttaaccgttatgtgtgtgacattagccttcgtatcttacagggtaaaacttaagtggcgaggggactgaggcactgaggcacggagagattaattagcttgcccaagatcacacagctgcaagctgagatttgaacaggtagcctttgtagcccaggctcccagccactgagttgtcttgcctcttaggaatctgttgcctactgtttaggctgccatttgcttatggaaagatctgatgtaaaatatagagcagtgatcctcaacctttttggtaccagggactggtttcctggaagacagtttttccacagacaggggtggggatggggggagtcgggggtttcgggggatggtttggggatgaagctgttccacctcagatcatcaggcgttagattctcataaggaccatgcagcctagatccctggcatgcgcagttcacaataaggttcgtgctcctatgagaatctaatgctgctgctgatctgacaggaggtggagctcaggcggtaatgcttgctgacctgctatgccactcacctcctgctgtgtggcctggttcctaacaggtccatggccctggggttggttgccccctgtatagagcatgttgctctctggtaccttagcttatgactaaaggaacttttattttgaagccataatgaatatggtcctttttctgaaacatttactgctagagatttatacccttcccagaatgtctttgagctcatttcagagctaaacattataatgaaaaccattgtgtagtccagcatccagaacttgagttgattcttttttttttcactgcttctaacttattcttaataataccaaacatagcaaaaggaggttgcaatacatttgtttggcaagtttgggtattgaattcttgagttttagtagagccaagcaggtcggtcactatgtgtcattttttggtatctagtagaacggtttatttagataggtattgggttcctctaaattgcccatttagttggtttcagttgatacggaaccttcactaggctttaggtctatcttgtaaacaagatatttttaaagaccatcctagattgagagcaatctatttgttgtttttttggagagcgggggtttgttctttttctcttctctcacaactctggtgttttccaccatttggctggactctggggcaagagtgggctggccgagggtgctccagtttctctcaccccggaacagctgcctgcctctaagatattctttggaagtctatcctgaagcactccgaagccttgcttctgcttctgggaggaattccttggaggactagaggcaacagggggcctaatctgttgaaacttgtgtgtatatttcagggttaataaatctcagctaagaaaattaataaaaattccactgtgaatgagaggttggtcagagactaatgtcttgaaaatgctttatgataacttggaagaatttgagcagatggaaaggagaaactttgttaaggtctccctgaaattagtcatcacttcttacaagcagatttcacaaggtgcttactatctatggtgtgtataatagggttgtcttattaattagtctgatgtttggatctggagaagtaaattaatgagtcaggttttgtataacaaatgatcactttttaagtaattagtgtagcatatgaccgtagagattaatattaactcttaaaatatggaaattgagactccgatggaaaatgtgaaagtgaagttaaaactttatctttttgcctatgtaacatttatcaagtgagaaagtgagaatgcctttaaataagcatttgattgaaagccattagaaggtgagaacttgtatacctttttttttttttctttgggatagggttttgctctgtcatccaggctggagtgcagtgatggaatcacagcttactgcagtggccttgaattcttgggcccaagccattctcccacctcagccttctgagtagctgggactacaggtgtgtatgccactgtgcccagccagttttaaaatttttattttgtggagacggggtcttactatgttgaccaactggtttcaaattcttggccttaagctattctcctgcctcagccttccaaagtgctgggattataggtgtgattcactgctcccagttgccttttgtgttttttttttttaacttactgtaatacacatacagaaatgtgcttacatactttacatcagtagtacttaagagtccagcatagtagatgttattaatgaaagttgactcatggcaatacatataactaggactttgattccccagtttttttcttgctttcataaatctgtaaatcttacttaagaatgacatataaggaaaatatgatctccttccccttccttgagtgcagtctatttataaacaatagcacttggtgctggggtttgttcacgtttgtatgagggagattgtcttattttctgggatataatgcggagatctgtgctttttgggaagtgatggaacgttgatagtgcatccagcatttaggaatgcaagaacaaacattagagccttttgaggatggtgtcctctaactcctcttcagtccaacagccctgtgggtctcttcctgatcagcatttttcactaagacccaaacttatttcctgtaaaccaactgggccagatactcatgactgtctgtggtctgaagatagtagtttatgttttgttttttgttttttttaaattgaattgggtgtgttgttcccagatgaacactgttatcagggcctaaacaaatatttttgtcagggagatgtcacaattgtattattggaaggggattttctctcttagcttttaatttgcattaagaggtgtctgggctgtgggcaaaatagtggctaaaatgaccacttttatttgtttttgagtcagctattgctttttgtgataactgaaaactttagtcttttttgaaggactgaagtgttgagagtttcctggaatgagtggttcactagctgttgctgatcacctggtttattcttagctttttttgcattcaggagtcttagttttcccttgttctccaacttctgtaatctttaagaaaatgaaaggatatttagcagctctgatgacctgtatttgctggattgtaaaggccttattgcattttttatcccttctgtcttggtaaaagttcctgatagcagcagcttttataaaagtttgagcagaactaaggcaaggaggaagaactctaaaatagtgatttttgcttctcagttgttattagtaggttaatcaggagaggaagtaggacattttaactaaaatgggtttctgtttcagttatcaagccaagctgctatttttaagtttgaaaccatttttaaattcagacaggtttgaggattaattgtactgaaatggagctcacatctagtgctttagtgagtatagctaaatgtgcctataatagggaggaagtaaatcatttggtttgatgaactctgtcacttgaggtcatatcatagcttttctgaaagagtgccctgtttaaggtaattatattttatgcagacaggtggatagtaggtatctagtatatatcttttttttttttgagacggagtctcactatgttggcagactggagtgcagtggtgcaatctcagctcactgcaatctccacctcccgggttcaagcgattctcctgcctcagcctcccgagtagctgggattacaggcacaagccaccatgcccagctaatttttgtatttttagtagagacggggtttcaccatgttggccaggatggtctcgatctcctgatctcgtgatctgcccgccttgacctcccaacatgttgggattacaggcgtgagcctctgcgcctggttggtatctcttaaatatcttaatgttaaatttctaaatctaacatactgttttctaaagaagagaaagtactttagtttaaaactggacatactctaccatttgctgcctctatccaggctttgtaacctctttgctgttgacattttgggccagagaattctttcgtgttaagggctgtcctgtgcgttgtagggtgtctagcagcatccttgctgtctacccgatatctgccaacatcactgttctctctctgtacccctagttgtaggaaccaacaatgtctccagacactgctctcaatatcctctgggagtgggaatcatccctgttgaaactgtgttggctgtggcctcttctttatacccagtacatgtcgttagcacttctgtgttttaggaaggattgatcaaaaggccgaagctcaaaaagccaattagcattttttgatgggtgaactctattctttctcaggatgcctgaaattcacttacacatttaggattctagattgtagtatgttacaaaaaatttcaaggatagattatgttcataggtaagttgaaggaaaaaatggaagattcttataatggaacgtaaaaaaattcttttccaattggacgtgtgtattctgagaaaaacattagggtcaggtcattgtaaatagatcatcttttactttcttccagctgaattacaggttggcacttatccagatttattcctcttagcataggaagataagatatattgattaataaggtagtataaaaattgtctgcaaaaatgttttgaaatgtctgcagttttctcaggcagactgtttacttttcagtgtattgtttttatttctgttaattttgatgattctggttacaacattttaaatatcttcttgagatgagaaaaagcagggaaagaaactggaaaataaggagagtggatagagactttcctcctgatcatttcattttgtcctctaaatagcattttttacgaaagtggggtggaggtgggaggttagggaaagaatgaagttcttgacaaataatcttccttcttttgtctccaaggcctctggttttgaactctgctgagtcagctaactatgagtgaaatctgtctgccacctgtctttatagggccatgtgctaagaatggtttttacatttttaagtggtttaataatgtttcatgacatagccatggtcattcatctaccaattgtctctgaccactttcacacaacagtggcatagtttagtagttaagacagaaactggctcacaaaacctaaaatatttactctctggcccttttcagagtttgccaatccctagtttaaactatatttctctattgttaatattggaggcaaatagtattgttagatctgttaaagtagatgtgagttaattaaagacaaacaaaattctcgtaaattggttattagataagcattggtcaaactttgtgtttttagagagtggtttaaaacttgtgttatctacatgtttcatagatttccaggtatccttggggaactttgatgctagagcatcgacatgcttgatgagtttgtttctcttctttcacctgaaggttttgcactgtaggactgctctgggaaggaaggttctgggccatgaactaggcaaaattgatccatagcttcaagactgaaaaccatgactttatgactttttggatctgctgtaattcacagatgggcttaattctgagcccagtctgattgcttgggttagttagtcctgagaagggagagctcaggtataggtatcttcttcataagctgtaaatagaagatggaactcagccggtctctgggatcctgagcgttgctcagcttggaggcagggtactttcaggttgtcagcagaggtactggcctgctcttctgcttatcaaagagcagttcttgctaattttcatcattttcttcacttttaaagattatatgtcactttctttgctgtgttgctgtgacacaggctaacaccccatttgtgtcctcacagattttagtatcatctttaaattgcagtatactgagtccgaacaaaatgggggtaatgcgtctcatcgagtagtattaaggttagtgttaagtagagttttttaagtatttgtttttttgcatttaaaaatgtatgcatttgtgtatttttcacatgtaaatggatttaccactggcctcctttgcaggtggtgcctttggaagtccagagaaattaaatgctttttccaagagcagagaagactctaaatttgaccctgtcctatgttcttgctggtgcacttcattggcttcagtgaggagtccggagagctgggactttaccaatgattttttttttcttttaaacatgtaaaaggtataaatgcacatagaaataattcaaatgacatagaaaggtacacattgacaatagaatccctctcccttttttccccatctttagtccactcttctctgagtcccacttctgaccatttctttatgttccatgtgtggttccttctttaaatatatgcatatacctctgttttgatttttgtttcaattttgagctattgtttccctttataagagatgaagaatttaactcaataccccctactcttcccagtttttaaaaaagttttgtattcaatttctgtttgatatacattaacagctttcaatgatgtaattgcatttgttttcttgattcatcaactttaggcctaaagtgactccccactctgtcagtcaaggaatttggtacttctcagccttctcccactcaatttctcttccttctcatttctcaccctccctcagccatcagtttttttacatcaacataccttatatcatctacatttcattctgtgactgaatgtgttatgtactctgactataggttggttacaaaaattgaaaaccagtaaacaaggatacggaattttaggtaggaggaataagttcaagagatctattgtacaacatactgattataattaataataaagcatgtagttttgaaaattgcaaagagtagattttaagtgttctcaccacaaaaaagaataaataagtgatgtaatgcatatgttaattagcttgatttagcattctacaatgtatgcatttttcaaaatgatatacttgataaatatatacaatttttatttgtcagttagagctcgtttggaggttccagcaggggagtgcagctccttgtatacccttgaccgaagacccgtcctccatcagggatggtcatcctctacgactgagcatgcagcttcaggaggggctcacatagagtggtgagggaggaaggggacacccgcctagccagccagatcagccgaatcaaccctggcgatcaatggggtgacagatttcgcagccagatcgccctcacatcctatttgtcagttaaagaaataaaaaatgttaaaaaaaagaaaaccagtacatagtgttttcaattttatgatattaaataccatgcagtatatgtcaggtagtttggcttcataagaaggagggataatcttgataattacacctgtgccacttgaaggaaatattctgagcattagagcaagtggagtctcttatattccagctggtgagaatcatgctatatttcagtttccttaacttctggaccatgacttcctgatatgtagtttttgttttttctgtctatttctaattcctttccctttttgttagcgtcagaggaaatagaagttattgattcctgtctcttgaatctcattatttaaaaaatcattttacaactcattatgcaccaacattttggtcccttgtgcctactcaggattgaaagtatgaagttttgccggtttttttttttttttttggtcgttcacaattactgtttcctcaaactgccatgcttcttctagaactgatagtgctttgtttcctttgtgatgagaagcctttcccttcagggtgaggacttcggggctgaagatgtactttgcagcagttcccttctgtttcttcataccacagatgtagaggaatgtggcatttatgggtcctggccttggtggtaacattttacctgtagagcatcggaacattgaagactgagaatgtgaatcattcttagaatcattttctacataaagtcctgaattggtgtttttagaatccagtgaagcagtcattcttttaacagtcaccagcattccagaaaagtcatgaaaaattcaggcacagaattgtagagtaggctgggtccttccaggtcaggtaatttttagtctttgatttttcagataagggcaccgagtcacacataaactagacctcagcaatttgcccagtcacaggatacctgggacatgcatcctgacttataattcactggccttccactgtactatacccatatccaacatatatttgaaaatttactgggttaggtaatatggaaattgtggtagacatatgttacttgttttgaaagaactttttagttatttagggaaacaaaactgccgtttgtgaaactattagagccagttaagtgctattattcattagaagttaaagaggttagaatgttgcctggcatatagtaagtgctcagtaaatgctagttgttaccaatggacagagatttgtagcatacctattatgtagcaggcactgttctaggttctgggaatacaggagctaagactaaaacaagagtcaatgatattattttacattcctgatataaagacaaaggccttaaagagaactcaaaaacagaaacaagttttggtgatggcctggcttaagttgactaaaggagagggtaaagaagctaagctttccctatgggacgatactttgaagggagaaagaaaattgctagtgtaaagtacggtgcttatgaaggctttgaatcctggaggagattggcttgatttagaatctttggtgcctgtgaagagtagttgggaaaacactgtaggtagttcaggatcagattgcaaattgccctgagagtttgtctgaagagttatgagttagatggtagtgaatcactccaagttattgaatataccaggaagctgcttgagaaaagcagtgtgagagaattaattttgtagaaaatttcagacctggaaaggagctaagagaatattcaatctagattattctggtagctgtgtgtaggaagattcaagtaggaaggcagctgagaatctgtttgaggtaatatagacataaggcagtaaatccctgtaccagtattgaattggctagaatcgggaggatgaaaaatgtggagacattttgtaaagagaaagaccaaagctttttaacaggtttgatcaagggtaatgatgagtggcttgaatcagaaaatttctcctacctttttccattggggtgttggagactggttgtactatttgcagaaggagatagggacaagctgatctggaaagtcaagttcatttcatttatgatgacgtggatgttagtggaaataatcaagtgggctggaaagccagtgagagatcagggaagggagatgctgatctggtagtcatcagcatagccgagaatgaatgagctcacttggggactgtgcttagtgagggcagggccaagtacatttctgataaccaaaagctgcacatcttacattaagaatattttgtagcagatgttaatgaaataaagcagcttgtgttcaaattgtcagaaaccagcagctcatggatcagcttacctaagaaaagataagatgatcagaaggaaggatttcaaagaagcgttttagtagagtttaaaaaagacccttctcatctttggcacaaatgataagactaaattattttttttctgggttaagacagaacataaattgtgtgtgtgtgtgtgtgtgtgtgtgtgtgtgtgtgtctgtgtgtgtagggaggatgggcagcccggtggtggagagggagagagagatttattaaggatcaaaatgcaacaccccaaatagggggctgaagtttgaaagttgttctgaaagtcagacagatttctgagaataccctccaaactgcctcttgttgatagtaaagaaaaactcccttctgttgggctggtaggtgaccccatgaactggagaagtaaaaactgtctttgaccctgggctacctctggaaaatttgtagggtcaaataacaacacttgatgtataggatatttcttgctacttttaggtagaagatccaaccaataattgttttaaacaaaagagatttgagaagaactccagaaatttgtatccttaactcatctttgataaccaatggtatgatatttagaagtttgctattaatgtatttttatgtattatgttatgtcttactactgcatttgttgcttctgtgtctcaccttgcccttgtagaccagttgttacagatggatttttataaagaaaggcaataggaaagaatttgtaaaactttagagtctgtagtgcttgtataaagagtagtttggaaattcagaatttataataattcagatgagacttgcctaaatacctgtcccctgtcaataagaaatagaagggacttattcaggagatgattagtataaataaggttgaaggggggttgattatctacttaatacaaccctgccttcagaggctttccaaaactatttctgtatgaaaaacgatctcagacatgtcagttgcatttattttaataggccaacactgtttaggttgattactgacaattattttctttttgttttgaaattgtttgtcaaaattacttgtttaaaattataagatgttgacagaacttttgttagcatatcctaacatgcaatacatggcattaattcatggtaaatgtgtttaggtagtgtgaatggatagtgcctagtaaccttgtgtacaaagataagcatttgtcaaacatgtaagacagattaccaacatagaccagcaaccattgcctatatgatgtgttaacaacatgaccctgtttagctagctgagaattgttaaggcctgaaagcatatcacatgaaccttcatgcaagttcttgggtgggatacactgttgacagattctgtcagagtgctaagcataagaatataaattaaaaataagttttagaagtaaagtcggtgtggtttttaaaaaaaaatcctgcaaagaatagtgttccatagaacagattgggaagtgctgaattaaagaaagagttctgttagtcaacagttaatatgtttagtgccacttaattgcagttattaaatggatttgtaagtaataaaactgcattttattaaaattttataatctacacattttgccctagttatacacccttcttccactcacttttaagtggttatctgttttgcatagtctcattttatgtaatagcttgatgtctaaaatgttgcctcaacaggaggtagtttctgtgcagccatattgggctggtgcagatagggccatatggttctaatctaaacatacatctggaaactcatagggtggagctggtgctgtctcctggaacctgtagaaaacgtcagcaactggagtcctgaccacatttttggaggagggtggtgagggaatgagatgctattatttgaggtcagggcttggatcctgtgtagtgattctggcagctactaagttggtggcccagctgcagtagtcatgagtcccttgagtgctctgccagaacaagggatgttgggcttggagtcccagcttttcccttcacagtcatttggcactcttacctgcatctgagcagcctctgttactgtcatacctaggcaggtgtgagatttatgaaaaatgatttgcctgggcaaagagtatattgcttctgcaatttggtaaggtattctgtagctacgtattttttgtgctcacatcgtgagggcatttatttctttgaatggacaagtggctgcacaaagacaaattgcacaatttggaagaaattcaggcatgttaggctctgagtctggaaaataccattaaaaggttatttataactggcttgtggctcattgacagacaggtggagatacatacagaatcgtggccacagccccagttcacactctttttggcctcagcactacacatcttaaggggtggagtgggcgcttggagggttacctgtcattttatcaagcccaaaagccttcctgttaagttccagagatctgactaaaggcagggtttttctgtagagattgaatagtggttgactgaccagggactgcagcaataacgatgacacccctgctggaaatacagactctcttttaccaaatcgcagttcctatatttagctttaatgcggcgcttcttaactggggatgtgtgagaatcgcctggtgagccattttaaattataaaaggcagatctctgcgcttttctaggtaatcccatttgttcccattgcttgaaattcatatttattctggccactcaagtttatatatttagccctgacttctctcttgagttccagacttgcatgttcactgacaccaccattcagctatctaatagtttcagaatataacatttgcccttctgtctcctccccagtaactggcttgtgggcctgttcctctaaaatgccacccataatcctcccccttgccctagcaaaaaactcaatgccaattttttttcctttcctgcccctcccattcctaactcatctttcttgtcattctttcatgttccttcccttcctgtccaagctaccatggcttttacctggcaaactgcagtcttttactccatatgccctactgtggctccagaatggcttaaaattttttaattgattgattctaaaactcagtctaagataaagatgttgatgctgctttttctgaaaattactttgaaccataaagggtgactctgtcttttcttaactcctttattcaaagttaggtgtagagccttgttagaccaaattatgcccctggaagacagtttatgaggttgcacggcctcaccctccattgcttgggctcacagctccttagggtcatggctctccagctctgatgatggagatttgggcaagaatttctctaaaaaggactaagcataagaatataagctttatttttgtagggccaactatttgctaagtatattagtttcttattgctgctatcaccacaaacttagtggcgtaaaacaagaaaaatgtgttatcatacagatctttaggtcagaagtctgaaacaggccctactggactaaaataaagatgtctgcagagctgcattccttctggagctccaggggagaatctgtttccctgccttttccagcttctggaggctgagtgcattccttggctcaaggctgccttccagcaatagcatcattctgatttcttgtgtcctcacatctccctctctggcctgactcttccattttcctcttttccttatgattacattgggcctactcagatattctagggttttcttcccatctgcaaagccttaaaattaattacatcagtgaaattccttttgtcatgtaaggcaaggtattcacagatttcagggattattaggacagggatatctttgactaaacattattctgcttactgcaccaggcgctatttaaatttacttgcatatactaactaatcctcataacaaccctatgagttaggtattattctccccattttacagatgaggaaactgcagcacagagaagttatgtaactttgaacttgcccagagttacatagccagtaagtagtggtgccagaattcaaattttggttggcttcagagtctgttcttaattatgacacatactatctggaggtgcatattgtagtacccttcaaagtgatttttcaaaagccatacttttactatgtagcagcagctgcaataatactttcttcactgcttacttgttggcaggtcctgtgctaaattctttcacagccagtccaagcaatggatattagtatctgcattttgcccatagaaactgaggcccaggattaagttacttccccaagatcacatggccaataagtgcggaaactagtattggaagccagatagcctgaacaggagccaatgcttagccattaagctgaattgcttccacctttatctggtgaaggatgtcattaaagataaaggtaatctttgctcttacatggtgggcacatttgatgacataatcagagtccagaaagaacttgatgtgttggagtgatatgttgaatctaacacaattagatttgaaggaaaaaaaaaacataaatgaaaggtggtatagatcctaagtttcagatacatgcatacactttggggtaaagttttgtttcttttgaatgctgctatcggtgggtatattataaacatatatatcttctacagctcttataactagaaacttgatttggttgagtgcagatcttatatcactaccatgataggaaatagtccagaattatcttggggttctttttccaaacttccttcactccccacaagaggtgaaaataatagtctcttgagccaggttagtgatggtagtgaaaatggaaaacttttgattggactgtacagaatccataatctttgctctagaaagggagccacatattgtattctattcaccaggtcatggttgtcatcctgtggccaacgtgggtcccattctatgttatttcccaaacagcccatgaaaaccaccctattaattagctctttccttcccattcttacctactttttgggatgcagtgaagacttcttttggattttctttcttcaaaaatggtgtgttttgtttttatttgtattatttttggtgtgggtttgtatgccaaaacattgaatacttagaaaaaaatgttacatgccatttttctttctttccttcctttttttctcccaataaatacctaaggtcctgctgtgtgctaggtaggtaggcatcagggtacagtacattgagtaaaacagctatggtgcctgttgtcaatatagggattcatttagtgaggaaaagagggaagcaatacatgaataaaatagataattgtaataacactgtggaggaaacaagaaataaattgagataaaccataacatgaggaggcctgttttagactggctggggaaggctatgcagaggtgacgtttggcatgagagttgaagcattatgtaaacagagaccatgtacaaaggttttagggtagggtggggaggagctggcttggaacggagataagatgaaggtgaagctaagttgagagaaagagatattcagtccttactgactgtggtgtacaatgttttgattttgagggtgcctaactaggtagagattaaagccctttactggagatctgaggactgtaggtgtctttttgaggaggatgatttttggacttaagtttgaaagccaatttgaggcatcaggcaggtatttgaatatatgggtctgtttttcaggggtgaggtttcagcgggagatacaaatatgggagacatcatggaatttaaatcatggagtggatgagatcatgtaagagagtatagagaggtaagaggctcaagaagctaaccttgaggtgctctaacatttagagcttgggagagaaggagccagcaaaggagactgataaacagttggcaggaggaaaacctagggcatgttgtattgggaatgagtaaagaaaacatttccagagggaaggagtgctccattgtgcctaatactccctgagatgacggataaggtaagggcagagtgcttttcatcaggcttgaaacatgggagcctctgggaactttacaaggtcagttttggtggagtggtgagcagatgctgattgtaatgggcagatgaatgaatgggagtttgtaaggaagggggataatgagtagagagaaacttttgataatcccggtacatgaagtgggtggggccctggaggggaatgggaatgtaagatgttttattcagggttctccagaaagacagaactgataggacacacacacacacacacacacacacacacacacacatgagaagggagttattaggagaattggcttatttgattatggagactgagaagttccactattggccatctgcatctgcatgctggagaaccagagaagctggtagcaggacttagtctaagtctgaaggccttagaaccagagaagccaatagtggagctcagtccaaggtggaaggtgcaagagcccagggaccactggtgtgagtctggagtctaaaggctggagaacctggagttctgacatccaatggcaggagaggaaaagcggccaggctcttagagaggatgagaatttgccctttctctgccttttaattccatctgggctcccagttgattggatggtgactaccacatttagggcacatcttctccacttagtccactcacacaccgtctcctctggaaacactctcacagatacacctggggcagctcaataattctaatcaattgctaaaccacctgggtttcactttgagtagataaaggatgggcccagtgcctactgaagccctgaagaataatcagtgtttgaccagctatctggatattcattaatctagtcaagttgaaccccaaattaaccatcacatggggttaagcacaggagggtggaagcacagagtttgacttttttagatgtatatagcatataataaatattaagttcaaccttacgaaattggtgatatttgactatgttttacctatgagaatggcattttcgtatagtttgatctaatagaacatgttacattactgagaatgagttgcttttagaagtggaacttgattgagcaatattgagagggtttaatcaaaagggcaaagaacaaagccttggagcagttgagataaatgggattgttgctcggcagagggttggcctttgaagcagggagaaggaaaggcacacagttttccaggaaggcaggagaagatacacagattcagccatgctggaaggatcacagtgaggccaataccagcgggtagtgtcctatttgaggcaaataattatgtaataaatttacggatttagctgtagatacacattgattgattttgttcataggactgagtggtaactgagcctgttctaccttgtggtagactctaaatttgttctctcaaaggtatttgatatgtgattttttgcttggtttttctctttcactaaaagcggagtaaatcaaatatcatgacctccttccccactcctgagcggtgcaatgctgtggcctccctgtagaactgattagcaaatcaaagaataaagtagttttctcataagtgattttcttgccctacagaaaattgtctttttcaatgttactataagtattctttgacttctcagcataattgaagcattatctatgatttctgtttctttaatgcagactacaagtgcatccttttaaggtcattccactcttctctgtcacatgtacagaatttgcttatgagggtgttcatttcaagaatttcacctgtttggagggagactttattccaccgcataatataattttaaaaatgatgttctttagaccattgtgtgcatatatccctaggccataattttctccatgtacttaattcagtacagaattccaggtactgatcattaatgatatctttaaagctaaatgagattgaaagtcatctttaatggctgtaggatccttttttcatgaactaactcctctagctaatgtttattttgaataatactcttatccatggattatgggaccaaagccataataaaaatattcccaggaagggttgtcttcttattcagtgtgtacttgttgagctataggcagttttgctgtgtatatggctctaaaatgatcttttcctcaaagtacagaaagatctggagaaatgtgggcactcatgtattaagtttgtagtattataatattgtaagtataagataaaatgtggtatttttttttttttgagacggagtctcgctttatcgcctatgttggagtgcagtgatgcgatcttggttcactgcaacctctgcttcccaggttcaagcaattcttctgcgtcagccttccgagtatctgggactacaggtgcatgccaccacacccagctaatttttatttttttattatttacctatttttttttttgagaccaagtttcgctcttgttgccgagcctggggtgcaatggtgcgatcttggctcaccacaacctccgcctcccgggttcaagtggctctcctgcctcagccttccaagtagctgggattataggcgcctgccaccatgtccagctaattttgtatttttagtagagacggggtttctccatgttggctaggctagtctcaaactcccgaactcaggtgatccgcccgcttcggactcccaaagtgctgggattacaggcgtgagccaccgcgctcagccgctaatttttgtatttttagtagagatggggtttcaccatgttggccaggctggtctggagctcctgaccaggtgatccacccatctcagcctaccaaagtgctgggattacaggcatgagccaccgtgcccggacaaaatgtggtatctttaaaagctctgtggtgatggcattttagattaaggtaatgttttattttatgaagatgtgtagctgtactgctggcgagatgaatcaacatgttctaatactgcttgtaataagagtaacttgatttaccattacctgctgtggtaaatttgtatcttcagtattggaattattcaacagaatctatcagaagggatttcaaaagctgcagtctgtggtgttgtgataagtgaagaaaagcatttcccctatttcagacagcctttgatagcatatgtatttaggaaaatatatacagattcatcaactgtacctgactcaaatatttttagcttctttgggttgaactttgggttatgccaagggatcccctttcgtcttttcatggagaatcacttgtaaccaatgttgatgtgcacttacaaagaagggtgtaaaggtttataggacgatactactcgacagctctgaggatctggaatctacatggttcaactagcttctctatttgagccctgaactagtgttgcactcatctcccatttcctttgctttgccatttccagttgtaaagtgatgtgtgctccctctcttgcctttcactggtgcagtggggcttgtctttcaggatgggacctgtgctaaaactttttcttgtctctgtgtatgctgataaacaggctttagagttctatcttgtggtgacttatcaccccaccccatcttagagatgacaattgcctttaaaggactatagttttaatgtgtagaggggctctttctgttatgtgcttctaagtagagaggcctgtgagagcatctttcaggtctgagaaggtacatggctgtcttgtgctcctttcttctctagcatcaggctgtagatattcacccctagtgttgtattgcccccaaccactgccacccccagtgatttgctgctaattttggctactttttttttttttttaattccaaaatctgttgcagtctcttcggacttctgccaattctggcatagtttgctcaaatgattggccttttcttggtagatctcagtctcttaacttctccctttccccttgttgaactgaccaataacctgtgagtataaaccttatatcttgtgtgttatatggtctttcatattttttcctaaagcatatcatgtcatacatactatttttaaactgccttttcaccacttctgaaaatacctttccttactttatcttctgaaaatacctttccttacatttctattttaaaacaatttatatttctaaattttcagtggctgacatcccttccatgataatgaatctatcgtttgaccagtcccctacttttgggcgtttggatattttctatccttttctcttttctcttcttccttctttcctttctgctttcctgttatttcctggtaatgagtatccagagttgtttgttcaccatgcatgtagttttttaaaaccttaatgtgggttttttgaggcttttgctagttataacatcaccttgtgtgttcaaagacaggggcccgtatcttatgcatgtcttcctagcatacatgcctgacacagtggccattcactaaagaattattgttgagtttcagaaatatgagggccatttgacaaataaatgagtaccttctatgtacttggaacccaggatataggggtgaacaaggtaaagattgtccctgctctcataaggtgaggtattattttgtataacgaggtttatgttacagagatggcaaccctcttaatgtgaggatcaatgaaaaaaatttaagacacacagtatagcaaaagcagactgaatgacttcgggtatggttacttgggagatgttcatgcttatggctgaattgactaattgatttttccatagatgatatttcttatttaggattatccactagtgttaagggattgagatggaatgatctttttcaagttcatacttttttgacccttgtgagtaactccagtcaattatacttaaattaaaaatttcatacctgaatataatatgctgttgtacagtgattccagggacccaaagatattttaggactgagtttggggggaacagaaatatttcccaaaatatttttggtctttctgttgcacgtcttaaaatatgattaagcaaagattgcagccgcggagaagattttctgctgtaaattggtgtttcaaccctgccagctgttcatgctttctgcgatcccacttataaaagtggaaagtgaagggtgagtggctgccctcgtaggcaaccacataatttaaaaaaaaaaatgtgtatgcctcagcagatctatattagtatttcatatagctgcctttttcttttttattgtagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcaggtaatgtatacattcgttaataatcactggcctttttttttttttgttctttttaagatttgacctgatgtctgttctgacttggtaagttgcttaaactctttggattctagtttctctttttgtaaagtattttgattagtcacatgaacattaatgttctgtttagtgataaaattccataattctatttctctcagtttatcttactattttatacttacgtgaatacagtctttttgtatgcttttcaggtcttattttctgtaatagttgaaaacctttaaaggtttaaattttgccagagatttttttttaccttcctttggagaatacaagaaaatccatgttcttattatatatcagttgtacattatagattttgtacaaagtaaggttagacttttttttttttttcttaatatccttttgcaagagggaagggaaatattctagagctgtactttccagtatggaagcccctgtctgcgtgtggctactgagcacttgaaatgtgactaatgtggcttgatatgtgctgtaagtgtaatgtacacacacagtgtttcaaacttagtgtgcaagatatcttaattcatttatatattgattatgagttaagataatattttggatatactggattaatgaaattttaaaattaatttcaactgctttgttttactagaaaattaaaaatttggtttgtattatatttctcttggacagcgctattatagagggcaatggagtcgaaaaccagcattggaaaggacttctgcctttcttaaactcagagtgtttcactcacattggctctgcaaattagggcaaggctgtgtttaaccttgtgccttagaccagaaactggattttgggggaaggatcctaaggggtaaatattttaaagttggacaaaattatttggcttctggcctcgttttcgaatatgtactttccactaactgctgagggcagagaacatgatatgatcttgaggtcgtggctcacaggccaagctggaagctggggacagtggagctggccaggtcttgcacctgcaacctcatcagctagagtgtagccagattctgataggatcagaatcctgtgcttacagggatagctgtttctgtgaggtttggctttatttagttttttgttgagtacttcttgagtacctagccttgttgtcatccatgataagggaacagcaaaaaaaaaaaaaaaaaattatttttgttgtgtggtctaaatctgggctggacagaaaggagttgcagagcaaccatggaagtcaggcagagcaagtcaggagggtactgggagagctgcaggactgaaggaagaaacagacactgctaacacatcctcctgcccagcttgtttccaaagatttgtcagcttatccttgagaagattttattttatttattaaactcatatattccatagggagataaatattattggcttaaaatactttgtattgactttcatataatttgtttggcctttaaattttttttataacttatatttggatgtgatttttgcagtctagttttaacataatttaaattttacaaaaggttgtttggttgtgttgtcacatttaatattatagagactatgaagaacaaaagtaaagttttagtttttttcccaccgttttttcctttgcatcccaacattattagccagaaggaatgctgcattgaaaagctagaaaacaataggatacataaaagctaaatctcaattttaaaatttttctcaatttttagatgattatgcctggttgaccctgttgtagttttacttctaggataagataggtagatataacatatgctacatggcagaatagctatagatagatatatttttgttcaggcatagatttttaatatacatgagatttactataaaataaagatagcacaaagtaaaatatcattttcagaactgtttttgaaaatgctgaaatatctggtcataatcaaatttcatcagaaatttttttcatggttctttttctataaatttctattaaattgttttggaagtaaagtaggagaagaaggaatagaatgaacttttttttttattagaagcggatgggagggattatttgtcagggtagttttgtagcacaaatagcatttcaagcctttgaatggtgatggaatattttctactctaaactcctcaatgtctacagaaatagttttattttataaaatacatatgcagagtatagcagtgaataattttgagcaaatatttaccaacattaaattaataattgttaaactttaattttttttcttttacatttttagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggtaaaatttgcacttcaaaaagacaggaggttattaagtttctttaggcctagagtcttttaatgagaatctggtagaggccacttctcaaatttttgagacattattctctgacttttaacattaatatattccttttatgtgtcattatgttttagtgttctcattttatcagtttatgtgccattcaaggatagtatctgtgcagtatgaaatggtaataaacaaaaaagaagggcttgcctttggggacaaaacagtatatagttttaagagactgcttgttcattttagtaactttttaaaaaatattgcataggaaaattatttcatgtctatgaggtctacttttagaaaaggcagaatactcatgggaaagtttgaatctttaaaataaagaagcagtattaaatgctttaagaaccttggtgttgattggtttcaggcacatacgaatgtgagtctcagctctctgtatttatcagtgttagatgactttaggcaagttacttaatccctctgagaccaagttttttccctggtagaatgaggatagtagtatctgtttcaatagggtgcaaagtgaaagaatcatgtatggcacaacagtagctgctatcattattgttactgcatatgatggcgtttatttattgggaccacagattcctcccttcccccacccctgaccccgccctgccaagatgaggggaagttgtttcaattataatgggacataggatttgatatacatatttgttggtttgagtacccagtcacagataatttagttgcagcatttttttttttgtggggattggagaggggggtgtatttccaaagacttattttgaaggagtgtgttacttttcttaatatctcgatttcatgattactgtcagaagcactggtaacctaataatttgaaggtttttttctttgcttccagcattcatttatcttctacttacattttttccccattagtttattggcagatattcctatttttctattttgaagacaacaaaatatgttactttaggtctggacacatgatttagtgaagcattttttttgtgcgtgtgtgctgcttttggatgtgagaggtagtctgcaagcttggatattgaaatgcttggatttctagactacagtgcaatatttagtgtgcactgacatgtaaaatatatgaaatcaatattctggaaatttgtgatgagcagttattacacctcaccttctgacttgatttccctatctttgatcttaatgtctttatcttttcctacatatacctgttagtgttatgttttcctcatatatattttagattgtctttctccttaatcttagcctgtaccttttaaatcaaaactcagggaaggctgggcatcatggaaggacttcagggatttggagctaggcagaatgaggcaggtatcttggctctgcggtgtattgcctgtgtgtccttgggcacattgatttgtgtatctgtaaaatggagatcatacaggtggagtaacatcttaagccagggttagttataaagtaattataaaaggtgatgaaaattacatgtaatccaaatttctttgctatttattcacttgagtgcagattagttagtatatttgcatttaggggatgcatatgaaaaacacgtatctttgattactagactcacactcagtgaggtgaggtgctcccacttaatgtaggatctagatggcttatggcactgcagattttttttctctataaatctcataatcacttgactattcaattattgagtgaaatggtggcagagccacttgtaatatctaagttgttctcccttctctttctgccaatcatgtttagtttaattcttgttacttaattgggagagtgatgtgattccatagtgtaatcttccttgtaggcttataaatatacttcaaagtgtgtcttgtgagtcttcctcatatgaagcccacttcttcccttttcttgattttttaaaagacctttattcttttcctttttctgcaacttttaattctcaccaatctcatttcttgttattccatacatgggcacttaactgtaataataaaatccatggtttactgggcagaatgccaaatgttttacaaacatttagtgcatacgcatgaaggttagtgccatgattcacgatgaaggtgttaccaggttacatagctaacaaggggcaccagaatactttcctgacaatttacctggatctcccactaaagtaaattctagcggcaaagaacatatgcctcctattaaacacactctcctcatggcctagctgaacacttggcatatagaataattgccaaataaataagacctctttgacctttctcaaagcccctccaccacatactcatactgcacacacacgcctccacgcttgcaggtcttcgcagatgtaaacatttacagcacttttacttggtctcctcactagaatgttagctcattaagggctggaactttgttttattcactgctgtgttgggaatgcctagaatcataactggcacatggtactgagtcattagagtttggttaaataagttaatgagctaatgaatctgactcttcaaactaggatgaaacatttgacttattctttggcgtaggcttttcttttaagttccctccttcctgatggctacttatttctattcttaaaaaaaaaaaaacttatttaaagtactcttttgtaattttatgtactaaaaacaggcaataataagctctttgagggcagggattgccctcgatttttagattttttgtttgtttgtttgcattactattcctgcttagttagtaggtcatcttctgagtagacatccctagtaagtattcctgactataatctcttttggtatcctagtaactatagctgaatctttttgtcttagtaaaagatgttaatgaccctgactctcaaacccttctccacttggaaaaaataattgtcagaaacaaacattttaaaactacagtgatttttgctgtcaagcaaaatgctagagagaagaatccactgacttaataattttcactattccttaacttaacaaaagtaaaatattgacaaataaattattctgtgaaaaactgaattattcacatcatgaaaagccattcttttttaatagaggaaaaagagaaaagtgtgttcacatacactgcaagtcaaaatgtgacactataatgggaaatctttgtataatactcctaaatgaatgtgcaattaggcagtgttctttctaaatgagatttatagagatttgtttgcattttctgcagcaacaatttaaaacaagctttagcatagtagtttgtttcatcggtggattttcgtctattgggaatagaaatatttgaaatagatttttaaaaattttctatatttagttccccaactttgtgaatttatgttgctgtgtttttctatatatagatatttttctttttggactgagttggtaatatctctcaagaaaaggtaaatttcaaaatatgtttgtattttaataaaattccaaattatgttacagtctgaaaagatctaacaattgtcataaaatatttaagtgttttacatgagtaaaaactgaattggaaaagaattgtgaagtaaatgctgataactttgtactgttatgcttttgaaagttttgaatcatagaccatgaaattaaatgttagttgattgatacatgttcatgttgtatttaataagctgattaaaacacaattacagcacctctgtatctataatcttaattctttgcttcccactagttaaactgctgaaatatttggttaattttacttcaaagaagtcacagtgtgtggagagaagataaggtatactaaatgaaagattggacagcatattgttagttaagcaatttgtgaaatgaacattagaaaataatcccccttgtggtatgactctaaaatagtaggaagacctaggcccaagagttacactggaaaataattttcttttgtacatttgcaattcttttgtagaactttttattgactcagagggtgattaggactttttgcttttttgtgtgtgtaaaattaagaaacagatgtttgcatttagtattatgataattatgtatcctctaaaaaagtttgtaaaaaaagaataaaaacatgaggaaatcagtgtaatatttccaaatatttctattcaaatattttcaagtatagttagaatttgaaaatagttctggtcagtcatagttggctaatatctctattaggggtgtccaatcttttggcttccctgggccacattggaagaaaaattgtcttgggccacacataaaatacactaacaataggtgatgagctaaaaaataaaatcgcaaaaaaatttcaaaatattttgagaaagtttagaaattcatgttgagatgcattcaaagccgtcctgggccacatgcagcccgtgggctgcaggttggacaaacttgatgagaggtggtggagacttagaagtctggttgctaaaggaactttactgatcagaatgagatggtcatcggaaggagaagttgtacgtgaacactgtttggagagtactttatttggtttagctactgcaggataaagtggattgtttgattttggctgccatgatgggaaattttagtttctggagctaaaatcgtatgcggaacaactgagttctggcatttattgcctgtacggcatcaggggagttgcaggtctttgttattttttactttgtgtgattttttaaccctgaaaagtggtaaatgaagccacatttaacaggtgagggcagcgaggctaagttagggtaatttgttcaaagtcagttaatttaattataaattctcagaggttggtgaattgaagctcaggattgcctgattgtaaaatctgtgttttttccatttacctctttttattgcctcttaagatactttatttagttcaaattattctatttcttttcttcttgtgttgtaggcattagctaatttaacacatttatctggactttgggttattaatagggttgtcagatttagcaaacaaaaatatagaatgctcagttaaacttgaattttcaataacaatgaatagtttgtgtgtgtgtgtttgtagtttgtgtgtgtgtgtttgtgtgtcccaaatatcacatgcagcatgcttatactaaacatttatttgttgtttatctgaaattcagattcaacttggctgtgcattttatctgacaaccttaattgttaagaaaattgtagcacttgagttaaatggcgctgtatggctatttagaattctgtttttagagatctctaaaatatgtgtattgagattctgttttagaggaagaatagatggtttggtctctcattggactttattctttgaggagcacatatgttaagcagctgctgagaaatttagatgatcattaaatagctcttctttctcctcagtttcagttacctttgtctgtctttcaagcctgggtgcttcaaaactctccagtgccctggtaatacaaataattactaacacttagggaattattatgttctgtgcactattctaggcattttacatatatcacatccattactcctttcagcaacttcatgacagagtctgtaattaccctcccttcatagatgtgggagaagtggcaggagagagcataagtgatctgttcatggcagggctaggtttgaaatcaagtgatctttttccagaaccagtacttgtaacagtttttaacatattgcgttttttggataattcttctgaaaccacaggctgagcatataggagggaagtcttttaagtatttccaagccaaatgtcaactactttagtattattaaccataaaaaagatttttttcagctatcttgcaaaagtggacatctcactgcactatctcctatccttcttttccttctgatttatcttaattgaaatgaatgtctctgtccctaaatactatattagtacatgagatagtgagtgattttcctgattgccacattttctacaattagaaagtgatttacaagcaatattttccagcttttgttttgttttgttttgttttttgagatggagtcttgctctgttgcccaggctggagtgcagtggtgcaatctcagttcactgcaacttctgcctcccaggttcaagcaattctcctgcctcagccacctgagtagctgggattacaggcacacgccacagtgcctagctatttttttgtatttttagtagagatggggtttcaccatgttggccaggctggtctagaactcctgacctcaagtgatccgtccgccttggcctcccaaagtgctgggattacagacttaagccaccgtacctagcaatattttccagcctttaagttggtttcttttagagactttgataatttgcccagtatttgtctaaagctaagtagccccctcgtgtaccctaagagtaacccaccaaagaaagtcacttttctttctaacagtgtctgtcatattttagacagttttctcattatttcaaataaccaagctctgtttggggaagacttactatgcctgaagtattgtcagtcagtgttagatgctcatagatgggatcattaatgagggaggggaggagctttagcacagatttagaaattatcttggagattgatcacacaattgcagctatgagaaaaagtatgcaggtcttctaaggggcacttagaaaagcaatataataaggggtcacagttgtacattgtacgtatagggctgcaggatgaacaaaacgcctgctgtcctaacaataatgcaaataggttcctctggtgtggggtaaaatttccagtgacagcatcttcatatggattcaaaaaatgatctctctcaaatatcttcattgaattaaagctgatatgcttagaaaactattaaatgacactgaatcaactgagaaaaacaggttagattattttggaaacctgggttcaaaagcatttagaggcatcagcaggtttctaggttttccaagtctcacagatctctggaagcctcagcttcatctgtgactgtcttcttaccctctcttggaaacttagtcgattactaagttctcttcattttgtctccttgacctcttatttccctctgtttatttcaactgcagtccataaccattttttacagaattttgcagtggtctcattttctgtttctctgcttctactttgcctttttagtcttcacactcttagtacagttatttttgaaagcacaggtcagaaaaccctcatgtcctccctccaaagttctctgtaagaaacaggaatggtttagaaggttttcaataatctgtctcccacttctatttttatatttatttctcaccatatttgcatcatgtaccctgcaatgcagccataaccaacttcctgtcttttccatatgctcttccctctatttggaactaccaccctttttctctctccagatgatgactaatctaagaatctttcttcttttcttttggtaagactttaccatttctttatttccatggcattttattcatattttcactgtagaatctgttttcatttagctttattgctttgcccttattagatgcaaggtacatgtttgaatgaataaatcagaacgttaattaaaactctttcacagtttatcagggaggaaaagcaagcttaacttataatagaagtgttggaattaaaattaatcagcagcgtatttgagtaatagtaataccatttaagattgtatgttaccccataagtatatgactagaagttgcagttgaatattgaaggattaaggagtgatggaagaaacctgttcgtcattttttcatagaaaataccttaattactagatgagaacaataaacactgaggattctgaaaggagggagagagggaagggggaaagggttgaaaaactacctgttgggcactgtgttcactatttgggtgatgggatcaatagaagcccaaacctcaacatcatgcaatatacccgtggaacaaacctgcaaatatacctcttgaatctaaaattaaaaaaaagaaaataaattattagatgaaaggatatttctgtttttaatgaactttattttaaaatttgagaatatttatcacattgaaatggaaaaaaaatcttgaggcttaagttgcatgtgttgtttattaccaatgtattatttatctggatataattattttttattcaaaaacttttcatgttttcctgaagattggtgcttatttaacttttgagtggaattaatatacttaaaaaatcgttattaataaaaataaaaagaaaagaaaaaatcattattatagcaatcaaaaccatagcagtgtaacagtgctttgtggagcggggtgccttcttagggatgggtgttttaatcatcttagggctcacagatcctcttaaaatataagtattttggaaacttaaagataatggacaatgattattaggtatagcatcagaacagagagtgaacatattaaagctaatatggttgtattattttatctttagtttcatttctagctgaagtaataaatttgcatttgtacttttttcctagtccttttggctatacctttcattcatcttattaagtacttattgaactcttgctcttatatgtttgcagtagatactagattaagtttgagtggtatgtgtgctcaggcctgcttctaaaatttgcaggaactggggcaaagtacacagaggcccacataccctgtgtttaaacatttaagttataaatcaaagaaataaattactaaagaaaaataggtcttctcctcttgcctggagaaatagctcagtgatctagaagaccaaatgtaggtttagattgctgttgctctagttccccactggaatatggtggtgtgtatggggagagccagcctgtggggcaggccagctgccttctcctcccaggcctggccctgtcccaaaccaggaaggaccttgattgaagcggtcctggtgccaggtctacacccctacaaactacagcctcttggccactgtttaggctagagagggtcggtcccatttgttagggttaagtgccctgatggggagagacttataagaatcccagtaggcttccagtctggggctgtttagacagatttctggaccctggtactcagaagggcagggcaggctctgggtcagtttgtcctgtggatttatccaattgaaaggggtgtagtcagaagaatagggaggtccttctagagtccagggctcagggccaggtaactcttgcccacatcctcatggtggtacttagtgtatatgcccttgaaccaaataaaactaaatgttcctgaagagcatcagaactccacataatctctagatttccaacctatggctgagagctcaaaattttaaaaataaattgtgatttgtgaacagttactaggtgcttaattgttcatgaacattgaatgtagacaatagagtttccagctttattggctttttttattttagaacttaaaaaaaaatagtggtatcgaatttgggtttatgcctgctttgtggaacttgtaattatgcactctttgttttaaatatttccccacttatttaaaatagctattagcttttttatgggtggtaatagtgttagaatggaaaagaataaattgaaaggtattcttaatgctgttctagccctcgttcaattttcagggatattccaacagaaagaaaaaaagctgtgaattgaccacttaagtaaatcagtttgcaactcagtgtcctaagattattaaatctagaggtaggaatataattttatgtcatgaaaattcatcccctaccactttttataaaatactatatttctggttggtctcatgttaatatacaattgtagtttttacagtaatttagaaaacgaaagaaccaattcagtgtaaaaggaaatacttgattactctgttgtataagagcaataaaagctaatttactgttatattactcagtactgaaagctgcaagaggctatctttcagttcattcttcattaattatgctgtatggtggtgatatcagtatgagttttatggaacgctttcaggttgacctctctgagcttgtattttggctcatgtgaatgtctttaccatattttcctcatgattgttgaggggtgaatgaagtgttgaaggcaaaatggactaatcaatcactgtgattcctctgtgaaaactcccatgataaactcttttttgaaatggccttagttcattcatcacagattataactgttgaaaataaatagttgtgcttaacaaaaaacatacaaaaaaacttttacttatcaatcttcataaagactaacccttaaaaatttgccttttatgctagattactggagttttattatcaaattaatttggaggcatttcactatttatagttctttagctagtagccagataattaggaattagtttgaacctttaaatttaggtaaaagatatcatgtgatatcttaaagacgataattctaatagaaccatttcatttacatggtccttgttgcacgtgtataataaaagcacggtacagaaatagatttacttacgtacatttgaatttagctcagttttgcaatatgtaggtagatatagtatattcagttaaatattatgttgatatttgataaaataaattcttcccacattgcaatctttatttcttggatggtaatgacgctgatttgttctagggctgaataagtttgctagggctgccatagcaaagtaccagactaagtggcttaaacaacagaaatttgtttttttcacagttcgaggctagaagtccaagatcaaggtgttggcagggttgatttcttttgaggtcatctctccttggcttgttgatggctgtcttctccttgtgtctttgcatggtcttccttgtgtatctgtgttctaatctccttttgttataagtacatcaatagtcatgtaggattagggcgtatcttcatgacctcattttaccttaattacctctttaaagacctgtctccaaatacagtcacattctgaggtggtgagacttcagcatatgacacagatctgtccataacaagggcatagagtgaattcagtgcaaactgaaattttgggtaaccaatatatgttttaagatgtggagcagtttatataagtgttttaattgtatactttacaaattgggtgttcagaatattttttatttcccctttacctaatttaattgtacagatgtgggaaagggcagttaaagactgatgatgatatcagttctgagcacttgatgttttttaacttggtagtgttggtatggtcatcagggagttagggcatctgggttggttggactttctgggctattccctgggaatccagaggtggatcctggctcagtgctctgggggcagtgttccaggttagtactttggtgaagctaggtgggattctttgcagaccaccatttcatgaaatatctttgaggttttaaaaatagacacagttttttttagttaaatgtggaaaaattgaagtatccaggaggtgttctttggtaccaaatcaggttaaaagtgccccagatcaagaaagtcctataaagactatttgacattatatttctatttggcctatagcttcatacgtgccacattgtaggtgctcagtaaataattgtaggatggatgagtagatttcaattaaagcaagaggaataaataagtcatagctgcagtgctcttttcaaaagctcatattcacattgtcagaatagttttgtcttctctgccctggcaggcttttattttttatttatttatttattttttgccagcaaatatagtatacatattaatttaactatatacagataagaaacagccatttggaccctcttactctttaattctctcacatgtaagtttggaaacaatagaccaatagttcagcttggatatacaggaacttctccttatacgattttttagatgggaacgggttattttttagggggtctgctttgcctgccaccagtagacagaattggtggctgtgtacgtttttgcttggccgttttagtagtctgccttgtggtgctatgtttgcacctgttggtgttaaaaatgtttcttatagccaaattgcaactatctttagataaaatttccaggatatttggaaagtagaggaaaaaacaggagaagcaaactgtcaacatctacagttctctttttgaaaaattttacctatatgcattcgcatttgttgtttgattagtgttactttgtgcttctaaggaattgaataatgaacagcttttgggaacaaatgcctgtattttgcagaattctacctctcagtgttcatatttatggtgtaattaccttattggtctgctgaaagcttttaggtatagtttatacttgcaatctcttttttcttagtttaacttatttaatgggtgaagaattttagatgtggcatgagaggataaaatttggatcccctattaggataacagtactgccaacttgtaaacagtgtttagatttttaaaattcaaaaaaaattccttagagataaaaaattgaattagatactataattattaaaatataaataactgctttttggccttaggtcatctatcttatttttctcatttctatctgaatttgtgcagttttcagagtgttttcattgttttaatattagtgggtttctgagtcccatgacaactaaaatggagtttcattaattgaaaacacctgttaaatttaaaaatatgtctatgaatgaaaattctaacgatgtccaaagtaatgcaatggaatgtgactgagttgaaatcagccatacgaattagacctttgtggtatatttgtgtcttgatttaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaaggtttgttttaaaacttttttggaatttggtaatattaaagcttaattgtacaatgaactaagtattgaatttttagatggtgaaaattcttagctttatatttgaaacttaaaatatttcttcacataccgttttcgttgattttggttcatctctgaaaaagccatttgaaacttttccatttaaatcctgtgttccactggaagcagtggcttactgctgtaatcctagcactttgggaggccgaggtgggcggatcacctgagggcaggagttcaagaccactctggccaacatggtgaaaccttgtctctactaaaaatacaaaaaaattagccaggtggtgctcacgcctgtaattccaactactcaggaggctcaggcacgacaatgcttggacccagaaggcagagggttgtagtgagccaatatagtgccactgcactccagcctgggtaacagtgcaagactctgccttgggggaaaaaaatcctatgttacaactttgtcccacaaatggaattactaggtcaaagtggcttaatagtttaaaagttttttttaagtatataattaaagtgacacctgtatagtttgtttcaatgtatatttcaatcttccatatagaaagtatcaatttatttgctttttagtcagcaatataatttttgaagttgttggccaatttgatggttgaaaagtttaattttaattttaatttttgattggtaacagtgttgcatattttctcatacaggttaaggtttttgtgacttgcttattgtactttttcttactgatttgtaggagtatttatacatatactccttaactcatatttttcctcagatttttattttcatcttttagtgtttgatatacaaaattttaacatatttatctactcaaatctgttattctgttttcttcagatattgcttttgctgtcatgttttaaaaagttttctccaatctagaggtcaaataaatagtgctttttttcttcctaatttcattttttaccattcactttttaaaaaactgattaaaaaaaatacgttacgatgggaggttttctgatctccatgtatcccctggagttaagaattatcttataatgaattgttttctttaatttatttaatgtcacttatacagcgcttactgtattagtccctgttctaagcactttacaaattgtaactaataatcttctaaacaattctgtgaaataggtacaattgttatcattgttttacacataaggacactgagtcgtccaggatcacagggcagcctggcattccatgtagtccaggctgtccacctccagaggctgtcttctttgcacactgcgccatcctgccttcctaagattgaattagtccatccttttctagtgatttgaagtgcaatctttattatatttaaatatgcattagtttctgggcattttgacttgtttcatggacttttctgtttgactgtaattgttgtgcctttataatatacttcgttaactgacatttgacgttccttctcatctttttgtttttaatatttttagttattatggatacataatagttgtacatgtttatggggtacatctggtattttaatataagcatataatatataatcagatcagggtcattgggatatctgtcacctcaaacatttatcattttcttgtcttaggaatgttggaattctcctcttttagttattttgaaatatatgatacattattctttttttttttaagcaattgaccaatcaattttaattaactcattctgtatgactatcataggctattaaaaataggaaagcgtgtttcttttttttattattattattatactttaagttttagggtacatgtgcacaatgttcaggttagttacatatgtatacatgtgctatgctggtgtgctgcacccattaactcgtcatttagcattaggtatatcacctaatgctatccctcccccctcccccaaccccacaacagtccccagagtgtgatgttccccttcctgtgtccatgtgttctcattgttcaattcccacctatgagtgagaacatgtggtgtttggttttttgtccttgcgataatttgctgagaatgatggtttccagcttcatccatgtccctacaaaggacatgaactcatccttttttatggctgcatagtattccatggtgtacatgtgccacattttcttaatgcagtctatcattgttggacatttggattggctccaagtctttgctattgtgaatagtgccgcaataaacatacatgtgcatgtgtctttatagcagcatgatttatagtcctttgggtatatacccagtaatgggatggctgggtcaaatggtatttctagttctggatccctgaggaatcgccacactgacttccacgatggttgaactagtttacagtcccaccaatagtgtaaaagtgttcccatttctccacatcctctccagcacctgttgtttcctgactttttaatgattgccattctaactggagtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttaatttaattagatcccatttgtcaattttgacttttgtttccattgcttttggtgttttagacatgaagtccttgctcatgcctatgtcctgaatggtaatgcctaggttttcttctagggtttttatgattttaggtctaacgtttaagtctttaatccatcttgaattaatttttgtataaggtttaaggaagggatccagtttcagctttctgcttatggctagccagttttgccagcaccatttattaaatagggaatcctttccccattgcttgtttttctcaggtttgtcaaagatcagatagttgcagatatgtggcattatttctgagggctgtgttctgttccattgatgtatatctctgttctggtaccagtcccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaatcattggtagcttgatggggatggcattgaatctataaattaccttgggcagtatggccattttcacaatattgattctttctacccatgagcatggaatgttcttccatttgtttgtatcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgtacgttgattttgtatcctgagacttgctgaagttgcttatcagcttaaggagattttggattgagacgatggggttttctagatatacaatcatgtcgtctgcaaacagggacaatgtgacttcctcttttcctaattgaatgccctttatttccttctcctgcctaatttccctggccagaacttccaacactatgttgaataggagtggtgagagagggcatccctgtcttgtgcccattttcaaagggaatgcttccagtttttcccattcagtatgatattggctgtaggtttgtcatagaaagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgattagcgtatattgaaccagccttgcatcccagggatgaagcccacttgatcatggtggataagctttttgatgtgctgcttgattcggtttgccagtattttattgaggatttttgcatcattgttcatcaaggatattggtctaaaattctcttttttggttgtgtctctgtcaggctttggtatcaggatgatgctggcctcataaaatgagttagggaggattccctctttttctattgattggaatagtttcagaaggaatggtaccagttcctccttgtacttctggtagaattcggctgtgaatccatctggtcctggactctttttggttggtaagctattgattattgccacaatttcagctcctgttattggtctattcagagattcaactttttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcttttgaaaaaaaaaaaaaccagctgctggattcattgatttttttgaagagttttttgtgtctctatctccttcagttctgctctgatgttagttatttcttgccttctgctagcttttgaatgtgtttgctcttgtttctctagttcttttaattgtgatgttagggtgtcaattttggatctttcctgctgtctcttgtgggcatttagtgctataaatttccctctacacactgctttgaatgtgtcccagagattctggtatgttgtgtctttcttctcattggtttcaaagaacatctttatttctgccttcattttgttatgtacccagtagtcattcaggaacaggttgttcagtttccatgtagttgagtggttttgagtgagtttcttaatcctgagttctagtttgattgcactgtggtctgagagacagtttgttataatttctgttcttttacgtttgctgaggagggctttacttccaactatgtggtcaattttggaataggtgtggtgcggtgctgaaaaaaatgtatattctgttgatttggggtggagagttctgtagatgtctgttaggtccacttggtgcagagctgagttcaattcctgggtatccttgttaactttctgcctcattgatctgtctaatgttgacagtggggtgttaaagtctcccattattattgtgtgggagtcttaagtctctttataggtcactcatgacttgctttgtgaaactgggtgctcctgtattgggtgcatgtatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaattttccagtctgtgtcttttaattggagcatttagtctatttacatttaaagttaatattgttatgtgtgaatttgatcctgtcattttgatgttagctggttattttgctcgttagttgatgcagtttcttcctagcctcgatggtctttacaatttggcatgattttgcagtggctggtaccggttgttcctttccatgtttagtgcttccttcaggagcccactgtctggcactctctagtgagatgaacccggtacctcagatggaaatgcagaaatcacccatcttctgtgttgctcacactgggagctgtagaccggagctgttcctatttggccatcttggctgctccctgcacattattcttaactatattaaaaagttctttcaatgagtgaacattgaattttgccaaagtgctttgtaattaatttgttaaattcttcgtactccatcaaaaaagtaatctttttggattttgatgaaaattgatgtaaacatttaaagataatttggggagaattgactttttataatttccattggagtttttttttttttttttttttccctcttgataggaggcttaaaatgcttacaggtttgactaggaagtgaagggtatattttctaccagtactgggattaattaactacctcatccaaaggggctagccacatccactctaggcatgtgctgctactggaaccagagttgtcaggatatccctccagttactcaagacaaactagaattccaaaatattatgtaaaatacctagagtttttacactgaaatgttagctattaatttagattaatataccaggatatgcacacatatgcatgcataaacacacacacacagagttgcagacacactcacacagtgctaaacagatcacatcagcatttctgaatctgtagtttagatacactagtttgcaaccttttaaacattaataactgtcttggaaaaccacataagcattgatatttgttttataaaggcaattttttgattaagttttaaattttttgtcaagtgcagtggctaatggctataatctcagtgacctgggaggctgaggtaggaggatcaactgaacccaagaattggaggctatagtgagctgtgatcatgcccctgcactccagcctgggtgactgggcaagaccggaactctaaaaaaaaagttttttttaggtctttaggtgttaccttacttcttgagcatgaaaaatatttcgtattttctaagaaaataattttatagttactcagattgtttctgattttaagaatttatcccatgtgtagttatttttgcttttttgttacttgttttgggaatctgatttttttcttcattttgatttacttaattttgttggtttttgcccaccttaccctcctagaacctgtttatattttaccagtttttactcttgacctatctgctttcatctttcctaattccttctactcactttcactaatgctaaatgagccagtccacttaataagttcatctgtgtgtttaccttttagcaatagtctgactagcttttatgtttttatatgctattttctcattattgtatttttcctacatatttaataactgtactactgttttctttttgacttaggtatgttagaaaaataattttcaatttgcaagtgctattttttcccagttatactttattataaactagctttaatgtcttatggccatagaatatggactgtatactctttttttttttttttttttgagactgagtctcgctctgtcacccaggctgaagtgcactggtgtggtctcagctcactgcaacctctgcctcccagttcaagcggttctcctccttcagtctcctgagtagctgggattaaggcacctgccaccatgcctggctaatttttgtatttttagtagagacagggtttcaccatgttggccaggctggtcttgaactcctgacacctgccttgaactctggtcttgaactcttgaacacctgcctcagcctcccaaagttctgggatcacaggcatgagccactgtccctggcctgtatactttttattctttagagatttttgaattttttttttttttgttacttaatgtgtgatcaatgttgatgaagcttctactggtgtttgaaaaggtggggtttgtagaatatagagtttggtatctgctaattccgtattttacaactactgtttttatcttcgtacagtcagttttgctgtcatattgcatacacgttcttaaaaataatgttatgcaaaattgtgcaatattaaacccagggctcatgaaaaagtatcgttagagtgtagcactctaaaacttcattagtgatgtagacacacacagaacatggaaacctaataaagatgctaatccagttttacctgtgttaaattggttaaaaaatgcataaatatatatgtcagtttaccttgaaaaaggcctaaagtttgcttgtggaagggtgtattggaaggagtatagattcgagttattactgagaagtgatggcaagtaggttagctgaaatcttttggaaagttgaatagcagatgtggatgactgtggctcataacccttgatgaactgagggagctggtagatgtttgaggtgtgtgcgtgtgctttgtgcattccttatacagctttgttcagctgcgtgaagttttgtaccttcatctaatgtttcttggagactaaattgtgcataagcaaggcaaaatttatttcctcatgtaatcaatcacctgggaactcattcccatttttgaaacaagtgtttatggcagaactgactgtacttattttttgctactgttcccctatcagcttttattttttgggtattttatgttttttttttttttttttccattcttgcctgatctttgttggcttctgtattagctcattcattcattcaacagacacttcccgaacgtctactatgggacagggactgcaaggtgggcactcctagactaagatttatttttcttcattgtaaactgtatgtatcatcattgataccatcttttctcttttttataattaatattgttatactaccactcttttgttgttcgtttgcttgagtttgctgtcctttttacttgaaggacagtcagcttggtggttctaaaggctgggaactggaaccagtccgcctaggttcaaattctgccaagtcccatctactgtgtggctttgagcaagttatttaacttctctatacctcagtttcttcatttgtcaaatgaggataatattgaaaccaattttatttggtttttgtgaggattgaattaattcagacaacatgcttagcacaatgcctggcacattttaaaaccccaataaacattagtgcttttttaacttttatttgagactttgagtatttctcctggataccatatgtaatttttaatgctgaagtcttctataatgggagacttttcttttagtttttgtttttttttgaaacagggtcccactctgttctcaggctggagtgcagtggtatgatcacagctcactgcagtctcaacctcctgggctcaggtgatcctcccacttcagctttccagtagctgggactacaggcgcacaccaccacggtggctcatttttgtattttttgtagagatgagattttgccatgttgcgcaggctggtcttgaacccttgggcccaagtgatccacctgcctcagcctcccaaagtgctgggattacaggcatcagccactgtgctcagtccgtataatgggaagattttaactgtaatttttttttctcttctctcttaaagctttcttatataatgcttcattgaaggtaactttttccccatgctcacttactttatttatgaaatttcaaattttcactaagttatatatctaggtagtataacttttcattaagatttccacctatcaattcaaatgtttctttagcttatgtgttctgtacttactgatttactactgcttttgtttcatttgttttagaattcaagtacgttgttattgtgtctctagtctctctttttcatatgcatttttaatttgttgtatttactgtgttttgggagatttttcccaagagtcttccctgccactccctcggttcagtactctggtattgagtcttttctggctttgagtatttggttctaactttacttctgtgctttttgtattgttgtccgtaagtccaagtatttccctccttttttatttatccgtgagcagcaacagctgtatccacacctggaatttgtcccaaaacatggtgtaacttgccttgaatccctttcttttctaaccatatactttcagtttccttgctgtgggtactagttattactggctgaccagcatccacttcacctgatttccttttgggaagtggtctctcacccaaggaagtcagctcctcttccttgttgcctagcccagacaagtcagctgtgacctgagctcagttaatcagcatattatttcccagggctttgaatctttagagagcgaagtgagggctgacagatggagggagggaagcagacacagaagaatgtttactggtcattcctcacagcaccttgcatttgcaagactcttcctgtaataagatccctgtgttccctgcagcatgatttctcattttcctccagccctttgttaagcctggacttttagcctgtcttcagttctgtgtgttcaagacagtatccagcatcagtttgtattgcttgcaaaccagaaagctagctgataggaacttacaacgtctccttagttcctctgttggagaattacatcctgcaagattatatgagaatcagggatcagcagttggggaaggtgtcctggttgtaaataggacagagtgagagaagagaggagctggggctatgagaagatctggaaaaggagtgccccatctatgaaaggttttctgtttctttggtgtagctgctgagcctggggctggctttctccctctagctttgtttttgtgtggcctgtaagccaggtaggagatgtgtgtctgaatgtgctgcttcacagagtccagccacctcagaaggaaactgggtctgctgctggctgcttgtggtcaggtgaggccagccatgcttggctctctcccagcatggcttcattaaggagactgcctctgcagcagtcacagtgcatgggcagagagacttctgcagagggggactcacacaagtgccatgagggcgaagagtctgtgattagtatctgtcccaagactcagctttgcctcagcccttggcccttcagtttaggagctgttgaccgaatctctcagaatcttcttatttatgctgggattccatgctgatttttcatgcagggcagttgcaggtcagtacttgaattatttcagttttacttttaccatatctgtcagaaatgctgccaattttatggcctgcggatggcctgtttctcctgactctacctggatgcaaattttcctcccctctctcttttttttattctgttggttatttttcttaggttgaaccatataaaattgccaatatttgactacttttgatatacaaaaatggcaatttcatgcatcagtccaatattacacataaaatatggtaagatattggaggggactgcagattagaatctagtgctcaatctttgtctcactcagatttgtctcactcagattccttctgagtgagaacagcttttttggcattggaaaatattctggaatacaggcttgatcgtgaacagtatcattttgcttgaaggaaaaatggttttatagccagattagtgcagatgaattctgtttctggtcaagatttgctaaagttctctctcttctagctgtaataattcacttttattcacttattacatttgtttttagaactagggtaatagcattcccccccacttacttgaacaaaacattcttagtgttagttgcttaaatgtatgtttttggaggaaaacttaatagatatttaagtttgctcctgttatttaaattctgagcttgtactaagtggcattactaatagatttttttgtgtgacttctagtgtaatgcttatgcagtggcttttctctttttgaagatgagctatggattaaatctgtacctaaatttgcaagctagctgttgcagagcagaacctgttaattccagcagagttccacgtaagctttcattgtccctgaagaataccaattgattgtgggaacttaacagaaacaaaactcaaatgatccttataatctattctagcagtgacttgtttgattcttatcccctcccccagcagcattattattcaactctataagcttttaaaagtgaaaatctagttaactaaagagagatctacgtaaacaacatctatattttctgtttttttgtgtgatctgaaataatttaatcaattataatcatagtacctactggtaatacatatccagtggatttaaaagaagctgccttccattaaataatcagtgtattgttttctatgcttgttttattttgaaaatgactggtggtgtaattttttaaaactttttaggcttcacatttgaatattttttggctaaatgcagttaaatactgcatgatgtttataatacatcaaaatgtgaacccttattgagagtcaggcagctgaaacattagccttagcatttcctttgactagcacacagcatgttacatattcattgttcctctctgggctctgagatattggaacagcttttatattgcatctgctcttgctattgagaccagtgttgagtggagaaacccacgaattattagaacctaagaacagtttatatattcaccaaagtcttgaccagtttctctttgtggatcttttagtgtgaaaaggggctccaaatgtgtgctgagatgaaggtaccatcagttagtatagattttttatcttcaccaaattggtgggtttcattgctttagcaagaatgcaaactctttatttatataatctttgtactatcttcttacaatttttcccctaggtttatatttaagtgaaccttccactgtcttctcaactatctctgcttgcttcttgaaatcagagaaatatttgatgttacatttttaaataagaatccaaacttaactaatgtgcatcttgggttttctaagaaattggactattaatcttcctaaacagactaattcattatacgttttatacaggttggattttatggtatttaactgaaggttgctgtaaaatttatagagcaatgggaagttacagtgtgtcttgtgatattcagagtcatttgcagatttggattgagtttagaatctaaagatatttagcatttcatcaaagcactgaaagcaatgcaccagggtctaaaataactttagttctaatagttgaagcagtggtttacgtttattttagaaagcatatgttctatccctaccttttcaattccagttcgtcttgagtgagacggctatccttccacctctcattcccttcaaccactggcatctatttatgtcatggagacctgtaaaagccatgagggacttctcaggtgctctgcccatcccttggatactttctcaagcctcagagaggatttttttgcagcattgacatcgatcactccattctcctcgaaattctgtcctcttttggctttgaagtgaccttgagctctttcactttcgggtctattctggcactgctgaccattcatttttcatcacctctctgatttcctcttctgcttacttccccaatgttcctgttctcgcctgttggggaacactgcttagttttcttcattttgcatgcttttccacactgttgttttaattaccaggcatttggactacttccagatctaaagatccaacctggacttcttgttctctagttagtggcaatagtaagagataagcactcgtttaattattcagccaatcctgtagcattctcttgagttaaggttctttatcatcttcattctcctgttgaggaatctgaagcagaggtgttaaggaaagtgcctaaggtcacccagctagtaagtgtggaaataggacccaagccaggcagtcttgccccagaaatagtgggcaaataatcttcacctctgtggtgctctgcctttccacctccctttcctgtgacatccagttagtccctaaactctgtgacttctgcctcttcagtgtctccagactctgacccctgcttttcgtctccattgctcttgtctcgtactattgtgaaaacctccaaatggcctttccatttccagctgtgccacttctaagtgtctgccatttcatcaacagagttagttttctaatatgtgagtcccaccatgtttgctttaaaatgctttgtggtgcttcagtctcaaaaggcacaggccactatcctttgcctgacacatactgactttttctgtctgattcctcccgacttgctcatccttatctccagtcacttcctgcttcacactctactcaggcattctgagccacgggtgtcctcagacacatgccgttttgtgcttcttaggaatttgcctgtgttcagcttggatttttatttttttccttttgtgcagtggataatttcagtcttactcatttttaacactcagctgaaatattacctcatctctgaaaccttcccttatttacttctaccattcattcagcaaatatttattgtgttatgctccagaaatgtaggaggtaagcaagactgacctggtcccagccctcagaaaacagcagggaagacatgtaattaaacacagtataataataaagggttttcttctatagaggcaagaagggggtcttggaaggcctcctgaagcaaatgatattcaagcttaaacctgaatgatgactagaactagccagtcaagaagtgggtgtcagagggcagagaaggaattttaggttgtgagaagagaatggtgattatgggccagggattaacaagggcatgtttgaacatctgaaagatgtttattagacagcagcagttggggagggtgggcagcgagggtgtgtgtgtagaagctgggtaaatcttggccatcagggagatacatatcaaaacttctagaagatactgtttccaacccttttagaatggctaaaataaaaaagatgacaacgtcaaaagttggcaagaatgtgtagcaacagaaactcatatgttgcgggtgggaatgcaaaatgggggcgactttctgaaaagcctccaaagagttttccaaacttaaaatatataccatgtgatctgggggctccactcctagcaatttacccaagagaaatgaaaaaatgttcacaaaaagacttgtacagacattttcatacaggctttttcctagtaacttcaaactgcaagcagtttaaatgtccttcagcaggtgatggattaaaaaattgttgtatattcatacaacagaatacctagcagtaaaaaaatgataaattactgaaatacacagtaatatggatgagtctcacaaatgttcagcagaagaagagagacagaagagtaaatattgtttgatttccattttatgaattctgagaggagactcaactgatctattgtgatagaaatggaatgtcagagtgttttttgggggcagggtgagtgggcgagcatggattggaacggggcatgagggaactctctgaattggtggaagtagtctatattattttggatagtgattacagttgtcacaattcatgagactgaaaatatgtgtattgtatattgttatatctcaattaaaatattttagaaaatgtaatacaatataaacatacaatacaataaatacaataatataatacaatacagtaaacataatgatatatgtctctcttgatatggaaagatgctcatggtataatgttaagtaaattaacttggttaaaaactctggctcccataaccctttgtgcatatatatcaaggtagtgagtttttaaattttattctttaacgtctttcacatttttcaacttattttgaatgagtattttatgaataaagtattgtttactatacagtgaaagatttaaagtacatcccctgcttattaaaactttgcagaaattattgaaccatatgagaaatttatttttatttctattaaattaaattaattaattaattttagagacagggtctttgtcactcaggctggagtgcagtggtactatcatagctcactgcaacctcaaactccgggctcaagtgatactctacctcagactcctgagtagctaggatctacaggtgcaggccaccatgcctagccaatttttataattttgtagagataggttttactatatttcacaggctggtcctcaaacccctggcctgaggtgatcctcctgcattggtctcccaaagcacagggattataggtgtgagccactgcacttggtcccaagacatttttaaataaattttcatgactatttttaagctacagttctgttacttttttttgtttgttttgttttgagacagatctttactctgttgcctaggctgagtgcagtattgcagtcttggctcactgccacctctgcctcccaggttcaagcagttctcgtgcctcagcctcccgagtagctgggattacaggcatgtgccgccacacccagctaatttttgtattttttgtggagatggggtttcgccatgttggccaggctggtcttgaactcctgacctcaagtgatctggcagccttggcttcccaaagtgctgagattacagatgtgaaccaccgcgtctggcctcagttttgttagttttcagtgcttaggagacacaggttatagcatttatagttcagaaaaaaatttagtttaatttactttttaatatatgccccaatatatacaaaggatacacaatgaaaagtaaggtactcagccactcctgtctccttgtcattttgctcttttcacaggaggtaactactatgaccaggctcttatttattttatggatgtatgggaaaacatatgcacatgtacataaaggcataggcatatatattatacaatgatagcatgccatgcacattgtgctggttttttttttttttttttgagtgggtctattttttaaattgtaaataagcataacataaaatttactattttaacaatttttaagtgtacagtagcattacaacatttacatcattgtgcagctgttactaccatccatctctagaactttgtcatcaccccaaatgcaaactttgtacctgttgaacagtaattcccgttcctcttgctcctggcaaccactgttctgttttctgtctctacaagtttgactactctattaggtgccttatgtacgtagaatcatataatttttgtccttttctgtctgccttacttcattcagcatagtatcttcaaggctcattcatgttgtagcatgtatcagaatttctttcctttttaaggctacatgatattcccctgtatgtattgaaagtagtgacaaaaaccacaattacttttgcaccaacctaatacataccacagcttatttatccattcatcctttgatggacatttgggtggtttctacgttttggccactgtgaataatgctgctgtgaatatgagtgtgcagatatctgtccaggtcccttctttccatctccagaaatggaactgctggatcacataataattctatgtttaatttttttttaatcactgtcatttaggtgtatttttttggcagagtaaaacatttaaatattttacatagacataaatatgagcatgataagcattgacatgaaaatggcagtaattctgtatgtgtgcttcttgtatttttgttatatttttatgtcatgcttttttgcaaaatacattataaacatttatgaatttcactagttttctgtgatatcgtttttaatggctgaataatgttctgtcactgtatggatgagttaacttgactaatctcttacttttggagatctaggtaattttttaacttttatctttgaaaacatctgtttgtatccatgatctctatttataatctaattttatacaaaggtaacaaagagctggggggagagggtgggtacagcagtttcatttgactgacaatataatcaacatttagctgtatgattttgtcctctttgttgcctaaaacattattctctagggctttccccaaattgttttagaacaagcaagttgacatgctttttctatagggtatactgcctgggaataatgtggaattgcaccaaggaatcaaagggcagtataaggacatgtgtaatacaagattcgtgcataattttttcatcaccatgctgttttccatactactgtaccattttacatcccaccagcaatgcacagatttctagtttcctcacatccttatcaacacttatttgctgttttattattttaagtaataggcatccctaatgggtgttgtaccgtgctttttaaacatgtatcttggagaatcttttagtaaagtctgttatgtgaatgggacttgttatttaactactcccgattttctggcctcttggtaatatatttagtgtatcttttgtctttagtatatataatgctcttattttaaaatacaatattttctgacttattttcagtgagcatggatgaaagtacatatgcattttacagtttgatagttattgccagcagtatgtgagactacttatgtctacatccttaacatcacagtatgttatacaactttttgatcttcttatctgataggtgaaaagtggcatcttaatgaagttttaacttgcatttccttatgagtgagattaaatttcttgtcatttttatgagccagttatttctgaaatatctgcattgtatcttttgccttttttttttttttgcattatcagtacccatttcttacaattttatgctaataggaacaatcagtgttaaatgatgaacaaaactgatgtgattcctgcgctcatggtacttacagcctgttggaatagaaagatagtagacatacaaatatgcaattaaattttgttgtaaatgttatggaagaaaagttagattttctgtaagataacagttcaggctggatttgggtggaatgtggtggccagtaacagcccctaatgaacctgtaagaaccaatgaggcaaatatttgaagggaaaacattccaggcagatagacagcatggacagctagctgaaagaagggcatgtggctggattgcaatgaggaagaaatgatgagagatgactgatttgccctctgttcctcatacactaatctgtatagatatgtgtcaacaatgttcaaaagtatacagtgagtttctcctatcattatataaggggctttaaaacaaatctttttccctgcctactagatattctccaggaaaggaatatgaatcagacaatctgattagcagaatgtctttaggatataagttgattcattgggagcttctgtgtttttgaatttttcatttaaaatttttttaaaatttaagaatgaaatactgtatgtcatcttgtattatttcctgtttctccagatgtgtcattagaaattcagctggttttctcatgtgaaattaatttgtgattctttgaagcttgctaaatgatgcattgtttgctactaagttgtctgtaacaatttccccattagggagaaaagctctttgagtgtgtccttctgtgtgtgaccaaattccaaatgtctgatgattctacataggggaaaaagtgacactcagagaaaatgatttgcagcttgttgtgctttgcagtaaattctgcattttaggtaaaatgcggaatgacagatatgctcagcttagttttgatcagtaattttcttaagctttctgtatcaaatttctcatcattgaaatagaaacatggtggtattttaatgtcttttaccattagttacaagtcaactcagtgtaaaaagtgaaagacaagtattgttaattttgaaaattagttcctggtttcttagtttctggatttgttagataaacatatacctttgtttcccttacttacccaatatcctttcactttggcctttaggtttcatgtttattaggaaatatcatgaagtgtacatgtaaaatagacagagaatgtcttggtagaaattaagcaatagaccctgtggtgtgggcacatcttttttttaaattttaattaaattttaatttaaattctaatgtttttaattaactttctccactaatattcccctgcttgtcagagaaatagttcaattgatacctgttgaacactgtgaatggaaagacttggaagtgcctgtattcattctaagtaaatttttttatagatacgggtatttctcattacttttaaaaaattgttagtcttgaatgtacagctacaatccatcttcatcttatttttatcatcactaacaacagtggctttaagtatggtccttttttaggttaacatagcttttctgttattgcttgtaaatattttttaaagtatttccagacatattgtttctgttaagacttttagtcctaggttttgtagttatcactaaatgatgatggttattgctatgcttctcagtaattaggttgacaattttctttgttttttggggactatttcttgtttttctttcactcatcagatgcttccttaagtgcttatcatgtatgttctagaattcagggcaaatttgtgtccttctgatgtttttgggttttgttgttgttaatggcaagtgtttttgctcaacacagtaaatattttatatcagaccaaatcttcctgcttgtaagaatcttctggtttattatctgtttttctattcttgtggatggattagagggtaataccctaggaaaaacaggcagttcaatgaaataggagtactcactaacctgattattctaccaggtatcatactattacaatatggtccatattaaaataatgttgtctcttttcttccatgggatgttttgttctatcttataaaagaaactatgctaagaggaactaaaagctatgtgctttctggcctactattatgatgtcatttatatatgatatgatatatttgcctatttttgacctagtcatgcaatttttctgaaaaacctgtatgagcatagtattttgaaatatgaatcccttggcttccatgacataatatcttggcattttcttatgagctggttttaagtcactctgattgagtcttaaaaagaaaaaatataactcattctttctccactaaatcaatggctgttttattgtatttttatatttttaattgatgcaaatatttgtacatatttatggggtataggtgatattttgttacatgcatggaatgtgtaatgatcaagtcagggttggggcgtccatcaccttgagtatcatttctaagtgttgggaacatttccagtcctcttttagctgttttgaaacatacagtacattgttgttaactatagtcaccctactctgctgtcgaacattagaacttactccttttatctaactgcatgtttgtacccattaaacaacttctcttaacccctcttcccaatcgctaccctaagtcaaatactcttcccagcctctggtgtctgtccttctactctccacttctgtgagatcaactttttttttttttagctcccaaatatgagtgagaacataggatatttgtctttctgtgcctggcttattttgcttaatagaatgacctccagtttcattcatgttgctacaaatgatatgatttcataggtttttatgactaaatagtattccattgtttatatatataccacattttctttttccattcatctaaatcaacacttaggttgattccgatctttggtgttgtgaatagtgctgcaataaacatgagagtccaaacagtacatccctttggtgtactgatttttttccttggtatacttgagtttttcccagtagtgggatggctggatcataaggtagttctatttttagtttttttttttaaataaatcttcaatgcctattttaataatgtaaatgttttttaaaaatctatttttcaacttcctattctgactcactgatgtgtttatttctaagtcacagttatggtagctttttaatggcttacaccaactggaaggacagattgctctttattactcttctctagactgtttcaggctaaattcagatttattatttttgtcatttaacatttcttatctccatttctcttatattttccttcagcttgatctttgactctccttttgcttgttttttgttaacttctcatcattccctattttctcttttgttaatagttctttgaaacttaactttttaattggccccttttcttaaacttactcttctttttcacttaactccttttggatgtcacactgtcatcaaaaagccctgtccaaatttgtatgcattactacaaagtgacttcctttctcaacgcaattgcactgtttgtgtattaatactaccattccgttagacacctggaattaaaactgtaagtcatatttgcattaatcttttcatctatcttcagtcattttctaattaccattgatactttttcatgtgatgtctcccgtcttcctcctcctccatatttcataattactactaccatgttctagatcatatcatctcatacctagataattgaaacttcattctgactgacctttctctttctattttattttgcaaatatctgtgagcttcttctaatataaaaactgtaggtaaatactaatattaaactgatggccttattcattaattcctcatttatgtaataaatatttgaatgaccattatctgccaagcaagcttctgagtgccggacgtgccaacgtgaacaaaacacattctagtccatgctctcttggagcttacattctaatggtgggtagaggtcgggagggaaagagtggagatctgacaatgaacaaggtaattttggtttctgataaagactgtgatggatagatagaatggggggtacagtgggagtgttagtttagcttgggtgcacatgaagacatctctgagctgagctatgagggcagttgagaccagccagactgggaaagatagggtagaagaaaatagataaatgctggaaaacattttaataagtgggaagtttttcatgcctcctcaaaattaatagacagaatagtctttaacctttaagtacagataagaattcagtctttgatgaaagtagcatcccaggcatcatggaggagaaatggattattaacaaatggagctgggaaaattagttactgtatatactgtaattcttggctggttgactttcttgaagaccattgatgcctgtgggacaggaattatgttgtaaattaaaactaatatagatgaaaaaagttctatcattggagtaaattttttccacttaatttttagttttcttaatctgcagtttttttctctattcaacatcagcgaagagtttatttttgatttatatctgaacttatgtctgaaattttccaaaagatctatttattgatatattgaaataatgaagtcaagtttccgtatttgataattagataataaatctcatactgtcctgacatctcaggctgcgaagcataacgcataaggggcaggtttggtccatagcctctagactgtggctaaatcaggcaatcaccagaaagataagaaaaagaactaattgtatgcataggtctattgacagtaaaggtgggaccggtagccttgaatttagttgtgttcttaaagaagggcgttttttagaaatttccagcttcttcattgtagattcttgatttgggcctttgagaatctgaagtttgattggatattgtgtttctttagacattctaatgagtcatcatattctccatgtgaaattatattagttggtgatccccatggcaacataaatttatttctttaatttttgcagggaatttattatttgattgttttttagaaattacgtccattatccactctgttactggttatatgatcatgcatatgtttgaattacatgttgtgttaatgttgtggcttctatcatatgctttgtaggaaaatagttattcatcctctgtgcctctggtctgcttcaactaaatttggcttgagagttggctgttagctgtaggcatccagtgatgtatgtcctttttaaagctgctttgcttctttctgaaattttaccccattttccaaaccatcttgttgcaggctggcaagtctgtggcacttaagatagatacttgctcaatttttttttcttttttctttttctttttttttttgacacaatgtctcactctgtctcccaggctggagtgcagtggcgtaatcatagctcactgcagcctcaaactcacaggctcaagcaatcctcccacctcagccttccaagtagctgggactacaggcatgcaccaccacacctggctaactttttaattttattttgtaaatatgggatctccttatgttgcccaggctggtctagaattccttacctcaagcaatcctcctgtcttggcttcccagagtgcatgaactacagggctgagccactgtgccagaccttgcttaaattcttgacttttatgcttccttgggcactatttcaaatttttaatagttaatgattttttttttcttctcaggggaaagtatcttctcaaaacaattttattaggattagggatcttgttacctggtatggtattatggcaaaggaatacccaatagacaagtaatgaagctgttagagcctttcactcaataatgaaaaataaactgtatagcctatatttcaactgaatctggggcaaagtactttatgatgttatctgtattcccagagtcatgtggtatttactagctttacccttgttattttttagggtagtttgcatgatcaacttatcagtgtcagaaggactaaagtaaatattgattttttgataaaagtatattgaaataaataatgtgcttaaagtgacagccctccaataaacactcatcaagcatatagtctgtgtaaaacacctttctaggtgctctgcaagattcagaaataaactagatatgggctgggcgtggtggctcacgcctgtaatcccagcactttgggaagctgaggcgggcaaatcacctgaggctgggggttcaagaccagcctgaccaacatggagaaaccacgtctctaccaaaaatacaaaattagccaggcatggtggcgcatgcctgtaatcccggttactcgggaggctgaggcaggagaatcgcttgaacctgggaggcggaggttgcagtgagccgagattgcaccattgcacttcagcctgggcaacaagagtgaaactctgtctcaaataaataaataaataaaccaaccagatgtggcttttgacattaagaatctttgaggctgtatgggagtttatacccatgtggaaggaacctccagaatgacctgcgtggcttttcctgcagaagggcaggggttacctgagacaccgggtgctatcatgaggtcttgaagttgaaattcattcactggtttaaacacattttttgacaactagtatacatactggttatatttaaaggctgttcttaatgtttatgcttgtttagtttttcatttgaacttttcttaacatttattaatgtagactcttgttattttctctctagtttaatagaaaatggtcagcttgaaattgtgacaggtggctgggttatgcctgatgaagctactccacattattttgccttaattgatcaactaattgaaggacatcagtggctggaaaataatataggtatgtattggtatattctttatttgggctattttggacagttaattttcgggatgtgaagtgaggctctgttcttttttcgagtaactattttccctgttagtcattattgttgaataatttattcttcattaatttatgatatttcttagctcataaactgagttacagagatttactatagtcacttttaggatcatctaccttgtttaatgtattatttatctatatttttattggttttgggattattttaattgtatgttaagacttgatgacaagaggcaaaaacctaattatggtagcttaagttttttttttcagcaaaaaaaggaaagaaagatattcattatgtcactgagtgttccagagatacggtagcttcaggtattgctgtatccagggatccaggggacttaaattatgttgtctgggcactgtatctttgggctctgcttgttttgctgggtttcttcacaaggtgagtaagatggctctaggcagccgagactaatttttccaacctagcaaccaggaattctctttaatactttatctagttggcccaacttgagtcagttccttatgtctgagccagttactgtgtccagaggtataggagttcaaatcactaaggtctagtcattttggtggaaatggtcttgggggaaagggaattgtggagagcagggtcagctgcacctaaaggcatgagaatgggtcctccatatgagtggcctcatggaatgggtccagttcaacagaataattctgttgctacaagaaatgggaaaaaagatgctagactgatagaatcagatgtccactataaaaacttgggactaatagaaaactatgtgatatttaatatttgcattttgtaacatggtatgtaaatcctttcaaatattttatatctcagtataataatgtagttttttatgtaagtatatgtgttttttattgaagttatttttagatatttccttattttaaaaaattgtcccttagagataaaattcttaatccctattttttctttactttttattttgagataattgcaaatttgaagaaatgtataagaatactgcaaaatattctcataaacccttcacccagatttaccagttgttaacattttgacacatttacttaattttttctgtttccgtgttgttgtagtggtgctggtatttcttattatcagaaccatttggaagcatgttgcaggtatcatgcccgtgtagaaaatagttagcatagcaggtctgctatctttagaaaggccttgcttgcaagattggcccttggttagtgtctgggaacatggatatcctaacgataagagtggctcactgtttttaatctgtttgtacaaacaaaatagtttgtgctaaacaattgctttccttctgggagtctgaattcttagtatgtgctgaacagagggtgcctacatgaccagcccccaacattggacactgagtctgtaatgagtttcctggtcaacagcacttcacacatactgtcacagtttcgtgctggagcatttaaacacatcctgtatgactccatggggagaggacgcttagaagcttgcacctggtttcctctggacttactctgtatgctttttccttttgcagatttttttttctcatttcactgtaataaattataggtgtgagtacgacaatatgttgagacctgtgatttttcttaacaaatcaccaaacctgaaggtggtcttggggaccctctctacacaatgccctttttcttaaatacttgatatgctaacccaagaatattcacttcataaacctccgttatgaatgttttttatgtttttattgaagtgtaatttacatgcagtggaatatataaatcttaaatgtagaggtcagtgagttttaacaatgtacatacccatttaatctatacatttattacccaaggtctctcatcccctcatctttccacttgcagccaactgctctttgatttctgtcattgtccatgagttttgtttgaagaagaatttattagtatatgaactcacataatattattttgggtcttgtgtcttttgcccagtgtaattttttcttacaactttattgagatatatttcacataaattcatagatttgtgcaaccatcaccacagtctatttttagaacttttttcaacatcccccaaagaaaccttatacccagtagtagtcactccccttcctagcttcacccttccctgccccagtctcaggctatcactagtctttctgtatatatggattggactattctggacatttcacatagatggaagcatgtaatgtatggcctttggtgattggattcttggcataatattttcaaggctcatcatgtattatagcatatatcagtgcttcattcctttttatagctgaataatattctgttgtatggatataccagatttgtttatcccttattcagttgatgggcacttaggttgtattttgcttttggctgctgtgaataatgctgttatacacatttgtttaaaagtttttgtgtgactctacctttcttcctaggagtagaattgctgagttatatggtaaaaatgtttagcattttgagaaactgtcaaacttttccaaaagagcggtatcgttctaccttcccaccagcaatgtgtgaggtttctattttctccgtatcttcaccaacatttgttactgtctctcttttttattgtagtcattctaatatgtgtgaaatggtaatctcattgtgattttgatttgcattttcctaaagactagtggtactaagaatcttttcatgtgtatatcagctgcgtatagatcttttaaggataaatgtctattctaattattttcctatttttcagtagagttatttatctttttattattgacttagaattttttttatatattgtggttaaaagttctttgttggatagtgatttacaaatttattttctcattctgtggttttttcactttcttgaaggtgtcttttagtgcacaagttttaattttgaggaagtttttcttctgttgcttgtgcttttgatgccatagtaagaaactgttgtttaatcctgaattataaagatgtactactgtctttaaactagttttatggttttagctcttacatttatgtcagtgattaaattaactaaatattatatttagttaatattatatagttaatatataatagttaatataactattaatataattgttatattaactaaaatattaatttttagttaatatttgtatatgatgtgaggtagagtttcatatttattttttttgcatgttgatacccagttattccaatgccacttattggaaaagatgattctttcctcactgaattgtcctggcacacttgttaacagttagttaaccataattatgagagtttattcctggactctcagttctgtttccttgacttatatttatgccagtaccgtactgtcttgattactatagcttgtataagcttgacattgggaagtctgagttctgcaacttccgttctttttttaaacttgttttttccatgtgaattttaggccagtttatcaatttctgcaaaaatatcagctagaattttgctagtggttgtattaaatctgtaggtcaatctgggggaatattgccgttttaacaatgtcacatcttctgatatagcaacatgggatggctttccatttaagtagatcatcgttaatttctttcaacagtgttttatagctttcagtgtaaaagtcctgtactttttttgttaaatatgttcctaggcattttgtttgttttactgccattataaatgggattgttttcttaatttcattttaggattattcattgctagtatgtagaaatacaattgatttttgttagtgatcttatatcctgtcaccagcatgaagtttttgggattcattcttgttgtgtatgttggtaatccatttccttttattattaatccagtttcctgttgaacatttgggttgctttcagttttgagctatggtgaatcatactgtgataaacatttgtgcacaggtctttttatgggcatatgttttccttctcttggagtgaaatgtttactagcactagaattgctgggctataggataagtttatgttgcagcttatgtgaactttgaaagagttttccaaagtggtggtgctattttatattccaccaacaacgaattagagttctgattgttccacatttttgccagtgtttgctgtgtgagtcttttttcttagaaccatgctagtgggtatatagtgatatttcactgttattttaacatgcatttctatgatgactaatgatgctgagtatgttttgttgtgcttattggccagtggtataccctattttcaagtttctaagtcttttacccattctttttatttgaattgttgctatatatatatatatatagatagatagatagatagatagatagatagatagatagatactttaagttctgggatacatgtgcagaacatgcaggtttgttacataggtttacaacatgccatagtggtttgctgcacccatcaacctgtcatctatgttaggtatttctcctaatgctatcccttccctagcctcccagcccctgacgcccctgtgtgtcgtgttcccctctctgtgtccatgtgttctcattgttcgactcccacttatgagtgagaacatgcggtgtttggttttctgttcctgtgttagtttgctgagaatgatggtttccagcttcattcatatccctgcaaagacatgaactcatcctttttatggctgcataatattccatggtgtatatgtgccatattttctttatccagtttatcattgatgggcatttgggttggttccaagtctttgctactgtgaatagtgctgcaataaacatacatgtgcatgtgtctttatggttgaatgatttataatcctttgggtatatacccagtaatgggattgctgtgtcaaatggtatttctggttctaggtacttgaggaatcaccacaccgtcttccacaatggttgatttatactcccaccaacaatgtaaaagcattcctatttctccacatcctgtcccgcatctgttgtttcctcactttttaatgatcgcttttctaactggggtgagatggtatctcattgtggttttgatttgtatttctctaatgaccagtgatgatgagctttttttcacgtttgttggctgcataaatgtcttcttttgagaagtgtctgttcatatctttcgcccactttttggtgatatcccctttatcattttttattgtgtctatttgattcttttctcttttattctttattagtcttactagctatactagtaaagggttgttgccttttttaaaatttgtagatattctttgtatgttctaaatatgagcactttgtcacatatatgctatatgaatatttttaccagtttatggttattcgtttgtttttagtggtatctttttcatttctcttaatcatttaataccagtatataagaaaatttttcatatgcatgtgtatatgtgtggtctaaagttgtataaatcctatctttttattataaatattttatataatttcttattagttataaatatgtaataaaatcataaaatgaaaattatctttttaaatacttatagtatttagactatatgtctgtttagtattttattgcatagataacatctcttatagtaatgacatagggtagtggtctttcttgttccagatttttaatagaaattgtttagctgttctgtattaagtatcatattatatagtatttttatggtaggtgctatttatagtgtttagaaaattattttcttcttagtatttttcacttaacagtgaatacgtaatattactggttttcttatagccgtctatcaatactgtatggtttttctcatgtttccgtggatgtgacagcagtttgttcagttaaaaagtcattgacttcctggaataaatcccttttggttttggtactattgaatttaatttatttagtggttttatgattttatatccattttcatgagtaagattagttttcttttttaatgtactacatttgtattttttttattggtttgtgatacttaataaaatgaattaggtagtactgaattcttccttgtattacgtgacagcttatgtacattagaaataatttattgctcagatcctaggcttagaggggtcttttattggaggtagattttttgataatgttaaaaatttctccaaagttattaatatccaatttacatctaaaatgtaaattgtattatttttgttagaaacccagccttcttatcaacattttaattacttggagtataaagtaagaattgtatatagtattctttgttttaaacagtattttattaaataacatgcagtcagtgtgggaaaataggaaaaaataatatactagcagaaagtaaggagaaatccttctgtaccctttagagataacctgttttgtgatatataacattatagcattctggactttttcatatgtatatttaaacacagtataagtttttttccacaaggataggatagtattttaaaacaaatttattagagatagtaaagtgtttaaagctatcttctctacaacttttgtatctatcttctttatagttttctgtagggcatttttatttgactgttagtctgtgttatttattttttaaagagcaggttaaaattttttaagctaaaaggtattttgtgtttcttcatactaccttatctttattttcctctttctttgctccttttgtctgttttttgtttctttttctctcaaggagttggcaacaggtgcatgtgcacacatacatacattttggctcatttgttctttttctacaacgtgaaggtgagtggcagcgaggcctcttgtgagagagcatacccatccatctcactcatcctgtggagtcagcataggcaaactgctgaaatggagttggagctcatttctgcagtccaggcagaggacaatggcaatgtggcagggtcagtctgagaatgtatgttcctcctacctcaaggtgccttggagaagatcagtgctggccttcgatgtgctcaggggatgtacttatgactcttagcatgtgatatgaggtatctcactacttcactctttcctccatcccaaatagtgaacacacttaacaacacttacaacatcataaaactgttcagttttagaggtataattgtcaaaagcacaatgtgaacaaatgcagcttaaagattgaattggctttattaagcaattcatgaacagggcaacatcccatctaaaaaataatattctgatgagcaaagcagagaagactggctttataggcagcaaaaggctgcaaaagcagaaataggaaacaaaaagtaggttggttatttcaaagttacttcccttacagggttacaacagaggagacttcgttatcatgctggctcaagtagaccaggccccttctgattgtggatcagattgcttcaaatctcctggtttttgttgttgttttttaaactggtacatattcaagttcagtttgattatgtggcacctagcacaagtgactgtattctggtttgatgtggtcttttggggtgtactgcagctgctcagcctaatacagtggccttccataaattttatttaacatagacctctatgaatttaattagtaggcttttgagcatcagagtgagactcactacatgttccataaagctgagaaaagccaggttcagggagattttcccttggcccagttactttctttttaaatataaggaacatatctgaggatatgacatttctttgtattgtagctttggctgcatcttatgaattagtgtccttggttttgttttcttttttttttatttttaagttttttttaaaatttattttagtattattattatactttaagttttagggtacatgtgcacaatgtgcaggttagttacatatgtatacatgtgccatgctggtgtgctgcacccatgtagggacatggatgaaattggaaatcatcattctcactaaacttggttttgttttctaaagaatttaggacatgttattttggagactgtttttacatttgattatgggatgcatttttagttgtttaatctttggctattaatgtctgcttttaactttattataaaaattgaccattataactttttttttttttttgagacggagtctcactctatctcccaggctggagcacactggcgccatctcagcttactgcaacctccgcctgctgggttcaagtgaccctcctgcctcagcctccctagtagctaggattacaggtgcttgtcaccgcacctggctaattttgtgtttttaatagagacagggttttaccatgttggtcaggctggtctcgaactcctgacctcaggtgatccacccacctctgcctcccaaagtgctgggattacaggcatgagccaccgtgtccggcctattataacttttttgagcttttaaagttgtcttttgactaccatatccatattacaaatatatttcctgattcctcttaaactatagtattaaatatacttagaataatccagttttattaggtactattcgtattactaatgttctaatttttaaacctattaggtttgccaaaaattgactgatgttaattcttcttaatgttttccatactttgttcttgtattttgaacagtttttacttttatacttttacttttgataatcttgttcttgcatgaaggcatgaaatctttttgatgagctttccagttttattagcaaatgtgccctctttataaaattttggatttttcttatattgtactttttcctaagtttgccccttaccctccttttaaaaagtattgccaagaaaaaccctagcaggacactaggttcctttttaagtctatccctagttctccactcctttcatatcaaagttttaaaaaatatagtttacactttctcttttctacattatttagtctcagggactctttattccattgcagctaggttgctacccctctggatccaacggttttgatgtggaaaagattaccagtgatgttataattgttaaattgaatggacactataaactctttgacatcactgcagtgtttgatactgatttttatctttttttgtaagcttattctgtccttgttatttggacaatacatactccttttttaattttataacttaattttgatataatttttaacttataagtggcatcatagtacttgggaaggactcccatgtatcttgtacattgattcatatgtatatttttctgaatcatttgagagtaagttggaggtaccctgtacccttatctctaaatacttcattgcatatttcctaagaaataaggacacttttatacgtaaatataataaagttatcaaatcaggaatgttaacagtgatacagtaggacagtgtagtccacaggctgtattcagattttgtcaattatttcaataatgtcttttataaaagccgcttttccccccacccagtcaagaatggaatccatggtcgtacattgcatttagttgtcatgtctctttagtttccttttatttgaaactgttccttagtctttttttggggatttcttgatctttatatttttgaagagtagatccacttttgtagaagtctctctatttgactttgtcagtttcttgatgatgggattcaagttatttatgtattcttcctatctacctgtttgtctgtctagttacaatatcactgcagtaatgtgatgtcccattgtcctcactgcatcatatcaggaggcatgtgatgtctctgtcctagtactggtaatactgggaacaactagttaaggtttgtctgctaagtttctccactgtgttaaatttttgccctttctaattaatatgtgggagatacattgggaataaatattctatacctcagccatctctcatgtttatgttttagtgtccattgatgattttctaattccttctataattgctagttggcattctactaaagagaagagctttccttcttattttctgtttatttatttatatcagtatgggctcatggttaatattcactgggttataatgcattatttattttcacacctcagttgtcccagatttggccattagaagcctctttggtcttttcctgagttattttaatatgcccccatgatttcttgactgtctctttgctttatgacgcaagaatatattccaggctatcatgtactttcctggcttcagccttggaataagctatttctttcaggtttttttttctttgtaaaatgattggtatgtagaggccaagatgtgagagctaaggtgtggtcattggtactgaggttttattgcatctaggtccttcaagtgcactgagttggaaaatttgtgtatgtttgtgaatatacatacagatacctgtatctatatttttatatttcctcatgaaaaaccataagttagtaccgatatctcctgttgtaatgcaatatcatagggtacattccagtcttccacatttgtagttacttatcttactgtgaaaattctggctcccttgttctcatttgttcaatcttagaatacatgaaagctgccttcagaattgttaaatccgtgctaccacaaaaaccaaagttactaaatagagttcaatatttctttttaatttttggatgtaaattacatatgtgaaatgcacaaatcttatgtggtcagttcttttagttttgacatatgctctttttgagttttgactgtatactcttggtcccctgtagatcctgacttttccttattgtcctttactggctccccatgtctatgttcttctttagtgttgtttacaaagttctagttctctttgttgtcttgtgtgttactttgtgttacacttatttgaatgacagcctctgcaaactagagtcaagatctaatttaactcgtttttgtaactgtggggtctttcatcatcttaggtaaggtgcttaaaaggtgtttgaatgaaaaaaaatacacacagcaatattacttatgtcagtttataagttgtaagtagacactttatttgagaatcccaaataattaaaacatcagatttttataatgctagatgaacaatcttattctaaccagtacatttattatctttttcatttttatttttttacattttatcctctgtgaaattgagatatatctttagtcagtagttcacattattggtgtgagccagctatgagaaatcactggcacctttgtaggtagagtgaaagcaccagcatcataatgacttaagatttaatgaaatatggtatagttattttggcctgttctgccactgtatcataagatgatttggggcttttgtaatgtgtaaaagacagactaaaaaagtccttaatgttggtgttgggaaatgtaagttgaaataggtacgttacttttctttatcatgtaatagttccagagttatccagctccacagatcacaggactgtgatatccttccaggaagggccctggtcctgtttattctctacctctagttaatggcagtggctttataataggtaaaagatgttaatggctaaaagatggcagtatttatttgaactctaactgattaatttcagtgagcatcctctgcctatgtggataggcagtggcacaatcctcccttcatgatatcttgctgggaatacttggcagaggataatgctgggtagatccttggtctgatatctctaggagactatacaatgacaatgagtctgaatgtgttgtgacttctttttatttcatatatcaattaaaaaaattaacacttatcatctttatccacaggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattggggtatgtagggtttgatgaaagttgatcccatttggcctagatactatttcacaagggttatgaactcatgccactgtgggttttgttcactgtcagtcttgaaaaatcaggtggcctaaagatagtcactctcgtaattatttttcccatgtgcctgtgtcaagattcttttaagtaataatgcagatatttatagagcataggagaatctttttatgtttaaagaaagtagataaatataaggagttagtattttgccaataatgctttcacttgcttctgttttagaaagcacgttttatcacaaatttgaacatgcattagaactgatatccagtcatatatcttatattcagccagtgttccttccttctgtctctcgtctctacatcttgtaagaattgctttttaaagccttaatcctgtcctcctaaaacagccctaatgtcaaaataccacctgtcttcacagtgtgttctgtggccacgcaggcattctaaggatatacttgtgcagctctttattaggagagaggagaaaagatctaggcctcttgggaggcctttgcctttctcaacccctatttaattcagaccaccttattttctatttatttatcgagcctttattatgggccatgtattatgttacctctgctttatattcattctcatttaatctttttaatattattctttttttatggtgaagcaatggaggcttagatatgagaagccatttgccaaaagtcatataggtcatgcatagagagcagagatttgaatgtagttctgtgtagttcctgaagcccaggctcctaacctctgtcattgtgttctcagtaaactttcatctgaaagaaatattttgtttataaaacagtgtttgagaaattactgcattacattatacttgttttcttgtgtaatctagaccccttaagtgtttcagaaaaatcatttgtaaatttagaccgtaactttcttatatgtactcctgtttttttcagtaaggaaagcattagctatacagtttcttaattctagaaaattaaacctgtagggagaacaagaacttgtaggggattgcattccatatagtttgatcaaatgctaaggagcatattaatttgaaaaacaaagaatttgaagaagccctacttaaacaattgcccataaatatcagttagtatgaaattattgagtacttttatgtatttcagtattgtgctaggaagaaatgttgaaaacatccttgcttatagggaaattccagtctaatttgataaaatacggatacagccaaatgtagcagataaaattaagtatgcaaattagctgcaaaagagtagcgcataaggagaattagtggggtatggagtatgtccttatccataggagagaagagttttaggacttgtgacaaccttttgtggcgactatatgctcatagcaagcattagtgaccagcatctacagtgtcaccgttgtgaatatgattcagtgaaacagctgacagcactgaagtacatagattttaatagttttaaatttggaaaataacagttaactaaattgataaaactggaatattttaggacttacctgataaatttgaacatgttgctttttaaaaaatgttttcgaattaagttgagcttgttcacgtgttcgagttcttaatgaagcagttattttcacttattaaaaatgtaaatttttttgtctttctgttacgtaagcagtacatactcattgctgaaaattggaaatccatacataaataaagggcgggggctatttaaaagctcaggatcatattcgcaaagatagcttttaactactaggtaggtcctccagtctcacttgttggtaggcttctcacctctccaggccaacatgtgataacattgtagttttaattaaaagtaattctgcatcaggaatcagtgctcattttccatatcttattcgttttgtttttatttttgtttcgctttttgaaaattactttttcttttcctgtgcttctttgttggtgaaaagtcccattgactgactcattcttggtaaacatggggtgagactgtagattctcctgggttgcacatcctctcctcaccataagaggaaattttctccaagagtgaatttctccagtgtttttataagtctatgctccacacttcctttgttcttccatcccttttttactccgttcttctcacccagcctctgcagctaatatcatggtatctctcagtgaattctgttacctgaattgggaacagttacggcaggaactggcagccagggatggacatagttttggatgagccagctgtaacttttacggctgctcagtttgtatccctcctggtcagctggcgctggttcatgctggggctttcctgtctctgctatgcttagatagaagaggtagatagagactgagatgtgtgagtatcttccttcagacaggtggccattaaataccgctggggtatatgtactggaagttaaaggggctgctgatttagcacagagctaaatcagcattactttgtgtaaagtaatgacattttgaatattttttgggaaaacagattttataaatgcaggtttgtgtgttggctctttattttagatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcaggtatgaaaatgcgtatttcataagacaacatcttgaataaagtagccacttagctgctagttgctgaagggttgaacaaatgggctttattagccaacattatccttgtttgaagtattcattcaaaccagatctaaagcaacttaaaaatgccagagccttgactatgccggttatgtgttacattttaatggaaagtgaacaatactagatcaatatacaatggataacctataatacactattattaccatctcctttgccctcattataaaagccttctactgtgtttgattgatttcatatacttttgttgaataaaacttctggtccctattgtacaaattggtaagaaaagcaattcaactgcaaaaacacatttattgaaatggagcacataaagagtgtaattatctgttcccttaataacaatttcaataatagtgaatgcttcccagctctggtgtatacacatctttgcatcattctgatgtttttgacttacagtaaactttaattaggaatatttatacttaaatacatttaaataaaaatcaaaggtatgaatcatttctttagaagaaaattgtgctaatgatggaagcatctcattaaaccaacttacatgtagtttctaatattggtacttttaaagtttaatttcttcacttaaaaattagtagtgtattaaaatgaaacattgtggtgtaatataaaaacactaaactctgctaggaaaataatatagcccattaaataaattaaataaatttatttttgcactattaaatcagtttattttcaaaagagaagtcacttaaaaaaaagtgtgtgaggaagaaggtgaaatgagatctttttaccttcaatgagtccttagaatcacaaagattttctttgtgagcctctcactgtggcagacatgaaggtgttttagcatggcagccttcttaaagtcatggagcccttctatcaaaatgtgactttaatagttatttagaaaaactgcccaaggttagggattgacttgatttcattttcttggttcctacagccatgagaaccactgaggaattctgaacaacctgctttctagctagggttgggttaagtaggcataagagaataagccagtatattgtgtggtggaaggtgtaataaaaaggaagggttgagtgtgggggcaccctggcctgtgtaggtgggcaaatagctgtttatatttacaggtatttacactactctctgctcaggtgaccagggatggggaagttcttaaaagtgaacaagatgtttcagctggggagtcccagtgcattcatagtattgtgagccctttgttctttttttggggggtgctactgagactacctgaggcacattattgaggaaaaaaaggcttttttataatccttttgctatgtcatctaacctttcaacaattgcccctcaggatgataccttgtgctcatttagttccagtggttttgaaagtgatttccaggcacctgggggcatactgttgaatgagtctatataatacttagagattttttctttttaaacttcttggccgggcgcagtggcccatgcctgtaatcctagcactttgggaggccgaggcaggcggattttctgagctcaggagtttgagaccagcctgggcaacatggtaaaaccccatttctatggcggcgtgtgcctgtaatcccagctactcaggaggctgaggtaggagaactaatagaacctgggaggcagagcttgcagtgagccgagatctctccactgcactccagcctgggtgacagagtgagacttcgtctctaaaataaacaaacaaacaaacttcttacaagtattgaaatgttaactctactggttacctcagatccatatatcaccttcgttttgacctgatgatgaattgagatcaaacacaggcattccagctcattggcccctttcaagctccccactttttttgagacaggttctctttctgtcacccaggctgaagtacaatgacacaatagctcactggagcctccatcacctgggctcatgcaattctcccacctcagcctcctgagtaactgggaccacaggtacatgccacaatgctcgactaattgttttaaaaaattttgtagtgacgaggtctccctgtgttgcccaggatggtcttgaactcctggggtcaaatgatcctcctgcctcgccctcccaaagtgctgggattacaggtatgagccaccatgcctagccctgttcaatttgttaacgtcccaaagaaaatgaaatttaaccataatgtacagatggcatcttttgatatgtccagctcagcaggttcttctactttgcaagtaaagaaatatcattctttgtcaagttcatttttggtcaagtactatatattttaagttggctttttctattgaccgtcacgtgatttgatgtttcggggattttatttttcttggttacagttaagttgacatttcttacctggtaaaataaatcaggagcaaattgcatctgtatgttttcaaatgtgatgttgggtcaattgatttgttattggttccatatatttaccatattaccatttaccaattaccattggaccatatatttagtgagtgtcttcttcctgccaggcgttacaggctggttacttggctttcccagtgttgacactttctggacaggcttgagagttaggatagatgtgaagtgttaaaggcatgccattaacgtttgtgatttcttttctttatatgtgctttacacatatgtatacaagatactctatatctaatagtaaacccttttttatgctggctgcctaggaaatctagttggagctcaattatatcttatatctatgatttatatatttgattatttttactcatttttttttggtagccttctttctatgtggtcaatctcattcttcatgtgttttttatcgtaagtaacctaaaagtgttttggcaaatgtggaatgttagtaaattactagtaaagataaagtaatgtgctaatgtcagaaaactaagcattatatgttacataaggacgctgtggttatattttactcaccaaggtattatgttactgctaaaattttatatttgcaaagcaatttcagagattacaaatgtaaaaaggaccatatgagatttaaatttagttaaatgtttataatttttataagatgcttcattctgtcattggtgttctttgagatactttcgtaagtttttatattgtgaattagaatttacttttggatgatccttgaagtgaaaattataaaaatacttgtcgtttaatcactgatttcttaagctttgtctttgtaaatattgtgaactgctttgggttcatccacttgtataatttcattttcacaagccctttgtcttagtttgtattctcagactttcttaaatgatgccctaattcagtgatttccaaaggacattctgcagaatactataatagaatatgaaatacaaaagctattccatcaagctattggttagagtccagagaagtagaaaccaaaataactaattcaactcctaatccttatctgatggtcagtattgaaaaggacactgtgacaaatactcagattattggtggcaggtgacaagtgtgtggatttttttttctttagaagaggaaatatgactctataaaatgttacagattaacatttattcccttttggttttgttcaaagtacacttttttctatgtttaatcagataattttagattagagaaaggaatattaagacaaagcaaacttcaaagtctgtatatgtgggaagtccttattgtcttactagataaatcattttaacacctgggctatctggtattcaatctctgtggctgggctttaggaagtccttggtaccccacttattatatgccaagttggtacatgaccatatttctccaaagataatccattggaaacctatgagtttttccttctgataagaatttatgaatatttttaaaggataatgaaaattagtatgatagttttaaaaaaatctgtctttaaattatactaaccttgcagatagataaaatatacagtttcttttaataaaatgtacttttgaatttggttatttcctttttaatcaattgtcacattcactttttcttagtcaaattcatatttgctgtttttttgtgtttgttttttttgtagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaaggtaaggagaaaatatttatgattccgtatttgaaattgaacctttattattaaatgagactataaacagaaatccttagcttctttgtcctacatcacagtgcttcttagaatatataattcttgtgtaaaatataatccattaggaagaaaattattatatgctatagttccatatctaaagttgtcccgttcctaacactccttgaggattaaagaggaatttacttttatgtgattgaaaatatgtacctaccaagttgtgatatttagtcttcagggacttactgtttttgttgtgcttgttttgttttgttttgtttttttaccaacattgaaagtctgttatttctctctgacagctgcatccttgtgatttagtagcatgactggcagatgcagatgaacatgtcatgaattttgcaaacaaatgtcctatgtccagagaatacactaacatttttttttaagtgagaagacttctaaaattaatcgtttgcctatggttcttactctttttttttttcttatggaaaatttaaaatgtactgtaaagttctgaaaatagcaaaaattgttccccttctccccatatccatggctcagctgcagcattcttcaactcaagaccactcttgtttcagccatgccacactgctgtctcactcctccccataggattatattgaagccaatctcaggtttcatatagtttcacctgtaaatatttcagtatgtatctctaaattataaaagttctgtttaaaaatataacgataataccattatcacacctaaaaaactaacaataatttcatgatacatatctggacagattcaaattttcctcatctcataaaaaacaattcttttaacacatgctttgtttgagtcaaaattcaagcaataatcatatattgcatttgatcaagtttttaattacaaaattgattttttattgatacataattatatatatttatgggacacctatgaattttgatacatgcggagaatgtataatgatcaaatcagggtatttaggatatctaccacttcaaacttttatcatttgtttgtgttgggacaacaggcttttaaagtcttttttttttttttctttttaaatgtgtcttagagactctacataagaagattaattattcagcatgtttattatttcacatattgacatgtaaaagtagaacatctgtgaaaatactatagaaaggaagtgatattactgtttaggaaatttgaaagctgatggtgaactatagtttagtaagaattcaagtttattaaataaacctaagtaatatcaaatagataaataaacctaataaaatatcaagtttattcaggattgttacagctgaatttttatcagattatgaactcggatcctaggggtatgtttaaattatccgtgtattttcctgagagatgatgctcatacatgaatatgtgatcagaggaagggatatatatatgagtatcttatctgtaattacatcttactaggaagtgattttggttcatagaagcatctggtctcctgtctgactgaaaaaattagaccctgattttagtattctacctatttcatcctttgcctactagaacagttttttaaaagtcatttaaaaaattgaagtgccacatacatagaagaagtggacaaaccataagtgtgcatagaattttgcaagtttaaaagtctccatgtaaccatcatccagattaaggcttagaacttttattgtccctcagatctctttccagtcatcaccaactgccgcaaaagcaaccactactttcacatctgtcaccatgattactgttgcctgttcttgaattttatacgatggggaccatacacatgtactttgtgtctggctttttcttttcacattatgtttgcgagagtcatccattctgttgcaggtagcagtagttcattcctttttagtactgtgtagtatctctagtattcattttttgatgaatataccacagtttattcattgtattgttattgggtatttgggattgttcccagtttttgtctatcacaaataagtctgctttgaatattttgtccatgttttggttacttgttatgagtttacatgggtataaaatgggatgtaattttttggccattgagtatgcacatgttcagctttagtatatattgccaaactgttccaaaatagatgcatcaattgtgttgtacaagaggttcagttgttccacaccctttctcagtttgtattgtcaggatttttgttttccatttttatccttttgatagatgggatggttttattttttatttctcctgtggttaatgaggttgagtctcttttcatatgtttattgccatttgagtatcctcttttgtgaagtacctatttaagtcttttgatgattttttaattaaattggggttgtctttttcttactgtttatagctctttggtacattttgaattctatcttttttcatataaaagttatgcaaatgttgtctcctactatgtagcctgcattttcactttctcatgctgtcttttgatgaacagaaatttttaattttaattaatcaaatataactatttttctttatgtttagaacttgttctgtttgaaaaatttttgtttatcatttggttctgaagctacattcttatgaagctatcctctagaagcttaattgtcttgccttcaacatttaggtctataatctatctgaaatggattgctgtgaattgtgtgagggtagggatcaagatacattttggcttatatagatatccagcaccatttattgaaaagaccatactttcttccacagcaccacagtgtcatctttgtcattaatcatgaatgagactgcatttgtgtgtgggtctgtgtctacactctctattcacttttattggtctgtttgactcatctcacactgtcttaattattaacactacagttttataataggttttaatatctgatagtaaaagtcttccagtttgttctccttcccaaaattgcattggttactgttagtcctttgtaattctacataggtgtaggtcatcttttaaatttctaccaaaaaaaaaaaaattgaaggggattttgagtgggattgcattgaatctttggtttgatttgagcacaaataactacaattattgggccatctaatcgatgaacgtggtgtattttgtgtattaatgcaattgatttttgcattttagccttgtatccagtaactttgttaaatttatttattatttttagttatttgtggattctttatggatttcctatatatgagtaatggcatatatatgtcttcctttccaaagctttaaatctttccatctactttcttaccatgtacaatggctgtgtcctctagtataatgttgagtaggcgtggtgaaagcagacataattttctaagagagaaaacattcgttagtcataatgtttgctgtagaattttgtagattccctttatcagattatggaattttccttatattcctcatttacagagtgttttttcatgaccagatactaaattttattattttcttcttctaggacattgctttgtgttaggcctttatgtcttgtgcaatgattgaaccagtaccccaagatgaaaatttggtagagtatagggtccaccttaatgcattttctttctctccaacatttttatcccttaagttctggctgctttagttctttaatgtcttcaaagctttttctttctacagtttatctagttatatctgtttcttgtgggatacttaaagttactttgtctgaactggaagcataaatttaatattttcttttaatgaactggagaacaaaagtaaataactgagttcagatggctgaaaaattgacgtggaatagccaagacagtcattttgccatttgatcatcatttaacaatttttgtaatttttcttatgtgttgtcctgatagaattcttacatttaagattaaagttgttgccttttaatgtaaaaaccatgtgaatatttttatttggttattcttaaaggtgtcctaaatatttactttttatgagctaccaagagactttctagagaaatttactttaaataattactttaaaaaatactctagcacaggtactgagttatttttctacccttaaagattgaattaagtttttgagaaagcctactaggctacttatctaaactgctctgggacattgccaagaaggaagtatttttatcttggctcataccaaaaactaattgaaatattttcaaagggtatactttattgttaatactaattctgtagcatgctatagatttctaaactttgaagttcaaaatggtttttattgtctaaataaaatcctttgttttatgtttgaggaaagtgagactcagaaatatttagatcgtagactattttgtcactcttattatttatactttcctgagctcatctgtatctgctggatatgaagttaatgccatatttccttctattcgtgactcatttcttttatggttacacacacacacgcgtgcacacacacacacacacaaacacacacagtcttcttcctagtaatgcttgtgagtaataatactcttagtgttagctaaaacatattgagtgcgtattatttgctgtaaattgcttaaagtactttatttaacttatttagttatctgaacattttctggtaggtcctatgattgttcccattgtagatgaggaaattgaggcacaaatagattaacttgcccaagatcactctctgtttggtgaagccaagatacattggctacaccaaattgaatacagttgaaaattgcttatctttaatataaacataaggatttagaaataatcatctattttgctgtaaaaatatattgcaccacaactagattacagtcacttatatttgccttatcagtatcattgttgtaaatgttccagtcgcaattttgtctttgcagtgaataagtgatagctaaatttataccattattggccagtcatggttgtaagtttttttttgtttgtttttgagatggagtctcgctctgtcacccaggctggaatgcagtggcgtgatctctgctcactgcaaggtcggcctcctgggttcacgccattctcctgcctcagcctcccgagtagctgggactacaggtgcctgccaccacacccagctaatttttttttgtatttttagtagagacggggtttactgtgttagccaggatggtctccatctcctgacctcatgatccacccgcctcagcttcccaaagtgctaggattacaggcgtgagccaccacacccggccagttgtaagcttttttcttagagccctattcactgtaacgtggatagacagagaagttatgtaatatgctcaaaacacatgtcagataagtggtagagatggaattcaaagctatgctattgctaccttgaatcaaaatgacttgcaatatctgtgtgtgtgtgtgtgtgtgtgtgtgtgtgtgtgtgtgtatgtgtgtaggaaacaacaaaatccgcatctttcttttaaaaggaacacattccctgttaaataatctgtttatttttgacaggactgccttttaatatctgtttacaagatttggtatcgtgtttctttttgtctttgatttgtagaatagtttgaactcataaaaacgaatttcttactgctgatttaaatcattagtcagaaagaccggtgtgtttaagcagccagacttgccattcttagcactccttggatttaacttctactcagtgttacctactggtagagtaagttcatttttttaaaatgacctgctgttcttaaagtcccttctccttcacaagaactcaactgggggaaaacggagatagaggagggtatgatatatgaaataccttatggctaacagaattattcttctagactttatggctaataaaactgttattgtagacttctggaacactttaatatgtcttttatttttgctgctgccctcatctttcatttatgtggattaatccatgcccaaatcattgtacactttgaaattctagagatatgtaggagttttcatattcactgatttgtagatctaaatagctctccttttaactgctgaagtgtataagttttcccttagtttaatttgggccttaatgtaagtaaaaaaaaagtcactattattttcttccctgcttctgatttttataaaatctgagctatgtattcatcttaacttggaaacacatgttaaatatttattattaactttccctaacagtgtaagaagtaaataattttaagatagaatgaataattgaagtgcatttttttaaaactagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaaggtacttttacctttctatagctacatgtattttttcactttatattatcataatctttttgtagagttttacgtaatatacatcattcatgtagtacattatgtagtgttaagctctaattaagcacttagtgtaattgtgaaattttaatgcaatcagaaatacgtctccaaactacaatcaaattattacatgggtttttgttctggaagaaaaaatagtttatttaaattagatttttaaggagttgtattctacattttgtatttttctaattaatttacctgtgttatttgcacaccatattaatattcagtgacaccatcatgagtgtctgcaggctggtaatctgataggcttctcattggaaacataggtgagcatcaaagaaggaaatagggcctcccagcagccaaacgtgagcttcaaagttcacagtccaaaactaatgtattttgtatgtgggagaactttagactaggcttcatctcagttcttacatacttatttgaagcacatttctataggcacagtcatctgcatagaagaacaacatttgaaaaaatgatgactgatgggtcagatagtgattgaaaatgtaaatggatacagagaagacagaaaagtctgtagaagacataaaaacactaaactgacactatccaggagaactttcaatcactgatagaatgttctatagtgataggttctatttctgcactgtccaaaatatagtcattaggtacatgtgactattgagcacttgaaatgtgcccatttaattttaattaatttaaatgtcaatagccatgtgtggctatggctaccatattggagagcatggtcctaagtaactaacggaggctggttgttgataaagttaaaactactccagaggctcccaaagttttctctatgtatagaccagtaaagtaattcattttcatgatgaatcttgatgtttgagttagattgtacttaccgtcttttatatactagtggacattggttacattttggaaaggctttttattaaaaattatgaatttaagagttgtatttttatatggtagttttttattgttaatattgtgctgctattaaatactatttcaaaagcctaaccttttactgttactcgtaatatgccagaaaaatgtctcattttaaaaaattattttcattattatagatacatattagttgtacatatttatggagtacatgtgatattttgatataagcatacagtatataatcaaatcgtaatttgtatattcatcatttatgtgtttcaaaataactaaaagtagaattggaatgtttcttacaaagaaataactgcttgaggtaatggaatatatcttattaaatttaaaataatgtttacatattatagtgactatccattcttaccctacagaatatcaaccagttatctcttatactattctaaacttttctgttataaagtgggttatattctcaataatgtagagatcgttttggaccactgaattagtgatttttaagtgccaaaaagaatattggtttatcttaatttattgaacatattcaaggcattgtggttactgctagtaatatatttggaaaatcctgctgcattaaaacaaaccaaaaaaccatacaatagttatgactttccaaatgtatttatttatacataagtttgtctgaaaatagtaatatttcatctctctgctcatttgcaaaatgtggataaaatataaaagtatagggaagacaatatttcccaaatcttctttttaacattttagggtgtctggatatgcatatgtactccttttaaaaccaggaatatttgccatggatatacgttaacatagatacacaatttagttaattcaagcttagtgattgttacttcatgatttttggaaggattagaatttaaaagtggagattgtttactctcctttgattatttctacagtttagagaaatgcatcattttacaaacaaagtatttctagtgtctcctcttttctgaatcttgataacattttcaagttgccttgattctgtctgcattgtccttaaaacatgtttcgtgtatagaaccttcttatactttttacttcatcaagccatgtctccttttaaataagtttttaagaaaaacttatcttgagccatatcctctgatgaaaaaacataaaaggtggaaattatagcccccatgttcttcttagactgaaggttttttcctttaaaatatactacaaaggacattttttttttaagagacagagtcttgctctgttgcccaggctggagtgtagtagtgtgatcctagttcactgcggcctcaaactcttgggctcaagtgatcctcccacctcagcctcctgagtagttaggactataggtgcatgtcactacacctggctaagatagagtctctctatgttgtccaggctggtcttgaactcctgggttcaagtgattttcctgccttggtctcccaagatgctaggattacaggcataagccaccatgcccagccgacatactgtttatcatctttcagtttgtattgttaaattctctgtatttgttatatgttatcattcaaaactgaaactaaccctttcccctgaactattcttgggccattattttctgcctctcctctcctctgagtgtcccgctcaccgaccatgcctttctttctcatttctcttaatgtgtatatgtgagagtaaatgatattctggtgatgttcatggtctatgtgtgtgttgctcttggagagaagaaaggacagagaaatttatccaatttttcagatttttttcactgtgctattcataaataagcctgtcttgctgccaacaggttctggcttctttttcaggatcatctagaacaaggactcctgataccagtgtagacatggtattctttgatgattgagaacgtaaatgtgttatacgggatacattggttgttttatatgaactattattaccaatatctttttcataaattgcttgtactgcaattatggattaaaaaatttgtaaagtatcaatgtcacaagttttagattataagctaaagtgtttgttttaaaataaaaatatgacttttatgcaattagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccaggtaatctaattatagaaaaatcatctttaaaaaaatcattaaaattatgggtaataagattatatcttttggtgaagttgttagtgtatatcaaaccacattaacaatgatatccctcataagtattactgtatcaaaacagcactgatattcaaatattaagaaatctgttgacagagtcccagctgcaccaactttttattgcaatgcatttctgcaaatagggtagtaaaatattattactactgtttaaagctgatcctattttcttctaaataacagtgtggagactggagttatcttcttgaccaaggacttggcatcaaataaaacatagttataatgtagagagataaagattcctacttcattgtatgtcagtttaatctcatcctatttcatatccaattgttcttgtatacttctttttttttttttaagaggcatattgacataataagctgagaagcatagccaggaaggaaaaagacctataaaccttatcatatgtggatgatataagccattgggaatgagaaaggatgacctgggtgttggtatcaaagccatctttaactcattgaagggctctcagatgggcaagggagtagaagctaagttatttctatattaaagactttgaaacaatgagtataggcatggtctgagataacagaggacttggcaaacagagcttcctaataagggggaagaaatcttaccttttgtagtagggagttctctatcctcacgccagcctttggatgaccattcattcattaggatcagtgcagggggcattcctagattggggaaggagttttgactattttatttactgtagtttagactattcttcctgatactgtttatcagcagtgttgtgctttgataacattttaaagtcatttaaaatatactgtgattttcttaaagaatagattttaaaagtgaatatccttagtactactccttgatgagaaaagcgtatacaacacataaaatcaatgttaaaaaattgactcacgacttatattactaattgtagtaaatgttaattaaatttttagttacaatattttgactggctttctagaaattgggggaaaaagatattcttgggttttcattagttgatttcagtccttaaaaaatgcattcaaagtagtatcttgaatatcttctccattttttaatggcaaatatatatgacacccacctgtcgaggttgatctggggttaaagtagaaaaccctcattagatgataaagatggtatttctcccacagaaaccatttttgaaagtaaggtcagatcctccttttttccttcttacctgctcctggcctgcttggtttgttgagagtttaaaagtgagactgcttagaatcagaccagggtagagctcctaagaggacatagaaaagtcattttcctacaccgcccacttgctatctctggctgtcatatcgaaagagatttgcttataggtcattgagctttggctacagaagattttttgtatcttgacctgtctggaagagctatcattggttcctccatatgttttgtgttgcttttagcttataaaaacttccccgtgtagaattgcgtgttagagaaaaaaaggtagtaagtctcaaactgtacttggcatttgtaaatttgctatgttagtacttcacagttcattgaaaagtcataaacaattaccaagtcattagcacagacattttaaggaggaaatttcaaaacataagttagagaattattaacaaagaggtagttagtattgggtgttctcttgaacttggactgatgactactattcattcaaatttggcagaaatatcactgtgaacaagtttatgaattaggggtgcatttggctgcgagtaatagcaaccagaaacagaataaatcctgtcctgcttatttttatgtcatatgaaaaaaatctgtagacaactggttctggtatggcagctctgcagtgtcatcaggcattcaggcccttctttctcctctgccatagtagggggaatctgagagcatgctgtcaacaatagatcgaatgtgtatatagttacaaactggaaagcaagaatacatcatggcatatttggagattaattctaatcatggcatgaaaaaaatgaattagattgggacaatgtttgtaatagtcagcttaaaagtattaatagataatgtggcttatgtagaagggaagaagaaatggtaatgaggtcatttagagaaatgttttagaattccgctaattattcctaacttgtaattaaggtaggtgggagaaaacggaacacagggtgagcgtgagggtcctaaaatgtagacaaactatatagtggcagacatgctaacatctccttaatacaacaaccataacagcaaactaagaaactgtgattcccaagtgatttttcccgaaccgtattccgtattaataggataagtgtatgtttggaaattagaggccctgaaaaaaatcctgtattaatgaaatgttgaaacgtttagaattttgttttacccaatgtttcccaaatgtactgtgtttcattttgttttgttttaagcaaagcagctctatacatcctgagaaaacatttggggagtgatatactgtagtctttagtactcatcttatgagaaggctgcatgtgtgcctttaggatgcagacattgatcctggctttcactcagtttaattaggactctttaatacatctggttttaggtggtggagaacatgactttcactctgcagattcaggctgcctaataaagatagccctgtagacaatagaaaggaacttagattgagggtcttgctgtcataactgaaccatattcgtatggtgttttagtatggtgaaaacacttaatgctgtctaggaaaacatttgaatatgttgggaagtttagttagattatggcatgaactcaaatccataagattttagcattaaaattatagatttgccatgtaaatgtatttaattaataacattgatcatgatcacttacatctctgaaggaaatattaatgctctgcaaaaaagaagttaacttcttttataggttttcttgttgttgttgcatgacaacaaaaatgtcttcaaggcatagatccaaagttgctttctgtattggaaaaaataatataattgaaaacgtgattagcgaggagtttctacgtacttctccaatatgaatttgcctatggatgcctggtctgtagagccttcaagaaacgtaactgaattaggaaaaaaaaaaaaaaatcttcaagcaagttctttttccatgagtaatgcttcagcagtagcggatgtatttcagaattggtctggaatcagtagacttttgattccttagacataaaaatacaatttgaatatagttagtaatttcagtgaccaaaaaatttaacagggataaagacaatttcattattcacatctgtcaaaaactcttgttctggttctcttgaacaagaacatgaaactaaattaaacaaaacatctattttaattcttggggtatgacttgtatacgaattgaattttcttgtgagctgaattatctcatgtttttattcattgttaaaacccttgttagagctttttctaaagtagcaaatcattgtttttttgatagaatgcttcaaagttattggggtgatcctactggatattattatttggtgcgatattcatagaaagtatacatagtttgattatgtttatgtgtttcaggtgtgtccagaaagctttcggttttaaatggattcttgtcagttatatcttctgatgtacttagttctaggggaaaaaagagcaggtttgtcatagattcattataggtttcactttgaatacaagatgaagatactggtggtttggctattagtaatgaaactgaaaatattgtatgcagatttttaaattgtttctcagactaataaaatttttgatttacagactttttcattcgttaatggttttggagaagataattggaaattctgcatttcttcttattttgaaggacaaactcacatacgactcttactctcctgataccttcctggagatggttagtaatttcatctatggtcatcataaaaatgtgtaattccattgttcttgcattagcaaagaggatgagaagcttaatgaaaaaagacattgaaatataattttttgtacattatttgaaagaatttttatcacttaatataaattacctgtatgttcatcttttctataaatatttcaaagtatgtgaaatatgtagggttttagaatactattaagatgttagtaaggcaactggggcattataactagttgttttgcttggctttaattagaaaccccttgatatttaactttttataagtccttaatctgttcctcctaaacttgaatttgaatggtcttctggtttcaggatgagtccatggagtgttaagtaaaattaaaaaattactgttcatttttataggatttgaaacaaaaatcacaagattctctgccacaaaaaaatataataaggctgagtgcggagccaaggtaaattcataatttcttacaaatgtttaccactttctggcttaatagtttttggttttatggttctggtttttagttagcgtatattttgaggcaatcaatttattaattaaaaaactcctaaaaaatggattttctttcatgactgtgttatgctcagtgccaatagctaacacagtgcttagtatattgactgctgaataaattattataacaatatttctcacagatataaggtatagcatgataaatatatagcttataaaacattttcttatctctataaaattttcagattatatcctttcttgattaacctttcatttaactaccttgttttcattaatccctgatcctatttttatatgaaagaagaaactttattattattggaagatcaaggtttctactgtaaattgtttattagataactgtcattttgctggtgaaacagccttgttttagcactattgatttatgctaaagtaaatgggaagggtgttcagtgaccttaaaccagggcatttaattggtggctacctaataattataaagaaatgcattatgttttattggtatttctttaaacagcaaggtatctgtttttaataaccaaatatttgttggtcatttcctagttgacccaggcacacagtggttattttttgtaatataacctttaactgtcagaatcaagatatttagtacctcctcttgccaattataggataaaacaataatttcaaagagtaattcattatttcaactaaatatattttattaaaattatttaaaaataaatggaatgaatgtaaaaagaatttatagttgctagtaaagttgagactttttgttaagcatagactaaagtcttagttgtctaaatttctttagtaagtagagacataaggtgtatacagcttattccttagaacgagataataagtttttttattttagtaatactaatgttctctgtaacacggcagaagccttaggagctttcagattgccaggtcatagttaggatgaaaggataatgacactgaaagaaatatttcttataaaattacaaaatgttttctttgtcttaaaataagttatgttttgatgcatttggggttatatgcctgttccttaaatattgtgttcctagtaaactctggcattagtaaatctatttggctttaggcatagttctctcatctattaacttttctttctttttatattttggtggaggaagatctttgtttttgctggttataagaataatatatgctgatataagtgatttgtgccccatctctgggtgctcttatgctgggtgcagtgaggcagggctggaaccataataggtcagaagaaaagatgttccctttagtttatctccttccttcactgtctttgccttagcaaacaataattgataattttgcctttctaatgccagaagaagaaagttaggaaatgtagtatattaatgaaagagaaaaatatttttaagctttcatattgaggagttttaactacaggtaaacataaatggaatttcgggggctattagtaaaatgattgctttttgatatttctttttaaatagtttttatttaaatagtatagggtttatcttcctattacttctttacagttctttttttatcaaatattgacttcctatttctgtaggttggtaaattaggaatacttctgattggcagattcttatttgtttttatgcttattatccattttataggttagggcttcttagattttaggttttaaaatctctattttacttgttagctgcaaattattttagttactgatctgtcagtaaaaatagatgaacaatgaaggaatgatagtggcctttaaaatggaagaatttgattgttttatttagcaggtactgaaagtaaaataattgcccttttcagtttttaaattggaagccttagaggtgtggctgtgagtctttgtcatattcttcatgagtcttctttaatgttgtaagggttggctttttttttagttataaacacagttcctgtttgagtaacaaattatctctctaaataaaccatgcattctcgatgggggagatattttttccaagagagtgaaaattggtttttggggatttgaagaaaatcttactctttttaatatataaagcacagatatagtacgtaacaggtaaacagtttgtgtgtggcattaaaattgtatgtgggtgattagtaaatgtctaaaaagagtccttagggaggtgataatgtaaaaaagattgagaaatactaacttaaacccatagaatataaataatacacgtaaatttgatcatgctgttggcaatattagttatagcaataaacctaacataactttgtaagtatttaaaaagtagtccaagatctgtttaaagtgacattagtacatgttgatatgcctaatttagttcacacagttatgtgagctatatcatgtgtggattcgtagtttttgtgtagaaaacagatacttcagaatatcaactaagatataaaaagaaaagccctcccataacgcattgccattggcttgtttaatggttctccctggatgacctcccagcaccaataatttaagttcctctgattttctccatacatgctttccttttggatgccagtcttgattaaaagtattgttatctttttagttatctaggttctgaaatcccagaacctactttgacctctaccttttattattccttaaatttcatcacttggagagtcttttttttctcatctgtgaaatgcatcttctcttttcctgttactttttggttctaagccatacttcgtgcctgaattacttcaacagcttcttacccttttgtcttcaatttcctatgccccttatttattacatgaagttatcagaggaatctagccaaaaacagagctctgagaaagtcacttctaaattcagcattctctaggtacttcttcttacctattgaggaaagtctgacctgatggtcaaatgttttagtagactattgcctaacaaactaatctaaaacttaatgtcttaaatacaatttattatatttcccacgtttttgtagaactgctggtcagttcttgcttggggtctctcataccattgcaggcaattggagattgggactggagttccccaaagatttgactgggctcagtgtgcaggagggctcatatacattgctgaaagttagtgctccctgttggctgagggttcagttggagctgttagctgccagtacttacacatggcctctccatatgacttgggcttctctaaccatagtggctggttccaagggggagtgttttaagattgaaagtctcaaaagtgagttttctgggtagaaacagcaagacttcttaagacctagctttggaagtcctagaaggccattttcattacattctattggtcaaggaagtcattaaggttagccaagattcaaggggagggaattactctccatttcctgatgtgaggagcatgtataggaagcagtgggaatgatggtagtcatcttcggagactagctatcacagttcacctataggctacctcagttcacatacctttcatgtacggagtaacctcacccacctcccaagatgtccaaagtctcatcccattatgctattagccccaaatttctacctagatcaggccaaaatgggtcactcatatggctggcagttaatgctggcttgtttcttccagtataattatttaaagttaatcacagtagattgtaaactccttgagagtaggaattatttctttatttctagcatcatgcctgtggtattatatgcaacatagcaagagtaattacagattcattgaaatacatttaaatattgactgaagagaatattaagcttcagacaccagatatgcatagaagaacatggttcacattctatgtgaaaatgtggtatcctggtatatattctcctcaggtggttctttggtctcatatttggaggttgggtgccagagtgcttctaagtaaactttaagaccgttacaaataaagataaaccataattcaataaagcttggaatttgtataactgtccatttaagattttagttttataccatgagacctgaaaaatttcagattgcatctcagcatcattgcattcttacagagttaacttcgttaagattggatattgggtgaatgttcagaatggatggatataaaagatagttccaaatagctgaatgaattggctttatcagattggtttttatatgtaagacttattgttatgatcaacatagcctgattctacattttgtatttttaatattgttattgtaaacaattcttctggcactaattatctattagtttaatgggattcaaggctagcttttttcttttcttatgttatcaatatatttttataccaagtaagaatgtgtcttagaaaatatctaatatctctaccagttgtttacacataagttttaaatgaagaagccaaactcgcaaccttatttttattgtttggaaatggaatttctaggaaaatagaattctgaccactcagattgtggcagcattatttgatagaggcatttggagcttaacggcggaagtgagattccatgacttgaaccaaggcggctctagtctgagaagtgagtctggtgaaagagctgttagtgtacagagggagcgcactttgtgctcaactgtggaggagatggaagtgttagctgcgataattagtccaggaactgtccttaatagctcatggattatgatggtttaagcttaaaccttgacacgtactagaaaactagtatatagaaatgtctttccattagttaacagaaaaatgagtgtaaaaagtcagtaagattaaaggttttctttcttgaaactggtcggctatattttttaattatcctaaagaattcaaggcaataatagaatacaggatttgacatcctggaccctctccagcttctgttattttgagaaaagctgagatatttttaccttttaaataaagctgttttgaacttttcttttggtgagggaattagtaactgatggtcctagagactcttaaacacataaaaactaagctattctgtattccagtctagtttagttgtatctaggcattaatagtacagtgtatttatgaattttattggatttgaaggatgagtttataaactgtcctctaggatgcttttctgtttaaatatatattgcttgtaaaaggtatttgtatgttttcacctatgttctgtctctgttatgtgttaactctgatttttttcaaggtataggttggctagttccctgattatccagaagcacttttcatcttgtctgtagtctactggagtgttttcagaaaggatgctttatccaaaagactgaatggaatatgttatattatgtaaataaccaaaagtttcttaaggaattcaaggtacctgcaagatgctacgttagttaattttatgttaaaaattatttgcattgactagtggttggtactagtgttggagcagtcatggcttggtagcaatacaaaataatcttatttggtgtttgccattccaattcagtcatcacaggattacattttgcctaatttttcaagaaaatataaaggtctcttggggaggaaatgaggagaaaaggctccacctttgttccagtccctcccacccttagcatttctatgtattttatgacatcaggaatgatgagtattaattcctgacatactgtttcaacctcacattgactgaaattaaataacatctattatattaaaaaaatagttgacacttccagtttacgtgatggctgactagagaccatgagactgactcttagtttcccattaaagctcatatgaaaatgtagaagatgatgaacagttgtaggaataccaaaaccttggcttgacagtcagtgtattatcacaatctaagatgtccacaaactacaaagctgatagaactggtctgaaaaatgcaattacttgctgattaatgataagcagttagaaataaaagcaacctgcatgtcttttaaagcaagtatggagaatgattccttttccttttcataatgtctacccccaaggctttcaaattctggtattatatcaactagaaaagtgaacaaatatttttctattggaagagtgctacttttgaggctattaggaagttaggtagcttttcttttttttctcttcttcctccctgcctaaggtctctgttgaccatcttcatttaattgaccaagtagatcaactgacactcttcattccttttcagtgcccatggtaatgtggccttgtagctaacaggctgttagctagcaggccaatgtacttccctccctccagtctttcagttgtgtgattatcatgaatcagttatttattcctaaacaagttgttgttatttttttctcataaaccattttattacgctgttgaattacataaaaacccttttttatgaagttgaggactttggaaatattcagcaaaggtgagtcactgataaatgttggcgagatgactgcaaaagatttgggaagaaatcataaaaatatagaagccggctgcactcagattttcttaacatttttgagtttaagttcttgctatactttagagaaacctaagcttggaaccacagaagattatcacatgtttggttatgcagaaaatatgaaaactccaattactggttccatagtcaaaggatttgcatattttgaatatgatacatgtatatatttcatggtaaagtaaaatattaagaataacacatacatatcataatgatcttctactttaacttttattttcagctcaactttaactctttctgttaatagatctattgccagccttgatcacattgatgaaagggcttccactgtgtccatattttgcaatcaatttggagactaaatctgccagaaataaagtaggcaggaacaaggaaacttaacgatagatcattgagctaggaaagtccgctcaaggaaattgctgttggtggtggcatgggcaagaatactgtgatattctttgttgaagaaagaagccttccctttgttcagaatcagagctggtatagaagactgaataccaatcaggcacagccaccttggatattaaaccttttggaaacttgcgatcaggctggatccatgcatgtgagcctattattcacccactctttttctccatcactgaatcctctttacatccttcatgacattattaacaaactggccatgtcatttattccttattgtgtgtctcacttggtagactagcagctccatgagggtagagagcttgtttggttttgcatcccctggcaaatacctggcacacagtaggtgttcaacaaatatttgtcaaataaactaactacgttagagaaggacttcagctaatatcaaaataaaaaggaccaagggtagttttagcaaacacagagtctaggtaaatgtctacttctttgaggataagtgattgaaaggttgtcataggagagctgtgaaaaagctctacagactgattaaaaaatagggtgcagcatgaagactcagaagtgtagcttacttattaaaatgatttattacagagaccagatgaaaatttttttaaaaaaagaggacctggaactctcaaaaagttttgagttataatctctgagaaatatgaaacaaggtgaaacactgaaacaaaaagatgacaaaaaatgaaaatgaaaatatttggaagaggagaggagtgagataaggagagattgttggaggggcaataacagaccatcttcactagtgatgctgaagagtaaagctgacactgaaagagggtatggatgtgaaaaaaaagtccatgagatacttttttaagaatgtagacaaaaggaagacaaatgccaacaatgagaaggaagatgatgatcggtatggaggacaagattccaacaaaagaattaaaaaactttaggaaaaaatacagcagaggcaatgatcaaagatataattgatgaaaagttttctgagctgaaaaggcctccctttatagatgaagagggataagtgctgggtaataaaaatgaaaaaagagccaccccgagtacaccatggtaacttagttcaactaaaaggaaaaaggacatattaaaaaagtgcccaggcagaaagactatattgtataatatagaacaaacgctagactgacttagacaggaagactatgaagttttgaaatcattttatactcaaagttatctttcatatgtgaaggtagtagagagacattttcagatatgaaaacacttataccacaggcacacttcccatatttttaaaaagaaattttaaaaatttcttgatgaggtcagttcagctgactgatagatgaattaaaattagcaattaaaaatgaagaattaaaaaggcattggaaacaattagacgtagtgaaatctaaatcattattgtcaattttattgtcaaactaaaggtagaagtgtccatttagttttgatagaatttaacagcaccatggatctgcagcttcaggttatattaatgcctgaaataggtggagaggcaggagcatataggagatcctaaataatagtttttcttcaagaagatttaaaaaataccaacttctggtgagagtgatatttcgtattccattgccttcacttactatcagtgtactgttaactcctcaaacatctgtctctgctgagaaaagtctcctaagttctagacccactggccaagtggatagctctcttgggatggcccattagcagctccatttcaccgtgtttaaaacggaactcctcttccctgcttgaacctgttctgtggtcccaagctctttcaattttagagtgaccagatatgacagttttttcactattagcctctttcactctcaaaattagtttggacaataaattatggggctaccctgatcatcttgtcttttttactttcaactcgtatccaaacacatgctagaccttttcattctgtgttttgtttgtttgttttgttttgttttgttttgtttttgagatggagtatcgctctgtcgcccaggctggagtgcagtggcacaatctcggcttactgcaagctccgcctcccaggttcacaccattctcctgcctcagcctcctgagtagctgggactacaggcacccgccaccacactgggccaattttttttgttgttgttgtatttttagtagagactgggtttcaccgtgttagtcaggatggtctctatctcctgacctcatgatccgcccacctcagcctccaaaagtgctgggattacaggtgtgagccatcgcacccagcctcattctgttttttaaatgtgtctcaaatttgtcctcttcatcttcaatgctactaccctgcttcagactgctactgtccctccactgggtgatggtaataaccctgtgacagatgtccctgcctcacacatttgttggcggagtttaatacggttatgtgtatgaacttcatagtatgggacctagcgcttagcaggcacttaactaatattagcaatgatgtaacttagctcaaaacccttcttttttccattaccctaaggataaactctagactctttaacgtggcttgtgtgcctgtatttttgtctctcgcatcatctcttgcatcagctcagtctgcactatgtgctccagccccacaatgactctattcagaacacaaaaattcagagaactatcaattcttggacactccattttttgttatattacctctacatctttactacctggggggttaaaaaaaacaaaaaagcaggccaggcgcagtggctcatgcctgtaatcccagcactttgggaggccaaggcgggcagatcacctgaggtcaggagtttgagaccagcctgaccaatatggagaaaccccatctctactaaaaatacaaaattagctgcgcatggtggcgcatgcctggaatcccagctacttgggaggctaaagcaggagaatcacttgaacccatgaggtggaggttgtggtgagccgaggttgcaccatggcactccagcctaggcaacaagagcaaaactccgtctcaaaaaaaaaaaaaagcgaaagaaccaaatcacaacaaaaaatctccaatcttggccgggcatggtgacttaccctataatcccagcactttgggaggccgaggtgggtggatcccctgaggtcaggagtttgagaccagcctggccaacatggtgaaaccctacctctacagaaaatacaaaaattagccgggagtggtagcatgcacctgtaatccctgctacttgggagactgaggcaggagaattgcttgaaccggggaggtggaggttacagtgagtcaagattgcgccactgcactccagccagggcaacagagtgagactgttgtctcaaaaaaaaaaaaaaaaaacaacctcagacttcacctctagatgcacccgaatgtgcacacacacagacatgcacatgcacacatacaccatttgcctgataaatttctgattgtcttttagaactcagcttagatgttacatcttacatcctctggaaacttggttgagatccttgaagctaggtagtgttctcatatgactccatgggactgtgtttacccactaaatgcctgcgtaatagtcctctgaagagacttgctataaacctcttgccggtatgggttggtcttgttcattattccaaaatggtgcctagcaaatctttaaggaaaatgacctactgccagtagcatttgagctaggaattgcactagagggaatctgtcctgcagaaataatcagatatggaggtggagagaactctggaaaaggacgtgcatttcagctttgtttatcatgtgaacaaatattttaaaagacttaaatgtttatcagtaatgaattggtcaaatattctacatgtgtaagttatatagaaagatttttaaaagatgcctaaattagcatttctttttgtaatagagaacatagggctggtaaattctgggattttaacttaagtttttatgaaatttgtgttttcaagttttatggagtaaatgaagatgacttgtttgaattgaagttgtgaatggttgagtgaaatatggaagaagtgcttggtacataggaggtgtttgctaaactaataactaaaaattggaggtggagagagtgaaaattatgagaaaaagtcatgtaatcattaggcaattaaataatttatccatagtgatgaacccttatgggaaaagttttgatttagaatcatctcgcattcattgttttcttctttaaaggtgaagttttttgtacttgttggctttcctttgttacccaatatgacttcttgtatgtatagtgtttcattttgtattgcactgaactgcatacaacagaaaccttattacaatggcttctgaagaaagccttttattattcttatggacaagtttcaaggcaggtagttagggctcatgatgggttccatggtgccgtcaaaagtccaggctgcttttacctgttagctctaccactgttagcctgtggctcttgttcttgtgaactcaggatggttcctgcttctacatacagtacatctgtgtttcgtccagaaagagggatgagcaaaggaggaaggtcatggcagttgggataaactggggactcagtaactttgtcagaatttccacatactggaattctaattacatgtcattgtccagaactgtgccacatgtctgcatctagcatggggaagcaggttttttttgttgttcattttgattttgttttttaagctatgactgttgccatcctaaataaaattggctttctatcaataaaggagaaagagataatggttgttgggtaggaaggagcagcatctgcaaattagattcattaactagatcaaaaagcagctaccagattttctgtcagctactcttccttgcccacttcggctcagggactggagttgtgttctgaatactctaggagcaggtctatactgaataaatcagtaatggttgttagaaatgtctttaaaacatgttctcaagacttatcagttaggaaaatcataccaaacacaatgaaactgaaaaattttctacatattctaaaaccaaaacataattagatgctgcaaaattaaaaatttaaagagataaagaaaagctcataaaataagagcatatatatacaattgagatttgggttatttaaatattaagaaaatagaatatttattcttaaacatttcctgtttatttgtaggactatgtgggcctatgttaaaatatagttccttattctttgattcatacattcattcattcagtgacaaatttactttgtatttctgtcttgggcagcactgtactggtatgtgttcatattttcttgcctctttcatttcttcttgattctttcttgctcagaacctacacaggcaaggtctcttttctaagtgacctgtgatttatactgtactgtgtagactgcccataagacaaaccctcagtgccttacctgaaatcttcaggggtagatgtatgtgagggttcagaattctttttaattttaggaaagtactgtgcatatgtggcatattattgcacagtctcctttgaaatttctgaatgttccgatcaaaaaataaagattctataaagcttcatgtcagttctgtttagatttactaccaaatgagttataaaaaagcttttgattttttcagagctttttggatttcacagtttagagattgtagttctgtagagtattggtttgggcgaattatgaaattgcttaaaataattagcaagcttcctaaaaagatgcattatagcagaaaccattttgattcttctaaatggcattgattgttactatcatccatacttgggtgcctcagcttttctttgttctgattcccatcatttcaaaaatctgttcaaaaatgtctgtctcttaagaaatctttgctagctgagcagtgcttttcacccttttgtaccacattctctaaacatgtaggtatttaggtgttgactttttttttctttgcgagaattcattccttgactttactgagtgttgtagcttcctaattatacttcaagcttccctcatcatctgaattcattttttcaaaagatttatcgttctattcttgcatctcctaaaataatgctttttgcatttcttgcatcaggcagtttaaagtttatgataggctacctaatacaatataattaaatatatatttttactgtcatttagaagttcgaagaaaagtgtttgtcattaggctattaccagtctcacacattgatttttaagtgatatgcagtgtgggatttgccttagtgctttaacagcataggattttaaatcattcttttcttcaatttcacatgaactttaaaagaatcttccttaccaggcccttataatttagtctgctatgattttgttcttaggtacaaaattcttttagattttatttgtgaaagtaattaaacagatagattgcatttaaagttatattttttatttttatttcttgaaaaataaaggcagagtagcttaatgttctgagaccacctgctaaattgcctggttagtctgtgttttaattgattttgtttatattttaagtcaaactttcttaattaactaattgcatggttctagtttattgtcagattattatacagtgaattcagtttgcaaagtgtgttttaattgtgtgttttgtgtggtgagattaaacttattttgcttgtttcttataaataacatcttcatccatcaaggaccataatcagaaaatgcaaatgatggggaggaaaaacaggtgctcatatatatagaattatgatgaggtattttgatatattaaaatatgaaggcagaattgtcatggaaagtaccatgtataatggataaaggattataataatttctagttaagatatttggaaatacataactgtatgtaactgaagaaaaactttgaaaagaagacgaggtggtgtcaaagaatagctggtgttagttttggtgtgtttgctagataatataaattttgaatgattctgttttgctattgctgtagcaccaacacttgaagttgtataaagtactgtgaaaatgttaaagtaaactaaatatctggagtatgagtgatttttaaaaaatgatttctattggggtgggagtaactgatggttacgtgagattacttcagtagcttattgttttcagtttcttgcaaacttagttctctgtccactttccacttcttttcctcccagtgtccatcatgtcttctgaaatagtaacataaagctaattattaacccaaagcagttcagaacatagactaaagtgatgtggcatatttcaaagtcttccactcttctgaactagattttttttccttctaaatgcagattaataaagcgtgcacaacaagaggaacaaggaaaaggattttagtgaaggtatcctgatcctgaaaaagtcagggagggcttcaagcccatcttggacttcagaacacctcacaactttgtggtaaaagaaacattttaaatagagcctttggacttatttatttcatccttattcagagagtagcgctttttttaaaatttttattttttttaggcaagacaattgtatgtgaaatcgcgttacttttcaaactgaaacatagggtttcagatttgttgtaggtacttaatatatactcaaaatattacaggtagttggttggcttgtgtgtttttctttgaaatgtgttcttttatcccttgtgacattgtgtttgcattcactgtgagtgatgttttctctagtgttttgtatctttaatcggttcattgggttgtatagtagggagtctttcctaggaccaatattgtttctaaaaatactttgaaagtagaaagtggtttgtgttttattgttttcatattttttaccagtcatatgatggcttactaatgtgaagagatgtagcactagtaaaaatttgttgttttctcctctattcacctggaaacctcacacaggatagatttcatttgtcaacacagatatagacagtgaatacaaacatctttgccatttctgtccttaacaacaaaacagtcttattttactttgttaactttttaaggtcctttttatttgtgaaaattaggttgtttatgtactatgtgttcttccaaagttacagagttatattcattggagaaatgaattttcttccagtagatgaaaattacattttgattgaacatcattccttatgcagtcacccataaatataatgtcttttgctgtcttttcagaaaatggctacagatgtgatttctgaattgacaaggaaatagaacatcttaatgttttaggtaaaacagatggtatttttgtttgaggcaaaactcagagaaagcaacttaattggtgacaagactcttggggtcagccaaattatatacaatttgtgtttgtttttgttgctttaatatcaaaagttttagaatacttggaatatttattcttttatttgactttactattttctgttgtgtactggaaatagttgtaaaatttttcaatcttttctttacaaaaattgtaagtccacatatttattctgcttcggttacatttatggtcttagaaatgctttttgcattgtgaaaagttcctgaaatttgtagttctacttttgagggttaacattttcatttgtagttttaagttgcatttgcaactacaaattctgtggacattgataccaactctgttctttccatgcctttgagctctaggcagatctcactgtcagatgcctggaatttccggagcacagtgttgtgaagggacccttgcatgagagtcagaggactgattctagccccatctctgtcactaaccagctcatatttttggaacttcagtttcatttgctctctatatttggcgggtattaataggtaatccccgaggtcacatccagttaacatttggttttcttgtctaagtattaatcatttataaagcaatcatttggataaacaccaggaaaggaagttttgaggaagagactactgtggacaataaccaagtgtttccagtaactgggacataagataatctgtcttccaaaatatctccagtattccaaaatgaagacctattatgtagcaaattttctttttaccacctcttacagaaattcagaactgggtagtgaaacaaccgcttgtgttgtcatcatagcaaccaggggaagtagcctaatcctcacctccaggaaaactcctttaccccattcctggcactgcaggtggggaggctttggagtgaaggttctctgctggggtgaatatagagcagtctgataaggctctgttcagagaggcagggggagggtaatgggattctgagtgctctagttgctgcatcagtgcttctagcacgtgcaccctgactgccttacccactgaagggagacagcaggtcaccttccctgtctctgactccctgacggattgagtttgaatcctggctgtaccatttctatggctacataaccatgagtaggatacagaaccattctatgcttctgtaaaataggcttgtaaagtaactgctcagcactgttttaaggctaattaagtgctagctgttggtattattatcatcatagctgctaagattaccataacatctgaaaaactctgctacgagctaagtcatttacttaaatatagcaaaaatattcctttaatacagttttatatttgacttactgctttgtctgttagtattataaacaaacataactgtctgccccagtaatattttctaacatagagctttctagaatatttacttaataatatcatactttccttgccattcttagtttagaaactaaaagtttattagtaatattttgtggaattcttgcatttgaggagaataaggtatttgcagcaatcacttagttgccaacagcaattttaggtactgtggtcatactgttttgtgaaggacaactttatatttgcatttgatcacacatgcagcatgcttgtttaccttccttttgaatcttttccttggacaaatggctctccatgggatgataggctcataatattttgtccatgattttaagaatgatttctcctaaatatagagaaaggtgtgaaataaactttcatatattaggaagatagggtagcatttatgtactactatatccaagtaaaattctaatttttattgctgaaagagtgttctgtaccttagcgttgaatttttttttcttgtaagagcaggccatatttgttacttaaccagctagtagcttccagaaaccatcatttaaaatttttcccttgtgaatacaggagagagggcaaagggctagacccacttcatttaatctttgcttggtcccagttccaaggaccccaagctcttcttgcttgttactctttgcccacctccatcctgttttccaggactcaggattttcttttatatatccttggtggtatgaaactggaagttagtcctcattttcaacaggaatagtgtaacctggtatattagtttcctgttgctgctataataaattaccaacaaacttaattctactaaaaaatacacacaaatttattatcttatagttttgggggtcagaagttcaagaccattttcactggattaacaaaatattggtagggctggttccttctggcggctctgaggggagaatcatttctttgccttttccttttctagagatgacctgcattgcttggcctgtggccccttccttgtatatcccatccacttggttctgttgtcacatagtcttcttctctgttggatcgtccctctaataaggacccttgtaaatacattgggcccacctagacagccccgaatgagctccccataccgtgagctgtaatttaatcacatctgcaaagtcttttctgccatataaggtagcattcataggttatggaattaggacatggacatcttggggtcattatgctccctatcatacctggaaatctgatttttaaatttccagtggaaaaatggatctatctgtcttcacctttcctgcctaagctatcaacttgaagctatctacttcgccgtcctgctttgagccttcaccccttaagttctttctctgcctggcaactagaaataggtattaaaaaggaaaatttgaccatgttaaaccttttccatcaactgcacaaaaagctccaagctccttgtaatgactaaaagacaacccactccccactatgacttgagttttatctacttttctaacttcatataattgcattttagagatgcactttactgtgtagcgtctagtggtagtggcctgtatatcttgaaaataacattatttcccgtatatctgtgtctttattactgaaaaggatttccctgcttcctttgccctttaaaaaatttgtttgtttttgatgttgttattgttctgaatttttctaataaacacgtaacttcctgtagaatagtgtttacatccaaagctattaaaaggatttctagcatattcactgataaccctagaacctagaggaggtaactattaacaacagtttctttttagaattttatatatttttatatttcactgcttattctttgtatataattcagaatattcttttgtatttaataatgcaacaaacattttcttgtatttaaaaaattctttataaatatttaatggctattagtattctagtacgtaagtatacttttaattgttaatgtgttccctcaatttaatattatattgattagctaatataatgttttgaatagtattgtttagatatttacattgcttagctgtggaaatagtttaaatattttttgtttactatatttctgtttttctccttacactaatttttttttttttttttttgagacagagtctcaccctgtcacccaggctggagtgcagtgatacagtctcggctcactgtaacctccacctcctgggttccagtgattcttgtgcctcagcctcctgagtagctgggactacacacacgcaccaccatgctggctaatttttgtatttttagtagagacaggatgtcgccatgtttgccaggctggtctcgaactccttacctcgggtgatctgcctgcctcggcctcccaaagtgctaggattacaggcatgagccaccacatctggcctccttacactaaatttctaaaagtaggaatcattggattgaaagacagactatttctaagttatagttttttctgattataaaattataaatgctagatataagaaatgtataaagtatgaaaaataattataatgctgccacctaacaataagtattgctaatattttggtaagtcatcaagttatttttctcttctttcttgccatcttttatagatgattttaatattcttttagtatttacatagaaaagcatagatgacttattatagtttaattgaaattattacttttgtgtttttttgtgttgtcatttatattttcttatatatttacccctctttgtgctcttcatttttccctgcaatctcatgtttccctctgatattattttctttctgcctgaagacttaacgtttctttcagtacaagtttgctggtaacccatacactcagtttttgtttctctgaaggcatttttatcattttctaaggatatttttgctggatatagatttttaggctggcagtatttttttgtttcctcaccacctcaaatatataattccattttctcctggctttcttaattattttgatatgtcagctgatgatcttattgttgcttctttgaacagtgtaatcttatttttactggctgcttctcagattttgccttttcataggggatttaacatgacacaccaggtgtattttctccgtttggggatcacagagtttttttgtatctgtgggttagtccctttccttagttttgggaaattctcagctattcaggtaattatattgtgctattttctcttttatttccatctacacatatcctatttcacatattagatcttttcactgagttccctgtgtccctaacgttcttttctatattgcatattctttttttcaccacttccatttgtatgttttttattgacttctcttttgctgagttaaatatatttattctgctattgttaaagatatctttggagtttttaactgtaaatatttatccttttagaatttcatttgattattttgtaatgtgttaatttctatggtaaaattctctaccttgtcctctacttgattcatgtttttctctttccttggccatattaattataattttaaagtcatgtcagctaacttcaatatctgggtcatgtatagttctagtttctttttttcttggtgtttagtcacgtggctctgtcttttgtgatgcctcttaatttcatattgagtactagacaattgtgcataaaatttagagagactctagaaaatatcttcttctagatagatgttccaatcaaggactatgttaaattgagactgatttattcaacctgttgttcacctggctttctaagtaatttttcaactaatagcctgcttatattctgtaggccctatcccctggtgggttctggaatgtcatgagatgtctctgctctacttttcagaagctttctgttcaggttttaagcttccctttctgcgcagcctcagtatttggcacttgtcgtaatgaaaaaatcaactgtgtacctgaagcctcccaaagtctccacaaaatgctcttttgatctctttgttccccagtgatttcttccagactttccactaggttttgcatggaactcacagcctctcccttgctgagaattggcatgccccagagtgaaaatgactgcagaaggctggtcacttttctgaagttttttcctctcttcagcagtttttctgttgccctcaggcaaatgattattattttttatctggcttttctagttggctagtagaagtgagagctcttgtttgttgacagctactccatttcccctggaagtggaaacatcatttatttctcaacttcaatttgacaaaaataaagtgctcacctttttttcaaaagagtgtttatatttctgttgatttataagagcactttacaagttttactattttttttttttttagtttttgttctttaatctcatttttaagatagaaaaatttttagttttttgttaccaaatctgtcagccttttacttcattgtatttttcagttatggctagaaagaccttttgtaccacagattatatatttattttttctactaactttgtatcttttttatgtttcaaaatttacatttatctggaatcagtgttgacatattgttttaatgcatctagtaaccatttgtcttgctcatctattattaaggatgtatgtatattatagaattgttttgcccatctcatgatcattttccttccctcacctttcttccaagaaatgaaattcagtgggattttggttggcactgcataagacttacgaatgaattttgggagagttgtgcttttgcattattttagttttcttatttagaaagatatgtctctccattcatttttatgttctactaagtgacattttttcattttctgcgtatattatacattctgctcattttgtataaaattaattttctgttttgattggtctcctgaagattgttaatcttcctaacagccgtgtgtgtgtgtgtgtgtgtgtgtgtgtgtgtgtctgtgtctgtgtgtctgcatgcatacgtatgcatcccatgacatgctattacatacctttgtcttattgcctaccctgttatattgaacttaccagtttgtttctgtgcctctccctcctaaactgtaggtactttgttgactgggattatgtattcatattcataagtttataactacacataccatacagcatctttctctcctttctttgcttgctttttaacttagccataagccatgtggttactttgaatgtgtattctcaccactaccatgttatcagaattcttgtttcaagatatctgtattatcacctgttgttaatttcctttatttagatttatacatgccttacacaaaaaaaggatttatgacagctcattgacctgggtttgttaaatcgttcactgtactacccagtgtgatgatgtgccagggtccttggtcaggataccatgagagtcttgtaagggaaaggagagaagtgaattgttattgagattctttttttgtgcttggtctgagctaggtggttttctaaacattttataatttaacattaacaataatcttgtttcccgattttatagatgaggatattaagtcttggggaagtgaaataacttgtccaaagcctctgaaactctaagtgacatggtggggatttgagtttgaatgtgtctgactcaagagcccaggaatcacacaattgtgatttttgaagatctagtataactcaaaaagacactcttagtttttaaggtcttgaattttttcctgtcaatatggtaagcattatattttaaacctagaaaacaaaatggtatatatcaaaagaacttcaaatctagatattgcaacttctgttaacatgtaaattcatgtttccatattcagaatactgtataaagcttaatgtttttctttaggttatattccactaatgaggctacttagagaagatgaatgcattcttgtttgaaatgatttttttaatatgttgtcattgattaagagtcagacaaaatgagctctaatttttgctttattcttaactttctttgtaatattgaatgtgccatttgccccatctttacaaagggactaattatataatttatattttcgaagaattgaaaagcactttttaaggaattgaaataatcaaaatggaactgctctgataaaactataaagccccacatcagtagatactatttacaagtaataaattctcctagtggtatttttctgcactgatgattcattaactactgaacattattctgtgctaggtacctatagtaagcacatgaaattacagttatttttcatatgccttttggtgtttgcttaactgattttaaagtgcacttataaagaacttgaaaaaatatgtatttttttaatcttcattacacaatcataaaaatatgtaagttgcttttaaaatgtttcctcaaatatcgtttttgcttacttcatgcagtgaggtcatgagatgaactccttagtatatattgcaagtttttttctgttccagtgttccagtatataaattttctttcacaaatataatatacttgaaatgtaaatagcttattgcttatctgagcttcctgaggagagaggctctctggggatattggccttgctaaggagaaagttcttcacatttgaatttggatgcaactaagggaatctccacaggaaacttcagctgtcacaactgtcacaaagatccttatatgcctggcctgtgagtgaagtagttaagaagatgggtgtggaggtgaaattgcattataagccctattgtggcactttttacctgggcctgtcttggcaacattcctgctcttgttgaacctcagtttccttatatgtccagtgagaagaatgaaaggttgccccacaggggttgcccatgcaggtctgaggaccagcccaggcatgcaggatgcactctgaatgaaggtccctctgaccaaggggcatgttccttccactttgtactgcagccagtcctagaaggaagcctgtgtgctcccagtctgttgttcacattttagtgggcactgattagatttacctcaaagagaaaattcagtattccatagttgtcttttttaacatgatatgaattacttctatgaaaggtgaaggaatttttagtatactcatcctcagtagaatcttcaaggacagccacgtttacactgggattcttccataaagtgattcccagtttgataggagcatacagatgttctttcatttttgtccattcgtttttctccagccaaagtagattatcttctgccctctagtttgattggcaggtaacatatgaatgctttttcttcatgaggtgagagtttttccttgtatatggagaactgagataattgctcataaccctgaattatgggggcccaatgtcacagtgagaactaggaggctggacgtgacttggtgacagatgatacgtaagaagctaatgctgatgtggtggaaattggagaagaaaaaagcactgaccttacagctaaaattgaaattaaccctccccattctgaagatataaacataattcttttgttaatgtggatcaaatattgttaattttcagtaagtgagtatgatattatgatatactgaaacctattggtttcattcacaactagagggcctgaaaggactcatgtttggggatattggcagtataacaaatgtttgactaccaaatgtgatgacaatgaaaattaagttatttatgattgtatacttatttccaaaggaaatatctatatatgatcatcctttctctgtactctacttaaaatgtacatagataggagttcgtgtgtcagataaatttgttctgtgatgcacataaaaaacatgctgtgaatctctaatcatgttaaaaattattttcttagtgcaacattatactcattatatactctacacatttagtctttgaatagattcctggcatgataattacataatcattcagtacagtagaaacatcgttatggtcaaatactaattagctactaaaatgaaacaaaatagaacctagttcatagcttattataaaaagtgatttaatagggtgcaaaaccaaatatatggttaaaattattgtttgcattaagtatgagtacttttttttcatagaaggaattagtgttctggatgcttattatctaatttattgcttggacacacattatagtatcacagtcttcatgacctttggctgtagtggagcacccaaagaacatgccagtagggattctaggcttagtgtgcctaggtatgcctcagggctactacagaattaggagattggccaaagttttcaggcaccattttctcaagttctttaaatactagctctgtaagcctctgggaacatgggtttcagtagtaaatcactcatttctggggttctgctttgaacatctttggtacagagaatgagtgatccaccactgtttttcttccccattgcaccttagaaatataggacagtcccattggtaataatgaatcctggccgttgcagttagccaggtgtgtttgtgaatggggaacagtcaggcgaaatgtaatctctggtaggagggctgtgggaggctgcaaatagattgacaaatctctgaggtaagtctgttgagtatacctctcaagagggcatcaccctccctcgccttgagaattgcttctgtgcgtaaaatgggattttatctaagtactaggaggattcgttgctctttgtaaatatgtttgtgactatgtggtttcatctgttcatctcttgtatacatatggaatctcagtgaacataagtaatacaagttaggtcctgttatcctgatgcatactgtaagcctaataggaattagagacattcttaatgtcattatcacctttggtatctcagaatgttgctttaacataaatgcttctgatgaacaatttataagtctagtgtcatggattttgtgttatatcctctttctttttcttcatttttcctgttgtcttttttccctttagttttggcccctgtaggtattcattttatttcttaatgaacactttgtaatgcaattaaagcaaaaatatatagaacacatatacaggatggaagaatactggtaagcttggtgctaccatctatagctacaatgtattgggggagaggtggttgttatccaactattcagtgtgttcctgcggttacaaaattgtataggaaaacaaaaatatttcagatcatgaaaatatgcactagtgaatcagtgagttatattattagtccaacatcctctttgaaatactcttcatttgaagacaatatgatgcaaattgattataaattataaaatcataaaccttgcagaggatgcagatttcatgaagtctgcaatgtgatggtctagaacgtctctgctcacaggcaaagccatgaaagaatgacagtctggcagagttatgctagtaagaaaatcaaggctgttgggtacctcaactgagaattatttgaacatcagaactgggagaggattttaggaaaaataaagtccttaaatattttttcaaatatagtttactaataaaaccatcatgtaaaaattaaatgttatgtgaaggatgtcataatatgctggtataaaatattggaaaaattgtgtcccaaatttcagttcatttatgtttttgttcataccaaaagttgcacgtagttgcaaatattgcctaaacttattttaatagtttgcattttcctttttctacctaatcccaatcaattttttttttcaccattacttactataaacatttggggccctgttacaagtggattcacttcaagtgaccttttttagaatcaactttctttaataataaagtcccattgtatataaaatatatgtgtgaattatgtgattttccatatatagccatacattcttagtggtctaaaatgaatattagatttttaactggaactcattgtgatgaaattgcaaacaaattgtgaattttttttattctgtgagattaggtaggaatcagggtattagttgtatggagctcattcttttaaacagatgaataaaaccgtatttatataagtctttttctggggtacagaaaagctttattacacatctatgaatatcttccatttgtaaagcattaattctttagaaagggcttctgaatcattatttaattaccctttgtactgtgtgatatttgttgtgatgaaattgcctgttctctgaaagttctcacagaatattcctgttaattcttctccatgagttgactctatgactgtccatgaactgaagtattatgaagggtttggaaaaaattagccagatgtagtagcatgcactacacctgctactcccagctactcaggagactgaggtgggaggattgcttgagcccaggaggttgagactgcagtgagctataatctccccactgcactccagcctgggtgacagagtgagacgctatctcaaaaatatatatgtatatgtatatgtatatgtatatctacatgtatatgtatatgtaagaagtaaaaatattttgagatcccaataatgaagcagctgtttttgcaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgaggtatgttgtagccatagaacttaaggaggcattgtaaaacaaacctagccagtatataatttgtgtatgtacagtagcccccatttagccatcatgttggtgtatgtgaggtgatgaaagttgtaaataccagagagtttaactggtgggtcaaatgacactaaaggaaaaatgatcctgtgttccctaaaatgttaatttctttgttagtatatatattgtatcttattatatgttgttcatatgtatattgtatatctttgtaaggatgcatactgtttattctaaggtaatgcagtaattattactcataaaattttgaatgttttgctctaagtgaatttaatgataattatgcatatcgaaagtgagataaataccacccttagtaactttggatagttttaggttttcattgcaaaggtgacataacacaccatggaagagaaatgccctaaaataattaagatgcttcttttgtgagatataattgtggaaaatctgtgctcaagttaataggtattttttgtgccaaagtttcttaaaataagcaatattaaactgatcactgtaccactagaaaggttagacttttaaaatctggaatgtcatttaaacggcatttctggagatacagccataaactaggaactctaagaattgtttctgcttgacagaagctattgctagctacttttattattattattattatttttgagacagaatttcgctcttgttgcccaggctggagtgcaatggcgcgatctcggcgcaccgcaacctctgtctcccgggttcaagtgattctcctgcctcagcctcctgtaactgggattacaggcatgtgccaccacgcctggctaattttgtatttttagtagagagggggtttcaccatgttggttgggctggtctcaaactcctgaccccgtgatccaccttctagctactcttaaatatgcatcatcttttagatagaaaggtaaactataataaaaattttggtcagattttacaggaagctttccatctagaaaatggaacagcaacagctcctggaaagcaggggtcatgtcttaaactgtgtgcatcccccatgctctgttcagtgtctgctgaacctcaagcatttgatggctaatgctaacttgtttaatatttatattatgtttatcatttttattaaccgaaatatcataatattgcaaaaaaaattaataattaggaaatggcattgttgtaaagcccttacattcatggaaaatttccttctctaggcattctagagtacagccaaacaattgagaatgatcatacaggttcacatattggataaaaacattagtgcttttgataggcctaccaactttaggttattaggttctctggataaactgagacatgtatggtttacccataagatatcaaacatttatagaatattgttacacagccatgccttggtatctgtagaggactggtcccaggaccctctggggataacaaaatctatggatgctcaagtcctttatataaaatggcatagtacagatgatccctgacttacaatggctcaacctagatttttcaattttataatagcgtgaaagtaatgtgcattcagtagcaaccgtacttcaagtacccatacaactattctatttttcgctttcagtatagtatataataaattacataagctatttatatttagtataaaatatgatttgtgttaggtgattctgcccaactgtgggctaatttaagtgttctgagtacatgaaaggtagactaggctaagctatgattttggataggttaggtgtattaaacacctttttgacttacgatattttcaaattctaattggacataacccaatcatgagttgaggagcatctgcatttgcatataacctgcacacatcctcttgtgtattttaaatcatctctaaattacttgtaacatctgatacaatgtaaatgctatgtaaatagttattatactatagtttttatttgtattttttgttttttgtttttttttcaaacattttttatctgtaattggttgaaactgtggacatggaacctgtggatatggagggccaactggattctctttttaaaaaatatgatagtttgttggttttaccaaaaatataaatggtttgcctctcagtagataacatttatctttaataaattcccttccctatcttttaaagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaaggtatgttctgaatagttctaaaattcatagaatgcttatcatttttgctacaatgtgtgtagattaattaggcaaaaggggaaaaaagtcttaagtagagctgtatcaaatactcttgagtaaaaggaagcatgagctttttgcaccttcattgaccacttgctgctcacatgtatagtctgtgggtggcgctactccgtggtctgtgtgtcactggtccaccagataagtacagaaattatttttttaaattgtcatatacatagaaccagatgcaacatgcttaacatcttagtggtgagttgcttattattattttttttaatctttagcaaatgatgactaaagaagatggtaaacaccatgaagtaaatgtgcaattttcatggtatggaaccacaattaaaagagacaaaagtggtgcctacctcttcttacctgatggtaatgccaaggtaagtggtactgatgagatgacaaatggaataaacacttattgaaagagtattgaggaaaaagataagtgagtgtcattattttatcatctgttgatttattagggatagatgaacttttggttgcagtattatctatcaccttattgatacttagcaatttgtagtcgaaagttagataaatggttgggcgcagtggctcacacctgtaatcccagcattttgggaggccaaggagggtagattgcttgagctcaggagttcaagaccagcctgggcaacatggcaaaaccccttttctacaaaaaatacaaaaattaggcatggtggcctgcacctacagtcccagttactcaggaaggctgaggtgggaggatggcttgagcccggaaggcagttgcagtgagccaagatcacgccactgcactccagcctgggttgacggagcaagaccccgttagataaatagttttttagagttggaatttgttaagatgctacaatgaacaatgttcagttaggataaacaatgaacatgggaagaaactagattttacgtagagttagggagctttatatgtatgcattttatacagacacaaaacctctagccgtatgggaaaaatagattttccactggaccatttttctccttaactttcagccctttaaaaaacaaatctttctcactcttgactataaaggtagtaatacgcaaactctggcacattttgaaaatgccagaaactaaagaaaacattaaaatttaccaacaggtgcacaatcccatgaaaaccattgccaacatttggatgtatttcttattgtcttttattttatgcatatccttttctccccgttctcaagtcttgacttattgcatgtacatattttgtttttcatttgtgacagtgctcacaatctgatggtatgttttttaaaaatccaattttaatatatactgttgtgtttaagatgttgcttatattctttttctcccgattcttcactaccataacattgtaataagctttctttgtagcattcaaaaagaatgctacaatgcaattctgattaattgctgagaataactttctagaagagtcattttgtatcagtgtctgaagtcttttaaggacttttgctgtgtactgcttatcttccctctagaaagactaggtaaatgttcaatcccaccagcattttttgagattaactctaaaatcccactccaagcactgagaattggccatattacaagctttgcctataatagtaagttagtagaaaaatatttttctgttaagatttttgtggttactagtaaggttgaacgtttttgtaccttcatttatctttcatatttcttttgtgattttcctatttctattctttgactgtttttctgttggtgtgtcctgatgatctctgagcactctatatgtggtaaaattaatccttttccctatatgttgtaaaatttttcttattgtgtcatttagtttgttaattattttattgtatttctcatttatagtggttttaaatttttgtgtagtcatttcttttttttctgtagagtttcttcctttgcttttatacctttataggttttctatacctcaagatcagtgaaatgttatcctaattattgtcttgttagctagggacctatctcctgaaaaagttacttttgttccacaagttatgaaacctgctaactaaaatccaatactggattttaagggattgtgtaggctacagtaaggactctaggttttttgtttgtttttgtttttggttttttttttggctgtttggggtttttctttttttttttttttaagtcagtgaagaattaaagacaaactacaactcatatgaggcattccaggatgggcagtgagtcccaaatatgagctgtttcagtgttttctcattcaccagcttttgtcattggacattttattttgattgactgtatttatacttaaaaaagtagttgtgctatagaatttcatgcgtagataccaataactaatttatttaaaaccattttatctttaaatagctctaatgtcagatagaaagataaaacaattgtcatttttacagagagaaaataaaaaacatcagggaaagaggcagtctagtgcatcagaaaaaggcaagagcccagaactcatcatcccaggttctcatcccctccctcactttctagctatttggtaattaggtacaagaaatttgtaaaccattaagcattttaataactccagaaaattttccctagccaaagaggtaaatttggaagaaaattacacaattctgaaaaaaaaattttttttttttggagacggagtcttgcactttcacccaggctggaatgcagtggcgcgatctcagctcactgcaagctccgcctcctgggttcacgccattttcctgcctcagcctcccgagtagctgggactacaggcacccgccaccaagtctggctaattttttgtctttttagtagagacggggtttcaccatgttagccaggatggtctcgatctcctgaccttgtgatccgcccacctcggcctcccaaagtgctagggttacaaggcgtgagccacggcgcctggccgaaaatcttacactgtttaagtagttcatattgcaagcctaactttctatgctattgttgagctaaggtatctaatactttaaaaatataattactcataaatgttttaaatttgcttccatgtcacataagttatgtgctttattaccattttttaaaatttaaataaaaactaaactagtggtttccaagtagttttttcaagtttgtgaatttatattcagctagttctttcaagtaaaaggacagaatgttttatagtttagtaaaccgagctatgattaaactatgtttctgaatcctgctttcagtttgcttagatgactccctgtagtcatccttgccacctgtcccaaaccctgaacattagggggctgggaccatggttataataattatttacctgggaaaatgtaacttctgtagaatgattgctgtttctaataagtaactatatggacaaatagaaggattttagttagaaatttgtatagctgggaggaatgctttctagaccagtgaagttgtaaacatttttatttcctattttcagcatttttaaaaataaaaaacacgttcagtttttatcacatgcatattttgttaccttgtaagatctggtttacacttaaaattgcaaatatcaggtgatacgtattttctatttttgaaaccataataaacatattcttttaaaagtttggaagccaaaatatttttcttaaatatattattttcttttcagccttatgtttacacaacaccgccctttgtcagagtgacacatggaaggatttattcggaagtgacttgcttttttgaccatgttactcatagagtccgactataccacatacagggtaagaaaataggaatgcagttatgaaacatatgtattatggtttttgaattcttgcttttcttatgccattcttaaattaacagttggtttttgtagatgatgtttttctaaacttgacatttttaatatgatttaaaatatgaaacttaccctttgataataaaaaatggtaaaacgtttcaatccctacatatacatgttcctctgtatatcttctcttaattgttgccatattggtcttgagctcattaactggtaactttatttttaacacctgaaaacaatacagtgttttgattttatgaaatggaaattatattaaatacgactttcagttaatagaccacacacatatatggggcctgcttccttaaatatagcctgtatcactggaatgtaactttaagagaaaaatgttctaagctggttctatttgtttacagctctttacccagtagagtataaaacctagcaattgtttatcatttttagaacagtattgagcagcatctttatgaacccaagtgataggaaataggcttttgatccttttgagaacttaaccctgggcaatggaactgattccatggggtctgagtggagctgtggtttccaaagacttgcacatttaggttggttgatttagaattcattgtttgtagaatggtgtgcttttccaactacagatttaatcctaataaccagggtatttaccatattatcaacactcttagaaaaagacctcataaaaatgccatttaaatttatctttgctgttagctaagttgaacaaattagaaaagaaaaaatactatttccctgaatcttcatacaggtaaaaaataaaggatttcacaaactaaagataaatgtataggtaggcacggtttcctttttaggtattgtgggaaagcaaagggatactatgttcagggaatctcttaaatcacagaagttcaattttctgatttcatagttaaatttaattttgcttttatttaacttttttattaacttcaaatttcattagtatttgctttttgttagaatttcaggtatggacaaactttctcatgcaacttctttaggtaataatatgataggtttttcagaataacccatgattcataggatgaatcaagaagtaaaagttctctggcaggtgggaaaaataatgctagacactaattttgtgtcctaaatgtgacttctgaagttatctgtgatcactttgctacctacaggaaaacctgtagttctgaaataatcttctattgagtttctcaaaacttctggtaagtcagaaactgtttttgatcatctgtttgtactcttgtgtaagccattatttaatacccctgagagctctaagttacatcttcaactttatagcattaccccacagaagatatgctgatctatttttaagtttgctttaaactattgttttttagtggaaaagtttttcctggagtacaacatggcacacactttggcacaaacttgtgtcatcaggtttgatttaccattgtttttcatcagttatatttagagatgggctatgtctcagaggaaatgctgtagcaactcttcctaaaattccaacttctcaatcaggtatatttgcataattgcttttgcttttatttaattatgtcactgtatcttctgggttttccttggattatccaggacctctagttctcacatcatagggcagtttgtgtagactagatggccctgttctgctgctagtggctgtagcttagtgcttgacttggaaattaataggctctgacttgcctatttacttatttgagcaaactacactcatcagaactaaatgcttgtcatttttcctttccccctctcttcctgtttccctctgggcagtgaactgtccagtggctaatagtgttaagcaggagcccgggccactgaggtttgactggctcctggccttccaaaggggctctcaatgtagcccatttctatttgctggtcttgcctctgcctcttttctcttttttattctttagttttctttctttctttccttccttttttttttttttttttttttttttgacagagtctcgctctatcgcccaggctggagtgcagtggagcgatctcggctcactgcagcctctgccccactggttcaaggattctcctgcctcagcttcctaggtagctgggactacaggtgtacaccaccacgcctggctaatttttctatttttagtagggatggggtttcgccatgttggtcaggctggtctcgaactcttgacctcaggtaatccacccgccttgtcttcccaaagtgctggtattataggcatgagccactgcacctggcttgattttcttttttcatgtgtttcctttctagattatttgtcttctcttccttggtgttctcgggcatatgaaaaaaataataaatgatggataaataagtgtaatgcaaacttagagcgcctcactgatgagttttacagtagttgcctggattaaatgagaagccgtcatatataaactggacgtaacctgtaaatcttttttcattctagtccggatcattttttttttcaacatgaaagcagttggtaggaaatagagataccagaatcacctgaaatgctttcttccaaactatataccttcccgtgtttgtatttgagctcctcttaacaaatctccctctgggaaaagataagcccggttgtggagagagtctttccttagtaatcttcatgactcacctgtctctcctgtttttcacataccattgcctgaacactcgggttgtctcaatcctggctgattgtggttttaatgaaatcactaatcaaggcccatgatagatatacgaagtcttcagggtatttggctctatcagcgttcacgctgcctgaaagggtgatcagtcttcagggatctgttatttagtgccaagtcttccttattaagaaatactggaaagttgtttaacattctaaactttggcctcctgtaaatcagacacctggatgattgatcaaaatgcatagacaaaatgtggcttttcattttagatgcaaaggaaacgtcagccaacttccatgctgttgtagattggcttttagctagtattgcataaaataacaaaaaatatttattcttgaatttaatttactaaactagttttggatatatgctacttttgtcccccttaaaccaaccagatgcagttatttgcatgagtattaatgaatagagcctatttgttgttagtaccagattttcaatccaggaagaaatgagggtttggggagagagactattaatgttttatgattacatactgtaattgtattaggttactaaaccagttaattatacaaaagattttgtaatctcagcaacaaggaataaagaaacagaaaatgagttagtattaaagattgtctttgttgggtgtctatttttgttaaaccttacaaatccaatttaaaaactaaactaacgcatacctgacaaaatattcttacatttctcagtctctactttagttgttctttgacccttttctccccaaagtaactattgcccaaattaagcttcaggagaaaacaaaatcaagaacgacaagcaacatttccaaaattatataaactttttggtccttaatgattttgaaacagagttgagaggccgtatagttcaacctacttttgtttttggtttggtatttaacttttgtttctctatctgcattctctccagattctgaaaatgatcagaagtgcagttgaagggctctctctttcttaacatcttttaaactaataaaagaacactctgttttccttttcattatcgttcagacatcgcattcaaaaggtttctaaaaatactaaattagaagaaatcttgtgctcactagccttaaaagctctacaagatcagagcagttcagaatttctaatgaaggcgtggcacggtggctcacacctgtaattccagcactttgggaggccaaggcaggcggatcacaaggtcaggagatcaagaccatcctggctaacaaggtgaaagaaaccccgtctctactaaaaatacaaaaagttagctgggtttggtggcacgtgcctgtaatcccagctattcgggagactgaggcaggagaatcgcttcaacgcaggaggcggaggttgcaatgagccgaaatagcgccactgtactccaacctgggcaacagagcgagactctgtctcaaaaaaaaaaaaaagaaaaaaagaaaaaaaatttctaatgaaatatattgttttgcccatgtcaggtttaataaatccattttatagcacccataatttaatgaaatgcaatttatttcatttgtagaaaataacactcttctgggggaaaagttgagggaggtgggaattaatttttcttgcagtataatcatctttcatttaattgaagctttaaacattaccatataggctgctactttagcttttttggttaatctgtaattagaagatagaatataatacaaacagaagctcctgtatcctcttgtgttttatttaatactgcacctacaaggaaagtacataccttgcaataatataataccaataagtgacattgttaactgtggccttatttgtcttcagagctgtaattattggactttagtgtcctagtttctgatatcaacagctactttgaagaattaggtcactgtgggtaacgagtatgtcgtgtacatttcattggcgcaaggactgtgttctcctaggcaggtgtttgttagcgagttagtatgtatgtgtgtgtaaaccatgttttaacccttaggggaaacatcttaaatgcaatacttctgccctgttttccaccaacatattataaagtattatatgtaatggatcttactcaaagaaaacaagcagcctggaggtaaaatgtaatgaactgacatcaaaaagtatggaaggaaagactttcctttgactgaaatgactgattttcttgcatatttagcaatcgaacagagttgcttagtttttctctgagcaattttgaatatataaacataagtggatttataacctgactcttggcttttagagaatcaaaatgagcttcatctagttaaacatattaggggacttcaaaaagtttgtggacaaatggaattaaaagataaaaattaaaaatataaactatttctcaacataagcttcatcaagttcatgacgcttttgtaagcaatgaatccagctactcagtccatccctaaggaacagagggtcctggaaatttaaccatgtcatttcagtctacttatattattaagtaaaatgagtgcccattaaatatttttttaagattaggaaacaaaaagaagtcaggaggagccaaattagcactgtaagtgactgcctaatgattttccattcaaactgtcacaaaattgcccttgtttaatgagaggaatgagcaggagcattatggtggagaagaactctgatgaaactttcctgggtgtttttctgctaaggctttggctaatgttctcaaaacattctcataacaagcagatattactgttctttgggcctccagaaagtcaacacaccaaatgccttgagcatcccaaaaagctgttgccatgacttttactcttggccagtcttcttttgctttgattggaccatttccacctcttggtagccattgttttgattgtactttgtcttcagaatcatactggtaaagctgtattccatctcctgttacaattcttcaaagaaatgtttcaggatcttgatcccacttatttaaaatttccattgaaagccctgctcttgtctgcagctgatctggacgcaatggttttggcacccattgagtggaaagtttcctcaactttaatttttcagtcagaattgtataagctgctaattgttagttctcttcagttagagcaggagcaaacttaatttttttcttgaaaattggtgtagtcttcgtcttctacattgtcccatcccttcttaaaacaatttatctgttttgtaaagtgctgattttcttggaccattgtctccataaacttttcataaagcatcagtgatttcaccatacttccacctaagcttcaccataaatttgatgtttgttcttgtttaaattttagcataatttatattgctctgataggggctcttatcaaatccaagtctcacccttcttagtgctcaaactagatcctgttcagacatgttacaataagtaagtatgagtttattttgatgaaatccatgcatagttttttcatgatatgcattttccatgaaacttttgaagacccctcttataagggaatcacattgggatttggagatccaaatccttagttttgcctctaagcaaactagaggagtatgggtttgtcctttaatttcttagggactcagtttcttaatctataaaaaaggtagatgttcaattaggtataactgtcaaagagtcttcatacaacttagtttcacataaaatctcttgtgcctgactccctgcttctaaattcatcttctacacttggtcttagccaaaaggccaagaagtgattaaattcatcttctaagaatgcctgaatctggggcttccatccctggagtctgccccacttgtaaacaaggtctcagagcttcactgaagttctttttattttcataaaaagattcatgaagacattaagatggtttgcaatcaatctctcatttttttccatagctatattccatatttagtttgatttaaaagtaaaaagcattaagtaagttatagctaggcaggcttaggtaattaaaacatttttggaatatcataatatgcaattgactgctaaggatttttttccctgttaattggaacttttaaaaattgaaataagtagctatgtgacgaatctgatcattccctacaggcatgaaagagaaggttattttaagggactgcaagcacattctggttacacagattcagaactcagaggttatctttggggctgtttgagagcagctgattgttgaagccataactccttagcaaagaagcatcatcccctacaaaggtgggttgcactgaactcaggtgaagggcacagggatgggggaaacacaggagatatgtaatggctcagagttgagactccagagccagttctcttgtgttttattcccaggcccatcctaggtctgccacttagcagctgtttgaccttgcacaggttactgccaacctggctttggttttatcatcctgaaatgttgacagtagtaaaatcagcttcagaggatgtttggagtattcaccgagtaaatatacaaggaaccttacccatagtgagtgttgtatctacttacaagagtgagtgagccagatgggttagatagtttactattataagacaaagcatggtcattaaggattgggggaattggggaggatttaatgaaggaagtgagtcactgagaggctaggtcttagagaatgtcacatgaaaggcagaaaggaggaaaagaatatcacaatgtgtgaaataaggttgtttagaaccccactataaggatttgaagaactctttgtcccttatatattttttaattgacttgaagtttttctttatacatttaaataattgcaaaggatgttattttggtgtattgtacatggtgacttttaaaaataagcatatccaatgggcagtggtactaaatcatgtgttttttaaaagcctgcactagctttttctttaactgtcggaaacttcacatcattattttctccttataattacattctatttctccacagaatgttatcttaatgtagtatttttgtggttcagagccttgttattggtcagtctttcattacttctctaaaacaaaaatcatgtgtgtgtgtgtgtgtgtgtgtgtgtatttatgtatacagttttaaaagtctgttataaggctctaagtattttatttcttctggattgagatataaaaattattatttgtatgcagttggtcaaaaaacataaatatgttcctattttaataattttattttataaattttaatgaaaacatttttctcagtgggttgtacctttttaattcctaatggataatgtatccattgatgaatgtcactcattgctagaatgatatatgattttattcttaatttttatttatataaatatcagtgcaaaggaaagttgttcacataaataagtagctggtaatggaaggagttttctttttttttttttttttttttttttagtatttattgatcattcttgggtgtttctcggagagggggatttggcagggtcataggacaatagtggagggaaggtcagcagataaacatgtgaacaagggtctctggttttcctaggcagaggaccctgctgccttctgcagtttttgtgtccctgggtacttgagattagggagtggtgatgactcttaacgagcatgctgccttcaagcatctgtttaacaaaccacatcctgcaccgcccttaatccatttaaccctgagtggacacagcacatgtttcagagagcaaggggttgggggtaaggccatagattaacagcatcccaaggcagaagaatttttcttagtacagcacaaaatggagtctcccatgtctacttctttctacacagacacagcaacaatctgatttctctttcctttccccacacgtcccccccttccactcgacaaaaccgccatcgtcatcatggcccgttctcaatgagctgctaggtacacctcccagacagggtggcggccgggcagaggggcccccccacttccctcccggatggggcggctggccgggccggggctgccccccacctccctcccggacggggcggctggctgggtgggggctgtcccccacctcctggagggggcggctgccgggcggaggggctcctcacttcccagacggggcggctgccgggcggaggggctcctcacttctcagatggggcggcagggcagagacgctcctcacctcccagacggggtggcggtcgggcacagacactcctcagttcccagatggggtcacggccgggcagaggcgctcctcacatcccagatggggcggcagggcagaggcgctccccacatctcagacgatgggtggcggggcagaggcgctccccatatctcagacgatgggtggccgggcagagacgctcctcacttcccagaggggatggcggctgggaagagacgctcctcacttcccagactgggcggccgggcagaggggctcctcacatcccagacgatgggcggccaggcagagacgctcctcgcttcccagacagggtggcggccgggcagaggctgcaatctcggcactttgggaggccaaggcaggcggctgggaggtggaggttgtagcgagccgagatcacgccactgcactccagcctgggcaacattgagcactgagtgagcgagactccatctgcaatcccggcacctcaggaggccgaggctagcagatcactcgtggttaggagctggagaccagcccggccaacacggcaaaaccccgtctccaccaaaaaaatccgaaaaccagtcaggcgtggaggcgtgcgcctgcaatcccaggcactcggcaggctgaagcaggagaatcaggcatggaggttgcagtgagccgagatggcagcactacagtccggcctctgctcggcatcagagggagacggtggagagagagggagagggagagggagactgtggggagggggagggggagggggagagggattgaaggagttttcttataggaatatcattcagtactttgaactcctgagttagatgccataagccacagactgatctatcgtcaaacattaattttaatcaattatttttaaagatctactgcctgacaacctgattaggtatgctttcaattttggtgaaagcaagcaattggaaaccatgtgttttgcagaaatatttgttgcttagtcattaaagtccagtcagacaccaatatgttgaactgtttttgttcagtacccactaaagaaggtgagagatatgctgctgcttgttttattttttttataagttgggagaagaaatagagtggtggaaaagaaacatctgtcatggaggcaggtcattatgaggaatcttttcctgcctaaaggtgccttagaaaggagcatgtttgggaaaacaggaagtaggtaagttcagagtaactgccagtgccacagatgtgcagatcaaatatcatgattagttcagccaacttctctcctctgtcctagaccagcccaagcctgggacacggggaaggcaccaaaaaactccggtgttgtgaggtattttattcacctcgtaggggagtgttttagttagaccttatttattttatctattttgaggttaaaactgatgtcggtattatgatccctccaaaacagagcttccaaaaaattctgttgtttcataacattagtactttaaaaaaaaaaccaaaaagcctttcagttttgttttatgtttttcatttattatgtcttcttcaagtatatcatagtttattggtataatctttacccaacatttgcaattcatatgatcaaaatgccatacctttcctattacagatttagtttttgacattttcatgagaattattgaaatgaaaggcataaagtaggtacactagtgcctaactcataagttattggtaagtaatagtagctgtttatctagtagtgttttatgaatggcacaaagcagtatatcatcattttcttaaatttgtgacttggaatgaaatttactaaaatttgtattcatgaaagcagatgttaacattttcacttgtggagaaataatcaatatgaacatttacagacccagaaatcggcagtgactcagacgataaattagatcttataatgaatggtaaattgagtgagtcaacatggaaaaaaagatcatccagtagtgggaattattaccatttttattttggtactttcagatataagtacagttttttttttaaatatggtcacgataatattttctttttagaaacatttagatgttgacttactcagtttgtcattgttgtgagaatttcatataagcatacttatcgaattaagcagtatatgttaattaataaccataagcttgagctttaagctaagttggataaagtttacaaaaacatcactaaagtaagtgcataatagcaaaggtatttttatatttttgatgattaaaatacaaaacaaaatgtttcccatattgaagagggaatattcaaaatcagaagccctagttttttctgatagctattattatcctacttctgcaacaaaatgatgattctgtcatcctctctgctcagacacagattggaggaaaggagatgagagcaacaattagatagataacaaggttccctttgcctgagagccagtatttttaagacactcagacatttctttgaatcttagatgggtgttttggagatttattttatgtgatttgatagctatgttaaatttcagttaaacttttatttgcagacttaaatatgccgcttaggattctcgccatcacttgtctttttcctaggtgaccgtgggccatttgctattgtccctcttgatctaatgagttgtcctaatcacattaggtgccactgataagatactggactttgctgggatatgagtgaggttcttttttgtcgtttttcccaagttgttgcctctcactcctataactggttgagtgtggtgagagtggtgtatggtttatgagtatattccttggaaaagtatactttgcatttcaaaatagctagaataaaatgatctggagaggtggagagggttgagctaactctgagattctgcaattcagggttgaattaggcggcttcagataaattgttgaaggatctgagagagttggtggtacagaggaagtaaaagcctgggattttccaaaggccgtcattagttgttgctcagagctatgactccagggtttccatttgcattttttggagtccttacaccctcatggatgtttcttttacctcatatttcaggcatggcgtgtgtcgggcttgccctccagtttttcttttaataataacaataataataattattgttattattatttttgcgatggagtcccactctgttgccccaggctggagtgcagtggcgcgatcttggcttgctgcaacctctgcctcctaggttcaagtgattctcctgccttagcctctgaagtagctgggattacaggtgcccaccaccacacctggctaatttttgtggggtttttttttagtaaagacagtgtttcgctatgttgggcaggctggtctcaaatcctgacttcacatgatccacccacctcggcctcccaaagtactggaattacaggcatgagccaccgcaccggcatgccctccagtttttctctccccacacgagggagcacgctttttggtttccttagactggtgctaagcaacagttaaaagggtgatgccttttgttttctgttctctctctcctgatccacccagtgggggaaggctctgagaagagcaacatcattttgagagtggtgctaaaaccctgtaagcctgagtgttctgtcctcccaaagctgtgatacggctcagcctcctgacggtgacctacttggttttatttcttcttgctgtctcagaaaatattctaaagatgcttaatattattttacaaatacaggtataaataatatatatgtgtactcttctgacttcacacattacagatataaagtaaaattcctctggcatctgtgtctgtctccatccactcttcaggagaggaattcagatatatgtgcaagcatacgtgcaccacacggtcttacaactgtagaaaagtatagtattgtgtttgtgtcgattttcagcatagtttatcatgctatacaaatgctacatttagcttttttcttctgatgtttctctgccaagagagacagttacctcattcttctcatttgtgacacagcattccataacatgggtgtatgtgattttatttattcatttccctgttgaagggcatctagtatgtcttcccatttttttgttcctagtgccagtatgcagtgaacatgctggtgtgtgcctcctgggctcaccattatgtacatctcagctaggtacagtggggaggaactgctgtgcaatagagtatctgtctttaatattaaatatgtattactttcttggcttctaaggtgagtgtgccattttaaaagagagttttgggttgttttaaagagtttttggggtctggaagcctcttgtgctttatttcactcaaatagctcttgcaggatatcagatttcagttcagtgccctctgcccttaaaaacaaaaacaaaatctggaggtcttctctctactcgcttactacaaggcctctcccagcccttggtcccagagtaacttgagccttctccaatagttggtctgccagtgagacatgatgatgtagtagtttagtcctggttctgccagtcttgtccttgggcgagtgatttcttcctcagcttagggtcaggaagaaaggagtcattatatgtaaagcttgtagtaaacatatggtacatagtaagcatcaataactcttggctcctgtcattgcgacatagctgccacccttcactcagcatacgtttaccacccttcactcagtatacgtttattgtacatgtctacgtgctgggaacatgaagataaataagacatggtctctagccttagggaacttatattctaacatgcatgtaacatatatgtaaaatgaaagttcttattctctcatctttccagctacttaaactttatccatagcccagtttactttcctcccatgtcagctaacttctgcatgataaaggacaggctttcatatcttagctatttctgtctaacagtgattcagtacttaccatgtaccccaaatgttgttaagaactggaatgcaaagatggtgtgtaagacagtctgtatctgtgagaagctaacattctgtagggagattaaaaaaaaaaaaaatcctagctccgggtgtgagactggaatctacagcatctatagaacactctgatgtagtgggaccttctgaaggactctttttggcctttttattaccacttttcacctgtgaactggctctgttctaccttgcgttgcctatgcaaataaggataaacaaactccattctctcttccaagggggagagaattagcagcaagagggcacatatttctctttgttaaaacctgggaatggcatcactcctttctttccctagtgactaatcttgtaaagtgttaaagagaagtctaagtcccccagagggacttagaaagccctggccattcatgcccaggtggagccactttagtaaaaaaaatagcatttttgctgccatgtgatgcacaggtaaaacagaccactggatactgctggtttgcattcctgcttcctgggaagttctcccttccatttcatgagcctctttgggaaaggtacaaacttagggaattactgacacagaataggaacaattggcaatcctttcactctttcacatatactgatctttaaaaaaataataaattatcattgagaactcagggatacctccttgcttttatgaccattacaggttttgtttggcttgttcataataagcatattaagtttaatcttattttaaaagtctgtcctgatacaaactttaaattgatatcttgctgaattgtgaatggacataaaggctccttttaaagagctttaagtgtttgttgccacaacagggtctgagtataatactgaggttgagaaagatgattttctcaacagaaatactttattattgctagaggtagtgtgaaattatcattttttccttgaagcatgttcttttataaatgctttctggagatacatgaattaaaattaatgatgttctcttttgttaaggctttatttcatttcatgtattctgttgatctttgagacaatatctaatctagagagaagaaaacataaaatagtactaaaaacccaatgaattcttttagtgaattagagtttacttcttgtcatcagctaagctccctagtattacgtgaatactatcatgcttggtgctacattttgtgttttggatgtttttggttcatttgtagatgcttatcttttgttattaaaattccatatacatttcattttggctttacaaaactattttggttaatgtaagcatactgaaaagagggtttgcatttagagtgatgcatttcgtaggtcagagaagatactgttatttatcatcagctatatgtgtgatttctttttcaacttcccaatagtggtggagatatttgggtcatctatctttgcaggtccttgtaataattgtcatcaggaaatgtacatgtgtaggtaactggcaggggttagtggttcagactatggccattaaaaaaaaaaaaaggcattagctgggtgcagtggcacatgcctgtagtcccagctactcaggaggctgaagtgggaagattgcttgagcccaggagttcgaggccagcctgaacaacatagtgaggccctgtctctctcttttttttttttttttttttaaataacattccgcatttcctcacccatggagatggtactcataatagttttatgaatgtaggaagaaactgaagttagctccattcaagttggaagagcagtatataccggaaagaaattcagtgagcattctgaaaattctgatcctagaggcttcagcccatttaagtgttaatttatcactagattgttatttttattttagaatttccattgtacttttcagataaatctatggtgcctacactaacagcatttacattctttttttttttttttaacagaaatgtcttagcctctggaaggccattttattcactaacacatgctaggaggcttcagcaatatcctgctccattctagaaaacagcaatttgatccttttttcctcctcagtcattaacaagattatgcatttgcggtgagatgatccttcttgaacaagtagccagaaatcatttgttccagtttcttctcaaggtgctgaattaagtctcgtctcataaatcttgtggcttccttgatgatggattcaaaaaatcatttcttgacttctataggtccttgcagtccttcaagcaatttgaagagtttttcatattttcgtctaaagtgttgaatttccttcactaattgacattttatatcagcattaatttcttcttgacattttggaaaagggagtatttctgtgacttttaggtcatctccagagaaattgctggtaatgattcctcctacaggtgcatttctaccaggtttctgcatcagcccatctttgctgcaaccactgaagtcatcaaaccgagaatccaattggcttggtggaataccatctcctgccataagcttcttttccttggacatggcagagcctccaataaggctgtctcctgctctttgtttccttaacaacagggccatcttctgccttttctgagatgaaggagtctcagattccctgggacgtttaaacacattttcaggttctacagcaaccttctctgctttatcagtcattgtttccagaaggaccgatccagtatggcccaagggggatggaagggaaactgcctgctatggcgtgccctgccccagccaaatactgggaacactgggaacctgtgtggtgcgccggagtcctgaggagaagccttgtgttcagtaggatcacgggtgccagccccgacaatcatggggcctgcatttacactctttcccacaaacctcacagagttaaacttcctttctttaactctttgctgtcaccttctgctaagctctggggattctacttgtgtcctaggaaaaagtcttccttactcctttcctaccttatgcatttttccttttttcctttctgaacctcagaaagcgtcagctttattgaatagaatgatgtcactctttcttcttatgaccactttcctaattgctctctttagaaggtcctgtaatatctctctcgcaccgtttttaaaaaaaatttccataggttattggggtacaggtggtatttggttacattagtaagttctttagaggtgatttgtgaaattttggtgcacccatcacctgagcagtatacactgcactctatttgtagtcttttatccctcgcccccctccaacccttcctcccaagtccccaaagtccattctatcattcttatgcctttgcatcctcatagcttagctcccacatatcagtgagaacatacagtgtttggttttccattcctgagttacttcacttagaataatagtctccagtctcatggaggtcgctgcaaatgccattaattcattcctttttatctcatacacccttgatctgtattaagtgtgttggatttcctcttctctatctatgaaattgacccaaggcctcactgaggacctgaagatacaattaaagtagaatgacagaaactagtaaacacttgaggcttatccaaatgaatgtttgatatgttagggactttttaaagctgtcctctgttttacataacaaaggacaaaatggatcatttcataacaaggagtcctaagagataactaaactcaactaaaattgatttaacttctggagagctttccagattatagtccacaaatactaatatgttaatattactttcagccataaaccatctcattagatctcctgtctcttttcctagcaataatacactgtcacttgaaccagcagaatgtaaactttactggctcataatttctggtctataaggagagaatggtgaaaaagtgggctagaatggctctttggggaatggtggtgcagatgagaagtggactggcctgtagctgggcagcccttttttcatttcatgtcctgtttctcctctagaactcagagaatcatttacatgttatacatcatctacatttttctcatcccagctgcttcattctttagatgaataatatgctcccctgaataagtgctatctaccttctgatagtttttaaaaagaaaagttaaattgtcatagcatttattatatgagagatgttaagacaagaagtagaaaacaagaaaatgtaactttggaaagagttctgtatagtatatttcaaaaaggtgaggcaagtaatttctttctattaatccatatatatttttttaaatttaggaatagaaggacagtctgtggaagtttccaatattgtggacatccgaaaagtatataaccgtgagattgcaatgaaaatttcttctgatataaaaagccaaaatagattttatactgacctaaatgggtaccaggtaatttttcctttaaaatgtttaagtaatggttgtattggtgtgtaattcttatatataacaatggcccagttaattttggatcctttgaaaaagtatacttaaagttgcaaattatatctaaaataaaactgaattttgacagaaaatttcgggttctacagttagaagaaatatttgggagaccatttttttagaacatctttttgtaaggatttatttgttcaaagggtaaatttggtgaccactatgaatgttaaatatcttgatgctaaaaaatatatatatgaatttatctaccagaaaggaaacataattagggattgatggattatacttattgggtttttttttttttttttgagaaagagtctcgctctgttgcccaggctggagtgcagtggcatgatctcagctcactgcagcctcttactcccaggttcaagcgactctcctgcctcagcctcccaagtagctggcactacaggcgcacaccactacacccagctaatttttgtatttttagcagagacacggtttcaccatgttggccaggctggtctcgaactcttggactcaagtgatctgcccacctcgccctttcaaagtgctgggattgtgggcatgagccactgtgcccggtctgtttttgtattagcccactctcacactgctatagcgaaatacccaagactgggtaatttataaaggaaagaggtttaattgactcacagttctgtatgactggaggggtagcctcaggaaacttacaatcgtagaggaaggggaagcagacaagtcttacatggctgcaggcaagagagagaaaagcccaggggaactgccatttataaaaccatcagatcttgtgagatctccctcactgtcaaaagaacaccatggggggaaccacccccatgatctagtctctgcccaccaggtctctctctcaacacctggggattacaattcaagatgagatttgggtggggatacaaagtctatattagttgtcctcataaggaattgatccatacctattaagtttgttccctatatattggtttaatgtatgatctaataatgggcccttgtaaatttcaggaaaactcttcctctatatgtgtgtgtgtgtataccattatacatacacagacacacatgtatacatatacataggtatatctattcagaaatgggcaggtatatatttaatcaaaattttcatgaaatgtttcaaattgtagtaaggaaattgatttatacaatcttatcaggttgtcaattctccaatttaatagagcacttttgattgttacctaaatctctgttttctgagtgtatgtgtttgataacatatctttgaaataccattaaaaccatgagcatgtttttaaaacaagtgttttagaaatttctggctgtgaatagaaataattttacaataaacactttgattttcaactgggggtgggtgaaaaagattttaataattttctcttctatgatttcctgcaaaagttaaatttaaactttttccaaaacataaaaattgcagcatacattctgaattagcatgttaattcgactacagccatttggattccagataaaatctcaacttcatggtgattcatttttttatgtacaaaagaaagtattttcttaaaattatacaaaaccagttatttgtatttttgggtgtagacatgaatgagaaacttagtaaaaccgaataactaaaaatgtgaattttctttttgaggatggaacgtttgactaaaaaagaaaatattacttttaagtctgtaatatttctgcttttaaaattgaccattttttaagctttggatatagtagtacttgggcaaaactaggtatctagctccaccagtggggaatcggggtagcaacaacacgattgtggtagttttacattttttaaaataagtttacatttacaagttaattgggtttggaaaggagaaatagagaattcttttaaggtagctttacttttttttttttctttaaacattttacagttgtagctttatcagtttattaatttcccaaggctgccatacaaatggaatcacgtaaaacaacaaaactttattctttcacagttctggagactagatttctaacatcagggtgttggcagggccatattccctccaaaagctatagggaaataaccttccttgccctttcccagcttctagtggttgcctatgcttggcattccttggtttgtgtatgcatcactcccatctctacctcttttgtcatacagcgttctccctatgcctcttgtatctgtctgtctgtgtccaaatttctctcttcttgtaaagatgccagtcattaggttaggtcccaacataatccagaatgacctcatctatttctgcagaggctgtatttcaaaataagatcacattcatgggttgtgggtggacaggaatttgagagagggaggcattattcaacctagtacaaccagtaatttgagggagacattgcagggttgctgggaagattaaagatcacatttgtgaaatactccggaccatgcctttcgttaatgggcacttaatacatgttaactattacggtaactttgtacctcttcttttcttcacttttatatccaactttcatgagtttaaatgaggagatgacatttttatgtggtatcattaagattcactgataatagggttctgagcttagagtcagtcactgtgacccagatgggctttggggttaccgacagtctttctcaaaaagtagagtcatatttcaaacattcaggtactaggctgcaaggaattggaatttggaactatctacattgaaactaatcaaaaagagtaagcactgaatggtttttaaatataaatatgcatttgattttaacataatatcttagaagatttggtgcagagacctgtggtatttattaaaaccaattcaagaataataagagatatttcttgaaaggggatagagaggtattatacttagcattcattacaaaagcagtttgttagatttagatgagaaatgaatacttaatacctttataatttgttttatgcaaatattggagagctagaagacttttaagcatttttattctgaatttaaataggaatgcctattttaaaaatctggacaagttctacctttcccacctaaaagttgttttctaatatccttgtggtttttcttcatattgttttaaataatgttttaatttttaaattatttcttccactgaataaaaaggaagctttgtctttttctcttgggaagaaaaatcacctgtcctcaagtttttaaaagaacatatgtaaatatcactttttgtagatggaattgttgtgttttatagattcaacctagaatgacactgagcaaattgcctcttcaagcaaatgtctatcccatgaccacaatggcctatatccaggatgccaaacatcgtttgacactgctctctgctcagtcattaggggtttcgagtttgaatagtggtatgtattgcttacactcttttccactctgaaaggtttcaattccaactgtatactttttctgttggtcagatgtggtataatctctagttaaaacctccctgtcttcttttcagcttttttctttcaacaaccagactattagttaagtttgggttttgtgagaacaacataaaaagatgaatctcctaaatcttcagatgaagaacaggagacctaaaattccatgtcaagatttctttttaaagataatttgcttctcctaatagtatgtattttgcagaggtctccatcatcattatgatttaacggatgtggaaactcagattcagaggtttagataagttgcctacgtttgcaaagttgggaagttgtggttcaaacttaggtccttttctgaatcatggtctttctattctgctaccacctgaaagaaggaagggagtagaaatgatagagatatggggataaagaggtgtggctttgaggattccaaaagagagaaagtgatgcgcagaaagtgagagaaaatagtcaatagacactgattaatttttgcaagtctttctattgagaggctttgatcctttataatacatatttttaattggttatcatacatggtatcattggtcttcttacattctaagagttggtagagatacatatctgaaggagccagataataactgagtgcagattcctggtgtgtcctttgacacaagcccactttttacatgaggcgtatacatgcattctgtatcttacacacacacacaaaaactgctacttctcatttttctttgtggccttcattagataagatcatataaactcatgccataaagacatgaattcgattttgaaagtagtaatggttccacatcagggatccagtagggagggttagagacttgagcaaactgaagagcatgttcccgatgtgcagtggggcagcattgttgctgtgtggttaggggcccagtgttgctaaattcaatttttttttgaagaagagtccagaagtctggaattttacgtgaagttgttcaatctgtaaaatattgatacaattttttaaaaaacactatgttgagaaaacataaaacatctttgtgccgtacatgactcttgagccactcatttttaaacactgccttaaattctcaaagctgtgccctaaatagaggactagacagtaagactcaagccgtggttaacaaagcagcattatctcacttcctggaaatgtgatgtacatttcctaataaacctcataagcatttttgattccaaatggtgctactaaaagtttcggagaacttaatttactctttaggttaatgttttggaaaaaaagtttcatttaaattttgatctgtcctgtctcacttttaaatttcttatcagatattgtgaaacattactaaagaaacacagaaatactatcctgttttatgaatttgtagtagctactttgagctactatcaagagaaagcccatggtgtagtgggttgtataaatccacctccttgactagagaggaaatttagagcaatacatcatgactgctacttaagtgatgctcaatgaatgtcagtattaaattattctggtcagttttgcttgtttgtttgtttgtgtgttaggtcagattgaagttatcatggatcgaagactcatgcaagatgataatcgtggccttgagcaaggtatccaggataacaagattacagctaatctatttcgaatactactagaaaaaagaagtgctgttaatacggtatgaaaaaataactagcatgatctgatattgattgttctttgtcacccaaaacttgaaattatgactttccacttttaaaattttaaaaatcatttccaatattgagatttctttatagtagatgtggcccacattcacagaaagagaacttcagttataaatatcgtgtaagatttgcacttaggtctttttattttttatgtttgcttattatgtagataaaaaataatgacaggaaatcactttgggtaaatattcctgaaattattttgaaagacataagaattgaaaaattgagctaaataaaagttaaagaatagaacttagtcatatacttaggagattaaatttggtaaactttatttgaaatcttagtaaaatttatttgaaatcttagtgtacttattctagtcttagactcttcagttgaaaatgtatttatatgtaggttttctatgaggtttactcctcaaagcaaaaatctagtactctgtgttgaatggtctggcaaaagcccagctggacctgaatgacctgacgatatgcttgttcaggcaaagttatcttcagagttctccgtaagttattgatccacccaccttggatagccctgagcatgggctttttctttttgctctattctcctttctgcacctgaccattgcaagtcctttctgctcttttcagccagtgatcgtacctttcactttatagagagaacagccattagacagggctctctgttccagttatctaacatctactcccacccttcccatctctcctcctgttacatttaaaagacactttacagtccatcatcctaggcaggtcccaccacttgtccttggaacttactctcttcacccacctcagcatccttttactgttcattctctccctctctctttctcccttgctcctcatatccaacacttcctgggagattctttctgttagcttttgaacactctgttttcttctattaaaagtagaaatggaatacagccttccttcagactcttatttccatttcctgtaagctgctatcctcttctctcctacccaattgagtcagagtttatgagatgagtttatttcatcacttccttctcacaatccatttgtttcagtctggctttagcctccatcatattctgaaagagctctttccgatgtcagtagatccagtgcatattgactttcgtcatcttacttcacctttcagcagtatttggcactggccattgtcactctctaaaatactgccttgccagggcttctatggagctatgcagtttggttttcctcctacctgtctggcagttctttatctctctaatagttctctactcagccattaaatcttagagctctcaaagcatgtcccctggccttctccttttcttattttttatgctatcccttggcaatctcttctactcctctggttttgtttgcatcttccacacaggtagaagccactaatacatatctccaacttaggcttgtgtctgacctcctgatttatctatctaattgcttcctgatattctctgtttagaaggacacctcaagtttgacatatccaaaacactcataatctctcttctctcccaaacctggcccattttcagtgttccccccagtcaacagccaccgccatccatacaactccaagacagacatgagttctgcctgatagacacttctccccatcagccttttctcacagagtaattgccatcacctatctatctcattgcctgaatatttcaaatttataatcttctttacttccaccaccctaatctaaagtgacttcctgtatttcctgggtctagcctatacacatccaccctgttctctttctgccgtatgtctgttcttaacccagaaggcagaatggtttttttttttgttttttttcaaagccacatctaactttattgcttcctgttgaaccctctgatatcttctcattgctatcagtataaaagtcaaaatttcttaccacggcctccagagcccctcatgatatgggccctgcatgtcccctaggcattggcattggcatgccttttactgtgtctgctttaggcccactggtttcctttaagtcccaagtactttccatcccctcctccccaccgcacttttgcacatggcctgttatcctctgccttagagactcttggtgatagttccggttagtgcttacttcatcagctgcttctggaccaggttaaaagcccttcccctatgctgcctccaaactgtgcatctcaccttcctgcaagtgtgcgattatttgatcctgtcttctcccctcctttggaccataaactccatgagagtggggaatgtgcctttctttgcttctaggattgttcctggcagaggacatgcctaatatatgtcatatgaatgaatatcgaaatgcatagatgaatgagctgttagagtacattttgccactgtatttattgcaatttctgcctattaccttgtcttcatatgcatgttgcattcctcctactagattccagggacttgttgccttcattttcatttgtccttatatttggtagacattctttaaacaaaatactagttgattgaatgaaatagcaacagctaattaaagcaaaaattcttccagtatttagaatattttagaaaaaagaattagtatccactttagatgtcaagagccataccattcttgagactcatattttaaatcaatcactgacaagatagcttagttttaaggactaaatctgcataggaaaatcattgtctgagtgctgacagctactgtcttttgctcctcctgaaaaagtttctcgcttatatgactttatattgacactaatctataaaacttctgttaactgcaataataaaaattttcacatcaaatctataaagctttgacttagaagtgaaataatttgtttattcccattcagaactccttggatagtaattgatttaaatttaatttaatgtttttatgttgattaaatttttcttttactcaagtatagattctgggtcttcaattaatggtttcttttaaataagaaatgaactagagaagagaaaatacattttaatgtctagtgaaaataattaaaaagacacttaattgatgaaagttaataccatgtaacttgaattttctagaaagagttcttaatttcaactcagactcaaatatctaaaataatgatggagggaagtgaagtagggggatactccctgaataggaagagattttaatgggaagccctgagcatgacagagcctcatggaaataatcccgagctgactaagtggaagtaagtcctgtcctcagagaattctgcagagagtcagtaaaaacaaggacttggatgatatccactgtgtaatatgtgcaggtgtccagtgaggactgtggctgcacgaggttgaccatcatttatgctaatcatcctcaaagccaatagaaatggaaaataggattcatctctttggcattgccagggtttgaatgtgtcccccaaaagttcatgtgttgaaaacttggctaccattgtggtaatgttgggagtgggacctttgggaggcttttgggtcatgggggatctgcctcatgaatgaattaatgccattatcatcggaatgggttagttattgcaggagtggctttgttataaaaatgagctctcttgcactctcttgccttttcaccatgtgataatgcagcaagaaggccctcaccagatgccagtgccatgctcttggaattcccagcctccagaactgtgagctgaataaacttcttttatagataaattatccagtctgtggtattctgttatggcagcagaaaatggactaaaaacaggcattgacggctttaggatttgtttctttgacggtttatccttacccctttcctgctactggttggttaatgaggcactgagctaggaaccctgtaagtgttcaagtgttaaaattgtgttgttgtacctttaaatataaggagaagaaattgggagagatcagattaaaatattaaatacttatatggtttagaaaagtgacagcataagggagatcaaccaggtttaagggtaaatacttaggtgaccagaagatctacagtaaacttgaggacatatcccaccaagacccacaactcagctccagctgattgtttccacaataggactgaatgcctgcccagggtgacacagatttccagtttcttgggtaaaaaacaaaaaatgtgttttgggttttttgaggttgcttttttattatgaattttttattaaagagttggcttaaaaacaaaaaaaaaaaaacattttaataccatacagacctaccaaaatgtgtgatctacaaatctgccccacagtcttcagctacagatacttacctccaaatgttatgattcaatgtattattcttcattttctctcctccttcctctttgtcttttttactccacccttcctctctagtgttcttctttcatttatttatattgcatttgcttattaaattaatagatttacttcaacagacatttattaagttcccaccatgtttcaagtcaaactgaataaacaagggtaacttaaaaaatggtctcttactatctcaccatgatttaacaggatcgtttaactcaaagtgagcttaataaagggcaccaagaagtctggcaagaagttctgactcatggactaagggctggaacccagtgaggaagagctgtactttgtgtggtttggatcagaaggtgctagaaactttctttaatgtcagacaggctgcagagagaaagctacacttatacagtctgaaaccttccaaccaacaagaaattaaataaggtttatagtactagattagttaagtacaaggctggggtattcatttataacttaaacacataaaatttcctgtagaaaacatgtttttaaaactttgggtttatcatatgatttacagtggaaaggttacctttgtagagattaatttaaatattgatggttcaacagttaatatcttgttgagcctcttgttgctgtaaatatgataagaaagtacatgaatggcagaactctgggtgagactttgccactccaacctggccagcctccagcagtgttattttttcatggtgctcttagggtagtgaaccacaactcttctataaacttccttatctttctaaggacagtaaactacacagtttttaaattcttgaagtccttaatatccatgacattgtttccttttagaagactcccatcaaaatgtctttgaaactgaatcttgtttttctaatgcaaaggtagttaaaaggtaaagtttatcttttgattctaaagggagctctgttttctctataagattggatgtctggggtggcacttcccggcacagggtcatggagcagtgtgcggctaactccatgaaattcacctggggaggcttttcagctttgcattttcaggaccccacctctcaagattgtgtagatttgggataggacccaagaatctatgttgattagaggtgccccaactcattctgttgtgtggttaatttggggaaacaccaacggttaggaagaactaatttggtttggaggattggtatatatgcacgttattgcttctggagtatagaagattaatcaggaagtgttctggctactcactggagtggtgaggaattactccaagagtgtggaacaaagccagagctttctctgaatgtttcttgacctagagtggacttaatacttcccagatttgatgagggaggtgttttcttttctgtttgaatcttttatgttttattactcgtgagtgactttgtcagcaatcctaacttagattatgaagtcctttgatcttggagtacatttaaaatatcttgttgaaattgttccctctctattcatgttattctacgagctgcattaaatttcagtgttgttggagaatattattttatatgctttatttaatctttcttttaatacaattcattcagacccgattttttatcagtatcttaatattgcagtgtccctctgctgtcttaaaattttttttttctctctccatagtctgaaatgtaatgacatctaatgttagcttctggcacgatgctagtcactttttgctagcacccttctgtgcaatgctaatctgacattctgaattttaagctgtatatctctataaatcctgtcttttcacacagatcagtagccaagccttttatctgagccttatattacaaaaaggatgcaaaatcagaagatgtcaatggagtaatcattttaagaaataagatacaaaattaaatttggttcaaatgtaactggtgatcaaaggacctttctgcataaattattttctaagttatttgtgtctgtttttactccttaggttaagattctactcagtcattgatttaattttgcatgtcatctagcatatttaatctaccaacattagtagattatttaatgtttgaacatacagaagtgttgcttttaaccatataccatagcaaaaactaaagcattttaaattatatggaataatcatatactatgtaagtgtgtgataactattcagtaacatatttaacacttctacttttggaataaaaatagtgaaacaattggcaatgatttaccaagttgaaagaaaacaatcagatgatctaggcatgccgcctatgttatttatatttaaaaattggatttattttgagagttttgttttctttaaattctgtcattgggtaacatttagttcctatcatttggtaacatggatggactttagctttgaatcagtatatgcctttatggtcttgttaaggggtataaatgaaactacaagaatatggtggatgaaacctgagaagggagataatatttgatgatgcacaacatataatctatgtacagcccaatccttgtactttgagagttttgtgataggttgagaattttcataaaaaggtatgccttgtcctgaaatgtttgtaggaaatgttttcagtatttttagtattaaatcaatggaagatatattttaaacatatgagttagatgtgtgctgtttattttcttttattgcttacaactaaacttggtagtttatggagtattttctaagactgttatttataaaatgtaatgaaaccaaattattcatatatttttatattaaaccctctcagataattctgttaatatgatgagaactggaaatatagacctcttaaacatttttgttttttcttgataggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtatgtctcaaaatatatcttataaaaaattactgtttattatgtacttgttttaagggggtaaggaaaggagaaaaaaataatgtatgctttactatgctttgaggaattattaacagggcttcacctttagccaaaagcttcatgcctttcatttgactattgctgtatattttagagtatatcctgatactaatttactcttaagttctgtatggcgagcaggtcaggaaataccattagtaggtgggcaatctgggccttaagtttagcactagtgacttttcccattcatttctccttgttagacaatatctctcagaagctagagaaatagtacttagttatttctatatcagaggctttgtattttcgtacctttctcttgagaatcactgcaactcagtttcccattagaaaaccaactgtttagaagaaatattagaggaaaagcatggggaagttttattaggtatgaaatttaatttagttagactgcagttatatacatacctgtttttaacatcaaaaagattgcatttggaaagaataagaattagacatttgacattgttcttatgtgttgcaaagctgttttgatattgcaaattgacatagatttagctggaaatagtaagtggttatggattctgtggaaaatatctcatggtaaatggcctaagtatgaaaagaagaggatgctcatgtttaaagacaatataagaggtgagaaatgtttaatgtagaacaaagaactaaagcaataaagtaaggataaatgcctataatttggatattagagatttacaactttatgtctaagatataggagaaaaaatataatttttttttctttatagatttttagttgagacaattttgaaagcaaaggtcagataaacaggggaaaaatagcaatagtatattgtacatgctatacctgtcacttgggagaggcctaagttcaaaagtatttttttcccaaggcagtggttttggcaccttgcctaaataatgttttaacaaagagccataaatcctctagagacaagacaaagaagaaagcaccttcaggcttccaaaaggtaggaaaatgtgggaggataaatttatgggaagagtgaagtctgctcctagatgctctggcactgctgtctcttagctaattagcaagccttgtaaaggggcctgtctttagactagaaaaggcagagaggaagggatgaagacctcttgtatttgtaaattgctgtcctgccatcaagcaggcagaagaagggacagaatggccccctggtttttttccttcttcagctcaataatcctcagttttttgagagagaagtattttggtttccttcagagataaggaacttatgcttggctatgcaggcaaacatatatgacttataataatgactacaagcaaatgctcgaggcgtgtgtgcgtgtgtgtgtattgaaaggctttttaaaatcattatcagtgaacttgcaggatttatttcctacccactacatgtcagttactgccataaaacacacaaatgcccctgcccttctagagcttagattctaatgggaggagaaaaacaagaaaaagtaagagaaatatgtaatatgttagatggtgttaagtgttatgaaggagtaaaaagggaacagccattcaaaggaggtaacacaattttgattaaggtgtgtagagagggcctcacagaggtgataatggagtaaaaatctgaagaaggtcagagaataagagactcctgcagatttctgggggtagagtgctccaggaaaagagcaagtgtgaaggccctgaggccggagagatatgtggccagaacagaagctccatgagagctatgcttgtcctttattcatggctatatccccgtgaagaagagtgtctgcacataggatctcaaaaactattttgaatcagtgaattgtgtagatgttttttctaggattctgctgtggttttttgtaggtctacattttggctccccgaggtgtcgtgtcataaattcatgagctaaaagaaacagaaagaatagagtggagggcatcaaatactctgggcttgaggttaccaccacccagcatagatggtagaggacatcagcgacctgaagaacccagaggcttctggggaggatgggcggtcaccatcccttagcctcacttctaggtggctcctccactgtagttgttttaaatgtgattgttttctggaagcagctggagctgactagagtcagtgagcatagggttttaccttctgtaaacgaagcctggaacttgttttttatgtcacctttttttgtggttactcacttcttcacatccttcctgcttttgactattttcttgtaatacaaatctaatcacttctcagatgaaaaatcccgttgcctactgaattggttcagacactgagcattcaggtcctctgcagcctggcctctacttactgcagccacctggcttcccgttgctcttcgtgcctttggacaggtgggccaccctccctacctgtgggctgagtgactgctgactcagctaccatttataacatgaggctaatgtcacgtattgctgtgtcaggtcttttgctaaaaacagacgaaatcctattgtgaaagccttttgagaacaaaggcactctgtaaacataccttgttatcctaatgacacttactccaacttggttgcagattagggttttagcagagggaatagagagcaacttaacaacataaagatttgaccaagaagattaaaaactgaaatgttaataatgcctattgataactaccatgctggctcataatcagaactaaatacttggcagttttgcattatcatatcagttggtgccagttcctgtgttagcctttgactcttagcacatatttataacagttgtttaaaagcccactagtaatccaaaggaaggactggtccattcaaaaccacttctttaaagaattccctaacctgataatagaaggataatcattgaagggaactgttgtgggtattgattcaaagaaagctgtacttacaaaatgtccagtgtaattccatgcttatactaaaaaaaaagaccaaaatgactcaatgaataagtacagaagccagacctaagcattttggtttgggttcctgtttctgtgtgctggaagcttccaatgtgcaataatgggctgttcatttggagaatgcaactcatttttccccttgaaataatgtcaaaatagacataggttccaagcaagacctgaagtctgcattggcctgtatttaagtaagcatattcctaaccaccacagtatttcatgagaaatgtgtctgaaggccaccttagcatgataaggacgcatgtcttcctgcctgaccaactccttcagcaccatgatagagagtgcccttgcttggccctctgggccgctgtctaaaggtttctcaattctaaacctcagttggttttcttgactcctgggataaggggttatagattcgaagaacagtgagggaggcgagttgcaggctgcaggtatgacaacccactgaggtggttcagcagttccagctactagtcctcaaattcactgtgcccggatcacacaggggagattttaaacatagagacttttacagatttccagatctctgagattctgattctatagggctggggaggagagcctaggaatttgtaatttttaaaaatgtttctcatgaaattgctgagttatctccatttcctaaattaggaaagtgagagttagagctaagttaaatgataaaaataaaatcacccagtggtaaatggcagaatcaggcgttctgaatctcagtgctgtgtgtggcctcagagggtagcatttgacttttttagaattactaaatttgtttctaaaagtccaagctttcagggattgctctatattagtagatgagtttacattttatatagacatatcttgcttttagacagacatatcttgcttttctgctttatatcaatttttggaaaatgattatatgccgtatatttgtattcagatgaaaaggggaacaaacatctctggaagccctgcctcacagcatgctgcgtggccttgcccattccagccactatctacaaacttacccattagctttcctattctgttggcctgtctttcaactcttttccttgatcacacctttcccctacactatgaagatcttgagatactaaaaagaagcttctgtaaaggtttgaaacctagggaacatgaacaccactgaaatacactacatgcaaaagccttgtcatcaggaaaggaccattatttaagaagaagggagattgggtagagaagatgcagggaggatctcatgggaggacagatgatgagtcaggcttctgaagctggagctgctggttcagcctggaatagagggacaaagaggaagctggataagctcagcttcatggagccattctacttggaatactttagaaatgtgatatgtagttcagcttttttttttttttttagattatttccacagcttttatatttagacatatttattttatataaacatgatatatatatatatcttaactctttctctatgtaatttattttgatttgtgtttaactgtttcttgcaaatagttaaccatcatttcaatatcagcaccacttactgaataagattttctctctccacttgttcattctgcctcttcttttcttataaaaggcagtttgaggattttactttatttgtctttcttataagaattgattggtgctttattgatctccctagcttctggaaaggtgaaaattgtgagaaaaaaaaattcctttgttgtacgtatctcagaacagccatttaccttccctttctttctgtcattttatcttgttgatcaaaacaggatagctattattggacattttaatgagcaccctaaaaaatgaatttctactggttataataccatcttaggacttataatgaagcatgtaattttctaacctttccagctgccagaatgcactagggatgagtgttaggtattttcaaagaatctgagtgggttggagaaattttcccaccagatgtgtagccgtgccttaatctatgtgcaccttactaaccgtgtgaagagggtggggtcccatgcatcctggagaatttggccaaagttatggcccctctcttccccacaaacggtggttgcacacataatgtttactacagtttccaaaagtttactgtttcttttggtgcgagagaggaatgacataactcacatcttaagatcttcagtagaggactattcacctgcttttttccttaaaagagactgtcatgtgtgtataattttcagaatggctcaaatcctatttgaagtggggtgaatggataggtggataggtggtagatggaaggaaattacaatttccaaagcttggtttctgaattgatatattttttgataagttatagttttatctctgctggaaccatcagtcaatactctcctttttcagccataaattggaggggttacctcctttagtttacagtattttgttattttacatcaaaaatattttttatcttttctctcctggctaggtatctatgagcacaaattcatagctagtgcaaaggtaggagaaggaagctgttaaaagcttaaactttggagtcagatgtcctgggtatgagcatgtctcctttgctttctaaccatgagacttagagcaagtcacttaactctctgagtgtcaggctactccttagtaacatggagatggtaataatactcaccttagagatgttctgaggattggagataattttagtgttagtaaagcacttagaacagcatgtggcacatagtaagccctatgagtgcttgacaagtaaaggttctcacctgtgatagttcagtcatgaacaacggcagttgtcactaataatgaggtaaaaacattgccagagtaaatcttgatgtcactttgacttattcctgatattttaggttggtacaaaagtaattgcagtttttgctattaaaagtaatggcaaagctacaattacttttgcaccaacttaatactt

SEQ ID NO: 539 - DNA, 175902 bp, Homo sapiens; identical to SEQ ID NO: 538

SEQ ID NO: 540 - DNA, 930 bp, Homo sapiens
ctaaaggacgaatctcacagttaacattttcttcagagcccccatgacatccttattcctaagactatagattaaagggttcagcaccggagtgaggatggtatagaagacagataccatcatgtccttctcaggggtgtggtaggagctggggagcatgtaggtgtagacggcagccccatagaagaggatgaccacagtcaggtgggaggagcaggtggcaaaggcctttttccggccctctgctgagttcatcctgtggacggtgaggaggatgagtaaataggagcttgaaatgatcgtcacagggatgaggagcatgaggacacagcataggtacatgagggtctcatagagtgaggtgtctgagcaggacaggatcgttacagcagggacttcacagaagaaatgatgaatctcccaggatctgcagaaggggaagctcatggtgatgggagtgagcatgaagccatccactgagcccaggaaccagcagcccgatgccaggaaaagacagaccctatggttcatgaggacagggtaacggagaggatggcagatggccacgtagcggtcataggccatggtggctagaaggaaaaattccgaacctgctagtgtcagatagaggaacatctgcatcccacactcaggggctgagaccttattcacacccatgacctggtccaggagcatcttgggcacagtgacagaaatgtacgccatgtccatgagagacaattgactgatgaaaaagtacatggggctgtggaggtgggcgtcacagtgtatcagaaggatcaggacagcatttccagacaacgccttcaggaaaaccacaaagatgaccacactaagtagagctggatgtttggattgtctgaagagtcccatgaggatgaaatccaaccttccagtgtggttggccat

SEQ ID NO: 541 - DNA, 55009 bp, Homo sapiens
gttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggtacgcgcgcgggccgcggggggcgcgcggggtgggcgcgccgcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagtaagttttattatgattttttttttcaaatttggggggctgaagacttagagctatttcttcttttggatttgcgaagaacatgcggttttcaggtgaatcatcaattaaacgcgtttaggagcagaagcccagtttaagttggctttagtttataggttttttttttttttttttttttttagaaagccaaagtgcattaggctgcatgaaagtggaaagcatagtagcaacttggtagacagatggcaatggcagaacgcaggttcgcgtacatatatgaatccagagtgtgtgagaccgtgtgtgtggtgggactgtatttgtccaaacataggtgtgcgtaggtacatctgtgtgtggtggccgcagccctggctcttgtcaccgcgtcaccacatgtccaaaatattcattgcatcaattcaagggcagtgagaggggggtgggggtgggggtggagggacagtttggcaattagattcttccgaactgggcttccagtgatcagatcttttacttacagcgcgactgcttgtaaagtgtaaaaccccttaatcgatgaaatggggtaggagttggcgttggtagagcaaagtaccgattaatcgtgaacttaaaggggattgcaaattgcaacctttggcaccatctgcaaattgtgggggtggggtctcttggtctccttgcttccttaaatgaacgtgtagtgtgtaccccgggactgcaagttgcagagcccttcagtgcacgtgtcttgtgcctgtgagtctgtgtttgcgagttgggggctgttgttcggtagccagcaggctttccgggttgctcggcattggcttgcaaatgcgggagagggatggaatgtggaatgttgaccggggaaccgaatcctgtcggaacggtcccatttgctggagaaattcgatcccttccacctccttcccgctcccccccgcccgccttcgggcaggaggcggggctgaggacgcggctgctgctcaaagtggcggagcgcggcggcgggaggcaggtgcacggcacccgccagtgggggtgcctcaacttccgcgggcgtttaaatagcagcctctctcccctcccaccggtaataggtgacctggcggccgagggcggcgggggagggaaccgggggagactcgggagcgagcctccgcggcacgtgggcaggtgctgggtggccccggggccaacttttgtagcccgcctctggtgtttgaggagaggcggcccagtgtggaaatgggggcgggcggcggccgaggcgctgcttctccgctgcggccggagcgtcacctaacggtcccagctgcgccgcccgggccggggtggggggttgcgggggcggggacgcccggcccgccgcgcccgccccgcacaaagcccgcggcgcgggggtggccgctgcgcccccgccccgggaacggcccgaagcccgacgcggtccccgcgccggttccggcgggcggccgcaggcgtttgtttgttggttccgcgccgccttcctcgccggatggcttcctgtgacagaggtgatacacagtttccagaactgtctgggggcgggagcgggagcgggagccgagcccgctcggagctcctcgccgccgctgccgctcccatcttaaaaccgtttctcgccggcgcgcccgccccagcccgaaggtgccgccccggagggactcggggagggggacggcgcggccgtttccagcggcgcaagtggcttctggacgcgagggagcgtttgatttgcaactggggccgagcggattggtgcagctggcggcggcggggcgggaggagctgccgcggcggggggtggccactttcaaatggagagggcggcggcggcggggacgccgctgcggagggagcggggcttggttgcgccacgagaaggtgtcatcactgcaccggggctaattccggcggaggtgccgggagttactttcccctcctcccgcgctgttgtttctgtcgcctcgggaggaggaggaggaggaggattgggagagagggaggggtcggcgccgcgcggaaccgcggccctgcgcattccccggcgggcggcgggagccgcgcggagcgttcgccgctgcggggcggcggccgagctcccccacaaccccggggtgccccccttgctgggatccttagccttctcacgtcccctctcactccgccaccctcccactagagctccttattctcgagtcctcaaccccggcttggcgcgtcccgggtctcccctcgccccaggattcctcccgcgccaggctccgctggccccaggtttcccaccccaagcgggtgggggcggccgcagtcccggcgccggtgaatgctgagagcaaacaaaaaagcgggcgatttaaacatgccttcgaaacccgttaggaatgcgtcgtcatccggagaccgtttaaaaggagctttagcttgccttctagtaacgagagggctggcgccctgccttacttcggcaggggcgaggggctgtcgccctctatttgccccggccaagagggaatttaaattttcttttgtaaaatgacagctgcagtgaatgacctgagacagctacgtttttaggaaagtaggagaggatctgaggtttccattaatgggaatgcttagggggttctttcccaaaggttttttattaggtgaactatttttcctttttataatacccgccatgaaggctagctctcttgctacttgtagctcaaggctaatacctttcaaagctaatgaactagttttaagatagagggaaattatttccctgaaagctgatttaggtagtgactccccagtggttacagattttatagtaagttgcattttgatcatatcacaactgatcaagatttaatcacaggtggagaaaggtggagaaaggaagcattcaatatgtccatacttgcattgagtcaacacttttgatgtaataatttgttgtaggtgggcaacatacgtggggggagttaaatgggatgttttgtgagtaacactcttagcaagtacatgcaacccagaatttttattgtccttttatcccaaagatcttagtctcatttacttacggtcacttttttttttttttttttttgttccttgagacagagtctttcgctctgtcacccaggctggagtgcagtggcatgatcttagctcactgcaacctccgcctcctgggttcaagcgattctcctgcctcagccccctgagtagctgggactacaggcgcgtgccaccacggctggctaatttttttttgtatttttagtagagacggggtttcaccatattagccaggctggtctcgaactcctgacctcgtgatccgcccgccccggcctctcaaagtgctgggattacaggcgtgagccaccacgcccagcctgcttacggtcacttgtaaatcagatgactttctgcttggtattttgctgtcttcttcaaagtttggatacttctataagtgtcttttacttggcattgtcattttaatgtgtagaataaatataattttaagctgtttaagtgttaggtttcctgctatttcctttggtccctatttagcagagataatgggagtgtctgaaagtaaggtagaacttgaacttgattccacctttaagagtacagactgcttactagtaaaagttgggttggctgcacatatattttagctttaacaaaggtagatatgtgttcatttaaaagaaaaaaaaaaaacccaccttcttagttctccccgcttcacttgactggttttctgcctgtaaaccagtgctgtgcttatattagttatccaggttgaaagagtagctatacagggacagcaatgaaaagtatgtgtgtctgggtgaaactagagggagaaaacctattggagtttgaggaaatgtgttttgttgcttagcctagggggttggagaagaaagatgacctaaaaaacaaacttggaggactaggtgagagtaaaagcagatttccattgcgtcttacgtatagtaggcacgtgaccgatattaatttttgactttagctgttaaaaagttattacacaagtagtgttacatgtacgtttttgaaaattagaaaatacaaggaaacaaatataaaaacaaattgctaccatccatagatgactactgtattacttttcagataattttctatgcatgtgcatgtgtgttttaataaaaatgagatacatgaatataccatctgtaaggattttttcttttttttttttttttgagatgaagttttgctcatgttgcccaggctggagtgcaatggtgggatctcactgcaacctatgcctcccaggttcaagcgattctcctgcctcagcctcctgagtagctgggattacaggctcccgccaccacgcccagctaattttttgtatttttagtagagacgggttttcaccatgtttgtcaggctggtcttgaactcctgacctcaggtgatccacctgcctcggcctcccaaagtgctgggattacaggcgtgagccaccgcacccagctctgaggaccttttttttttctgtcagctagcttggttagttttaatataatctattactgtaacatgtccagatttccccatttagccccagactgtaatagagaagctttgtctaaaccactgcctaataaaggaccatttattgcatttggttgtttcccttaagtcgattttaatcttaagtaactttttttttttttttttgagacggaggcttgctctgtcacccaggctggagtgcaggggtgcgatctcggctccctgtaagctccgcctccctgtaagctccgcctccctgtaagctccgcctccctgtaagctccgcctcgcgggttcacgccattctcctgcctcagcctccagagtagctgggactacaggcacccgccaccatgcccagctaatttttttgtatttttattaagacggggtttcaccgtgttagccaggatggtctcgatctcctgacctcgtgatccgcccgcctcagcctcccaaagttctggggttacaggcgtgagccaccgtgcccggcaatcttaagtaactttttgacagaatatctgacactgaggaggcaagcctttggaaataaagttgcctggattttaaaaaagcaggaaatccaaatggtatttattgtaatttggaaatcttaaatttggagatcatctgcttgcttgatgttactttccacagacttgttggaaaaagatttatcagatgtttgtgtttcagtactgaggtggttggaacagtaaacatcaagatatcaaatacagattacatcctgtctctttagggtttggtcagagaagaggaggcataggaatctgtcacagttctgcttgctgctttactttcttgtttgtgaagctcttccctgtcatttagtattatggggcacctgttacagcattacagttaatggtctgtcagaatttgcattataaaactggttttcctgtgaggtttataaaacagttatagagggaaatatgacatattagcgaacacaccttgctttttatttgggttggcattaagaggtttagcttgattgttaaaacggtgaaagttacgtcacgtttaaacttatttcctcccttgtacaagcctttagagaattggcaccatattcaacaatactttttttttttttttaaacatgaagggtgggtttgcttggagtttctggtttcttagaaggtatcagcaatcttaaattaggaaagtattttaattcctgagacaggtaagttgtttccttaaaagtcttaaatctgttttctccgttttcaagtccttgcagcactttatatgaccatgtatttacaatctggacaattctttttatgtttgtggaatgtaatatctcagaagttgagatttagttgagtctattgagtctattgtcctttgcctagtgtatttctcatatgaaaactttggtttgtgatcatgagggtgtatgcattatttttattttttctttttttgcagttcatagccctgatgaagcaagttactctgctctcctaataaatgcaagaaaatgaccttggagggcctttttaattacacatagaagtgacaatttgtaagtttaaggttgggtgtcatggaatagaatggaagaaattgatgctaaaaactttggctatgatggggcctttcctagcccaggacttgaatgattattaaggatcctttcctcacctcaaagcacaaacataaagattaccagacttggactggaaagcctttatcactaggaaaggggccatgtatttttacgtttaatcccttagacccatagtgtacgatgtgcacacagtaaatgttcagtgaccaaattttggttactctaaaacgaattcagtatttactttttgcctttagttcttcaggtagaggtaggacataatgtgatagagagcagttgaagaaagttaatttttaaaaccttagatttttttgggcttacttgttgagggaagtaaactacattttctctctctttttttttttttgagacaagttcttgctctgtcacccagggtggagtgcagtggtgggatctcggctcactgcagtgggttcaagtgagtcagcctccggagtagctgggatcacaggcgcatgccgccgtgtctgtctaatttttgtatttttagtagagacggggttttaccatgttggccaggctggtctcaaactcctgacctcaagtgacccacctacctcggcctcccaaagtgctagattacaggtgtgaaccaccatgactggccagttttctattactttgaaagcgctcacaattgacatctgtctctttgtattttttgttagagagatgaggtttcactatgttgctcaggttgcccaggctagtcttgaactccagagctgagtcctcccgccctggcttcctaactgcgattacaagtgtgcacctgtgtggctggtggaagtaatattttaaactattgatcatttagtgtctcctgtgcaggagattttattattttgagaattcatggcatcttccatgagagtttataaggacttactttaagtgaagatttcagtggtgtgggtccacactgaggcataaaataatctttttgtttgtttgtttcccacttaaaccagggtaaggaacaagaaatagcaatgttattagcaagttgcttgaggttgaacttcatggcttgctttaatttagcacaaagtacactaaatgcaatttaaattttttattgattactctttgtcataatctttacgagcatcagttacttccatgtggaaatgccatgatgcacttaacatatagaggctgagtgttggtggttgtaactttttaagttggggacacttgacactgaaacccatggaagctctcccccagaaaacatgggtgtttccttaagcacatccttggattctagtttaagtgtttaaattctggtgacttctttttatgatttctctgtgatccttttactgccactgttaccatgtattgtagttaaaatgcctgttgagaacagtgatttttctgcttattggtcattaacttgaaaatcaaataagaagcctgttagaagtttttaaaacttgtgtacactggctccaagtaggagcctcaggggttttcttttgagaaaaacccactggttttactgtggcctttatttaagttgcttagaggtctcctcaatgccttccttttgattattctagttagggacttcttttttttttttgagatagagtcttgctctgttatgcaggatggagtgcagtggcatgatctgggctcactgcaacgtctgtctcctgggttcaagcaattctcctgcctcagcctcccgagtagctgggattacaggcgtgtgccaccatgccctgctaatttttgtatttttagtagagacgaggtttcaccatgttggccaggctggtctcgaactcttgacctcaggtgatgcacccgcctcagcctccccaagtggtgggattagaaacgtgagccaccatggccggccatagttagggacttcctaaggagtgattgtgtctgatccttaattttgtaagctttcggttgcttgtccagcacctggtaattgattcacattgaactaaacacgcataatggtggtttataaacatcatactactgatcggttgatttataggacagatcagttgcctttctctgtaaagagccaggtagtcaatattttaggttttgtgggtcatatggtctgtcgcaactgctcaagtctgcagttgtgccagagcaaccatgggcaaaatgaatgtgaaagtgatatttatggatatagaaatgtaaaatttttatgaattttgtatgtcatgaaatgttctttggccctctaccctcaaccatttcaatatgtgaaaatcactcttagctcaaaaaccatacagaaacaggctgttgacccctgattggttgattgattgatttgagacagggtctcaccctgttgtccaggctggagtgcagtggtgtaaattccagggctcacttgatcctcccatctcagcctccccagtagctgggactgcaggcatcccacaccaggcctggctagttttttgtattttttgtagagatggggtttgctatgtttctttgttctcgaactcctgagctcaaaggttctgcccactttggccatcactccctggcctccccagatttatagtaagacacagcagctacttgattgtttctgctggtggctgagctcccttctaggaacctgaaaatgcaagttgaaattagaagtttgtttggaggtagttggctacgctgagggctgtgggttgtttttgtttcgctctttttgcccaggctggagtgcaatggtggttttttttttggggggcaggctctctctgctgctcaggcagtagtgcagtggcacgatcacggctcagcaaccttctggtctcaggcagttctcctgccttagcttctggagtagctgggattctgatcctagatcccttttgaggataaaatgtgtaagaacaaataccttggtcatctctcacaccctccgggggggtcaagctaagaagacctgtgtaagaggatatgtattataagattgtgttccactacagagggagataatgtcaagtagggtgtatgtgtcacagcaatcagaagttaatgcctaccactccgggagaactcatactcctgtggtagtgtttaaggaactgctgacacattcttccagctttaccttttgtgtgcttcactatgcaaaatgaatggcatttgtgaccatcttgccatgaatctgtgtttcagttttcaagttaacagactgttgttcattgattacattttcagtttttgctctctgataacgtatcatggccttagtcattcacatgacctctttttaaatcccagtgtacatccaggaggaagaagcccatagtccaggaatctgggaggaggtggctggcacaggaggagagtgcccctccacccacctggggaactggtctttggttcttccactgcctttgcactagatctacttatgtgtgtttgtgcaagttgataaacatgcagaaatccatgtactcctctttaaaagtaggaaaggtggattaaattattttaaattgtttttgaaatcctctctagctctgcagttaattatgattttatgggtttcttttgggaagatttctttttttttttgagatggagtcttgctttgtcacccaggttggagtgcagtggcatgatcttggctcactgcaacctccatctcctgggttcatgcaattctcctgcttcagcctcccaagtagctgggattacaggcatgtgccaccatgcctggctaatttttgtatttttggtagaggcagggtttcaccatattggtcaggctggtcttgaactcctgacctcaagtgatccacccacctcaccctcccaaagtgctgggattacaggcgtgagccaccacgcctggctttcttttgggaagatttcttctagacacaatctgtgttgtgagacttgtaggcagagtctacgttgtgagactgagacttcagcctcagagagtgctttctagaccttgcttctaggtttgagaccaacttaggtttccatgatcataataacgaggcttgtacaattgtgatgaaacgtttgttttcatatgtaacttggatgattgtgtaaatgttgtttttgtcaagtgtgtcatctaggttttcaaatatacaacattgggagtctctctcttttttttttttaaaacagtactttaaaaatttttggtgacttaacattgttagtggtaacggatagtttctgacaaccgggtataatcaaggaacaaagttcctgaaaaacagctgcatttcaatctgtgcacagtgtaattgtcattagctggtggagtctggtttctgcagaagctgatttgtatatcctgtataagaacatctggtttgagcatttaaaaatcttttaaaattaccctgtagacatttagcatttattggcttactccaccaaggatggaataatgggttgtagaatcctttctcatgcttattcttaccttcgttcattcagaagcacttggttttcctaaagtgtctaatgagcttttagagtttgatatgaagtgtgtaggtttgtattatagaaattagtacctggttcagagacccccaaggcagaatggaacacaaactcctgatttcagtgaaatgctttaaaaaataaacatttcatttttgtatattctgaagagattaatctgaccctagctttccctgataaattgtcagaaaactgagacgcggaataagacatatagggcaaatgggctttatctctcttggtgatagcactgtgttaaggaggattctgaagatatgtgcctgggggtgtggaaaagaatgacctaatttgtcaaccatgccttgccataggtggaaggaatggcataattgccagctacctcttgaacatagcctttttaaattttttccaaagtagtactactgtgataatggataaggagttgaaatggcttcttcttttttttttttttttttgagagggaatctcactctttttgcccaggctggagtacagtggcacgatctcggcttactgcaacctccgcctcctgggttcaagcgattctcctgcctcagcctcccgagtagagtagctgctaggtttgagaccaccaacctgattacaggtgcctgccaccatgcctggctaatttttgtatttttagtagagactgggtttcgccatgttggccaggctggtctcgagctcctgacctcaggtaatctggcccgcctcggcctcccaaagtgctgggattacaggcatgagccaccatgcccagcctgtgtatagtttaaaccctaattttcttgtctgggttagtttttttctattattattgcatatattttaagtgacctccttctaatgttggctgtttttacctgtttcaaaaacttaagcttttgaagtatgtgatgacctaatcaagcaaataggggataatagcattttatggcattattaccttttctcttttttttcttctgcacctttgcatcagatattcttttaaagcaagacaattctttgatactgcatctcaggaaagaggtggcatatacatagtttattgatggttgctcgttagttataggctggtgctttgcactggggcaagaagttgtgcttccaggtcttttatatagtgaagagcagggaagaaataaatctttactactggccgggtgtggtggtgtgcgcctctagtcccagttacttgggaagctgaggcaggagaatcgcttgaatccgggaggcggagtttgcacttagcagagatcacgctcctgcactccagtctgggtgacagagcaagactctgtctctcaaaaaaaagtatctttactattataagtgtagtacacaatcatcgtaaaaagttaaaatcatggccaggtgcagtggctcatgcctgtaatcccagcactttgggaggccgaggcgggtggatcacctgaggtcagagttcgagaccagcctgaccaacatggagaaaccccgtctctagtgaaaaaaaaaaaatacaaaattagccgggcgtggtggcacatgcctgtaatcccagctactagggaggctgaagcaggagaatcgcttgaacctgggaggcggaggttgcggtgagccgagatcacaccattgcactccagcctgggcaacaagagtgaaactccgtctcaagaaaaaaaaaaaagttaaaatcatattaaaggtcataaagaggaggaaaagttcccaactcagtctgtcttggaaccctttggtcacatttctcagagatgaccactatgaacatttatattctttcagaaatgttctatgaatatacaagcaattgctgtaggtattttctctcctcctattatatataaatgctcttatattttgggttttttccctgcagttagcctgtttttctcccctaatatgtcttgggcatctttccacatctgagcatttagatctaacagaaaagaattctgagtagatggaaataaggataaaagctcaagattggagaccatggtgactgactgccttttttgtttggttgtgaattcatttactcccatgtcaagggaagttaaaaaaatacattccaagtacaaatgattggaatgttttgtcatagctgctcttattcagttgctgactcttaattgagtcagcaattacagagtcctggaaggggtttaatagattgccttagagctcataagcagtgattggattatttatacattggcaaatgagagctgcttgtgattcattcagaaccactcaaatttaaaattccttaaagtcttgagaaatgctttcttggtttttaaatctgagttcaaaaataacttataaagaatttaaagtgaactaatgtattatagtacatgggctttatgagtaatgctcctaagagtaaatattatagttatttattatgtggtcagttatcataattttttttcttttggaggaggtggctattgctaatgtaaacttgtcagctgaatatttgtaagttttacctccttccagaggttctgtattagcttgggccagcattttccttaaataagttttgatgtatgacgttataaagagcacatttttttgcttgagatatttagacaagattaaaacattaacgcttaagagttaagctatttgtcagttaaatgtatgactttatttttgactagatataaccctttagttaaattgagaatctgtgtttgagttatagtcatagtagcatttttagattctgtgagcatatgaattagataatgttgccagttggaaaacttcatatttaagcgattaatgtttactttaaaaactgaggtaagaaaccagctgggtttccttcacattcatttaggggcaggtggacagattttattgtgaagttataggtcattatatttgggtatttagaactgtatattccatagaagacaaaagtgaccaattattaagaatataatgtatctttttgggggagtattctatgttcagtaatttaggaatcaaattatcaggtacctagtgtttaaaaaataatttgaactatgtgaacttaaacagaaaggagtggcagggcgcggtggctcacgcctgtaatcccagcactttgggaggccgaggcgggcggatcatgaggtcaggagatcgagaccatcctggctaacacggtgaaaccccgtctctactaaaattacaaaaaaatatatatatatattagctgggcgtgttggcaggcgcctgtagtcccaggctgaggcaggagaatagcgtgaacccgggaggcggagcttgcagtgagctgagtgagccattgcactccagcctaggtgacagagcgagactccaactcaaaaaaaataaaataaaagagaaaggagtagctcataaaatacttagttttatataagaccacctggtttctgaaaatacattctttagtacctttaggtattagattttagctatttgacagaatggaagggcatcaataaatttaaaagtgaatacaggagaagttattccagttaaaggtcaattagatattaaagtaaaagcatctcaaattcaataaagtggagtgaacataaggtaacagtacgggaactaaggcattcatccagtaggttattttaatacatagtattgcattgggtgatatataaaagtatgtagcggtctttaattgagtaccttctagaacttcttgagtgaaataaataaaaatggaaacagtagataaaactgatactttgagagagaaaccagcctttctgcatatgagccataagacaaaatcactaggttgtaatccttattatagctatagagtttatggcctgataaatgggccctgttccaccacagagagtaagtaattctagtaactggacagtttgttttcctcaaatcagtccttgtttcccaggaatagcattgaataaacatcctcaaattcttagttacctttccctttttttgtttcttttttcgagacagagtcttgctatattgcccgggctggggtgcagtggtatgatcttgactcactgcaacctctgcctcccgggttcaagcgattctcctgccttagcctctcaagtagctggaacaacaggaatacaccaccaaacctggttaactttttgtgtttttagtagagacggggtttcgccatgttgctaggctggtcttaaactcctggcctcaagtgatatgcctgcctcggcctccccaagtgcctggattacaggcgtgagccactgtgcccagccctcttattcttttgtaaaagtccttctctccttgtccatgacgttctcattctttcttagaatcatcacatcagtcatgaccacgcccaggtcactgaacttgttcgctcaaattcctgagccaccctagggatgggttccttcacatagtggctcctctgaatctattgcatgcagatttttcccagtttcagtcagaggaatgtaaatttcaaggttttcaggtgccttgctatctcatgtgcatgtaagcagtaatctggtgacttttatagcacttaccacactgaagccacttgtctagttatttgatgtttcctccaggtagactgtgtgctcctgcagtgcagacattccatatcttgttcaccgtatctctgacgtctaccttgataaaattttcctcaaattattatgttagctaatgtactgcattttaacccacatgacagaagggatccaaggagagagtaatctgcatataatctaaataggggtttgggccagtgggtaaagcctgtgtttgcatttcctgaggagatggttctccggcagctgccacagatgctcagttgtcttggtgcatctcttcgtgcagtgagtggagtagagacaccagaggattgttaagtaactggtccagccagggtctttggccagtggcctttccaggcagtgttctgtttttaatttaacttcctaggtagtcttcctctttttgggcaaactcccaaatgcccactaactagctcttttgtctctgtagctattatgtttctcgtggcaagtggacactccaggctccgataagctggataactttgcatcagttttgaggaaatgtaaacagaatgtcagggtgagccgtgtcgactggatccagagttctgagggcatctattgtagccacgctgagaggccttgtttctgaccagtctgagttggattcaatctctgtcccgtactgcaaggtcccattgcagtgttccctatacctaccatcatggtcccccttctctgttatgtctttttttttgaaacagagtttactcttgtcacccaggctggagtgcagtggcacacgctcagctcactgcaacctccacctcctgggttcaagtgattttcctgcctcagcctcctgagtagctgggactacaggcatgcatcaccacgcctggctaatttttgtgttttttttttttttttcagtagagacggggttttcccatgttggccaggcttgtctcgaactccaggcttcacatagtggctcctctctatctattgcatgcagataatatgcctgcctcggcctcccaaagtgctgagattacaggcatgagccactgcacctggccctatgttatgtttatttcatatttgacttgagagaatctgttctccagaaattactgtaatctttagagacacacacatgaaacatttaagtcatgatgcaaggcagtagttgattgaatactgacaaagactcctttgaccaaaactttagtcacgctcctccggtcctccgcgtgaatgggcactaccttgggcttctctttgtattattgttgaatccagttgaagcaaaaatcctgttaaaatcagtttagggaaaattcttcacctgggtatctgaccactctgtcctatcttatcctggcctgtcttcaagaataatcctatcaaattagccataaaccccttatccttgatatttctgtttagtagtcagtctcctatccaccggccccaccctcctccttggttataaatctccacctcttttggaatctgagttgggttcaatctccatccccctctgcaagatcccattgcagtgttccctgtacctaccaccatggtcccccttgagtaaaatctgctttaccatttctaacaagtgtcatgaggaatttttttcagtgatactattaaggtaacagtgcattgaaaagcaaggtgaaaaagttctaaaagaggaagaaagttgaactgagcagtacagaatataagtgtttggagttggagtggtcagtggctttgagctgagccccagaaaagtggtgggattaggatagggagcaaggagcaacaggagcagcattagcagagaatgagaactgaaagtaagcagagtgttcagggaagaagcctggcccaaccaatgcaagctctgggttttggggcttgctagaacagatgcctgagtaaagctgtgagaagtcagaaaacttcatttttggctggacactttggacttagacctatttgtaatgtggaatggagggagagatctgcatatagtattttgatgaggttgcctcatggggtgtagttaatttgttgttttaataattggaagtgggaagagatcatagtttggagaataggtgtttaaagctttctaggtacaagtagttgaagggcaaacccacagggcatatggggacttcagagagtcataacattatgaatcagtaaaccttggcaattggctataaggtgagaatggatgtgtatgaagatgctacccagagtaatatgctgtgttacacatatgttggtaagtacggtgctctgccccaaacatgcccctttttctggctacctcctctttgttcttcaggactcagctcagtcttaccagcctcctctgactcttatccaccttttgtattcctgtagaactccgcatttaccactgtcaggcacaaacagtagtgaatttccgttgttttcctgtctgcccaactaggccagaagctctgtgaggtcagggttagtaattttcatccagcacctcctaatatatgagatattcaaatgtttgtcggctgcattatgtgccattatatcttcttgctactttggggtgttgtgagtagccattttaattgattattacttatcctactactgtctagattagtaattagccattgccctgagagtcaggaaaggtgatgatgcagatgctggcttttagtggggcagatgtttgcagcatacaaccactgtattgtgtagctgaaagatagtaacatgtattttgattttctgatacagtaagtcatcctgggtgagataaatcagcttgatgtcaaggtttaagtactttagagccacagaggaggaaattctgctgagcactaacccccatactgtgccaagttccctggagaagcaaatacagcactctcaaaccctcattactcaagatcttcagcggatgaaaatggatttcattagaaagaaaatactatttttactcttcttttacttgaataattttgcttaagagagtatttatgtgtgtttaggtgcatcattgtattttggccaatgcttgcgttctttatttagtgactgttgaagtgcttcctcagggagttgtgtttgaaagctggaaagtaagcattttgattcaaaaagattcttaaaagctactctgttaggtgaatctaatttttaaatttttttatagagataggggtctccctgtgttgcccactccggtctcaactcctaggttcaagcagtcctcctgccctggcgtcccaaagttctaggattacacatgtgagccaccgcgaccagcctagtactaattttttttagcactcttttgtaatgttggctttggggagctgaagctgttaggagtgagtggtcttctgcctttcccttttcccttttacctcttgctggatcctgaggggacccagaggtgcattctctagaaggttggagagcttacctgtctgcagttggtgtttttggcacacacagggcagagaaaacagttgaatagggagtggaccactggtgtttcttggttatggaacctgagggctggagtgggcttaccccaggccaagttgcagattgcctggttatgggtgagtggggcttttggaaaagggatggagtgggttttaggacttgactatgcctacagcatgaaaccccagcttgtaaagcgtgtccataatatagctcatgacccatactgatcaggacttatgttcagcctttctcttggtacatcattttaatggcttttgaagaatcaattgataaacaaaaactttaactgggtgagtttctcaggaagaaaatataaaatattgcaattatagattagggacctaaatatttggatgaattgtgtagatccattttttaagtgtagtataggaaaaacttttcatctacttttttaggttcagttcatgcgagtctgaattaaatgacaaaagacattacaggagaaaaggcaaacttcactgatgttgatatttttatgtgccagatgtgggtaaagggaaggagacttcaccgaagagaaaaaacccaagaagagttagacctgaaggcttatatacaattttaacagagggtgataaattgtgaagtgactagtcaaaggaaaagggagtttaggcttttttgactgctcttttgtaggcctttttagagtggagctttggttttttaaaattgctttcttgttctatcacagtggttctccacatttttctttttttttcaagacagaatctcactgtgtcacataggctggagtgcagtggtgtgatctccactcattccaacctccgcctcccgggtttaagtgattctcctgcttgagcctcctgagtagctgggattacagatgcgcgccaccacgcacggctaatttttgtatttttagtagaggcagggtttcaccgtgttggtcaggctggtctcgaactgctgacctcgtgatcctcccacctcggcctcccaaagtgcagggattacaggtatgagccaccacacccagcccggttttccacatttttttctccacaccattcctatgtgccccacttctattgttgtgtgtatgtgtgtgtgtgtatgttgagacagggtctctgtcgcccaggctggagtgcagtggtgtgatctcggctcactgcaacctccgcctcctgagttcaagcgattctcctgcctcagcctcctaagtagctgggattacagacacctgccaccacgcccggctaatttttatatttttagtagagacggagtttcaccatgttggccaggctggtctccaactcctgacctcaagtgatcctcccgtctttgcttcccaaagtgctgggattacaggggtgagccaccatgcccagccacatttgcattgttaacaccacatcatacatattgtgattcccaatgaggaggaggttgggatgtacttttctgagagggtggatgggtaggtaggtgatggactaccatactttttctcacttgaaaaagctccctttcatttttaggattcattgaactgacagaccagtgccctaaagatgtcaggttgatcagtaattttaatttggaaaagctttttgtatttgtttagagagctgccctgtgtgaatataaccgcgagaccatctgtataagttcattactggccattccgtctcagttcactgccttcttacctaaatgcagcctttctcatacttgagggtagtgctagaattctgttatcatcagctacctgggaggagttggccaggtgcgctgggtctttgtacaaactgacttcttattttggctggatttgggtctatttgtcctgaagggagctgaggtgaagtggagtggaaatagtgttggatttggaattagaagctccattcccacaacgtgaccttggggaagttgctgcttaacctttcttggctttagtttcctaatgtgaaagggaggggtctggatcaaaattgtataatgtctgtggttccttcctgttccctctgtggggttagagatggctggaggagacatttgcattccattacccgatttgttttgtttctttcgcctttagggttattttagtaaaatttgcctgagaagcataatcatgcccagtgcagtgtaaatattcacacatccaggcacaaccccaccccaccccccacatgtacgcataaaatatgaatctgtctgtagtgaggaagcacagtacagtgttcattgctgtggatttttttctgcagtgcttgctgccagtcagctaaagattcctggagtagttatagtaataatgtcacaggaatatagaaagaaacctggcatctttgggagacctactgatatgtgacttctccacccctccccctccttttttaacctggtttgttaatgattgcacctaattatgtatctttggtctttttactgtttacaattcaaatgctacttaaagccatttgtttgcttttgtttgctgtaaatcctgggctgccatctgaagcacaacttgatgattgtgtattatcatcttgggttaagtgctgtctcattgctttgcaggctgcctgctgtttcccggggagatcatgaaacgaggtcgccttcccagcagcagtgaggattctgacgacaatggcagtaagtcctgctttgttgttcttggagcctaccagggtttgggtcggggtaaaaacatgattttttaatgtaatgctttaaattgctgaggccctttgcatgtcaggcaggtcagagaaagccaaagcctggagaaacgtacctgagtgtgatactgcaggtctgtaaccagatcttactgggtaaggttgactgcaggcaagcattcctgaggcttcctatttgttatcctgggaggaataatccagttccaagagtcactggtgtgtctggttttcctaaacatcatttatggtacttcgcagttgcgctttatgaaaggggaacttaatcaaagccaggtaatcattaactggttcaactcaatacaaggggaggttgaagactgcctagtgtgatgtgaaaattattaagtacaggttcttaataggtcgaaagtccctgctcttcacttggttttaatgtgactatattgaatactactgctgtctgtatctcagctctctggcaacttcatattttcacagtgcagctgagaaccagaagttagttggcttccaggcagtcaaaataaatatcacacagtgtctgtgtattgagaagctaacagactactcagagaagagctcccctcagataacagagggaaattttgtacctagcacagtgcctgagctctagcccgttagcttatgttttacattacaaattaaacccaggacaccttgaaagaatgtgtgatgggaaaggagctgggcctgctttcaaggaactctgctttagacatatgtaagaagagctctgatgtgaaagtcatcagggcagtaatagagatgtctttttgatgcactgtggaaacagatacagatacagattcagaggaggggagggcagggaaacctgcagaggagatgaaagttgtatagatccttaaggatgaaatactttttaggcaaatagggttattttcagttttctgtgctctaagttttcagcaagttaaaagctgcacattagaaagcaaggctttgctgctgtaggtgccaccctgttcagaagaggggaccaggaatatgaaaaacagaactcaatgtggtatttcggttggtgtgcttggcacaggcacaggcacggggcttttggggaggagaattggccgttatgggagagtgtcaggtgtgaagggcttgcaatgaggacctctaaggaattgagagttttagggttgactgctgatgttggcagcaggagagaagtgaactagttgagagagggtgtaggggctccagagcgaaagacctttcctcttatttcagagaaaggtattaaaggtctgtttccaagtgcaggcaggtaaagccacctgtccgagcctttgggatgccaccttctgaacttctgaggcgcttgttgtttcataaccctgcctacctgttttctaacgtttatagttttaggcattttactccttgaggcaaaaacatcattgggaatttcttctctgcccctgtgtggcgcctatcaaagtgtctttgtgagttataagtactctataaatgctccttgcttgagtacataattttgtcctacattaattaaaaaaaatagtcttgcctggcctggtggctcacgcctgtattccccagcactttgggaggccgaggtgggtggatcacaaggtcaagagattgagaccatcctggccaacatggtgaaaccccatctctactaaaaattagctgggcatgatggtgtgtgcctgtagtccagctactcgggaggctgaggcaggagaatcacttgaacccaggagacggaggttgcagtgagccgagatcgtggcccctgtactccagcctggcgacagagcgagactccgtctcgaaaaaaaattcttgcttttagggtgagaattagtcagaagactgcttggtgaattacctccatataaagataatgcccaataaaagcttaagagccctatttaaatatttttcttggcattgagcatcaggtgtatgctcactctgtctgctctcgtcactgcctctcttctttgggagagctgtgttagaaaagtttctcctggatgttctctcagatttagagccttctcttttctggactagcattgtcccataggatgagaatgtcctaatctagtgcaactgaggaactgaattttaaacttttacttaattttaatgaattaaaaaatttgaagacacatgtggctagtgtccactgtgttggacagtgtagttctggaccttggcttagtttagtccctttcagttgtccagagggtcttagtagcgcagaaggcctcatattagtcagctcaggatgctacaaaaaagtaccacagcccccggtagtttaaagctacagaaatttgttttctcacagttctggagactggaagtccaaggtactggcaggtgtggtttcttctgaggcctctcgtggtttgcagatggacttcttctcacgtgttcttacttggcctttcctttgcacaggcatcgctggtgtgcctcagtgtgactaaattggattatggcccaccctaatagcctcattttaactcagtcacccctttcaaggccctgtctccaaatatagtcacattctgagattggaggttagggcttcaaagtacgcatttggggatgggggtacaattcagcccataaaagccctagaagaccaaatatttctttttttttttttttttttttgagatggagtctttgctctgtcgcccaggctggagtacagtggcatgatctcggctcactgcaagctctgcctcctgggttcacaccattctgctgcctcagcctccgagtagctaggactacaggtgtccgccactgcacccggctacttttttgtattttttagtagagacagggtttcatcatgttagccaggatggtcttgatctcctgacctcatgatctgcccaccttctgcctcccaaagtgctgggattacaggcgtgagccaccacgcctggccaaatatttcatctaaaatatatatgttcaggatgggcatggtggctcatgactgtaatcctgacacttagggaggctgagctgggaggattgcttgagcccaggaattggagaccagcctgggcaacaaagcgagaacccatctctattttaaaaaaaaaaaaaaattccacctagaactctggttaggaaggaggaagagagtgtccacagtccccaccaaaagtgtgtctgtcaactcacaagtctgtactggcctccgtcaagaagctggggatggagaattaaggtaaatatttataggttatcaaagggttagcctaggctaaacatggaaatctggtggtggaggagaggaatgatagttgctagtagaaggttggctgtccttttgtcatacagctggttcaatataaagtatatattgatgctttacagccatgctgtctgtccacgctcaatgatttgataaggtggatgatggtagtggtaaacgcagagttctcattaagaacccctgaaatgccaggcttataaaaagatgcacatactcattgccatggaacacacccctttccatcccctctgaaggcagctggttcacagcctctgccaccaactcactcatttgcactggagccttccttttgtatataactgggtggcctgcgtcatggggtgtgcctgctgtccctgctttcaggtccacaaaatgagccctacctgggttaactgcccatactctgccttccttcagccgggcctgtgcatttggaaagttctgcttacaagaaagatagggtctatgcagtggccacacctcagcctctccagcctgcaggcctgacagaattttggcagcacttcccagcccagtgcacaccatgtccaagtgaaggagaggcagctgcagacgtcagcatggggctgcagcacgagccacagccatggctgggacttgctggcctctggtctggagccctttgccttgttttctggcctggtccagaggaataccagtgtggtatttacagttggggacggacaggcattttctgtgccaggtgcaagcccttatacagctgcagtcatagttgaagcctttctccaggtgccctggaggcccagccctgcagttggatggaataatgttggggtgtttgcaggcagcgtctgcagttgctgggcttctgggactgggtggctcagccagtctctgaagttacgcattgcgccagagcatggccaagggaaacaagtccttaattttctgctttccagcccaggatcctgtccttagggatttggcacatgtgggaatagggtccactaactactttcagtacagttgatccttgaacaactccccctaccctgcaaatcaaaattctttgtataacttttgactcccaaaaatttaactaataatagcctactgttaaccggaagccttactaataacataaatcaacatattttatatgtcatatgtattatatactgtatttttacaataaagtaagctagagaaaatattaacatcataaagaagaggaaatatatatgtatatatataaaatatactattcattgagtgaaagtagataatcataaaggtcttcaacttcgtcttcatgttgagtaggtagaagaggagaaggaggaagagaaggcgtgggtcttgctgtcttaggggtggcagagagaaaattctcacgtaagtgaactgggcagttaaaacccgtgttgttcaagaggcaactatgtttctaaaacctaaaggacataccatgttatcttcagtaaacctgtagaggctaatttaaacatcaagtaaccttgtttttatcaggaattatatattattgtttatctcaggcaaatagtagctctgatcagcactgtttttttttttttttttgagatggagcctcgctttgttgcccaggctggagtacagtggcatgatctcagctcattgcccgctcagctcacagctcactgcaacctccgcctcccaggttaaagtgattttcctgcatcagccccctgagtatgatcagcatctttatatatatgtagcaaatggtgtttttgttggttttggttgttcttaaactttggtgtctctcaaaggtccaaagggagattggtctcattccttacttcacaaagaatgatagaagtgtgctcatactgttaagattttcctaaagttatagagcaggacttcttattcttgtctgacttccttaaatttcagagatttgttgactttctttgggaagaaggtctggagccaggctccatgtgggccctctctggtctccctgtttctgcacctgagctagggtggaagcagtctgtcttcccacctatcagagccaggctctgccccatcacctgtgataaggaatgggcagaaaggaagccagctgaaattgaaaattagtaattttcccactgacttgtacttggacctcagcagaaatggtgggtgagtgtcaaatgtttgtgtgtcagttggttgaaggcctaagtgtatttaagtatgttgaaacatttctgggccagttctttgaatgtatgtatgatgcctttgtttgttggaagtggaagtgagtttggctgtagagctgggctacgctggggtaaaaaactatggtaggtatagggtcagcctctggtctaaatgacagttatatcagatgcttgtcttctgtcatgccgctaaaacaaataaacagtaactagattaaatttccctaatttgagatgggaattaacacagcattgctttagtctagtacaaggctagcttggcttttaagtaactcatagatgcgtttgtcaggtctgtgtgcccttgctgtgacaccagactgctggactcgatacttgccagttttaagcatcttactttgttaagctggtttaacacccctaaagacagataccagcatattatttagtgtccagagcagtgactgagacaggatgaccgctgtttgatcagtggcaaggttctttcatagtttgcattttgtggtgcagcaaacacgaagactgccattcattctaatttctgaacctttcatgcatggcacaacatgagaagcttatcacacaccagctaccaaatgtggaaggtgtgtgcagtatgtgttagatttactcttcaggttttccttattttagatctagggcaagacagcatggctatttttaatatttcaaaggggagtgagtgttggagatgtctgtataataggacctgaaggaacgttgtgcccgggcagggtccatgctcatggtgctacaaactctgtgccttttataactttatattaacccaaaggattctgttttaatggaagttggggatattaaaaacaagacaatgtttttccccactcagtctttcccatgtttaacatgaggtaatgtaatatagaattgtttttaacagtgtatgtcaagaattttaagtcctttaaatttgtcagtaaagtgaacttaactttaggtaataattttaccttgtgaatggcagtaaaatacttttagacattattagcagatttttagagttcctaactcctttcctgaaagcgaaaagaaagtaaaacaaaattttactcgtcatgtgcttaaattagtttgtcattaaatatcagcactctggaaacaaacaaaatgcaaaccaacccagtgtaatcttaccacgcggtttttaacaatagcaagcacactgtttttaataagtgcgtgatgttttgctgtagtataaatcactgactcctggtctttttagtatttaaaatattctaatttctggtttgaccccactgtcccacccccaatattttccagaaagtgtttataaattttgttttaattaaaaaggagtgttttgattttaataatattctggtagcttcctgacctcctgggaatgtctggggagagcctggctgtagggagaggtgttggtgtagcaatgtcaagacactccctttgagtctctagcctgtggccttccatgaatgtttctgtagatgtaggtgcattccaagcaggaaacagtggctccacaaatctatctttaaatgtattattgctttattttccttgagctcaaacgcatgtcttctattaggtgaaacaggagtaaattcttagtgcctgccaccttcagttcatgggttacagcaatggttacagcatgattgactgtcctcaacaatgacatttaaaaaaaaattatctacttttcaaagaaatattgagaatctgctgtgtgcacagcactgactaacttagctatgctctatgttgtaaattctgcgtcttataccagtggctcttgatagattaactttttggtacaacaagaaaatgagaaggaatagatcaccagcaaatacctgctcctggagatggaaggcagagcagttccctcgggttcacaaccccctcccagattctcacttggttcatcagcaaagtctaggttttatacagaccacttgtgtaaagtaaaatagaatttttttccccttactgttagtggatggtatctcagtgataaatgtttaatagctttattgagaaataattgacatacagtgagcctctgagcctcatatatttaaattgtgtactttgatacgttttgacatgtttatacccatgaaatcattgaaatcaagataatccttccctcccacttttctctagtcttccactgatctactttctgtcactatagattagtttgcatttctagagttgtatgtaaatggaataatacaatatggactcttttttttttggtctggcttctttcactcaggagaattacttcagcatttattcatgtttgcatgtatcagtagctcattcctttttattgctggatggtgttccactgtgatggtgttccactgtatggatataccagagttttttcattcacagtctgttggtggatgtttaggttgtttctgatttttggcttttctaaataagctgctaagagcattccttatgccagtgataatttaaatttagtttctttaccagtctttccctgtctgcaaagtgagtttaataggattaattttgcttttccttcttctgtattgtatcaacactaggtaaattaagaggaaaaggaacagactatttttgggtggactagagtttctcttggttattactattggataccaagtatgtagcatctttgtatatctgtttttaaaagcaaatgtggcatagacagcaattttcaggatttatgaaagcagtcctaggaaaagttttcaaatgagtgtcattatttgggttgtgttctatgccagcaaagctgcaagcttcctgggaaccttggaaactacttgggagggatcctgacagatcctcaggaagagacaagagggtcagaaaacctgagaatgaatgaatttgttgtttctgctttaaccctgaaagtatttgactctgaagaccctcttctccctacttcatgttaatttttaaagtatagcagtggagtgattctctaaatttctggctttgttccttatcatttataaccttttccatagtaattcaaagcagaggaggaccatccctttttgttctgcttctcttcccttccccagaccttctgataattccatccagacactgcgtgtgcttttcctcgtctcttctttcaggctgtggaccggctggaggatggcctccaggacaagagggagaaagagaggcctctttatagaccctaggagccacccagccaccttcatctccaggttcctaacttggcgtctgtcttccttttttccagtaatgaccagatttagaacttctgcaggttgggctcaccccagtgtgcccagaatatttctttcagtgtgggagtgaaatattcttgttcatttagagtctaaagaggcacacttagtatttttttaaagaagaattttctaaaacatttactgaaatgccatggggccaccagcaggagctccagttctgctgattgtgctggtggaacagcagtcagttgacctagtaatgagcctcagaactggtgctcaagggtagtgccgatgttgtccctgtcagggaagcatggcaatcccatttggtcttggtcatcgcaaatctgatgataggcttatgtgcagaatctatttcttaaggtccccaaggtcttaagggtgctttgattctctgttcctgtctctggaatctgtagagataagagcttcctgtctgagtgacaaatgatttcactggcagaatggcagttaaccttaagcttttttggcttttatttttctggattttgttaatttctggaaaatggtacagtaggtgttcaggattggggtgatgattattaaaaataggaggtggaggtgaattatcagaaagttggacaaatactacatgtgggtgttagggttgtttcagatctctggcagcagtacggcacccacaaatggaaggttttgcacttaagttgtctttgtaacaaattaacaggaggcagaggcagagatggagaagaggagctggaattattgggaagttgaattgacctaccattgattgtgtcctgaatgagaagagtctaggacaactcttagatttctgacgtcaagtagaaatggtggtaatagtcatcaaagtaggaatgtaagaggcagaacaggtttgggtaaaatgttgagctcagtttttataatgctgagttgacagatctaaggaataccttaggattgatgtcttatgtgaaggtgaaactggatctggagcttgggagggaggttagtctgggaatgtaggtctggcaggttcctctgggtgtgctgggtaagactgtggacatgggtgagcacccccggggagaatatttggagcaagaaaagagcaaagagttcaggagaaacccatgttgatggggtacatggagaggaggaacccacagagtggaaagagaattgccactgaggctgagggagtatttcaggcaggatggagttgttggtgctgagaagtgtcagggcagagaagagatcagacttggcagcagttgggagaccctgttaggcagcagttaggtaccatgttctgggggaggccagatgataggagtagacccccctttggaagaaaggcagagaacagagccaactggaattttcatgggaaagtggagcaaattttaaaggttatttggcaattggccccttagtcttcactaagtttgtttacctcccgtcctctcttcttatggcactatgctagctatttactacaccataggcctgaggttccctgtctagggattgctaagtttttaggccttgtagagtgaaacctttttttaaaacagtgttttagaaagcttcctgaaaactcagtaagatgtttttcttttcttttctttctttctttttttttttttgacagagtcttgctctgtcccgcaggctggagtgcagtgacgcagtctcggctcacttcagcctctgcctcctaggttcaagcaattctcctgcctcggctttccgagtaggtgggattacaggtgcctgccaccacgcgaagctaatttttgtagttttagtagaggtggggtttcaccaagttggccaggcaggtcttgaattcctgacctcaggtggtccacctgccttggcttcccaaagtgctgggattacaggcgtgagccgccacccctggcctgatattttttcaatttgtatttagcagcatgagactttgaacctcttcagtgcaggcttatgggtgaagactacacctgcatggtgttcttaaagtcctctcttctgttgggtgtggtccttgatacagcatccctgcacagaatgagcacattaggcctgcttatgagaggtgagagttaaataactgatggacgtggaagagctctgtgagagccaggagggcatcacaggtggtctcatggtgcagtgctgaggtgagcctgggatgagtttgggtaagaaaacccctgagaacactcagtgacccctgcaatttctaatggttcttatttggatatttgtttctttaggcctgtcaactacttggtcccagaattcccgatcccagcataggagaagctcctgctccagacatgaagatcgaaagccttcagaggtacttcttgaatgcttgcctgaccgtgcatgaatatatgctatcccatatgcctagttgagtggtatctatttgtgcagtcctgggcaaattattcaaatccttgtgctccagtttccaaatctgtaagacggggagaacacaagtgtctacctcataggattgttgtgaggattaagtgggttaattcacatagactaatacatgcaaagcatgtgaatagttgctggcacataaaaagtgctcagtaaatgttagttattattattaattacattctttttttcctttcttgttgcatcttcgctggctcccaacaacttttcttcctctggccaggatatcagcaggttcagctgctgccaagtcactgccagcctcaagttagttttagccatgggtttgtggcttatttggcaacaagcaaaactctgggacttttgtttaggggattatgctgaaggctttccccattctttctcaatttgtttctcatcttatgtttcctctgctccctaacttttgttatctatctatctaaagttgcttttaggtgcatttctttctgctggtctttgtttaggggtccttatgagacctgaggtctgtttattctaaagacttttgctaggctttaaatcatcgaagaaaaacattttattttatcacagttttcaagtgagaaggttataggaagagtttctttggttgaatgctttgctttgtgctgcttcttatgggatgagttcacaaacagcctcatcctgtaatggcaatgcataggcagatattccttggaggaacttcccaggctctaatagggaacgtcagaaggctgccctgctgtggagtggaggagttatttggttgtggaatagcttcctccatgaggaagtagtttacatcctttagaattgtggaaaaccatcccaggaggcactttagcatgagatcaaatgtacttgggaaggtagccacttcttccccttactttatttcaggccttttttcctttgaacctttagtgctctcttccttttctttgccaaggagtgtctctgctgctctttatttcttaattccttgtgctgtgtctgtaacccccaaaatacctttctgatgttcacactaaactcctgttacttcagcacaggaatacaagggggacttagcagctgtgacctggtgtgacgagggctggtccccagtggtgtagttcgaaacctacttccagcagtgacaccaagcatggagaagggggcccagcagcacgggttgctgtgctggctttgtcccagccctacattttggtccagatgtttttctcaaccctgagtccaaactatatgtatggcactaacatactctaccagagactccagagttgacgtccatttgagggcctttgtttcagttcttgactgagtctttgagcaaaggaatagcaggctgcctttttttcatttcattgcttcagtttgattttctttcttttttggcaaactcctttgttttttatttatatcagttagttggaatatgtttttacctgattggctcttgaaggtataggcccatctcttaggttttaaagtacttttctcttgggggccagggagttggtgtccactgggctgggcacctgcttctgcggctctatgcttgaagggaaggatcctggtattacacgtgatttttgtgggaggtgcatggcctaattcttgcttgttaataggtctttagaaatgaagagtggcatactggggaatagtccgtatggaaaatgacaggcaggagaaatggcctctttattcagacactgcctcagactttattatggggaagtttattaaagtgatcactagcctgaaaagccaccaggaaaaacaaatatggacctattagcaggcgtatgatgtgaactgtgcttagtagcacaagaaagaactccctgtcctgagaaaagagagttcagcattgtgacttgtgtaaacagacagggcagcttacagatgcaagcttgctcgatgccaaacacaactttgggctggtcctgatgtcaaggtcagagctttcttatgcagccttagacaccagtgggccaaggacgaggcttgagagggagccagctgtgcagccctggctgggaggcggtgttgtgctccaccccaggggcaggcctcactgaccaaggatgaatgccacaggcccaggagtctgcagtggcataggcactgggatggctgcctttcctgtggtttccttcatttggcctgtgataaggaattggggagctctctcggtagaggggcactgttggatctgcctgtttttggcagagtggggagagggtagtgactttctctatttcctttccccacaaataactcttcccaggtagaagttttgccaggtgaaggtgtgcaaacatgttttttgcaggcccatcaacccagtggcctgtggttgcttctcttccagatttttctaggccagcccagaccttgacttcaccagctaccataccataaaccctggtgccctgggaggtagggcctgggtgggggcagtctcattatagaaggtgagtccctggccaggagcagtggctcatgcttgtaatcccagcactttgggtggccgaggcaggtagatcatttgaggtcctgacctcaatggtttgagaccagcctggccaacatgatgaaaccctgtttctactaaaaacacaaaaattagctgggcgtggtggcgtgcacctgtaatctcagctactcgggggtgctgaggcaggaggatagcttgaacctgggaggcagaggttgcagggagccaagactgtgttaccgcactccagcctgggtgacagagcaagattccatctcagaaaaaaaaaaaaggagatgagtccctggtggttctgggttttggcttgaagttgttacatggttagtggagttatatttctagagcacccttgagtgcagtatctcccttcagagatttccaggtacatgttttcagcagcccttttggtgaactgagagacatttttcagaggcggacaacaagattttttgttgtttttgttgacgttgttgtggacactatggactgagggagtgagagggcagtgttccctcagcactgccaccccccatgcctgagtgaggtaaaaggcgtgtcaggcaaagtttttctgtaataggtcaggcttgttctatgttgatacagtgaccttgttacatggcagctccatggttacattgcagctgccagcactctgaataagaatgcaaatatcaaatgtcagtgtccctttctcttcctttccaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggtagagatgccctgaggacagaagcctctccacccacccttgctcttcttccctgacagcaggcatctgagaagagacaatttctgtgggaagagacagtttctgagttagcattaaaatatcatgaggcctcaagtggaaatagaaattcaggagcaacatacttcaggcatacagggtagtggttttgagggccatgagcctccaaacttaacattacagccaccactgtggggaggtgctgctttcttatgagaggaaggcaaattccaagacatcctgggaagtgatgggctaggggaggaaaatttgggtgttcacacgtctgcatcctcttttcctgccctccgtattcgctctggagagtggctctcctggagagaagcatctggctttgttgggaactagcgcgggcagctgctctgcctactgcggttgcctctgcctttggaggaggacaggtgttaggagacctgtcagttagggtttgtggagaggggagttttggagggatttattttgactggtcacattattcttggggtacgttctctggatttactgacttatctttaaggatccctcagggtcgagtccctgccgactctcctcacaatcaggttgcagctagtttactcatttcctcactgtgccactctgtgccacctggagagtcctgttaggagggaggcttgagtgccctctgtgctcagccggcacctggcttctccgccatcatcagttggctgctgctttgcgaaatagtgtctttctccacgctgagtcattactgaacttgcttcctggccctcacccactttgtgtctctttttttgggcacttaagattatcaaatttgagttgtcattttgggatctctggggagtctatccagtggtgacaaatgcccctgtcttactcaggtttaggtgaccagtcaggagtgccaggatggcccccacaggctagagtctggacctgtggaatggagtggtcatggggccctgcggggcagaccaggtatctgcctcagagcctgtgtctgagatgcagcatcacctgattcagcactggcagccccagtccaggaatcacttgctgaatgcttcactttcagtggggagccaggacagaagtgagcattaatacagcttgtggaagttttacaagctgtattaaagttggagccctgagcaagttggatccctgctcttggctgagtaggagaaataaatcccttcagtttgtccatgtcagtgtcacgtagataaaatcactcccgtaatataagggtgatgaaggtactctgacagactctgggcagcctgttgacagtaatttaaactgtggaaatgcatatgtggaaggactttgttgaggcctggggtctgtgattaggaagatggcctttttttggttccaagtcgggagtgatttgctcttgcacatgcagtcttattttgagtggggtgagttggaaggcaccactccaggtgttaaaggtcgggagagattgtgtggcagtaccaggaggagaaacttgtgcttttgttcctgggatcatgggtatatgttgggagagtcagtccccttcttggctgggactctgtttcttagattttttggtaatggccggggtcttatttccttttttttgtttgcgtttgagacagtctcactctgttgcccaggctggagtgcagtggtgcaatcttggctcactacaacctccgcctcctgggttcaagcaattctcctgccccagcctcccgagtagctggggttacaggcgtgtgccatcatacctggctaatttctgtatttttagtagagatggggtttcactgtgttggccaggctggtctcaaactcctgacctcaaatgatccgcctgcctcggcctcccaaagtgctgggattacaggcttgggccaccttgccccagcccaaggcctgattttcttttccctctctccctctttttttttgtgaggtgtgagggttggcgggtttctccctctggttctcagagtctgctgcgcctgccctgcctgtgtggtgccctggttctaatggcctccagcagggatgggcaggtctggttaagggaaagtgatttaatgactaactcttgaaatgtatgggtcagtgtgttttggtgttggctgcaggccagagtggtcagaggtggtgggcagggcacagcagggtcccgggaagcagattttgaaggcttctacagtgttttcatttgtatctattgcctgttagcaggctttaacaacttctagttaaggttttattagcagtgacattcaggttttcagcctctggtgatgacctggggctctaagggttggaagaggaagacatttggggccttgtggcacacttcattgtctgtggctgaaagggtaacctggctgccttgtttttttattatccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggtgagagaccatgtattctattattttattaaccaatgatgaatagagacattttaggcaggtaggtgagtagcagaaagctccttattgccagttgcaggcagctccatcatagctttagtcagtgagaatcgcagccctgccttagatctcagcctgtttggctgtgtcagatgtgctgagatggtttcagagtggaagcaaggctcctcggctcaggcaccagggattcccatccccgctctgatctaactccctcattcacttaccttaaggaagctgaagtccagggaaacgaagtgacaaaagggcatggcccacagttacctgctctagtgtttttttcctgtgatgccattcggattccttctttagccgtggtttgctgcttctctaaatgaacactcttccaggcatgctccccatttccaagcacatcatgtgtgttttaacttgagcgattttccttatgtcatgctgcaaacctggagttctttttccctccgtttatctctgtcctggctttccttcagtgaagcctgacattagctgtgtgcccagcccttctccacctcttttctgcaagctcattttagcgtatgtagacgttggagcatctcatggtgttgagactgggatggcgtataggtctcatctcacatgccagtcctgattgctaagggttgccttgagggtcttgatgaacaagacagtggagtcaagtctgggctcagtgtgaaaaactgtgaggattaattagcttttgtgctgtaggtacacggtggggaggtggtggcaagggccatgtattgtaatctaggacatagtaaataatcacaagatcggccgggcttgttggctcatgtctgtaatcccagcactttgggaagccaaggtgggcagatcacctgaggtcaggacttcaagaccagcctggcaaacatggtgaaaccccgtctctactaaaaatacaaaaattagctaggcgtcgtggtgggtatctgtggtcccagccactcaggaggctgaggcagaagaatcacttgaggtgattcttctcaagtcacttgagggggtggaggtttccttgagccgggattgtgccactgcattcccacctgggcaacagagccagactccatctcaaaaaaaaaaaaaaatcacaagatttttgtcatggtggatttcacagccttgaagggccaagaccttttgcgtctttccagggaacgtagcatagggtgtggcttgcagtagatgcttgtcctgccattaggctcaccacctgttgaatgggagtgataatgtagactgagctgagcatggtgttgtcttctactcgctcagttactcaagtgtttttatagacaaaatagacttccttcttcttggtcctgctttaggtattaatggccaaaacattagcaggccacaaggtggttttatggcatgagttcaggagttctcagagatcttttggaattgaatactaaattttagcttcacagatgatacagtttctgctgtgttgtaagcacattataaagaccagtgtaatacacttgactggaatctaggtgtcctgtgttaagtcagaggactcagcccaaagactcttcgcatttatgaatggtttaaataataagaactgggctaatccatatttgaagatactgttgaatacattggcaagattaattttgtaattttataacataaacggaacgcatgcttaaatatgtttgtcttagctgttattggtctttttttctttcttttttgagatgaagtctcgctctgtggcccatgctggagtgcaggggtgcaatctcggctgactgcaacctctacctcctgagttcaagcgattctcctgccccagcctcccaagtagctgggattattggcacctgccaccatgcctggctaatttttgtatttttagtagagacaggatttcgccgtattggccaggttggtcgtgaactcctgacctcaaatgatctacctgcaaagtactgggattataggcatgagccatcgcgcctggtgtttcagtcttttttgcatttggttaactatgtttttcaaccttgtagaagtaagaggatgaggagggataaaccatttaaaaatatttgagtgcccaaagtgaaatctgttttgagagaactgttttacctaccaagaaaggcaaatttttaaaaacatccataccattatatgaagtcatggttttgaagtcacttacgtgttagttgttatgtgtaatgagtataatgaaatgacttattcaacaatgtatgtatttaatatccttgaatccttttaaaatttaccttttgcttttccatttactacactgcatcttcactacctgaccataggaaaataacagtttcctggaagactctcccctttgaagattgtttcttagaaggatctgataagcatttaataaaaaattttggggccctcagagatggatgcatcgatgggttgattgattgatagattgagacacggtcttatgtcactcagcctggatcacagtggcacagtcatggctcactatagccccaacctcctgggctcaagcagttctcccaccgcaggctcttgagtagttgggactacaggtgtgtgccaccacgtctggctaattttcatattttttgtagagatggggttccactatattgcccaggctgaccttgagctcttgggctcagatgtgagccaccacgcctggccagtgattggatttatttattgtacaattatttattcattatacattatttttaagtataaataaaccagtactattttgtaatatttattaatatggatttattaaaatgggttttgtggcatttttaacttcaggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggtatgtggggcagggaggccagaaagaagaaacctggggcatgagcctgtctgctgtgggagtgtatgcctggagtccaggattcttcctccgaatggggtctgtgtttctacgatttaaagaaatgtgccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcccttccttgcctcttcgtagcttatggtgatttgggcaatcttgggcattccttggctcgcggctgccttcatcatcatgtgtgttctccctgtgtctctgtcttcacatggtggtcttctttttttttttttttgagatggctggagtgcaatggcgtggtcttggctcactgcaacctccgcctcctgggttcaagtgattcttcctcctccgcctcccgagtagctgggactgcaggagtgtgccaccacacctggctagagatggggtttcactatgttggccaggctggtctcgaactcctgacctcatgatccgcccaccttggccttccaaagtgctgggattacaggtgtgaggcaccgtgcccggtccacatggcggtcttcttagaagggtaccagtcgtatgggactagagacccaccctacttcagagtgagctcatcttaaataattacatctgcaatgactacttctaaatctaaagaaggtcacattttgagatatttggagttaggacttcaacatgtcttttagaggacacaatttgccgtcatatttgtgagcatgtgttagggtataagctgagctgttagaggaaagcagccccttttcctgaagacgatttcctgtcttaaaaaacaggacagtaggttttggtgattgcttgctaccatccacagaaagggaaacccttagatttcaggaggatgggcgctaggtaacttaaaaagtttatgacaatctcagtgcctcttttttatttagtttttaatgcagtaatgaagaaatttggatttgggtggggacatgtgcccacgtatattcttaggatttaaaaggctatcctgaagtactttctttaaattcacctgttgatgctgagatttaaagcaaacttaaaagaaagacttgtatggaataggtgcttggtgacttcttgggaagaagaagcacgtttgctccatgaagttcttgattaccctttgcttcataatttgtgacctcctaggctttccctctgtctgaagacctccccagctgtggcccagtcctggctccttgatagggagacctgcgactcctgcttcagtcatcgccgtctgttgctctggatctcacactgtctgggaagtctccttacggtagtgagaattcctgtggtggctttgttctgtgacatgagcatcctgatgaccagtgttgcttttttggttgctggtgcttcatgtatttacttggctgacttctcagtctttttcttgtctttacttgctatttttttccccatgaaaaatttttttgagtaaaagctttctgcttgaaaactggtcaacccctgtgttatcagtgagttaactgatgtcagggcaggcttgtgcaagctctcacggtggacgtgtggcagagttgtaacttaaggcttttggatgcccccttctcaccttctcttctttctgccatatcaccttttctcttttcctcaacatttacttcatttttcctttgagaaatccttcatggcttatctttaaggcatactttatgtaatctcctaaattaatttagacctgcttttccaggaaaaaaatttcttccttcacatgtggctgtagaatgtctgatacagacctttagtgttttgaaacctttatagtgtcacttaactccattaaaaatttttttctagtaagtctgcgttgacggtagcttatttatggcccccaaacagcactctgaggcttccatctgaagtgtgacttttctttgctcaactctcatccttgtggtttcctctttgcatcgtcgtgggtattcagattgcatagtggctgtgttttttctgtctgaagaattagagctatgctactgtgactctcgacttcctgacttccaggtcatttatgaataaagtgctgaacagttgggtttttaaagggctctctgaatatgctcctggtaccatcgtggtttttatttattcagttatttaacattaaccttttctgtctttgaactgtcttaattactttagttgtaatagccttgatttctgcagtttatgccatcttgtttaattttgccatcttgtacaaaacaggctttgttttattttttaatttaaattgttttttttgtctccatttctgaaaggctgaatttgttttaaataccagctaaggagacgacattcttcctgtgtagaaggtctcctttttctgccctgttttgttcactgggagagtgctgggatctagttggtatggagtttgcttagcctagggagtgtgcatgcttctctcctgttccattgccatctcattcagcagctttgggagattctctcagctgctgtatgctttttctccacactctgtattccaccccacctctgtcagtaaagtagagaaatagcttctctcacggaaccctgtggagtgtttcgaggacttactgaggacttactgctcaatatttagaaacttggtatggatgggtttctgcggcaacacagcaaagcagatttcatttaaacctttctgtcctcaagtagtttccaggaccaccctctgctaaataaatatgtattgtgtcagcagagctcacctctattatgaatacatattcacctcctaaatgctcctgtgaggctgccgggcattttcccgaggggagacggtcgtagccaggaagctgtgggagcgtctctgctttggtggtagttctgttaaaatctttctaagtgtttaaaatgaatagatataatgggaaaaataacattttctctttctctctattcctctgggatgtgccgtggcatcacaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtacgtgtggttctttttttgttgtttttacttttttttaagacagagtttaactctgtcgcccaggctggagtgcagtgagctggatcatggctcactgcagccttgacctgctgggctcaagtgatcctcccacctcagccttttgagtagctgagattataggcatgtgctaccaggcccagcttattttttattttttgtagtgaggggatctcactttgttgacctggctggtctcaaactcctgggatcaagcagtcctctttccttggctttccaaagtgttgggattacaagcgtgagccactgtgcctggtcaagcatggtttttaatagcaccttagctcagaaggtcctggcttttaactgggatttagtgggtgggtggagaaccatgcataaataggcagcattgcagctatgagtaaaaagataccttttagttgctacctttttccttgaggaaaaactgaatcttaagcacactctcatcttgtcatggaatgtagattcatggaaatgttagctggaagcagcagtcacttgggactggaagttagtggtggtcacccagccatcacagtgagccttcccatcgcgactctcactctcaggagcagacctgtagcacttaaacagctgtggcctgggtgtgtcattccccaaggatcagctgtacatcctgtgtgtggcaagctgtacttgagttgaggcaccaccatggttaaaaaaccaccactcttaggcatactttggtgatttttatttaaactcttattgtgcctcaacctttttaatttcaggtctggtctaatttatttctagtctcagaccttgactaatataatttgcatagctcagtgtgagaatataatttgctattcaaattccagcatgttttgggtgtgattttggtacattttcctcttggggaatattatttgaggatgatttggattgaggtttcatgattcgggtcttggtagcactgagtctcgtggtttggtattgatgggatacaattcggtgatccaggctgaatgcagagatgataccttatttatctttgtaatttcccatcttgaatgtagtcatgtttcagactgaagaaaatggttttttttggcgagagattaaaaacaggttatatttacttaccctgttgttgacaacctatttgaatcgatttaagatggatttttagtcttcaccaatttgttatgagctagagattatagacggcattgtcctggtacatgactctttgtcatcagacgctccggtgagaagtgaaaactcagttatctaagtgtttttgacagacagggatgtctgtcagatggggactgggctgtgagctcagttgtcactggggctgttctgaggcttttaaagtaagggtttgctttgagtgggtgccccttgccactgtctggtaggagagatgtaggaaagtaatggatcttttagtttctgacattcatgttcagcctttgacgacctgagccaccctgtcttgctgttttccgacctttaggtgagcattggcagcccagagaagatggagcccatcaccaaggtgtcacacattcccagcagccggtgggcgctagtgtgcagcctctgcaatgagaagtttggggcctctatacaggtaattagcttcctaagaatggcttcattttcctttcctgcgtggtggggagcaggatgagggaaggctctgtgaactgtccaagggtttggagaggggactagaatccaggaagcaggacgaggttcccaaggggtgactccagccccagtacacacacctttaataggctaactgtatccggtgtaactagaacccaagctttcacagtcacagggtagttcagaagttcccctgagctgtgaggcggttgcagtttgtctctcgctaccctttctgcccaaagtctagcatcgcaacttctttccataggccaacacctcctagcagtcttagtgagatgttccttgacacggcatttgagagttggccaccctcccacctgcagtcactgagtgtagctgcagaccctggcccacctctgtggcggcctcctgagattgcaggtttccatggtgtgcgcacatctgttagtaatcaaggggacatgctaatgcatttgcagttggaaaaacagagactctttgaacacggcctgggtagaggggcatctgtgaggagttcctgtgtatgctgtcatctcattggggcatcatttggatgtctgattctttatggcaccaggcgcgcatgcacgtgtgtgtgtgtgtgagcgtgagcgaaagagtgcgtgcacacctgtgtgtaaacatgttgcctgcctgcttttgcatatccaggtacagacaagtataggatgtcatgagataggggaattaaggagggaatatagatggcatgctgtttttcatgtggtctaagaccctactgagaagttcgtttttaggcctcacattattgacatctagacagtcaggattagagaggcctgcagtgctgtgtggctgatgggggcccttcaggttaagtttggatcttctcggatgtactagcacaggccacaggctcttcttccttggtttcctcattgaattctgggagcagaggcactgttttgggatggcttctttctcaaagcagctcagcacagacataagctccgagagcatggtcatcctgtcagccatgggttttaaagaaatgacctcatttggcaaagtcggtttgtattttgactgataaatactttttgggaaggtggttttaaaatttttttttttttttttgagacagagtctcactctgtcgcccaagctggagtgcagtggcatcatctcggctcactgcaacctccgcctcccgggttcaggcgattctcctgcctcagcctcctaagtagctaggattacaggcgcgcaccagcaagcccggctaattctcatttttgtatttttagtagagatgggggtttcaccatgttggccaggctggtctcgaactcctgacctcgtgatccacccacctcggcctcccaaaatgctgggattacaggcttgagccaccgcgcctggctatttttaaatttttttaacaagccaagtggttctacttttcttctttatcactttgactagtgttcaagaatccaaaatataacagaaatatttggagggtgggtcatgagacagctggtgggatttggctggggaccttgaaatagtggagatatttttggcatgtgaatacatgacaaacgcctctggcccgagttggattggggaaggaggaggaaagagtggagcaggaagagaaaagggcagggagctgatgaacttgagtgtgtgtgtgtatgcatgtgtgagtgtgtgtgtatgggtgtgtgtgtgagtatgcgtatgtgggtgagcatgcatatgtgtgcatgtgtgggggtgtgagtgtgcatgtggttatgtgtatgtgtgtatgcatgtgtatttggttatgcatatgtatgctgtatgcatgtatgcgtatttgagtatgcgtgtgtgaatgtgtatgtgtgtgagtatgcatgcgtgagtgcgtatgcgtgtgtatgcatgtgtgcatatgtatgcatgtgtgtatgcgcgtgagtgcgtgagtatgcacatgagtatgcatgtgagtatgcatgtgtatgtgtgtatgcgtgtgagtatgcttgtgtatgtgtgtatgcatgcgtgtatatgtgtatgtgtgtgagtatgcgtgtatgtgtgagtgtgcatgtgtatgagtgtgtaagtatgtgtatgcacgtgtgcactggcaggaaacaggctgcagcagaccacattccccggtgttctgagcgtagaatttatgcccttgcctgagtatgccaatctggtccataattaatgtttaaaagaggtgggcgaatgggatctttgtttcccttttgaagagagatgatataatgacttttttgttgccattgacctctttttcccagaacattaatctaaagaagaggccaaagaaggctgatgatttttcatatcttcacagaatggattgattttattaaaagaattcctctctgaaatgtctgcagctgtgaaggctctggtttacgtttctgtaacatctgtttgctgagtcaacctgaatgggaaaacccagaggaaggccatttggcgtttttacaaagtcctgtataaatattctgctgcagttcatttctctttagggttagagcgcttgggttaagtgtagtttaagccaaacacagatagtgtctcagtcatctgttcccacttttacttcccacttggctgtgtgctacaagggaagacactttgtcttctcatgacagtggccaggtgtgtatgtgtgcgtgcttgtgtgtgtgttctgccaccaaagctgatttcatacatttcttagaattgaggttatttatagagaaaatacagatttatgtcagtctctgtggttgaagtgtttgtaagggtggaatggtgaagggagctggattttctcctcttctcagtaaaagagacctcatagtaatggaagaaagcctggttggcagtgagtttcctcttaaatactggaatgattagggggaaagcctcagctctagcctctgccatccttggtgatgtgattcaggatctgttgaatgagttgaattcaacttctcagttggcttgaagccgctggattctacagctctgtgcagcccctggcatgccccggtgatcacttggcttcacacaatgcagtgctgcttttcagggactggcttcagtcaccatgaggaaccaccttctagggatttgctcagcaagatcagtggaggaggagttaatcactttgctcctgctagaccagaggcttgttgtctggatcaaaggcactaaattgtggccctgtttaggcagtgagaggggaagtgttcttctgcataggttgctgatacctggcctctacgttgacctccctgtgacgcatgggaaggatctttcacggttctcctgcctctcttcagtggccaggatcggcgtgcaccgatctcagggctcagagccctccatgcatctggtgaagcttcttcgcaagtgtgaagacctttccctacctttcctgtgctggattcctcttgtctcctattttttggggtttttattcagtttctccttcgtgctgcttcaaggaagtgcactgttcattttctcactcgtgttgggactcttcctggctggggagtcaggatttatgttcaaactgtgagtagtagtcattcttcccaaggaggttcttattcaggtttgcaccaaaagagctcaaatctgtaagaaaacccaagttaatgcctgaaagtggactttgcatattgagtacagattcttttgaatatgatcctagtgccacacctcctttctctacacatgtcatttgtgtaatcatgtctgctccaagatgggatttggatgcagttacttttctgaggaagttagggtttggttgattaaacctttcatttgaagagggcccttaaattccaagacttggctgggcgcagtggctcacgcctgtaatcccagcactttgggaggctgagatgggcggatctcttttgcccaagagttggagaccaacttaggcaacatagggagacctcatctctataaaaaaaattccaagccttacctcttttaaaacatgacaggatcttgcagggttaatccacgtacaactttcctgtcatggcacatgcttgaagcatggctcttctctgtgcatgtgtacatggggtgcctagcactgcaggccttctgccatcattgctctataatggtctattctcatgttctttgtgtgttcttgacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgtatgtgtgtggcattacttacatttactttattaaaaagcctaaggaactttaaagaatttgtattcagtttatttttattttttcaagacagagtctcactttgttgcccaggctggagtgcagtggcgtgatctcggctcactgcagcctccgcctcccgggttcaagtgattctcctgcctcggtctcatgagtagctgggattacaggcgtgcgccaccatgcctggctaatttttgtatttttagtagagacggtttcaccatgttggtcaggttggtcttgaactcctgacctcaagtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactaccaa

SEQ ID NO: 542 - DNA, 65601 bp, Homo sapiens
gttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggtacgcgcgcgggccgcggggggcgcgcggggtgggcgcgccgcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagtaagttttattatgattttttttttcaaatttggggggctgaagacttagagctatttcttcttttggatttgcgaagaacatgcggttttcaggtgaatcatcaattaaacgcgtttaggagcagaagcccagtttaagttggctttagtttataggttttttttttttttttttttttttagaaagccaaagtgcattaggctgcatgaaagtggaaagcatagtagcaacttggtagacagatggcaatggcagaacgcaggttcgcgtacatatatgaatccagagtgtgtgagaccgtgtgtgtggtgggactgtatttgtccaaacataggtgtgcgtaggtacatctgtgtgtggtggccgcagccctggctcttgtcaccgcgtcaccacatgtccaaaatattcattgcatcaattcaagggcagtgagaggggggtgggggtgggggtggagggacagtttggcaattagattcttccgaactgggcttccagtgatcagatcttttacttacagcgcgactgcttgtaaagtgtaaaaccccttaatcgatgaaatggggtaggagttggcgttggtagagcaaagtaccgattaatcgtgaacttaaaggggattgcaaattgcaacctttggcaccatctgcaaattgtgggggtggggtctcttggtctccttgcttccttaaatgaacgtgtagtgtgtaccccgggactgcaagttgcagagcccttcagtgcacgtgtcttgtgcctgtgagtctgtgtttgcgagttgggggctgttgttcggtagccagcaggctttccgggttgctcggcattggcttgcaaatgcgggagagggatggaatgtggaatgttgaccggggaaccgaatcctgtcggaacggtcccatttgctggagaaattcgatcccttccacctccttcccgctcccccccgcccgccttcgggcaggaggcggggctgaggacgcggctgctgctcaaagtggcggagcgcggcggcgggaggcaggtgcacggcacccgccagtgggggtgcctcaacttccgcgggcgtttaaatagcagcctctctcccctcccaccggtaataggtgacctggcggccgagggcggcgggggagggaaccgggggagactcgggagcgagcctccgcggcacgtgggcaggtgctgggtggccccggggccaacttttgtagcccgcctctggtgtttgaggagaggcggcccagtgtggaaatgggggcgggcggcggccgaggcgctgcttctccgctgcggccggagcgtcacctaacggtcccagctgcgccgcccgggccggggtggggggttgcgggggcggggacgcccggcccgccgcgcccgccccgcacaaagcccgcggcgcgggggtggccgctgcgcccccgccccgggaacggcccgaagcccgacgcggtccccgcgccggttccggcgggcggccgcaggcgtttgtttgttggttccgcgccgccttcctcgccggatggcttcctgtgacagaggtgatacacagtttccagaactgtctgggggcgggagcgggagcgggagccgagcccgctcggagctcctcgccgccgctgccgctcccatcttaaaaccgtttctcgccggcgcgcccgccccagcccgaaggtgccgccccggagggactcggggagggggacggcgcggccgtttccagcggcgcaagtggcttctggacgcgagggagcgtttgatttgcaactggggccgagcggattggtgcagctggcggcggcggggcgggaggagctgccgcggcggggggtggccactttcaaatggagagggcggcggcggcggggacgccgctgcggagggagcggggcttggttgcgccacgagaaggtgtcatcactgcaccggggctaattccggcggaggtgccgggagttactttcccctcctcccgcgctgttgtttctgtcgcctcgggaggaggaggaggaggaggattgggagagagggaggggtcggcgccgcgcggaaccgcggccctgcgcattccccggcgggcggcgggagccgcgcggagcgttcgccgctgcggggcggcggccgagctcccccacaaccccggggtgccccccttgctgggatccttagccttctcacgtcccctctcactccgccaccctcccactagagctccttattctcgagtcctcaaccccggcttggcgcgtcccgggtctcccctcgccccaggattcctcccgcgccaggctccgctggccccaggtttcccaccccaagcgggtgggggcggccgcagtcccggcgccggtgaatgctgagagcaaacaaaaaagcgggcgatttaaacatgccttcgaaacccgttaggaatgcgtcgtcatccggagaccgtttaaaaggagctttagcttgccttctagtaacgagagggctggcgccctgccttacttcggcaggggcgaggggctgtcgccctctatttgccccggccaagagggaatttaaattttcttttgtaaaatgacagctgcagtgaatgacctgagacagctacgtttttaggaaagtaggagaggatctgaggtttccattaatgggaatgcttagggggttctttcccaaaggttttttattaggtgaactatttttcctttttataatacccgccatgaaggctagctctcttgctacttgtagctcaaggctaatacctttcaaagctaatgaactagttttaagatagagggaaattatttccctgaaagctgatttaggtagtgactccccagtggttacagattttatagtaagttgcattttgatcatatcacaactgatcaagatttaatcacaggtggagaaaggtggagaaaggaagcattcaatatgtccatacttgcattgagtcaacacttttgatgtaataatttgttgtaggtgggcaacatacgtggggggagttaaatgggatgttttgtgagtaacactcttagcaagtacatgcaacccagaatttttattgtccttttatcccaaagatcttagtctcatttacttacggtcacttttttttttttttttttttgttccttgagacagagtctttcgctctgtcacccaggctggagtgcagtggcatgatcttagctcactgcaacctccgcctcctgggttcaagcgattctcctgcctcagccccctgagtagctgggactacaggcgcgtgccaccacggctggctaatttttttttgtatttttagtagagacggggtttcaccatattagccaggctggtctcgaactcctgacctcgtgatccgcccgccccggcctctcaaagtgctgggattacaggcgtgagccaccacgcccagcctgcttacggtcacttgtaaatcagatgactttctgcttggtattttgctgtcttcttcaaagtttggatacttctataagtgtcttttacttggcattgtcattttaatgtgtagaataaatataattttaagctgtttaagtgttaggtttcctgctatttcctttggtccctatttagcagagataatgggagtgtctgaaagtaaggtagaacttgaacttgattccacctttaagagtacagactgcttactagtaaaagttgggttggctgcacatatattttagctttaacaaaggtagatatgtgttcatttaaaagaaaaaaaaaaaacccaccttcttagttctccccgcttcacttgactggttttctgcctgtaaaccagtgctgtgcttatattagttatccaggttgaaagagtagctatacagggacagcaatgaaaagtatgtgtgtctgggtgaaactagagggagaaaacctattggagtttgaggaaatgtgttttgttgcttagcctagggggttggagaagaaagatgacctaaaaaacaaacttggaggactaggtgagagtaaaagcagatttccattgcgtcttacgtatagtaggcacgtgaccgatattaatttttgactttagctgttaaaaagttattacacaagtagtgttacatgtacgtttttgaaaattagaaaatacaaggaaacaaatataaaaacaaattgctaccatccatagatgactactgtattacttttcagataattttctatgcatgtgcatgtgtgttttaataaaaatgagatacatgaatataccatctgtaaggattttttcttttttttttttttttgagatgaagttttgctcatgttgcccaggctggagtgcaatggtgggatctcactgcaacctatgcctcccaggttcaagcgattctcctgcctcagcctcctgagtagctgggattacaggctcccgccaccacgcccagctaattttttgtatttttagtagagacgggttttcaccatgtttgtcaggctggtcttgaactcctgacctcaggtgatccacctgcctcggcctcccaaagtgctgggattacaggcgtgagccaccgcacccagctctgaggaccttttttttttctgtcagctagcttggttagttttaatataatctattactgtaacatgtccagatttccccatttagccccagactgtaatagagaagctttgtctaaaccactgcctaataaaggaccatttattgcatttggttgtttcccttaagtcgattttaatcttaagtaactttttttttttttttttgagacggaggcttgctctgtcacccaggctggagtgcaggggtgcgatctcggctccctgtaagctccgcctccctgtaagctccgcctccctgtaagctccgcctccctgtaagctccgcctcgcgggttcacgccattctcctgcctcagcctccagagtagctgggactacaggcacccgccaccatgcccagctaatttttttgtatttttattaagacggggtttcaccgtgttagccaggatggtctcgatctcctgacctcgtgatccgcccgcctcagcctcccaaagttctggggttacaggcgtgagccaccgtgcccggcaatcttaagtaactttttgacagaatatctgacactgaggaggcaagcctttggaaataaagttgcctggattttaaaaaagcaggaaatccaaatggtatttattgtaatttggaaatcttaaatttggagatcatctgcttgcttgatgttactttccacagacttgttggaaaaagatttatcagatgtttgtgtttcagtactgaggtggttggaacagtaaacatcaagatatcaaatacagattacatcctgtctctttagggtttggtcagagaagaggaggcataggaatctgtcacagttctgcttgctgctttactttcttgtttgtgaagctcttccctgtcatttagtattatggggcacctgttacagcattacagttaatggtctgtcagaatttgcattataaaactggttttcctgtgaggtttataaaacagttatagagggaaatatgacatattagcgaacacaccttgctttttatttgggttggcattaagaggtttagcttgattgttaaaacggtgaaagttacgtcacgtttaaacttatttcctcccttgtacaagcctttagagaattggcaccatattcaacaatactttttttttttttttaaacatgaagggtgggtttgcttggagtttctggtttcttagaaggtatcagcaatcttaaattaggaaagtattttaattcctgagacaggtaagttgtttccttaaaagtcttaaatctgttttctccgttttcaagtccttgcagcactttatatgaccatgtatttacaatctggacaattctttttatgtttgtggaatgtaatatctcagaagttgagatttagttgagtctattgagtctattgtcctttgcctagtgtatttctcatatgaaaactttggtttgtgatcatgagggtgtatgcattatttttattttttctttttttgcagttcatagccctgatgaagcaagttactctgctctcctaataaatgcaagaaaatgaccttggagggcctttttaattacacatagaagtgacaatttgtaagtttaaggttgggtgtcatggaatagaatggaagaaattgatgctaaaaactttggctatgatggggcctttcctagcccaggacttgaatgattattaaggatcctttcctcacctcaaagcacaaacataaagattaccagacttggactggaaagcctttatcactaggaaaggggccatgtatttttacgtttaatcccttagacccatagtgtacgatgtgcacacagtaaatgttcagtgaccaaattttggttactctaaaacgaattcagtatttactttttgcctttagttcttcaggtagaggtaggacataatgtgatagagagcagttgaagaaagttaatttttaaaaccttagatttttttgggcttacttgttgagggaagtaaactacattttctctctctttttttttttttgagacaagttcttgctctgtcacccagggtggagtgcagtggtgggatctcggctcactgcagtgggttcaagtgagtcagcctccggagtagctgggatcacaggcgcatgccgccgtgtctgtctaatttttgtatttttagtagagacggggttttaccatgttggccaggctggtctcaaactcctgacctcaagtgacccacctacctcggcctcccaaagtgctagattacaggtgtgaaccaccatgactggccagttttctattactttgaaagcgctcacaattgacatctgtctctttgtattttttgttagagagatgaggtttcactatgttgctcaggttgcccaggctagtcttgaactccagagctgagtcctcccgccctggcttcctaactgcgattacaagtgtgcacctgtgtggctggtggaagtaatattttaaactattgatcatttagtgtctcctgtgcaggagattttattattttgagaattcatggcatcttccatgagagtttataaggacttactttaagtgaagatttcagtggtgtgggtccacactgaggcataaaataatctttttgtttgtttgtttcccacttaaaccagggtaaggaacaagaaatagcaatgttattagcaagttgcttgaggttgaacttcatggcttgctttaatttagcacaaagtacactaaatgcaatttaaattttttattgattactctttgtcataatctttacgagcatcagttacttccatgtggaaatgccatgatgcacttaacatatagaggctgagtgttggtggttgtaactttttaagttggggacacttgacactgaaacccatggaagctctcccccagaaaacatgggtgtttccttaagcacatccttggattctagtttaagtgtttaaattctggtgacttctttttatgatttctctgtgatccttttactgccactgttaccatgtattgtagttaaaatgcctgttgagaacagtgatttttctgcttattggtcattaacttgaaaatcaaataagaagcctgttagaagtttttaaaacttgtgtacactggctccaagtaggagcctcaggggttttcttttgagaaaaacccactggttttactgtggcctttatttaagttgcttagaggtctcctcaatgccttccttttgattattctagttagggacttcttttttttttttgagatagagtcttgctctgttatgcaggatggagtgcagtggcatgatctgggctcactgcaacgtctgtctcctgggttcaagcaattctcctgcctcagcctcccgagtagctgggattacaggcgtgtgccaccatgccctgctaatttttgtatttttagtagagacgaggtttcaccatgttggccaggctggtctcgaactcttgacctcaggtgatgcacccgcctcagcctccccaagtggtgggattagaaacgtgagccaccatggccggccatagttagggacttcctaaggagtgattgtgtctgatccttaattttgtaagctttcggttgcttgtccagcacctggtaattgattcacattgaactaaacacgcataatggtggtttataaacatcatactactgatcggttgatttataggacagatcagttgcctttctctgtaaagagccaggtagtcaatattttaggttttgtgggtcatatggtctgtcgcaactgctcaagtctgcagttgtgccagagcaaccatgggcaaaatgaatgtgaaagtgatatttatggatatagaaatgtaaaatttttatgaattttgtatgtcatgaaatgttctttggccctctaccctcaaccatttcaatatgtgaaaatcactcttagctcaaaaaccatacagaaacaggctgttgacccctgattggttgattgattgatttgagacagggtctcaccctgttgtccaggctggagtgcagtggtgtaaattccagggctcacttgatcctcccatctcagcctccccagtagctgggactgcaggcatcccacaccaggcctggctagttttttgtattttttgtagagatggggtttgctatgtttctttgttctcgaactcctgagctcaaaggttctgcccactttggccatcactccctggcctccccagatttatagtaagacacagcagctacttgattgtttctgctggtggctgagctcccttctaggaacctgaaaatgcaagttgaaattagaagtttgtttggaggtagttggctacgctgagggctgtgggttgtttttgtttcgctctttttgcccaggctggagtgcaatggtggttttttttttggggggcaggctctctctgctgctcaggcagtagtgcagtggcacgatcacggctcagcaaccttctggtctcaggcagttctcctgccttagcttctggagtagctgggattctgatcctagatcccttttgaggataaaatgtgtaagaacaaataccttggtcatctctcacaccctccgggggggtcaagctaagaagacctgtgtaagaggatatgtattataagattgtgttccactacagagggagataatgtcaagtagggtgtatgtgtcacagcaatcagaagttaatgcctaccactccgggagaactcatactcctgtggtagtgtttaaggaactgctgacacattcttccagctttaccttttgtgtgcttcactatgcaaaatgaatggcatttgtgaccatcttgccatgaatctgtgtttcagttttcaagttaacagactgttgttcattgattacattttcagtttttgctctctgataacgtatcatggccttagtcattcacatgacctctttttaaatcccagtgtacatccaggaggaagaagcccatagtccaggaatctgggaggaggtggctggcacaggaggagagtgcccctccacccacctggggaactggtctttggttcttccactgcctttgcactagatctacttatgtgtgtttgtgcaagttgataaacatgcagaaatccatgtactcctctttaaaagtaggaaaggtggattaaattattttaaattgtttttgaaatcctctctagctctgcagttaattatgattttatgggtttcttttgggaagatttctttttttttttgagatggagtcttgctttgtcacccaggttggagtgcagtggcatgatcttggctcactgcaacctccatctcctgggttcatgcaattctcctgcttcagcctcccaagtagctgggattacaggcatgtgccaccatgcctggctaatttttgtatttttggtagaggcagggtttcaccatattggtcaggctggtcttgaactcctgacctcaagtgatccacccacctcaccctcccaaagtgctgggattacaggcgtgagccaccacgcctggctttcttttgggaagatttcttctagacacaatctgtgttgtgagacttgtaggcagagtctacgttgtgagactgagacttcagcctcagagagtgctttctagaccttgcttctaggtttgagaccaacttaggtttccatgatcataataacgaggcttgtacaattgtgatgaaacgtttgttttcatatgtaacttggatgattgtgtaaatgttgtttttgtcaagtgtgtcatctaggttttcaaatatacaacattgggagtctctctcttttttttttttaaaacagtactttaaaaatttttggtgacttaacattgttagtggtaacggatagtttctgacaaccgggtataatcaaggaacaaagttcctgaaaaacagctgcatttcaatctgtgcacagtgtaattgtcattagctggtggagtctggtttctgcagaagctgatttgtatatcctgtataagaacatctggtttgagcatttaaaaatcttttaaaattaccctgtagacatttagcatttattggcttactccaccaaggatggaataatgggttgtagaatcctttctcatgcttattcttaccttcgttcattcagaagcacttggttttcctaaagtgtctaatgagcttttagagtttgatatgaagtgtgtaggtttgtattatagaaattagtacctggttcagagacccccaaggcagaatggaacacaaactcctgatttcagtgaaatgctttaaaaaataaacatttcatttttgtatattctgaagagattaatctgaccctagctttccctgataaattgtcagaaaactgagacgcggaataagacatatagggcaaatgggctttatctctcttggtgatagcactgtgttaaggaggattctgaagatatgtgcctgggggtgtggaaaagaatgacctaatttgtcaaccatgccttgccataggtggaaggaatggcataattgccagctacctcttgaacatagcctttttaaattttttccaaagtagtactactgtgataatggataaggagttgaaatggcttcttcttttttttttttttttttgagagggaatctcactctttttgcccaggctggagtacagtggcacgatctcggcttactgcaacctccgcctcctgggttcaagcgattctcctgcctcagcctcccgagtagagtagctgctaggtttgagaccaccaacctgattacaggtgcctgccaccatgcctggctaatttttgtatttttagtagagactgggtttcgccatgttggccaggctggtctcgagctcctgacctcaggtaatctggcccgcctcggcctcccaaagtgctgggattacaggcatgagccaccatgcccagcctgtgtatagtttaaaccctaattttcttgtctgggttagtttttttctattattattgcatatattttaagtgacctccttctaatgttggctgtttttacctgtttcaaaaacttaagcttttgaagtatgtgatgacctaatcaagcaaataggggataatagcattttatggcattattaccttttctcttttttttcttctgcacctttgcatcagatattcttttaaagcaagacaattctttgatactgcatctcaggaaagaggtggcatatacatagtttattgatggttgctcgttagttataggctggtgctttgcactggggcaagaagttgtgcttccaggtcttttatatagtgaagagcagggaagaaataaatctttactactggccgggtgtggtggtgtgcgcctctagtcccagttacttgggaagctgaggcaggagaatcgcttgaatccgggaggcggagtttgcacttagcagagatcacgctcctgcactccagtctgggtgacagagcaagactctgtctctcaaaaaaaagtatctttactattataagtgtagtacacaatcatcgtaaaaagttaaaatcatggccaggtgcagtggctcatgcctgtaatcccagcactttgggaggccgaggcgggtggatcacctgaggtcagagttcgagaccagcctgaccaacatggagaaaccccgtctctagtgaaaaaaaaaaaatacaaaattagccgggcgtggtggcacatgcctgtaatcccagctactagggaggctgaagcaggagaatcgcttgaacctgggaggcggaggttgcggtgagccgagatcacaccattgcactccagcctgggcaacaagagtgaaactccgtctcaagaaaaaaaaaaaagttaaaatcatattaaaggtcataaagaggaggaaaagttcccaactcagtctgtcttggaaccctttggtcacatttctcagagatgaccactatgaacatttatattctttcagaaatgttctatgaatatacaagcaattgctgtaggtattttctctcctcctattatatataaatgctcttatattttgggttttttccctgcagttagcctgtttttctcccctaatatgtcttgggcatctttccacatctgagcatttagatctaacagaaaagaattctgagtagatggaaataaggataaaagctcaagattggagaccatggtgactgactgccttttttgtttggttgtgaattcatttactcccatgtcaagggaagttaaaaaaatacattccaagtacaaatgattggaatgttttgtcatagctgctcttattcagttgctgactcttaattgagtcagcaattacagagtcctggaaggggtttaatagattgccttagagctcataagcagtgattggattatttatacattggcaaatgagagctgcttgtgattcattcagaaccactcaaatttaaaattccttaaagtcttgagaaatgctttcttggtttttaaatctgagttcaaaaataacttataaagaatttaaagtgaactaatgtattatagtacatgggctttatgagtaatgctcctaagagtaaatattatagttatttattatgtggtcagttatcataattttttttcttttggaggaggtggctattgctaatgtaaacttgtcagctgaatatttgtaagttttacctccttccagaggttctgtattagcttgggccagcattttccttaaataagttttgatgtatgacgttataaagagcacatttttttgcttgagatatttagacaagattaaaacattaacgcttaagagttaagctatttgtcagttaaatgtatgactttatttttgactagatataaccctttagttaaattgagaatctgtgtttgagttatagtcatagtagcatttttagattctgtgagcatatgaattagataatgttgccagttggaaaacttcatatttaagcgattaatgtttactttaaaaactgaggtaagaaaccagctgggtttccttcacattcatttaggggcaggtggacagattttattgtgaagttataggtcattatatttgggtatttagaactgtatattccatagaagacaaaagtgaccaattattaagaatataatgtatctttttgggggagtattctatgttcagtaatttaggaatcaaattatcaggtacctagtgtttaaaaaataatttgaactatgtgaacttaaacagaaaggagtggcagggcgcggtggctcacgcctgtaatcccagcactttgggaggccgaggcgggcggatcatgaggtcaggagatcgagaccatcctggctaacacggtgaaaccccgtctctactaaaattacaaaaaaatatatatatatattagctgggcgtgttggcaggcgcctgtagtcccaggctgaggcaggagaatagcgtgaacccgggaggcggagcttgcagtgagctgagtgagccattgcactccagcctaggtgacagagcgagactccaactcaaaaaaaataaaataaaagagaaaggagtagctcataaaatacttagttttatataagaccacctggtttctgaaaatacattctttagtacctttaggtattagattttagctatttgacagaatggaagggcatcaataaatttaaaagtgaatacaggagaagttattccagttaaaggtcaattagatattaaagtaaaagcatctcaaattcaataaagtggagtgaacataaggtaacagtacgggaactaaggcattcatccagtaggttattttaatacatagtattgcattgggtgatatataaaagtatgtagcggtctttaattgagtaccttctagaacttcttgagtgaaataaataaaaatggaaacagtagataaaactgatactttgagagagaaaccagcctttctgcatatgagccataagacaaaatcactaggttgtaatccttattatagctatagagtttatggcctgataaatgggccctgttccaccacagagagtaagtaattctagtaactggacagtttgttttcctcaaatcagtccttgtttcccaggaatagcattgaataaacatcctcaaattcttagttacctttccctttttttgtttcttttttcgagacagagtcttgctatattgcccgggctggggtgcagtggtatgatcttgactcactgcaacctctgcctcccgggttcaagcgattctcctgccttagcctctcaagtagctggaacaacaggaatacaccaccaaacctggttaactttttgtgtttttagtagagacggggtttcgccatgttgctaggctggtcttaaactcctggcctcaagtgatatgcctgcctcggcctccccaagtgcctggattacaggcgtgagccactgtgcccagccctcttattcttttgtaaaagtccttctctccttgtccatgacgttctcattctttcttagaatcatcacatcagtcatgaccacgcccaggtcactgaacttgttcgctcaaattcctgagccaccctagggatgggttccttcacatagtggctcctctgaatctattgcatgcagatttttcccagtttcagtcagaggaatgtaaatttcaaggttttcaggtgccttgctatctcatgtgcatgtaagcagtaatctggtgacttttatagcacttaccacactgaagccacttgtctagttatttgatgtttcctccaggtagactgtgtgctcctgcagtgcagacattccatatcttgttcaccgtatctctgacgtctaccttgataaaattttcctcaaattattatgttagctaatgtactgcattttaacccacatgacagaagggatccaaggagagagtaatctgcatataatctaaataggggtttgggccagtgggtaaagcctgtgtttgcatttcctgaggagatggttctccggcagctgccacagatgctcagttgtcttggtgcatctcttcgtgcagtgagtggagtagagacaccagaggattgttaagtaactggtccagccagggtctttggccagtggcctttccaggcagtgttctgtttttaatttaacttcctaggtagtcttcctctttttgggcaaactcccaaatgcccactaactagctcttttgtctctgtagctattatgtttctcgtggcaagtggacactccaggctccgataagctggataactttgcatcagttttgaggaaatgtaaacagaatgtcagggtgagccgtgtcgactggatccagagttctgagggcatctattgtagccacgctgagaggccttgtttctgaccagtctgagttggattcaatctctgtcccgtactgcaaggtcccattgcagtgttccctatacctaccatcatggtcccccttctctgttatgtctttttttttgaaacagagtttactcttgtcacccaggctggagtgcagtggcacacgctcagctcactgcaacctccacctcctgggttcaagtgattttcctgcctcagcctcctgagtagctgggactacaggcatgcatcaccacgcctggctaatttttgtgttttttttttttttttcagtagagacggggttttcccatgttggccaggcttgtctcgaactccaggcttcacatagtggctcctctctatctattgcatgcagataatatgcctgcctcggcctcccaaagtgctgagattacaggcatgagccactgcacctggccctatgttatgtttatttcatatttgacttgagagaatctgttctccagaaattactgtaatctttagagacacacacatgaaacatttaagtcatgatgcaaggcagtagttgattgaatactgacaaagactcctttgaccaaaactttagtcacgctcctccggtcctccgcgtgaatgggcactaccttgggcttctctttgtattattgttgaatccagttgaagcaaaaatcctgttaaaatcagtttagggaaaattcttcacctgggtatctgaccactctgtcctatcttatcctggcctgtcttcaagaataatcctatcaaattagccataaaccccttatccttgatatttctgtttagtagtcagtctcctatccaccggccccaccctcctccttggttataaatctccacctcttttggaatctgagttgggttcaatctccatccccctctgcaagatcccattgcagtgttccctgtacctaccaccatggtcccccttgagtaaaatctgctttaccatttctaacaagtgtcatgaggaatttttttcagtgatactattaaggtaacagtgcattgaaaagcaaggtgaaaaagttctaaaagaggaagaaagttgaactgagcagtacagaatataagtgtttggagttggagtggtcagtggctttgagctgagccccagaaaagtggtgggattaggatagggagcaaggagcaacaggagcagcattagcagagaatgagaactgaaagtaagcagagtgttcagggaagaagcctggcccaaccaatgcaagctctgggttttggggcttgctagaacagatgcctgagtaaagctgtgagaagtcagaaaacttcatttttggctggacactttggacttagacctatttgtaatgtggaatggagggagagatctgcatatagtattttgatgaggttgcctcatggggtgtagttaatttgttgttttaataattggaagtgggaagagatcatagtttggagaataggtgtttaaagctttctaggtacaagtagttgaagggcaaacccacagggcatatggggacttcagagagtcataacattatgaatcagtaaaccttggcaattggctataaggtgagaatggatgtgtatgaagatgctacccagagtaatatgctgtgttacacatatgttggtaagtacggtgctctgccccaaacatgcccctttttctggctacctcctctttgttcttcaggactcagctcagtcttaccagcctcctctgactcttatccaccttttgtattcctgtagaactccgcatttaccactgtcaggcacaaacagtagtgaatttccgttgttttcctgtctgcccaactaggccagaagctctgtgaggtcagggttagtaattttcatccagcacctcctaatatatgagatattcaaatgtttgtcggctgcattatgtgccattatatcttcttgctactttggggtgttgtgagtagccattttaattgattattacttatcctactactgtctagattagtaattagccattgccctgagagtcaggaaaggtgatgatgcagatgctggcttttagtggggcagatgtttgcagcatacaaccactgtattgtgtagctgaaagatagtaacatgtattttgattttctgatacagtaagtcatcctgggtgagataaatcagcttgatgtcaaggtttaagtactttagagccacagaggaggaaattctgctgagcactaacccccatactgtgccaagttccctggagaagcaaatacagcactctcaaaccctcattactcaagatcttcagcggatgaaaatggatttcattagaaagaaaatactatttttactcttcttttacttgaataattttgcttaagagagtatttatgtgtgtttaggtgcatcattgtattttggccaatgcttgcgttctttatttagtgactgttgaagtgcttcctcagggagttgtgtttgaaagctggaaagtaagcattttgattcaaaaagattcttaaaagctactctgttaggtgaatctaatttttaaatttttttatagagataggggtctccctgtgttgcccactccggtctcaactcctaggttcaagcagtcctcctgccctggcgtcccaaagttctaggattacacatgtgagccaccgcgaccagcctagtactaattttttttagcactcttttgtaatgttggctttggggagctgaagctgttaggagtgagtggtcttctgcctttcccttttcccttttacctcttgctggatcctgaggggacccagaggtgcattctctagaaggttggagagcttacctgtctgcagttggtgtttttggcacacacagggcagagaaaacagttgaatagggagtggaccactggtgtttcttggttatggaacctgagggctggagtgggcttaccccaggccaagttgcagattgcctggttatgggtgagtggggcttttggaaaagggatggagtgggttttaggacttgactatgcctacagcatgaaaccccagcttgtaaagcgtgtccataatatagctcatgacccatactgatcaggacttatgttcagcctttctcttggtacatcattttaatggcttttgaagaatcaattgataaacaaaaactttaactgggtgagtttctcaggaagaaaatataaaatattgcaattatagattagggacctaaatatttggatgaattgtgtagatccattttttaagtgtagtataggaaaaacttttcatctacttttttaggttcagttcatgcgagtctgaattaaatgacaaaagacattacaggagaaaaggcaaacttcactgatgttgatatttttatgtgccagatgtgggtaaagggaaggagacttcaccgaagagaaaaaacccaagaagagttagacctgaaggcttatatacaattttaacagagggtgataaattgtgaagtgactagtcaaaggaaaagggagtttaggcttttttgactgctcttttgtaggcctttttagagtggagctttggttttttaaaattgctttcttgttctatcacagtggttctccacatttttctttttttttcaagacagaatctcactgtgtcacataggctggagtgcagtggtgtgatctccactcattccaacctccgcctcccgggtttaagtgattctcctgcttgagcctcctgagtagctgggattacagatgcgcgccaccacgcacggctaatttttgtatttttagtagaggcagggtttcaccgtgttggtcaggctggtctcgaactgctgacctcgtgatcctcccacctcggcctcccaaagtgcagggattacaggtatgagccaccacacccagcccggttttccacatttttttctccacaccattcctatgtgccccacttctattgttgtgtgtatgtgtgtgtgtgtatgttgagacagggtctctgtcgcccaggctggagtgcagtggtgtgatctcggctcactgcaacctccgcctcctgagttcaagcgattctcctgcctcagcctcctaagtagctgggattacagacacctgccaccacgcccggctaatttttatatttttagtagagacggagtttcaccatgttggccaggctggtctccaactcctgacctcaagtgatcctcccgtctttgcttcccaaagtgctgggattacaggggtgagccaccatgcccagccacatttgcattgttaacaccacatcatacatattgtgattcccaatgaggaggaggttgggatgtacttttctgagagggtggatgggtaggtaggtgatggactaccatactttttctcacttgaaaaagctccctttcatttttaggattcattgaactgacagaccagtgccctaaagatgtcaggttgatcagtaattttaatttggaaaagctttttgtatttgtttagagagctgccctgtgtgaatataaccgcgagaccatctgtataagttcattactggccattccgtctcagttcactgccttcttacctaaatgcagcctttctcatacttgagggtagtgctagaattctgttatcatcagctacctgggaggagttggccaggtgcgctgggtctttgtacaaactgacttcttattttggctggatttgggtctatttgtcctgaagggagctgaggtgaagtggagtggaaatagtgttggatttggaattagaagctccattcccacaacgtgaccttggggaagttgctgcttaacctttcttggctttagtttcctaatgtgaaagggaggggtctggatcaaaattgtataatgtctgtggttccttcctgttccctctgtggggttagagatggctggaggagacatttgcattccattacccgatttgttttgtttctttcgcctttagggttattttagtaaaatttgcctgagaagcataatcatgcccagtgcagtgtaaatattcacacatccaggcacaaccccaccccaccccccacatgtacgcataaaatatgaatctgtctgtagtgaggaagcacagtacagtgttcattgctgtggatttttttctgcagtgcttgctgccagtcagctaaagattcctggagtagttatagtaataatgtcacaggaatatagaaagaaacctggcatctttgggagacctactgatatgtgacttctccacccctccccctccttttttaacctggtttgttaatgattgcacctaattatgtatctttggtctttttactgtttacaattcaaatgctacttaaagccatttgtttgcttttgtttgctgtaaatcctgggctgccatctgaagcacaacttgatgattgtgtattatcatcttgggttaagtgctgtctcattgctttgcaggctgcctgctgtttcccggggagatcatgaaacgaggtcgccttcccagcagcagtgaggattctgacgacaatggcagtaagtcctgctttgttgttcttggagcctaccagggtttgggtcggggtaaaaacatgattttttaatgtaatgctttaaattgctgaggccctttgcatgtcaggcaggtcagagaaagccaaagcctggagaaacgtacctgagtgtgatactgcaggtctgtaaccagatcttactgggtaaggttgactgcaggcaagcattcctgaggcttcctatttgttatcctgggaggaataatccagttccaagagtcactggtgtgtctggttttcctaaacatcatttatggtacttcgcagttgcgctttatgaaaggggaacttaatcaaagccaggtaatcattaactggttcaactcaatacaaggggaggttgaagactgcctagtgtgatgtgaaaattattaagtacaggttcttaataggtcgaaagtccctgctcttcacttggttttaatgtgactatattgaatactactgctgtctgtatctcagctctctggcaacttcatattttcacagtgcagctgagaaccagaagttagttggcttccaggcagtcaaaataaatatcacacagtgtctgtgtattgagaagctaacagactactcagagaagagctcccctcagataacagagggaaattttgtacctagcacagtgcctgagctctagcccgttagcttatgttttacattacaaattaaacccaggacaccttgaaagaatgtgtgatgggaaaggagctgggcctgctttcaaggaactctgctttagacatatgtaagaagagctctgatgtgaaagtcatcagggcagtaatagagatgtctttttgatgcactgtggaaacagatacagatacagattcagaggaggggagggcagggaaacctgcagaggagatgaaagttgtatagatccttaaggatgaaatactttttaggcaaatagggttattttcagttttctgtgctctaagttttcagcaagttaaaagctgcacattagaaagcaaggctttgctgctgtaggtgccaccctgttcagaagaggggaccaggaatatgaaaaacagaactcaatgtggtatttcggttggtgtgcttggcacaggcacaggcacggggcttttggggaggagaattggccgttatgggagagtgtcaggtgtgaagggcttgcaatgaggacctctaaggaattgagagttttagggttgactgctgatgttggcagcaggagagaagtgaactagttgagagagggtgtaggggctccagagcgaaagacctttcctcttatttcagagaaaggtattaaaggtctgtttccaagtgcaggcaggtaaagccacctgtccgagcctttgggatgccaccttctgaacttctgaggcgcttgttgtttcataaccctgcctacctgttttctaacgtttatagttttaggcattttactccttgaggcaaaaacatcattgggaatttcttctctgcccctgtgtggcgcctatcaaagtgtctttgtgagttataagtactctataaatgctccttgcttgagtacataattttgtcctacattaattaaaaaaaatagtcttgcctggcctggtggctcacgcctgtattccccagcactttgggaggccgaggtgggtggatcacaaggtcaagagattgagaccatcctggccaacatggtgaaaccccatctctactaaaaattagctgggcatgatggtgtgtgcctgtagtccagctactcgggaggctgaggcaggagaatcacttgaacccaggagacggaggttgcagtgagccgagatcgtggcccctgtactccagcctggcgacagagcgagactccgtctcgaaaaaaaattcttgcttttagggtgagaattagtcagaagactgcttggtgaattacctccatataaagataatgcccaataaaagcttaagagccctatttaaatatttttcttggcattgagcatcaggtgtatgctcactctgtctgctctcgtcactgcctctcttctttgggagagctgtgttagaaaagtttctcctggatgttctctcagatttagagccttctcttttctggactagcattgtcccataggatgagaatgtcctaatctagtgcaactgaggaactgaattttaaacttttacttaattttaatgaattaaaaaatttgaagacacatgtggctagtgtccactgtgttggacagtgtagttctggaccttggcttagtttagtccctttcagttgtccagagggtcttagtagcgcagaaggcctcatattagtcagctcaggatgctacaaaaaagtaccacagcccccggtagtttaaagctacagaaatttgttttctcacagttctggagactggaagtccaaggtactggcaggtgtggtttcttctgaggcctctcgtggtttgcagatggacttcttctcacgtgttcttacttggcctttcctttgcacaggcatcgctggtgtgcctcagtgtgactaaattggattatggcccaccctaatagcctcattttaactcagtcacccctttcaaggccctgtctccaaatatagtcacattctgagattggaggttagggcttcaaagtacgcatttggggatgggggtacaattcagcccataaaagccctagaagaccaaatatttctttttttttttttttttttttgagatggagtctttgctctgtcgcccaggctggagtacagtggcatgatctcggctcactgcaagctctgcctcctgggttcacaccattctgctgcctcagcctccgagtagctaggactacaggtgtccgccactgcacccggctacttttttgtattttttagtagagacagggtttcatcatgttagccaggatggtcttgatctcctgacctcatgatctgcccaccttctgcctcccaaagtgctgggattacaggcgtgagccaccacgcctggccaaatatttcatctaaaatatatatgttcaggatgggcatggtggctcatgactgtaatcctgacacttagggaggctgagctgggaggattgcttgagcccaggaattggagaccagcctgggcaacaaagcgagaacccatctctattttaaaaaaaaaaaaaaattccacctagaactctggttaggaaggaggaagagagtgtccacagtccccaccaaaagtgtgtctgtcaactcacaagtctgtactggcctccgtcaagaagctggggatggagaattaaggtaaatatttataggttatcaaagggttagcctaggctaaacatggaaatctggtggtggaggagaggaatgatagttgctagtagaaggttggctgtccttttgtcatacagctggttcaatataaagtatatattgatgctttacagccatgctgtctgtccacgctcaatgatttgataaggtggatgatggtagtggtaaacgcagagttctcattaagaacccctgaaatgccaggcttataaaaagatgcacatactcattgccatggaacacacccctttccatcccctctgaaggcagctggttcacagcctctgccaccaactcactcatttgcactggagccttccttttgtatataactgggtggcctgcgtcatggggtgtgcctgctgtccctgctttcaggtccacaaaatgagccctacctgggttaactgcccatactctgccttccttcagccgggcctgtgcatttggaaagttctgcttacaagaaagatagggtctatgcagtggccacacctcagcctctccagcctgcaggcctgacagaattttggcagcacttcccagcccagtgcacaccatgtccaagtgaaggagaggcagctgcagacgtcagcatggggctgcagcacgagccacagccatggctgggacttgctggcctctggtctggagccctttgccttgttttctggcctggtccagaggaataccagtgtggtatttacagttggggacggacaggcattttctgtgccaggtgcaagcccttatacagctgcagtcatagttgaagcctttctccaggtgccctggaggcccagccctgcagttggatggaataatgttggggtgtttgcaggcagcgtctgcagttgctgggcttctgggactgggtggctcagccagtctctgaagttacgcattgcgccagagcatggccaagggaaacaagtccttaattttctgctttccagcccaggatcctgtccttagggatttggcacatgtgggaatagggtccactaactactttcagtacagttgatccttgaacaactccccctaccctgcaaatcaaaattctttgtataacttttgactcccaaaaatttaactaataatagcctactgttaaccggaagccttactaataacataaatcaacatattttatatgtcatatgtattatatactgtatttttacaataaagtaagctagagaaaatattaacatcataaagaagaggaaatatatatgtatatatataaaatatactattcattgagtgaaagtagataatcataaaggtcttcaacttcgtcttcatgttgagtaggtagaagaggagaaggaggaagagaaggcgtgggtcttgctgtcttaggggtggcagagagaaaattctcacgtaagtgaactgggcagttaaaacccgtgttgttcaagaggcaactatgtttctaaaacctaaaggacataccatgttatcttcagtaaacctgtagaggctaatttaaacatcaagtaaccttgtttttatcaggaattatatattattgtttatctcaggcaaatagtagctctgatcagcactgtttttttttttttttttgagatggagcctcgctttgttgcccaggctggagtacagtggcatgatctcagctcattgcccgctcagctcacagctcactgcaacctccgcctcccaggttaaagtgattttcctgcatcagccccctgagtatgatcagcatctttatatatatgtagcaaatggtgtttttgttggttttggttgttcttaaactttggtgtctctcaaaggtccaaagggagattggtctcattccttacttcacaaagaatgatagaagtgtgctcatactgttaagattttcctaaagttatagagcaggacttcttattcttgtctgacttccttaaatttcagagatttgttgactttctttgggaagaaggtctggagccaggctccatgtgggccctctctggtctccctgtttctgcacctgagctagggtggaagcagtctgtcttcccacctatcagagccaggctctgccccatcacctgtgataaggaatgggcagaaaggaagccagctgaaattgaaaattagtaattttcccactgacttgtacttggacctcagcagaaatggtgggtgagtgtcaaatgtttgtgtgtcagttggttgaaggcctaagtgtatttaagtatgttgaaacatttctgggccagttctttgaatgtatgtatgatgcctttgtttgttggaagtggaagtgagtttggctgtagagctgggctacgctggggtaaaaaactatggtaggtatagggtcagcctctggtctaaatgacagttatatcagatgcttgtcttctgtcatgccgctaaaacaaataaacagtaactagattaaatttccctaatttgagatgggaattaacacagcattgctttagtctagtacaaggctagcttggcttttaagtaactcatagatgcgtttgtcaggtctgtgtgcccttgctgtgacaccagactgctggactcgatacttgccagttttaagcatcttactttgttaagctggtttaacacccctaaagacagataccagcatattatttagtgtccagagcagtgactgagacaggatgaccgctgtttgatcagtggcaaggttctttcatagtttgcattttgtggtgcagcaaacacgaagactgccattcattctaatttctgaacctttcatgcatggcacaacatgagaagcttatcacacaccagctaccaaatgtggaaggtgtgtgcagtatgtgttagatttactcttcaggttttccttattttagatctagggcaagacagcatggctatttttaatatttcaaaggggagtgagtgttggagatgtctgtataataggacctgaaggaacgttgtgcccgggcagggtccatgctcatggtgctacaaactctgtgccttttataactttatattaacccaaaggattctgttttaatggaagttggggatattaaaaacaagacaatgtttttccccactcagtctttcccatgtttaacatgaggtaatgtaatatagaattgtttttaacagtgtatgtcaagaattttaagtcctttaaatttgtcagtaaagtgaacttaactttaggtaataattttaccttgtgaatggcagtaaaatacttttagacattattagcagatttttagagttcctaactcctttcctgaaagcgaaaagaaagtaaaacaaaattttactcgtcatgtgcttaaattagtttgtcattaaatatcagcactctggaaacaaacaaaatgcaaaccaacccagtgtaatcttaccacgcggtttttaacaatagcaagcacactgtttttaataagtgcgtgatgttttgctgtagtataaatcactgactcctggtctttttagtatttaaaatattctaatttctggtttgaccccactgtcccacccccaatattttccagaaagtgtttataaattttgttttaattaaaaaggagtgttttgattttaataatattctggtagcttcctgacctcctgggaatgtctggggagagcctggctgtagggagaggtgttggtgtagcaatgtcaagacactccctttgagtctctagcctgtggccttccatgaatgtttctgtagatgtaggtgcattccaagcaggaaacagtggctccacaaatctatctttaaatgtattattgctttattttccttgagctcaaacgcatgtcttctattaggtgaaacaggagtaaattcttagtgcctgccaccttcagttcatgggttacagcaatggttacagcatgattgactgtcctcaacaatgacatttaaaaaaaaattatctacttttcaaagaaatattgagaatctgctgtgtgcacagcactgactaacttagctatgctctatgttgtaaattctgcgtcttataccagtggctcttgatagattaactttttggtacaacaagaaaatgagaaggaatagatcaccagcaaatacctgctcctggagatggaaggcagagcagttccctcgggttcacaaccccctcccagattctcacttggttcatcagcaaagtctaggttttatacagaccacttgtgtaaagtaaaatagaatttttttccccttactgttagtggatggtatctcagtgataaatgtttaatagctttattgagaaataattgacatacagtgagcctctgagcctcatatatttaaattgtgtactttgatacgttttgacatgtttatacccatgaaatcattgaaatcaagataatccttccctcccacttttctctagtcttccactgatctactttctgtcactatagattagtttgcatttctagagttgtatgtaaatggaataatacaatatggactcttttttttttggtctggcttctttcactcaggagaattacttcagcatttattcatgtttgcatgtatcagtagctcattcctttttattgctggatggtgttccactgtgatggtgttccactgtatggatataccagagttttttcattcacagtctgttggtggatgtttaggttgtttctgatttttggcttttctaaataagctgctaagagcattccttatgccagtgataatttaaatttagtttctttaccagtctttccctgtctgcaaagtgagtttaataggattaattttgcttttccttcttctgtattgtatcaacactaggtaaattaagaggaaaaggaacagactatttttgggtggactagagtttctcttggttattactattggataccaagtatgtagcatctttgtatatctgtttttaaaagcaaatgtggcatagacagcaattttcaggatttatgaaagcagtcctaggaaaagttttcaaatgagtgtcattatttgggttgtgttctatgccagcaaagctgcaagcttcctgggaaccttggaaactacttgggagggatcctgacagatcctcaggaagagacaagagggtcagaaaacctgagaatgaatgaatttgttgtttctgctttaaccctgaaagtatttgactctgaagaccctcttctccctacttcatgttaatttttaaagtatagcagtggagtgattctctaaatttctggctttgttccttatcatttataaccttttccatagtaattcaaagcagaggaggaccatccctttttgttctgcttctcttcccttccccagaccttctgataattccatccagacactgcgtgtgcttttcctcgtctcttctttcaggctgtggaccggctggaggatggcctccaggacaagagggagaaagagaggcctctttatagaccctaggagccacccagccaccttcatctccaggttcctaacttggcgtctgtcttccttttttccagtaatgaccagatttagaacttctgcaggttgggctcaccccagtgtgcccagaatatttctttcagtgtgggagtgaaatattcttgttcatttagagtctaaagaggcacacttagtatttttttaaagaagaattttctaaaacatttactgaaatgccatggggccaccagcaggagctccagttctgctgattgtgctggtggaacagcagtcagttgacctagtaatgagcctcagaactggtgctcaagggtagtgccgatgttgtccctgtcagggaagcatggcaatcccatttggtcttggtcatcgcaaatctgatgataggcttatgtgcagaatctatttcttaaggtccccaaggtcttaagggtgctttgattctctgttcctgtctctggaatctgtagagataagagcttcctgtctgagtgacaaatgatttcactggcagaatggcagttaaccttaagcttttttggcttttatttttctggattttgttaatttctggaaaatggtacagtaggtgttcaggattggggtgatgattattaaaaataggaggtggaggtgaattatcagaaagttggacaaatactacatgtgggtgttagggttgtttcagatctctggcagcagtacggcacccacaaatggaaggttttgcacttaagttgtctttgtaacaaattaacaggaggcagaggcagagatggagaagaggagctggaattattgggaagttgaattgacctaccattgattgtgtcctgaatgagaagagtctaggacaactcttagatttctgacgtcaagtagaaatggtggtaatagtcatcaaagtaggaatgtaagaggcagaacaggtttgggtaaaatgttgagctcagtttttataatgctgagttgacagatctaaggaataccttaggattgatgtcttatgtgaaggtgaaactggatctggagcttgggagggaggttagtctgggaatgtaggtctggcaggttcctctgggtgtgctgggtaagactgtggacatgggtgagcacccccggggagaatatttggagcaagaaaagagcaaagagttcaggagaaacccatgttgatggggtacatggagaggaggaacccacagagtggaaagagaattgccactgaggctgagggagtatttcaggcaggatggagttgttggtgctgagaagtgtcagggcagagaagagatcagacttggcagcagttgggagaccctgttaggcagcagttaggtaccatgttctgggggaggccagatgataggagtagacccccctttggaagaaaggcagagaacagagccaactggaattttcatgggaaagtggagcaaattttaaaggttatttggcaattggccccttagtcttcactaagtttgtttacctcccgtcctctcttcttatggcactatgctagctatttactacaccataggcctgaggttccctgtctagggattgctaagtttttaggccttgtagagtgaaacctttttttaaaacagtgttttagaaagcttcctgaaaactcagtaagatgtttttcttttcttttctttctttctttttttttttttgacagagtcttgctctgtcccgcaggctggagtgcagtgacgcagtctcggctcacttcagcctctgcctcctaggttcaagcaattctcctgcctcggctttccgagtaggtgggattacaggtgcctgccaccacgcgaagctaatttttgtagttttagtagaggtggggtttcaccaagttggccaggcaggtcttgaattcctgacctcaggtggtccacctgccttggcttcccaaagtgctgggattacaggcgtgagccgccacccctggcctgatattttttcaatttgtatttagcagcatgagactttgaacctcttcagtgcaggcttatgggtgaagactacacctgcatggtgttcttaaagtcctctcttctgttgggtgtggtccttgatacagcatccctgcacagaatgagcacattaggcctgcttatgagaggtgagagttaaataactgatggacgtggaagagctctgtgagagccaggagggcatcacaggtggtctcatggtgcagtgctgaggtgagcctgggatgagtttgggtaagaaaacccctgagaacactcagtgacccctgcaatttctaatggttcttatttggatatttgtttctttaggcctgtcaactacttggtcccagaattcccgatcccagcataggagaagctcctgctccagacatgaagatcgaaagccttcagaggtacttcttgaatgcttgcctgaccgtgcatgaatatatgctatcccatatgcctagttgagtggtatctatttgtgcagtcctgggcaaattattcaaatccttgtgctccagtttccaaatctgtaagacggggagaacacaagtgtctacctcataggattgttgtgaggattaagtgggttaattcacatagactaatacatgcaaagcatgtgaatagttgctggcacataaaaagtgctcagtaaatgttagttattattattaattacattctttttttcctttcttgttgcatcttcgctggctcccaacaacttttcttcctctggccaggatatcagcaggttcagctgctgccaagtcactgccagcctcaagttagttttagccatgggtttgtggcttatttggcaacaagcaaaactctgggacttttgtttaggggattatgctgaaggctttccccattctttctcaatttgtttctcatcttatgtttcctctgctccctaacttttgttatctatctatctaaagttgcttttaggtgcatttctttctgctggtctttgtttaggggtccttatgagacctgaggtctgtttattctaaagacttttgctaggctttaaatcatcgaagaaaaacattttattttatcacagttttcaagtgagaaggttataggaagagtttctttggttgaatgctttgctttgtgctgcttcttatgggatgagttcacaaacagcctcatcctgtaatggcaatgcataggcagatattccttggaggaacttcccaggctctaatagggaacgtcagaaggctgccctgctgtggagtggaggagttatttggttgtggaatagcttcctccatgaggaagtagtttacatcctttagaattgtggaaaaccatcccaggaggcactttagcatgagatcaaatgtacttgggaaggtagccacttcttccccttactttatttcaggccttttttcctttgaacctttagtgctctcttccttttctttgccaaggagtgtctctgctgctctttatttcttaattccttgtgctgtgtctgtaacccccaaaatacctttctgatgttcacactaaactcctgttacttcagcacaggaatacaagggggacttagcagctgtgacctggtgtgacgagggctggtccccagtggtgtagttcgaaacctacttccagcagtgacaccaagcatggagaagggggcccagcagcacgggttgctgtgctggctttgtcccagccctacattttggtccagatgtttttctcaaccctgagtccaaactatatgtatggcactaacatactctaccagagactccagagttgacgtccatttgagggcctttgtttcagttcttgactgagtctttgagcaaaggaatagcaggctgcctttttttcatttcattgcttcagtttgattttctttcttttttggcaaactcctttgttttttatttatatcagttagttggaatatgtttttacctgattggctcttgaaggtataggcccatctcttaggttttaaagtacttttctcttgggggccagggagttggtgtccactgggctgggcacctgcttctgcggctctatgcttgaagggaaggatcctggtattacacgtgatttttgtgggaggtgcatggcctaattcttgcttgttaataggtctttagaaatgaagagtggcatactggggaatagtccgtatggaaaatgacaggcaggagaaatggcctctttattcagacactgcctcagactttattatggggaagtttattaaagtgatcactagcctgaaaagccaccaggaaaaacaaatatggacctattagcaggcgtatgatgtgaactgtgcttagtagcacaagaaagaactccctgtcctgagaaaagagagttcagcattgtgacttgtgtaaacagacagggcagcttacagatgcaagcttgctcgatgccaaacacaactttgggctggtcctgatgtcaaggtcagagctttcttatgcagccttagacaccagtgggccaaggacgaggcttgagagggagccagctgtgcagccctggctgggaggcggtgttgtgctccaccccaggggcaggcctcactgaccaaggatgaatgccacaggcccaggagtctgcagtggcataggcactgggatggctgcctttcctgtggtttccttcatttggcctgtgataaggaattggggagctctctcggtagaggggcactgttggatctgcctgtttttggcagagtggggagagggtagtgactttctctatttcctttccccacaaataactcttcccaggtagaagttttgccaggtgaaggtgtgcaaacatgttttttgcaggcccatcaacccagtggcctgtggttgcttctcttccagatttttctaggccagcccagaccttgacttcaccagctaccataccataaaccctggtgccctgggaggtagggcctgggtgggggcagtctcattatagaaggtgagtccctggccaggagcagtggctcatgcttgtaatcccagcactttgggtggccgaggcaggtagatcatttgaggtcctgacctcaatggtttgagaccagcctggccaacatgatgaaaccctgtttctactaaaaacacaaaaattagctgggcgtggtggcgtgcacctgtaatctcagctactcgggggtgctgaggcaggaggatagcttgaacctgggaggcagaggttgcagggagccaagactgtgttaccgcactccagcctgggtgacagagcaagattccatctcagaaaaaaaaaaaaggagatgagtccctggtggttctgggttttggcttgaagttgttacatggttagtggagttatatttctagagcacccttgagtgcagtatctcccttcagagatttccaggtacatgttttcagcagcccttttggtgaactgagagacatttttcagaggcggacaacaagattttttgttgtttttgttgacgttgttgtggacactatggactgagggagtgagagggcagtgttccctcagcactgccaccccccatgcctgagtgaggtaaaaggcgtgtcaggcaaagtttttctgtaataggtcaggcttgttctatgttgatacagtgaccttgttacatggcagctccatggttacattgcagctgccagcactctgaataagaatgcaaatatcaaatgtcagtgtccctttctcttcctttccaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggtagagatgccctgaggacagaagcctctccacccacccttgctcttcttccctgacagcaggcatctgagaagagacaatttctgtgggaagagacagtttctgagttagcattaaaatatcatgaggcctcaagtggaaatagaaattcaggagcaacatacttcaggcatacagggtagtggttttgagggccatgagcctccaaacttaacattacagccaccactgtggggaggtgctgctttcttatgagaggaaggcaaattccaagacatcctgggaagtgatgggctaggggaggaaaatttgggtgttcacacgtctgcatcctcttttcctgccctccgtattcgctctggagagtggctctcctggagagaagcatctggctttgttgggaactagcgcgggcagctgctctgcctactgcggttgcctctgcctttggaggaggacaggtgttaggagacctgtcagttagggtttgtggagaggggagttttggagggatttattttgactggtcacattattcttggggtacgttctctggatttactgacttatctttaaggatccctcagggtcgagtccctgccgactctcctcacaatcaggttgcagctagtttactcatttcctcactgtgccactctgtgccacctggagagtcctgttaggagggaggcttgagtgccctctgtgctcagccggcacctggcttctccgccatcatcagttggctgctgctttgcgaaatagtgtctttctccacgctgagtcattactgaacttgcttcctggccctcacccactttgtgtctctttttttgggcacttaagattatcaaatttgagttgtcattttgggatctctggggagtctatccagtggtgacaaatgcccctgtcttactcaggtttaggtgaccagtcaggagtgccaggatggcccccacaggctagagtctggacctgtggaatggagtggtcatggggccctgcggggcagaccaggtatctgcctcagagcctgtgtctgagatgcagcatcacctgattcagcactggcagccccagtccaggaatcacttgctgaatgcttcactttcagtggggagccaggacagaagtgagcattaatacagcttgtggaagttttacaagctgtattaaagttggagccctgagcaagttggatccctgctcttggctgagtaggagaaataaatcccttcagtttgtccatgtcagtgtcacgtagataaaatcactcccgtaatataagggtgatgaaggtactctgacagactctgggcagcctgttgacagtaatttaaactgtggaaatgcatatgtggaaggactttgttgaggcctggggtctgtgattaggaagatggcctttttttggttccaagtcgggagtgatttgctcttgcacatgcagtcttattttgagtggggtgagttggaaggcaccactccaggtgttaaaggtcgggagagattgtgtggcagtaccaggaggagaaacttgtgcttttgttcctgggatcatgggtatatgttgggagagtcagtccccttcttggctgggactctgtttcttagattttttggtaatggccggggtcttatttccttttttttgtttgcgtttgagacagtctcactctgttgcccaggctggagtgcagtggtgcaatcttggctcactacaacctccgcctcctgggttcaagcaattctcctgccccagcctcccgagtagctggggttacaggcgtgtgccatcatacctggctaatttctgtatttttagtagagatggggtttcactgtgttggccaggctggtctcaaactcctgacctcaaatgatccgcctgcctcggcctcccaaagtgctgggattacaggcttgggccaccttgccccagcccaaggcctgattttcttttccctctctccctctttttttttgtgaggtgtgagggttggcgggtttctccctctggttctcagagtctgctgcgcctgccctgcctgtgtggtgccctggttctaatggcctccagcagggatgggcaggtctggttaagggaaagtgatttaatgactaactcttgaaatgtatgggtcagtgtgttttggtgttggctgcaggccagagtggtcagaggtggtgggcagggcacagcagggtcccgggaagcagattttgaaggcttctacagtgttttcatttgtatctattgcctgttagcaggctttaacaacttctagttaaggttttattagcagtgacattcaggttttcagcctctggtgatgacctggggctctaagggttggaagaggaagacatttggggccttgtggcacacttcattgtctgtggctgaaagggtaacctggctgccttgtttttttattatccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggtgagagaccatgtattctattattttattaaccaatgatgaatagagacattttaggcaggtaggtgagtagcagaaagctccttattgccagttgcaggcagctccatcatagctttagtcagtgagaatcgcagccctgccttagatctcagcctgtttggctgtgtcagatgtgctgagatggtttcagagtggaagcaaggctcctcggctcaggcaccagggattcccatccccgctctgatctaactccctcattcacttaccttaaggaagctgaagtccagggaaacgaagtgacaaaagggcatggcccacagttacctgctctagtgtttttttcctgtgatgccattcggattccttctttagccgtggtttgctgcttctctaaatgaacactcttccaggcatgctccccatttccaagcacatcatgtgtgttttaacttgagcgattttccttatgtcatgctgcaaacctggagttctttttccctccgtttatctctgtcctggctttccttcagtgaagcctgacattagctgtgtgcccagcccttctccacctcttttctgcaagctcattttagcgtatgtagacgttggagcatctcatggtgttgagactgggatggcgtataggtctcatctcacatgccagtcctgattgctaagggttgccttgagggtcttgatgaacaagacagtggagtcaagtctgggctcagtgtgaaaaactgtgaggattaattagcttttgtgctgtaggtacacggtggggaggtggtggcaagggccatgtattgtaatctaggacatagtaaataatcacaagatcggccgggcttgttggctcatgtctgtaatcccagcactttgggaagccaaggtgggcagatcacctgaggtcaggacttcaagaccagcctggcaaacatggtgaaaccccgtctctactaaaaatacaaaaattagctaggcgtcgtggtgggtatctgtggtcccagccactcaggaggctgaggcagaagaatcacttgaggtgattcttctcaagtcacttgagggggtggaggtttccttgagccgggattgtgccactgcattcccacctgggcaacagagccagactccatctcaaaaaaaaaaaaaaatcacaagatttttgtcatggtggatttcacagccttgaagggccaagaccttttgcgtctttccagggaacgtagcatagggtgtggcttgcagtagatgcttgtcctgccattaggctcaccacctgttgaatgggagtgataatgtagactgagctgagcatggtgttgtcttctactcgctcagttactcaagtgtttttatagacaaaatagacttccttcttcttggtcctgctttaggtattaatggccaaaacattagcaggccacaaggtggttttatggcatgagttcaggagttctcagagatcttttggaattgaatactaaattttagcttcacagatgatacagtttctgctgtgttgtaagcacattataaagaccagtgtaatacacttgactggaatctaggtgtcctgtgttaagtcagaggactcagcccaaagactcttcgcatttatgaatggtttaaataataagaactgggctaatccatatttgaagatactgttgaatacattggcaagattaattttgtaattttataacataaacggaacgcatgcttaaatatgtttgtcttagctgttattggtctttttttctttcttttttgagatgaagtctcgctctgtggcccatgctggagtgcaggggtgcaatctcggctgactgcaacctctacctcctgagttcaagcgattctcctgccccagcctcccaagtagctgggattattggcacctgccaccatgcctggctaatttttgtatttttagtagagacaggatttcgccgtattggccaggttggtcgtgaactcctgacctcaaatgatctacctgcaaagtactgggattataggcatgagccatcgcgcctggtgtttcagtcttttttgcatttggttaactatgtttttcaaccttgtagaagtaagaggatgaggagggataaaccatttaaaaatatttgagtgcccaaagtgaaatctgttttgagagaactgttttacctaccaagaaaggcaaatttttaaaaacatccataccattatatgaagtcatggttttgaagtcacttacgtgttagttgttatgtgtaatgagtataatgaaatgacttattcaacaatgtatgtatttaatatccttgaatccttttaaaatttaccttttgcttttccatttactacactgcatcttcactacctgaccataggaaaataacagtttcctggaagactctcccctttgaagattgtttcttagaaggatctgataagcatttaataaaaaattttggggccctcagagatggatgcatcgatgggttgattgattgatagattgagacacggtcttatgtcactcagcctggatcacagtggcacagtcatggctcactatagccccaacctcctgggctcaagcagttctcccaccgcaggctcttgagtagttgggactacaggtgtgtgccaccacgtctggctaattttcatattttttgtagagatggggttccactatattgcccaggctgaccttgagctcttgggctcagatgtgagccaccacgcctggccagtgattggatttatttattgtacaattatttattcattatacattatttttaagtataaataaaccagtactattttgtaatatttattaatatggatttattaaaatgggttttgtggcatttttaacttcaggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggtatgtggggcagggaggccagaaagaagaaacctggggcatgagcctgtctgctgtgggagtgtatgcctggagtccaggattcttcctccgaatggggtctgtgtttctacgatttaaagaaatgtgccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcccttccttgcctcttcgtagcttatggtgatttgggcaatcttgggcattccttggctcgcggctgccttcatcatcatgtgtgttctccctgtgtctctgtcttcacatggtggtcttctttttttttttttttgagatggctggagtgcaatggcgtggtcttggctcactgcaacctccgcctcctgggttcaagtgattcttcctcctccgcctcccgagtagctgggactgcaggagtgtgccaccacacctggctagagatggggtttcactatgttggccaggctggtctcgaactcctgacctcatgatccgcccaccttggccttccaaagtgctgggattacaggtgtgaggcaccgtgcccggtccacatggcggtcttcttagaagggtaccagtcgtatgggactagagacccaccctacttcagagtgagctcatcttaaataattacatctgcaatgactacttctaaatctaaagaaggtcacattttgagatatttggagttaggacttcaacatgtcttttagaggacacaatttgccgtcatatttgtgagcatgtgttagggtataagctgagctgttagaggaaagcagccccttttcctgaagacgatttcctgtcttaaaaaacaggacagtaggttttggtgattgcttgctaccatccacagaaagggaaacccttagatttcaggaggatgggcgctaggtaacttaaaaagtttatgacaatctcagtgcctcttttttatttagtttttaatgcagtaatgaagaaatttggatttgggtggggacatgtgcccacgtatattcttaggatttaaaaggctatcctgaagtactttctttaaattcacctgttgatgctgagatttaaagcaaacttaaaagaaagacttgtatggaataggtgcttggtgacttcttgggaagaagaagcacgtttgctccatgaagttcttgattaccctttgcttcataatttgtgacctcctaggctttccctctgtctgaagacctccccagctgtggcccagtcctggctccttgatagggagacctgcgactcctgcttcagtcatcgccgtctgttgctctggatctcacactgtctgggaagtctccttacggtagtgagaattcctgtggtggctttgttctgtgacatgagcatcctgatgaccagtgttgcttttttggttgctggtgcttcatgtatttacttggctgacttctcagtctttttcttgtctttacttgctatttttttccccatgaaaaatttttttgagtaaaagctttctgcttgaaaactggtcaacccctgtgttatcagtgagttaactgatgtcagggcaggcttgtgcaagctctcacggtggacgtgtggcagagttgtaacttaaggcttttggatgcccccttctcaccttctcttctttctgccatatcaccttttctcttttcctcaacatttacttcatttttcctttgagaaatccttcatggcttatctttaaggcatactttatgtaatctcctaaattaatttagacctgcttttccaggaaaaaaatttcttccttcacatgtggctgtagaatgtctgatacagacctttagtgttttgaaacctttatagtgtcacttaactccattaaaaatttttttctagtaagtctgcgttgacggtagcttatttatggcccccaaacagcactctgaggcttccatctgaagtgtgacttttctttgctcaactctcatccttgtggtttcctctttgcatcgtcgtgggtattcagattgcatagtggctgtgttttttctgtctgaagaattagagctatgctactgtgactctcgacttcctgacttccaggtcatttatgaataaagtgctgaacagttgggtttttaaagggctctctgaatatgctcctggtaccatcgtggtttttatttattcagttatttaacattaaccttttctgtctttgaactgtcttaattactttagttgtaatagccttgatttctgcagtttatgccatcttgtttaattttgccatcttgtacaaaacaggctttgttttattttttaatttaaattgttttttttgtctccatttctgaaaggctgaatttgttttaaataccagctaaggagacgacattcttcctgtgtagaaggtctcctttttctgccctgttttgttcactgggagagtgctgggatctagttggtatggagtttgcttagcctagggagtgtgcatgcttctctcctgttccattgccatctcattcagcagctttgggagattctctcagctgctgtatgctttttctccacactctgtattccaccccacctctgtcagtaaagtagagaaatagcttctctcacggaaccctgtggagtgtttcgaggacttactgaggacttactgctcaatatttagaaacttggtatggatgggtttctgcggcaacacagcaaagcagatttcatttaaacctttctgtcctcaagtagtttccaggaccaccctctgctaaataaatatgtattgtgtcagcagagctcacctctattatgaatacatattcacctcctaaatgctcctgtgaggctgccgggcattttcccgaggggagacggtcgtagccaggaagctgtgggagcgtctctgctttggtggtagttctgttaaaatctttctaagtgtttaaaatgaatagatataatgggaaaaataacattttctctttctctctattcctctgggatgtgccgtggcatcacaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtacgtgtggttctttttttgttgtttttacttttttttaagacagagtttaactctgtcgcccaggctggagtgcagtgagctggatcatggctcactgcagccttgacctgctgggctcaagtgatcctcccacctcagccttttgagtagctgagattataggcatgtgctaccaggcccagcttattttttattttttgtagtgaggggatctcactttgttgacctggctggtctcaaactcctgggatcaagcagtcctctttccttggctttccaaagtgttgggattacaagcgtgagccactgtgcctggtcaagcatggtttttaatagcaccttagctcagaaggtcctggcttttaactgggatttagtgggtgggtggagaaccatgcataaataggcagcattgcagctatgagtaaaaagataccttttagttgctacctttttccttgaggaaaaactgaatcttaagcacactctcatcttgtcatggaatgtagattcatggaaatgttagctggaagcagcagtcacttgggactggaagttagtggtggtcacccagccatcacagtgagccttcccatcgcgactctcactctcaggagcagacctgtagcacttaaacagctgtggcctgggtgtgtcattccccaaggatcagctgtacatcctgtgtgtggcaagctgtacttgagttgaggcaccaccatggttaaaaaaccaccactcttaggcatactttggtgatttttatttaaactcttattgtgcctcaacctttttaatttcaggtctggtctaatttatttctagtctcagaccttgactaatataatttgcatagctcagtgtgagaatataatttgctattcaaattccagcatgttttgggtgtgattttggtacattttcctcttggggaatattatttgaggatgatttggattgaggtttcatgattcgggtcttggtagcactgagtctcgtggtttggtattgatgggatacaattcggtgatccaggctgaatgcagagatgataccttatttatctttgtaatttcccatcttgaatgtagtcatgtttcagactgaagaaaatggttttttttggcgagagattaaaaacaggttatatttacttaccctgttgttgacaacctatttgaatcgatttaagatggatttttagtcttcaccaatttgttatgagctagagattatagacggcattgtcctggtacatgactctttgtcatcagacgctccggtgagaagtgaaaactcagttatctaagtgtttttgacagacagggatgtctgtcagatggggactgggctgtgagctcagttgtcactggggctgttctgaggcttttaaagtaagggtttgctttgagtgggtgccccttgccactgtctggtaggagagatgtaggaaagtaatggatcttttagtttctgacattcatgttcagcctttgacgacctgagccaccctgtcttgctgttttccgacctttaggtgagcattggcagcccagagaagatggagcccatcaccaaggtgtcacacattcccagcagccggtgggcgctagtgtgcagcctctgcaatgagaagtttggggcctctatacaggtaattagcttcctaagaatggcttcattttcctttcctgcgtggtggggagcaggatgagggaaggctctgtgaactgtccaagggtttggagaggggactagaatccaggaagcaggacgaggttcccaaggggtgactccagccccagtacacacacctttaataggctaactgtatccggtgtaactagaacccaagctttcacagtcacagggtagttcagaagttcccctgagctgtgaggcggttgcagtttgtctctcgctaccctttctgcccaaagtctagcatcgcaacttctttccataggccaacacctcctagcagtcttagtgagatgttccttgacacggcatttgagagttggccaccctcccacctgcagtcactgagtgtagctgcagaccctggcccacctctgtggcggcctcctgagattgcaggtttccatggtgtgcgcacatctgttagtaatcaaggggacatgctaatgcatttgcagttggaaaaacagagactctttgaacacggcctgggtagaggggcatctgtgaggagttcctgtgtatgctgtcatctcattggggcatcatttggatgtctgattctttatggcaccaggcgcgcatgcacgtgtgtgtgtgtgtgagcgtgagcgaaagagtgcgtgcacacctgtgtgtaaacatgttgcctgcctgcttttgcatatccaggtacagacaagtataggatgtcatgagataggggaattaaggagggaatatagatggcatgctgtttttcatgtggtctaagaccctactgagaagttcgtttttaggcctcacattattgacatctagacagtcaggattagagaggcctgcagtgctgtgtggctgatgggggcccttcaggttaagtttggatcttctcggatgtactagcacaggccacaggctcttcttccttggtttcctcattgaattctgggagcagaggcactgttttgggatggcttctttctcaaagcagctcagcacagacataagctccgagagcatggtcatcctgtcagccatgggttttaaagaaatgacctcatttggcaaagtcggtttgtattttgactgataaatactttttgggaaggtggttttaaaatttttttttttttttttgagacagagtctcactctgtcgcccaagctggagtgcagtggcatcatctcggctcactgcaacctccgcctcccgggttcaggcgattctcctgcctcagcctcctaagtagctaggattacaggcgcgcaccagcaagcccggctaattctcatttttgtatttttagtagagatgggggtttcaccatgttggccaggctggtctcgaactcctgacctcgtgatccacccacctcggcctcccaaaatgctgggattacaggcttgagccaccgcgcctggctatttttaaatttttttaacaagccaagtggttctacttttcttctttatcactttgactagtgttcaagaatccaaaatataacagaaatatttggagggtgggtcatgagacagctggtgggatttggctggggaccttgaaatagtggagatatttttggcatgtgaatacatgacaaacgcctctggcccgagttggattggggaaggaggaggaaagagtggagcaggaagagaaaagggcagggagctgatgaacttgagtgtgtgtgtgtatgcatgtgtgagtgtgtgtgtatgggtgtgtgtgtgagtatgcgtatgtgggtgagcatgcatatgtgtgcatgtgtgggggtgtgagtgtgcatgtggttatgtgtatgtgtgtatgcatgtgtatttggttatgcatatgtatgctgtatgcatgtatgcgtatttgagtatgcgtgtgtgaatgtgtatgtgtgtgagtatgcatgcgtgagtgcgtatgcgtgtgtatgcatgtgtgcatatgtatgcatgtgtgtatgcgcgtgagtgcgtgagtatgcacatgagtatgcatgtgagtatgcatgtgtatgtgtgtatgcgtgtgagtatgcttgtgtatgtgtgtatgcatgcgtgtatatgtgtatgtgtgtgagtatgcgtgtatgtgtgagtgtgcatgtgtatgagtgtgtaagtatgtgtatgcacgtgtgcactggcaggaaacaggctgcagcagaccacattccccggtgttctgagcgtagaatttatgcccttgcctgagtatgccaatctggtccataattaatgtttaaaagaggtgggcgaatgggatctttgtttcccttttgaagagagatgatataatgacttttttgttgccattgacctctttttcccagaacattaatctaaagaagaggccaaagaaggctgatgatttttcatatcttcacagaatggattgattttattaaaagaattcctctctgaaatgtctgcagctgtgaaggctctggtttacgtttctgtaacatctgtttgctgagtcaacctgaatgggaaaacccagaggaaggccatttggcgtttttacaaagtcctgtataaatattctgctgcagttcatttctctttagggttagagcgcttgggttaagtgtagtttaagccaaacacagatagtgtctcagtcatctgttcccacttttacttcccacttggctgtgtgctacaagggaagacactttgtcttctcatgacagtggccaggtgtgtatgtgtgcgtgcttgtgtgtgtgttctgccaccaaagctgatttcatacatttcttagaattgaggttatttatagagaaaatacagatttatgtcagtctctgtggttgaagtgtttgtaagggtggaatggtgaagggagctggattttctcctcttctcagtaaaagagacctcatagtaatggaagaaagcctggttggcagtgagtttcctcttaaatactggaatgattagggggaaagcctcagctctagcctctgccatccttggtgatgtgattcaggatctgttgaatgagttgaattcaacttctcagttggcttgaagccgctggattctacagctctgtgcagcccctggcatgccccggtgatcacttggcttcacacaatgcagtgctgcttttcagggactggcttcagtcaccatgaggaaccaccttctagggatttgctcagcaagatcagtggaggaggagttaatcactttgctcctgctagaccagaggcttgttgtctggatcaaaggcactaaattgtggccctgtttaggcagtgagaggggaagtgttcttctgcataggttgctgatacctggcctctacgttgacctccctgtgacgcatgggaaggatctttcacggttctcctgcctctcttcagtggccaggatcggcgtgcaccgatctcagggctcagagccctccatgcatctggtgaagcttcttcgcaagtgtgaagacctttccctacctttcctgtgctggattcctcttgtctcctattttttggggtttttattcagtttctccttcgtgctgcttcaaggaagtgcactgttcattttctcactcgtgttgggactcttcctggctggggagtcaggatttatgttcaaactgtgagtagtagtcattcttcccaaggaggttcttattcaggtttgcaccaaaagagctcaaatctgtaagaaaacccaagttaatgcctgaaagtggactttgcatattgagtacagattcttttgaatatgatcctagtgccacacctcctttctctacacatgtcatttgtgtaatcatgtctgctccaagatgggatttggatgcagttacttttctgaggaagttagggtttggttgattaaacctttcatttgaagagggcccttaaattccaagacttggctgggcgcagtggctcacgcctgtaatcccagcactttgggaggctgagatgggcggatctcttttgcccaagagttggagaccaacttaggcaacatagggagacctcatctctataaaaaaaattccaagccttacctcttttaaaacatgacaggatcttgcagggttaatccacgtacaactttcctgtcatggcacatgcttgaagcatggctcttctctgtgcatgtgtacatggggtgcctagcactgcaggccttctgccatcattgctctataatggtctattctcatgttctttgtgtgttcttgacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgtatgtgtgtggcattacttacatttactttattaaaaagcctaaggaactttaaagaatttgtattcagtttatttttattttttcaagacagagtctcactttgttgcccaggctggagtgcagtggcgtgatctcggctcactgcagcctccgcctcccgggttcaagtgattctcctgcctcggtctcatgagtagctgggattacaggcgtgcgccaccatgcctggctaatttttgtatttttagtagagacggtttcaccatgttggtcaggttggtcttgaactcctgacctcaagtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactaccaacttgttttctcaagtaagttagttttctgtttaattcacacaatatcagtttatagcagatcctcaaaaatcatttaatacctgtgactacaatcaaggcatatgatcattctcagactgacaaataagtagccatcattagaaatgcagacaactgagtaattatggtgactgctcttccttcagacacacacctcggggcattgcatacctgggtaccagttctggatctggaagttaggtgacaggagtagatttcaggagggcttgggagcacacaactttaagaagacacagttgctgatgtggtgggtagccatgtcattcccaaggctgccacttcactctcattcctttcccctaaaagatgcagtaaatgtgagttcagcaaatgagtatttattcagataaagacgtgctaccactgcactctggctagcgttatggaaagtggccaagtcctgggggcagtcctgtagtcactcagtggaatggtcacctttgaaaatctggtagtggctacagtgtcccctgaacaaaaggcacgttcaactttagtgctgcaaacagttttggattcaagaaaacactgaaaccacttttagatgtcttagagcagtgtatctcagggtgttgtccctgacccagaaacttaggaatgcagattcatgggccccacctccaaagggtggttctgttttgtgggtaccccatgtttctgtttgggaacactgctttaggggaaagggatgatcaggtttaaggtggtgtgagagtgcacctggagatggtttaaatgttttttaagatacctccttgcaggcagttgggagaagataaagcaggggagggagcttggtggaacgggtgcaggaagaagggacaagctggatgtgttttgaggatgggagagcatcagtccagctctgcaggtggaggttgctgagcgttgtcctatagggaactttatgcataagggaagtcaggtttagagtcctcactactataaagtggagttggtcagggctgatttgttccgattgaaaaccatgccctttgctttttgggtttacatttagatatttcccatcagagatcatgaggaatagcagtgggatttttctatttagcagccatggtgtggtcaaagctaccaaaattaaatttgaataatatacaaagttcaaattccctggcttccccgttttccatttttaaggataatttcaagtaagagagatgtaagtatttctattacatgtctgatttgaatatgagagcaacctgtctgctcctaagatgtcaggatttgtttccattttttatttccaggagtcagattccttgttaatgtaaaaatggttctgtttcctagaagttttgaatctgctatggatctaggtctggcccctcgttcttgagcttcactcttaatttcccctgggtggaacaatatcgaagagaggaggatgttagccacttccattcccaagttggtgagaatttctataaaggacacctgcttcttggattgagggtgtgcagctgtcagagaagggaagaaactaccttaactaggctgattgacatccatgtaatatttactatgagacagggagagtgtttttattctcaattctttaaatttaaaataagacaggaaatgttagtgacataagggattgttagagaaaaaaagatgggaagatccgtaaagtgaatttgttaggggcaggagaagcctgacttggcattttcctgtttaggccaggagatattaccataatgcaaatgtgaaagcctgtgttctgtctctcttaatgcttcatgtcctcttgcaaatgagactgccttcagcacagctggaattattagggtttagtctacacttacgctctacaccagagtgcaaaatcttttgtgtcttcacaaggcttgttgatgcttgttgctgtcctcactgccaaaagaaaaggttggtgacctttggactttttccacttaaagtagggtgatactactttattgagtttatggggaaaaaattataaaggtgtcaggggaagagtttgctcataatgggatatttttaggaaagtgaaggcatgcctgtaggagctaatgggaaagatgtggtcagataaagatgctaccactcctgccactgagattacttaggaggtcttgtccacatattcctgaagaagggtttaattgtgtatttggtgtgctgtgtctgacatctgtgtttgcaggtccgtgtaatctaatcaggttgaccaatagaagattttaggactgaaggattaggggagtttagagactaattctttaagttttgtgtattgagtgatgacaggtggggaacaaatctaaatgttgattactgagcataggttagggttatgtgatccaaagcagtcacacatcagataggaagtagagccaactcttagcactgggtcttttcagttacaagcgaatcgggagagggcaataccagtttttcaagtgatgatgcagagaactggactggagatgtctaaccagcaaatcattggcaaagctggaaatttcctaggcattcgcacacctcatagcaacacataagctacctgctaactccaggcctttcagtgagttcagtgtgcagttgacaaagacatttactaggattcttggtaaccatttggtcttccagtgggcctggtgcagggggctccactttgatgacccttggccccatgtttacccagttcagcctcagaagatagttgataaagtgcagaagtggcttctgaactgctttaaagccattggccatccaagtaatagaagatattgatgcaataattagcaaagtcgactggcaagaggttgcaagttttgacttggacaccaatggcctctgtgccgggatgggttaggtgtgatggaggaggcaggacttttgtaggagttctctaggtgtccctcccactcctgtgggtccctaaccctcttcgatgttgcttctgcctatgttgagggctatatgtggaatccttcttatctgcccaaaaggagatcagagattggataaaatgtttaaagtacctattgatttcaagtatctgtcaaggccctagtaggagtaatttctcttaggtaaagaaatttaaaaagcaccaaagtactgttatactgtattgcttacttagaatctttattctctacattctaggttcggaacctcacttacatggtgacccgcagggaaaagattaaacggtctgtgtgcaaagtccaggaacagatattcaatctttacactaagcttttggagcaagaaagagtttcaggtatgcattaagccctggtaggtcaaagtatagggcaggggtttgtaagctttaacactgttgaggaagaaataatcatttcttaattttcttatagaagaatttaagaagcatagacgttcatatttaaaggaagtctttaatttgaggcatcatgtttaagggaaaaagctatgaatttgccctctataaatatgggtggaatcctgtgttctctgcttactgagcaaacacatgaaagtcttttgagtctccctaatttcttcatgtgcaaaatggagatatcgcaagctacctcttggaattgagagactaaaatgaaacagtgacttatatattacacagtacttggtaaacacatcatggggatacctaacaggtttatattcagccttgggctctatctgtaacatggtaaatatggtcaatatatgttaagactgtacttaagacacagtccatttttagataatgttcacagtagattttttttgtgtagatggattgttgactatttctgagattgagcaccaaatatttatttagtgtcttctattttatattgccctgggctaggcaaacagaaaaagaaaactagggtatatacttcctctactctggacaacacatcagttacttgggagatcaagggcaaagatcaagttgggcaggttgtttaacctctctgagattccgttgatcttaaagtttgttttagaatcaagaccccttaagtgcatttgagccctatattctgtgatcataagcccccaaaagtaggtagtataaggatttcagagaagcagagctgctgagtgtggatcaggcagaattagggacccatggaacaggtaggtcttagactggacttcattggaagatagtcagcctctctcctgccttggactgccctttaaagttctagctgcaccattcttggtgcttgcgttgtgcaatcatagttgattcactcttgtttttgtgcatttgtggctttttgtcactccatctagattattatggtgcacagagaacaaagaagttgttataacctgttgtgttgaaatccaaattctggtttatctaaccaattatgtgcgactagagggagctcggtcatctgaagaaataaaaaaaggtttagggaggtttaaataatgttcttgaagtgttacatagtttgaatgcaataacttgttgatatcctagatattttcttcccaagattaagtattttccaggtgaatcaagtgtatatcattagctggaacttgcagtttaattgttaagattttaaaaataaattttctaagtagggtgtcatatgtaaaagtaggtcgattcagattccctaaggtgagctctctcttcatgattcctacctgaatacaaataaatgagatctgtttaactgccttggaagactgtctggtgcagatcaccgagcctacagcagcaaatgctgagctgggatcactaatacaagttgtgcctgtggagttgtgccattggagggctttctgcaactcttaggtcattatgtaatgagtgattccctgtaaaaataagccgtaaagagcattttcatctggtttcatttgagttatttctcatggatattgcaggcaggtttttgcatttcatggctgaggtttttactgggtgagcgaatgatattcttaataagtctgggagttattttgtggtaacagagctgtaatgtagatctgcattcagaagtcctactatttcagaaaaggaaaacaaatcttcctttcattctgatgtaagaaccataggtatgatcagttgaaaacatttatcttcctgtaggattctgttgagtaatgcagttgaaaccctttagggtgctttttttctttttccagtcctaggcttcagtcgtgttcttattcatgcctaaaggctgtctcctgcctgaagtagagcagatggtcatgatttatatgtcatttagggtccatggtttaaactctgtgattctgagagtgggtagggtcatttgctgagagtgtcctcagtggcaacagtgcttatggggggtgggagggtcatgagttggaggctctttagagacatggattacagtcaaggagatagaaatcagagttcagaaaatgttagcctcttcttaccattctcttttcctgtggcaggtgattgagtaaaagaaatatatgcagtgtgatgtgaaggttgattctaatgattgattcttgagaaagcagcatttccaaaccagcaggttgtaaaacacctcctgtggtcatgacagctctgtgttctgagtcgctagctatgtttcatttgcttgcagtgtctgtgtctggtgagcactaggttctcatatggcctcctgtctcataacctgggggctgaaccttgttttcttggtggctcatatcttatgggagacagaaaacatgagaactgctctttctagatgatcttgaggctgttgtagaatcatggtctttatgacaaacactaatgtgttatgaattcacctgctaggggtaacaactcattagtgggttgtgagatgaattcagtgggtcatgaccagtattaaaaacaagtaaagtataataggaaatgtcagagtacattatcaaatgatgagggttaatattatttcgtgaaatgtgaactcttactaggtcatgctgtggaatttagtcactgtgatttgcatcaaaaaatacgaaaaacatcaatttaacttacttcaagttgaatgacaattcagttgaatcccacaaatgtattttgcacataataataatgaacatttttggaacgcttactatgtgtcaagaattatttcacacatttcctttattcattcacatgtttacatgtacttgtcctcgtaatagccctgtgagggtacagacacatagagaaacttacaagccccgagccctgctttttgggtcctctcagtctcgtacgggaggcagaagactggaccgtggaggagcgcggcgcaggtgctgctctgtaaccaggtagagggagcagaggcagccatcagccacctgatgagttctgcatggagtccgctctgaaaatcagatcagttattttgtttggaggaggtctagttttatgaaaaattatgtgagcttcagctgttttagaaaatgtggcatattgagtctgcagattgaatggagattctcaaggcaggtcatctcttcactataaaaaccaaatttgtacaaacttggtggtgtaagtgttgtgttgttgggtggggagttcacatcaattgggccacactaagggtgtagaattttattcttttggatttgcttctgctgtaatttttctttatttgtggttttatgtttataggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaaaggtgcatgaagagttaaaaatcaaattaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaataca

SEQ ID NO: 543 - DNA, 13228 bp, Homo sapiens
atcgccccctttcccctcccatctcccggccgtggtgcggcgcagctctctccccctccgcagtctcagtggcgagctctgggtgctgtggcccggccttggcggggcggcctccggctcaggctggctgagaggctcccagctgcagcgtccccgcccgcctcctcgggagctctgatctcagctgacagtgccctcggggaccaaacaagcctggcaggtaaagatgaagctccccaaacccaacaaccttagaacttagaaatttccctgagaaaggcaggacctacccgaggagagcttctttgaaggactttgaagaaagggatcaaacttgacactttctttcagtcctcaaagaaactaaccacccttcccataggcaattctgtgtgccggcctctgcacagtttaatattaacgacaacaatgtttgcattggaatataaatggaattctttctgcttaagcagtaccagaggggaccctctttatttttatgattgttaacagatgccattgagaaaggtatgaaacgcattcctgaaaagtctctttggcggggttactatgaaagctagcctctcccctctacccttttatcaacttggctgcggaggtcagcaaaaggagcataggaaaacgtttagaaaatgaggcggcgaaatgaagtagaaaagcttttgacttgctttgaaatactctagctgaaaaaaaaaagtgtgtggggtggtgatggtggatgaaacattggcaaaatattgacaatagttgaagctggtgatgtgcacatgggggttgtacttttctctcaacttaatacttttctctgtgcttttgtgtagtcttgaaattttctataataaaaggttttttaaaaagttgtagaaacactcccgcttgattgctctgacatttttacactgtccttgatttgaaaagaagctgcttgctgtgtctagggggctttcaccccttattaacccttctgacttctgaaattcattcttattttatccgaagtacatttgtctccacagaggattataaaagtcatattttgctggctggagaattatacttagaatctggtttataatttagaagagagaatgttaaaatccctgccaaataagacatgtaggcttgaaggtagaggccaagtatcatatggaattttatttttattaggaaatattagaggagttcctttagtgagggaagtggtagatgtggatactgtaccccatttttcttccagatagctgggaaaactgcatgcttttaagaagctttttcacgttttaaaatgtgagactgtttagcatatacttggcatacagtatgtgttcattagatgttaaaataagcaattgctagtgtgagttaattttctccattgggtaaatgattttcctctgcccaatgctcaaatatcaaacaagcatattgcattttaacagtaggatcagactcagaatttgggaggatagagctactttaccttagcactgaggtaactttgcagatgagaaatctgagatggagaggttaggaaacagtaaagttaagttagtagtatgcaagctattattttataactaaaaaacgttaagcttcgtataggtaaaactgatgtgggttagctaaaaacattgtgaccatagatgctttaaaacctgaaaagtagcatacctatttatagatattctttgctctcaaaggccaacttgaaaaatacagataagtctagagctatatgctgtgcacttcataaggcagcatatgaaagagtcctcttggggttcctttaatgtcattcacccaaaatttgatttatccataggattgcacaaattgagatgtacaggtcatggaaaaatagcccccaaacaaagggaggttttgttttttattgtgatgagaaacagaagttgtgggttactgtaaaataatcaactgtgtaactttaccatcttcctttccctcaagtactgccaaactttttaagcagacatttttttggtctccatttatgaaactaaacttgaaaatagtgctatggtatgatattttgaatagaaattggcccactgtcaatgaactttcttgccatttattctcagcctagaatcagtggagagcttatcctttagtaatggattataaagtatttgataaacgtgaaatatttggcaggttcaagattttccttagcattgaaataaattgtggcacatttgggggactagttaacagtgctgtaggtcatgctggaagtgtgctggcactacaactgtttttgaaaaactatctgccagaaaattgtctgactgtagacagcattatcagccctcagttcatcaggatgggctctgtggcctgtaggtaggtgggttttctaaatataataaatttcatatgtctccctatgtcacagccatttagtatattattagccagttaaaagttttgcccctgctgaatcttacatgcttttaaaataaaatctatttcacagctgagtaagtgtaaacattttaaatacctgcgttagatttgccatcaccaggctaattttgccatctagtggtagcaacatggataacaggcaagttcttccctggatgactaggaattgaaccttcctgagaagcattgatgagtaaattacttgtgttttctcatttgtggtttactctagaactttaaagctggaagaaatcttagaaatgttctagtccaactcaacagttaaggactatcagagagattctttaaaataaaggcttcgaaatgcatggcggagttagcaggtggtatgcatttgttgaatagacaaatttatctatcctgttctaattcttgtttttcctctagcaatattgcatcctaccactatgaagttttatcgtgatcttctgtttttagttttaaaattgcatttctgtatattatttcttaaaataacacattttcatttatattttaagtcccagaaggaaacattcttttctactgtttttgtttgtttgctttgagacagggttgccctgtctcattctagttgtccaggctggagtgtagtgacacaatcacagctcactgcagcgtccacctcccagcttaggtgatcctcccaactcagcccagagtagctgggaccacaggcatgcgccaccacacttgtagagacagggtctccctatgttgcccaggctactctcaaactcctggactcaagtgatcctcccatcccagcctcccaaagtgctaggattacaggtgtgaggcaccgcgcccggcccttttctactttttaatcactccctactactactacttctcttttcttttttttgacggagtctcgctctgttgcccaggctggagtgcaatggcgtgatctcacctcactgcaacctctgcctcccggttcaggggattctcctgcctcagcctccccagtagctgggattacaggtacacaacagcatgcctggctaatttttgtatttttagcagagacggggtttcaccacgttggccaggctggtctggaactcctcacctcaagtgatccgcccacctaggcctcccaaactgctgggattacaggtgtgagccacagcctccgccactccctactactactttctttctaaacagtcaggcagactgttgtaaaaactcgattctcacctttgtaagtgtagcagtttcctactgctgctgtaacaaattaccgaaaactcagtggtttaaaacaacacaaatttattatcttatgcatctggagatcagaaatctaaagttttggctgggcacggtggctcacgcctgtaatcccagcactttgggaggccgagatgggcggatcacgaggtcaggagatcgagaccatcctggccaacacggtgacaccccatctctactaaaaatacaaaaaaaattagccgggcatggtggcgggcgcctgtagtcccagctactggggaggctgaggctgaagaatggcgtgaacctgggaggcggagcttgcagtgagccgagatcacgccattgcactctagcctgggcgactgagagagactgcgtctcaaaaaaaaaaaaaaaaaaaagaaatctgaagttgtattgtgatcttctgtttttagttttaaattatatttcttcatatttttcttaaaacaacacattttcatttatgttcctccttctggaagttctaggaaataattttccttacctttttcagcatctagaggccactcatattcctcagctcatgatcctgcattgctctggcctccgcttacatctatcagctcttcccactcttaacccgtctgcctccttcttatatgagcccctatgattgcattggacccacctggataacccagaataaccacttcaccttaaaatccttaatgtaatcgtatttgtaaagtctcttttcttgtgtgtgggaaatattcacaggtcctggggatgaggatatttggcataccacaatgaggcagttagagatgtatgaaataccttgtaaatatctacctgagtgttggctccccctgtttgatatgaaaaacattggctttaatctttgtggagtgcttactgtgctctgggcattgtgcttatcatattagtttctcacaaaaatattctcaaatattatctctatctaataaatgtgggaaataatgtctagagagattaggtaaccttcacaagatcacagtgtaacaagtggcaagtgtacttaaggttgatttggcttcaaagcccactgcccccataatcattgaaacaccctagttcttactccccttttttattacgttacagacactgttattttctcatacactctctaaattaaatgttacctccatgtagtgctgctgtcagggagcgcctcagtggatcaggaattagttttcataagataccccctctcctcagcatctgttcccccaaataaaactgactatgaaagtttttacaattgtcatccaaaacatcaccgctttctttagtgcttgctttattcctgtttatgtcacttgtaattctccccctctcctgctgtggccttttgcctaagccatttctctctgcagttattcagaatcatctggccaggccccagtgtctccctgttgtgtgtcaatcctgagtaggtggaggatgaaagtagaggaggaaatgagggcatgtcttcacatttaggtatgcatgtaaacagagccagtggtgttaggaagcacaggtggttgggattgcagatggctaaatagaggacagccaagttttaaaaggtggtcatgcaatcattggtgtgtactaacatacacactaaagtagagggtggtgttggccctatggggtcattgatatgactgagtaattcctgacccacagcagcctcccaggaactgtttgatggatcaatgcaaagttgtgtcccatggcaacatgctatgtacataaatatggacaagtacctcactagacattacaaggaaccaggtgaaaagaaaggcataagtaattgtgaatctgtcacctagtgagggaaagcaattcaatgcaggtccttcaatggtaagtcagcatctttgctttctcatagacaggaaaaataattgatttgaaatattaatatagtgggcagccatctaatctttcattagtttgtctgctctatctaagctagactataaacttctagggtaaaaaacaaaacacaaaagagaaactgagccttaaggtataatgtcatttcatcataggattctatatactctagatagactcactcaaaaagttgtttttttttcattgtagatcactcccttagagtaattatgttgacatagactctgtttctttttaggctgagggtctgatgcagttccaaaattcccagtgtagatccaggctataaataagacacagaaaatgcaatttaagtgttttgtggctgcatagtgtttaatcacacttaagtttaatagcaatgagaaaaatatattacagagccatggatattcatagaaatgagtaattaggaaagcattcatttgggaagtctctaaagtgaagctgtccttgaacgaaaaacaaaacaaagaaaaagcgaattttagagtgagttggaaactatcttgaaataaaaatatttgactgtaaaactgactttttagaaaactacaagatctctaattttggcttatataacaacctgttttgaagtgatacaaattcaccaattaaggtaggataataattataaaataacatgtgttaactacttactatcctctgggctcagtagtaattctttgcgtgtatcatctcatttaatctccataacaatgttatgaagtcgaaattactataatattatccccactttgcagatgaggaaagtgaaacttggagagttaatgaactgcccacatgcacatgcctcataagtggtgaaaagggaattgaacccaagccttcccactccttggtctgcactcataaccactatgctggtacagatacacaaatattctcaacgctgtcagcaatcacatttctaagaaactataaacaaataacaaaagggtaatagtaagtgatctcgtagtcaagtgtggtcacttctattaatagattgggtacaaatgtgtaattacatctcttccatcagtaagagttcatctacatacacagatattcttacttcttccttaattcccttctactcaatctgtcttcaggatccagcccataatcagctgtgtgtatgctgactcacagtggtgggcagcaatcactgcaactttgctttcattaaccaaaattggaatttgaagccccaaatgcaagccatctggaaatggacagtgaaggtcacagttatattggaagacaggaaaaatgagggggatggggaagccaagggatgttagactttcaaaatattatagctgccccttcaactgggactgtgtctttttagatcaatgagttagtcctttttggataatgggcatatgtagatgtctccactgaacaaactgtggattgctctatcagtaagagctatcatttatgccacattgacattttaccacaagacaaacttagattttccaaaagaaagtgtctttaaacatttgcccaattttaaattacaggccaaattaggctaactaaatccatgtcctcttattactgtgattctgaggtcatattacaaagctctgcccttcccatacccaagggtagacgtgggcatggtttttattcctgtggtacactgcacagagctccctcaaagggcaccaggcagggctggtgaaccaatgccattgaatgatctgtagtatgagatattggaggcattacatataaaccttatgaacttcacttttgccattgaatgatctgtagtatgagatattggaggcattacatataaaccttatgaatttcacttttttgagacatatgatgcacataggatcactatgtgatcctagttcacaccactgcactccagcttggtgacagagccagactgactctcaaaaaataattaaaaataaaaataaaagttagttatgtttgttttttattaattggctgagttatttgatattgtcagttgctaacatagtaaaagcataaagtcagaataaattaattttgtacacagagatgaagcagatgtcatttaaaacccgggtaagccatcatccttggaaagaccaccttctggggtatggctcatgttgctacaccagagccttggctactgtagtggttcttaacctttattgagtgtcaaagtcatctggagggccggttaaacctagctgggagtcactctccaccaccctttcaggagagtttctaacagtaggtctggggcaggccctgagaattagcatttttaacaagtttccaggtaatgctgaagttactagtgtagggactgtcctttgagaacccctggtctggtgtttccttttggcgagcaaccaagatatgggctctcaaccaccgttcgtaactgctgtgagaatgtgaacgtgaacacagagaaggaaaaccatgcctatatcattggtattgtcatttgataagtcaaatcattgctttgtaccaagccaggtttcaaatagcattgaaaatttccaaagtattgtccaaggcctttgactagaacaatagctttataaaccagtgtcatctacatagccagaaataaaattatacttaaatacaattcaactctgatgaggctttcttaaaagtctggctacagaattatggcacaggataaacgtaactggggaaaaaatatcacagtaacactatttagacatcctttattttgcccaggaatgcctttcacaagtgtattgctcctcagatcattagtaccaagcattaagatataccaaatgagatactttgtgtctcttgacgtggatatttggctgactttcaagctttgatgtaatcatatattaagtacacagtggacagctgttgtcataaagagctaaatgaaaaagcaattaagaaaaaagtttcccacaccaaaacaactcccttgattgaaattttgctgagaatcaagtagatttaaaaatatacataatgatatatatcatttttatctattttggtttgttgataagctaagtagcagcaaataactctttgattttcactttttttttcagccaaggacataaattttcatcctgggaactacaatttcaagcgctcagtagagttactgagttgtgagcctttttcattctaattaaataaacttgatgaaatactattgagaaaaattgcatagaagacaaaataaaatactaagtggctctactctacaaaatccttgatgatataattactgttttgcagcggtgactattagaaaatattgtgacgtaaatgcagatttcctcccctcccctcccctcccttctccttcccttccctcacctccccccctcctctcctcttcgacagggtctcactttgttgcccaggctggagttcagtgccatgatcatggtttactgcagccttgacctcctgggttcaagcgatcctgctgagtagctgggactacaggtgtgtgccaccatgcctgactaattttttaaaagttttttttgtagagatgaggtctcagtatgttgcccaatctggtcttgaattcctgtattcaagcaatcctccgatcttagcctcccaaagtgctgggattacaggtgtgagctaccacacccggcctgcttaatatttccaaatgtataatggttcaaattaattatgttatgttttcattaatatatcacatttaaacaataaataggttaatgtagcatacatttttcatcaaaagaatgttttagtttgttaataaaattattgtatttgtatatggcaacataaattctgttgtatcaagggataccgatattgaactttgcatcagggttgacttttcccttttgtgccagtgcacacatcctgtgggtgtaccctgtggtacaatggctgtgggccattgctaatgtgctttcttttccatgcaaaaaagaaataaataaaataaagcttatcagaaagcattgaggatgaatgtattgtagggataagcgaatgctgcattgcctctgctttatacaaagtacaaatcatttgcttaagtcttgatattttaactattagttaaaaatgacttggagcatagttggcaaatactagcgacacagaggttcaaaattgctgctccagcatgctcctactatacccacctccaagcaaagatggctgatacatatcagttccactaaatagatacatgtacatgccagtgagcctcaagaaaagaaaaagagggcaagaagatgtgaatagtaggagaggtattatataatttattatgtactggcacctttaacaatatttaaataacacaagaacactggtcttagatggtgagacctacggtgaaaagggactatatctaaccattctcatgtcccccccaaacagcctgtacttcataaattcttacaaataattttaatatgcagtaaagtcccaccataaggcattttgtatggagctttgcttagagggtggtttcaagcacaactttgttttttaaaaatacatggtacatttttcttactttagcataaaatggcctgtgctatatattttctttttatgaccaggcattctatacaaatcaaaacagatcaatagaagattaattagcaatttatttattgctaatactcttactgctttaaaacattatccaagaatttgcattgcaccttcacatcagtttgggctgcgaatcctggttcatggacattcactgtatccaatgagcagttttttgagctctgtgctaggcagttacagtctagagatggagaagttatgatccctatttttaagtagctaagtgtgggaaaagactgcagcacatttgcttttatctttatttctaaatcatctggataaaaagttgtaggatatctaaggaggagagtgtggcttagccgacagaggattccaacctactaccgtattctactctctcaggcacgaggctattaggggagatagaggtggagatgacaggttggggtgggagcgaggtggattagggctggtggagggaagtttgggtggaaaacaacttactgattttggaagtctgtgtgagcccacttaccagtgtttatctaatctcaataaaatctaggtaaggtgaaaataaggacacctctttgtggtgaaggtacatttaggatccaagggctgaatgaaatggataagtaagatttaaaaaggaaacattataaacctctctctttttctatttttaaggacaaaattagaagatcaaaatggaaaatatgctgctttggttgatatttttcacccctgggtggaccctcattgatggatctgaaatggaatgggattttatgtggcacttgagaaaggtaccccggattgtcagtgaaaggactttccatctcaccagccccgcatttgaggcagatgctaagatgatggtaaatacagtgtgtggcatcgaatgccagaaagaactcccaactcccagcctttctgaattggaggattatctttcctatgagactgtctttgagaatggcacccgaaccttaaccagggtgaaagttcaagatttggttcttgagccgactcaaaatatcaccacaaagggagtatctgttaggagaaagagacaggtgtatggcaccgacagcaggttcagcatcttggacaaaaggttcttaaccaatttccctttcagcacagctgtgaagctttccacgggctgtagtggcattctcatttcccctcagcatgttctaactgctgcccactgtgttcatgatggaaaggactatgtcaaagggagtaaaaagctaagggtagggttgttgaagatgaggaataaaagtggaggcaagaaacgtcgaggttctaagaggagcaggagagaagctagtggtggtgaccaaagagagggtaccagagagcatctgcgggagagagcgaagggtgggagaagaagaaaaaaatctggccggggtcagaggattgccgaagggaggccttcctttcagtggacccgggtcaagaatacccacattccgaagggctgggcacgaggaggcatgggggacgctaccttggactatgactatgctcttctggagctgaagcgtgctcacaaaaagaaatacatggaacttggaatcagcccaacgatcaagaaaatgcctggtggaatgatccacttctcaggatttgataacgatagggctgatcagttggtctatcggttttgcagtgtgtccgacgaatccaatgatctcctttaccaatactgcgatgctgagtcgggctccaccggttcgggggtctatctgcgtctgaaagatccagacaaaaagaattggaagcgcaaaatcattgcggtctactcagggcaccagtgggtggatgtccacggggttcagaaggactacaacgttgctgttcgcatcactcccctaaaatacgcccagatttgcctctggattcacgggaacgatgccaattgtgcttacggctaacagagacctgaaacagggcggtgtatcatctaaatcacagagaaaaccagctctgcttaccgtagtgagatcacttcataggttatgcctggacttgaactctgtcaatagcatttcaacatttttcaaaatcaggagattttcgtccatttaaaaaatgtataggtgcagatattgaaactaggtgggcacttcaatgccaagtatatactcttctttacatggtgatgagtttcatttgtagaaaaattttgttgccttcttaaaaattagacacactttaaaccttcaaacaggtattataaataacatgtgactccttaatggacttattctcagggtcctactctaagaagaatctaataggatgctggttgtgtattaaatgtgaaattgcatagataaaggtagatggtaaagcaattagtatcagaatagagacagaaagttacaacacagtttgtactactctgagatggatccattcagctcatgccctcaatgtttatattgtgttatctgttgggtctgggacatttagtttagtttttttgaagaattacaaatcagaagaaaaagcaagcattataaacaaaactaataactgttttactgctttaagaaataacaattacaatgtgtattatttaaaaatgggagaaatagtttgttctatgaaataaacctagtttagaaatagggaagctgagacattttaagatctcaagtttttatttaactaatactcaaaatatggacttttcatgtatgcatagggaagacacttcacaaattatgaatgatcatgtgttgaaagccacattattttatgctatacattctatgtatgaggtgctacatttttaggacaaagaattctgtaatctttttcaagaaagagtctttttctccttgacaaaatccagcttttgtatgaggactatagggtgaattctctgattagtaattttagatatgtcctttcctaaaaatgaataaaatttatgaatatgacttaa

SEQ ID NO: 544 - DNA, 13228 bp, Homo sapiens; identical to SEQ ID NO: 543

SEQ ID NO: 545 - DNA, 154936 bp, Homo sapiens
caccaagggctggccgcagccactgtagctgagctcagagccttctgtgtggtttgcgggggcaaggtcagctgccccctgccctctctctggggctatttgaggaatgcggcctttttgcataagaaaggcttttctctacagtaactgtggtcgctgatcaatgacaccttcctggtaacatttcatattgcttttttggaggtgggggtgcagatatctttaaaacttgcatgcgattgtctttcttttaatcacataaacatcatttaaaaccaattcatattttgtattgtatattaatgcctttcattcctgtattttaaaatgctatcataatcatttttcgaaatacatatttaattattttcatctgttcaatcatctttctttagtaattaaatgaaaatagcactttattaagaaagacaaatgttacatattctctgttttagtgttttccagaaatttgctatgaaatacgactggttgaaaaggagagggtcagagactttcctgagagccacaggacaaaatttacttacaatcgcaggcttaaagaagctatgatagtttaaattacgtggcttagtttgttcttattgtggaaggtgcacaaggaattaatttgtgtagacagaacactgagagtcccattctgaatgcagagacagctactttgctaccgtgcaaatgagtgtcgtcatattgtttgtttttctccttacccaaaagctatagacattggcttgcatatttgagtattttcactttggttttgtaaatggctgcttgacttgccttcctacagaaaatccataatacagagatgtattattttcttactcctttatgagtgattagtttgcactgaaataaaaatgccactcaggaaatgtcatacatcttcaagcagcatatattttaatagtatcatcttgtagaaagggaattacaatctttatttcttctatatcaatgagcaaactacttttttaatttttatatgttcatttttattgacttagtcaatagtttacctactttttaggttttacgtgctccattaatgtccattgttttaggctgaacctttgacactcctcatatatcgtttgtatgagactagatggcaagtaaagataggattcctcaccctaggttaaacactaacttcctcttgaagaaacaacttaggagtccaaaaagcaggctaggaattgtttaggttctgcaatacgaattgtgcaaatgccaacaggattgaattgagagaaacacattctctaatgaaggactcattcctgcagggtggatctatgagattcaatagcaaatggctgttatacaagtaatgaaatcctcaatcttatggtctaaaagcgattctggggggcacttatttaagatacatgagatgtgaaaaagcaatggaccaagagcattgatagtttatggatatttttatttcacattattgatagagctttgtttgccaggcaatgctgcagtcaggcactcggggtttcaataccctatacagaaaatctcaagagcagaccttggttaatttttttaagtaaccctcatcttcattcttttattgtattatgacctcgcgccattgaccttaaatttcactacaaatttagaagaacctaatagtcattgcaaactagatagataatggtatttatgtaatgaaggacaagggaaagatgattcccaaatctgaaagaaactagaagttttctggggaaacaaatagaggagataagatttactggtttattcttcattgatgagagttgcgttctgttctgataaatggaaagctccattgaaattacagatggtcctcaacttaagttggggctacttcccaataaaccatattgaaaatggtttcataaattgaaaatatcaccataaattgaaatatcataaattgaaaatatcaccagtcaaaatgtgtttaacatgcctaccttactgaacatcatactttagtctagcctgtcttaagagtgctcagaacacttatatttgcctacatttgtacaaaatcatctaacagaaaccatattttataatgtgttaaatatctcatgtaacttattgaatactgcaatgaaaatgaaaagcagaatggttgtatgggtactcgaagtacaatttctactgaatgtgtattgctttctcacaattataaagttgggaaatctgaagtcatacctcagggagtgcttttattacacaatacaggtttatcagacgcatataccaacaaatcataggaaattcaggtttgggtcaagggggaggggttcaacctacttatacatatttccttcctctctgttgggctacctttatccttgggattgttgcaagatggccgtgtcatgtaaagggctgtgtcttttagcatcatgaataagatgaaagagttgaaggccaacttcattcaaatgtcttctcgatgtgtccttccctttttctcctggactgctctgtgatccatgtctctgtagaaaatggctggcataagtcaatttctgactgggagctgtcatgattactgtctcccactgttaacactgtacttggaggtcttgatggaattgggcaaacctgttctttcagaccctcagtttcatctcaacacaaaactctccaaaagtccttgctgctccacagcagggaactctcttgaagcaataacatgaggaaatagtgggcttgcatggctgcctcacattcctcaggtatcactgtgctcattgcctgatgtactgtgtcttgccaaccatcattccacgtaatttacccattcttggtttttacattggttaaggcatgtacaaaccctgttagtttttctgcagtatttggattcataccttctgaaattacttgacgattactgtgtctctggttatttgcttctagttggcaatacaaaggaacaatgtgaatgaaactcataaagaaaaacctatgatttaatgggcgtgtgtaacactagagggaaggtcagagttagtctatgcatgggtataggtaggagtctcagtgggtgtcagccattctgtgtcaacaaatcaaatatttaaggtggatctaaaagaaaggtaatatctctgccaattaaactagagtcacgcattgactaatggcaaatacagtctaagaagtgcatttttaggcaattttgtcattatgagaacaacgtagagagtacttacacaaacttagatggtatagcctactacatggctaggctatatggtaaagcatgttgcttctaggctacaaacctttactgaactgtaagcaatgataacacgatggtgtcatatcccatatatatacacatacacacacatacatatatatacatatactatagtaaaaatatgatataaaacattttttaactggtactgctgtttaaagcagatatcatgagtggattttgcaggaccggaagttcatccaggtgagtgagtgagtgagttgtgagtgaaggtgaaggtctagggcattattgtacactactgtagatttaagaaacactgtatgcagccgggcgcggtggctcacgcctgtaatcccagcactttgggaggccgaggcaggcggatcacgaggtcaggagattgagaccatcctggctaacacggtgaaacaccgtctctactaaaaatacaaaaaagttagtcgggtgcggtggcgggcgcctgtagtcccagcatactcaggaggctgaggcgggagaatggggtgaacctgggaggcagagcttccagtgagctgagatcgcgccactgcactctggcctgggtgaaagagcgagactctgtctcaaaaaaaaaaaaaaaaaaaagaaacactgtatgcttacgctatactaaatttattttaaaaacctgaagtaggccaggcgcagtagctcacgtctgtaatcccagcactttgggaggttgaggcaggaggatcacgaggtcaggagttcgagaccagcctgaccaagatggtgaaaccctgtctctactaaaaatacaaaaattagccgggcattgtggcacatgcctgtaatcccagctactcaggaggctgaggcaggagaatcacttgaacccaggaggcagaggttacagtgagccaagactgcaccactgcactccagactgggtgacaaagcgagactccatctcaaaaaaaaaaaaaaaatcctgaaatactaatgacattatgattgctacaatgtcacaagataagataaattttcaactccattgcaatcttatgggaccagcaacgtgcatattgtctgttgttgaccaaaacggcccttatgtggtacatgaccctatacacataacagcatattttatatttatggaaaaagcccttctagaattataaaatcacaagttttactcacataaaatttaacacaatattgagattaactcataaatgaaattataaaagtcttaaaattttgactatgatagttctaaacaagattttaatccagagaaatgaatgtgttcacgtaatcctctgtggcataaagagtaatggcaatgaaacatttcttaataaaacaggctgcatcattgtcagtgcgatttgcaccttcccgttgacatccattctgtaggtattgaatgcaggtgatcttacctgaaggtgacaacagaagattttattacaagatcacgcatgtgccctcaataacgccatgtcattgatgccaccagggtaacagctattgtgataaaatttgaaaaataaacatatgtggcttgaacccgggaggcggagcttgctgtgagctgagatcgcgccactgcactccagcctgggcgacagagcgagactccgtctcgaaaaaaacaagaaagaaaaaagaaagaaaaataaacatacgctaaaaatttagaaggatagtaagtaataagcatttgattgcttgagcccaggaattggaggctgctatgctctgtgatcacaactatgaatatccattgcactgcagcctgagaaatatagctaggctccatctctaaaaaagtaaataactaaataagtgtttgaaaatatttagcaaggaagccatactaatgtagctgaatcttggaaatcaagaaaaaaaattgttcgtttaaaagggcaaaattaaaaaattctttccagatagaaagaataggtgcagatgatagagcagcgtggcccaggggaggggctaagcagtggactaaggatggggaggctggagaagaggctgaggggagtcacatgttgtcctgagatgagaaagggaaaaaaagaaacatgttcatcttcaagtgcaaactctcttcagattgaaagaaagtttttagtttcttgggaagcagaaaagaatataggtgaggagtttgagagattcattaatttctttgtgaaattcaacataaaggaagatattctgtgttgctctttgttcactatatgtgtggggctcacagggaagcaatatagacaaagtttccaaattctcagatgttaaaggccaatggggattcagaaaacgcaacagaaactaaactgcaagtggaagagctgcccttgggagcccagagggcaagtttcaggcctggactgggtgggcaagggaggcctccaggaggaggagctttggaggagattgtggagagtgaggagcagtgagtccagcaaacagggcagggaaagcgaggaggaaacagtgtgtctgtggcacaggccagggcatgagaagagggtggtgggttggaaggaccactgggatgagtaatacatgaggaggcaggagaaggaagggcagaccatgcagggactgggcatgggggtgagggtgccgggcagctcagaaagtgatgcaggggccgctctctgaggactgcattctgtggggagggatttgaatgtctcagttcttttatgaaatgttatccccaatccatgaggtcttctgattcaggaaccagtcagaacaggtgagggtggccccagtccactgtgcaggaccattagcattgccaggaggggttggtgctgaggacaaaagagagtgaaaaggggcaaagaactttctttcctgtctgtcattttgcagatgtaagtgggatctgtggatctgaaaattcacagtggccagctcaccaccacctgatgaaagatacaccacagggtgagagcatcctaacagcaaactgcaaatgaggtgggtttgcagctgcacagagaagggaccccagggaagctacacgggcaaggcaggcaggggacttcagaggtggtagcagtgggtgttgatgaaattattctctgaggatatacacgtttgtcagtgtacgtgcatgaccgcttacatgttgatgttcgcatacaaaccccacaattttctcatgtttttcagagcatagcatgtattttgactttattctttctaccacacgtaaccatgccttgtatacctagcaatacttaacgtttatttttggtggattattcatggttaatgcatttcctgacttggtagccaaatgaaattaccttgctttacaggcctttggttgatcatttctgaagatttgtgtcgcctgaattcagtgggggtcacctctccatgatcttaagcaacagtcctgttgggactgttatgctatcctacttaactttggacttgtatgtcctggaaaatatgaaactatcgatactcacttgaaaattccaggtgctttaccttttactttgtttttgccgtgtttccaatgttatatattttctcccacttactttggattcaattgctctgcttccttttacagtaaaaatttagatgtttgaattttgggtttcaacttttctaatatatacacactcaatgctgtaattttcctctaagcttccctgttgtagctgacaaattttgatgaggtgtgttttcctttcaatttagttcaaattattttaaaaaatttctcttgagatttctttgacccatgtattatttggaaatgaattatataatctccacgtattttgcaattcaccagtttttaaaaattgatttctagcttaattctgttgtgttttgagtgcatacattgtattagtctgattcttttaaatggtttcaggtgtgttttatggaggagaatgtggtgcatctcgatgagtggtcctgtgggcttgagttcaatgtgtattctgcccgttgttggataaagtctgtagatgtcaattatatccaattgactgatgatactgttgagttcaactatgtccttactgattttttctgcttggtggatctgtctatttctgatagaggagtgttgaaagtctccaacgataatagcggattcatctatttcttattgtggttttaacagtttctgcctcacgtagactgatgccctgttgctctgttgttacatgcatatatattaaggatcattatattttcttggaaaatcgatccctttattatcacataaggtctttatccctgataattttcctgtatttacattacattctttctgaagctaataaagctatgcctgctttcttctggttactgttagcaaggtacattttgtttcattcatttacttttatatgtacttttactttttttacatttactcttattaattgacaaaatttgaggtattgactatgtaaaatcttcacatcatcttcaaacatgatgtttgaagaataatatatattgtgaagtgaaaaattcttgctaagaacatatgtgttacctcacacagttatttttcgtggcaagaacactttacatccactctttcttcatttttcataatgcaatttattgttaactatagttaccatgttgtacaatctcttgatctttttcttcctatctaactgaaattttgtacccattcacaatcatctacccatcctcatcccctaccacccttaggccctagtactcaccattctactttgtatttatataaatgagcttttttagattccgcttacacatgggttcatgtggtatttgtctttctcttcccggcatatttcatttaacatattgtcatgcagatacattcattctgcctccaatgacagtaattctccctttttaaggccgataatatcctgttttgcatatacactgcattctttttatccattaatctgttgatgggcacttaggttgatcccatatttggctattgtgactaattctggaatgaatgtgggagtgcagatatctatccaacacaccggatagtcaatgaaatctcccaaggcagattttattacctttggatatatacccagtaataagactgctcgatcaaagggtaattctattgtttttttttttaggatccttcacaatttttcccataattactatattgtactaatttacattcccaccgacagtacacatgttcccttttctccctatctttatcaacactaacttttgtcttttaaaatagccattctaacaagtgtgagatgatatctcattgatttaaatttgcaattgtctatgtatgtcttcatatttatacagatttccaatatacaagatataacggggacttgtttttagatctactctgacaatgtgtctttaattggtgcatttcaaccattgctactcaaagggattactgacatggttgtgagaggtgaggccagctggacttcctgggtcgagtggggacttggggaaatctcctgtcttacagaggattttaaaatgcactaatcagcgctctgtaaaatgcaccagtcagcaggattctaaaagtagccaattgaggggaggattgaaaaaagggcactctgataggacagaaatggaacatgggtggggacaataaaggaattaaagctggtaaccccagccagcagccacaatccgctggggtccctttccacgcaatggaaggtttgtctcttcgctcttcacaataagccttgctaccggtcactctttgggtccatggcatcttggactaagagtccaaggtcagttcaacttggtggagcaagctggcagttagatgaaaaatatacacagacttgctgcagctgtacagatgatgaacgtagaactcaaaagatgatggaggccgggcgcggtggctcagggcctgtaatcccagcactttgggaggccgaggcgggcggaccacgaggtcaggagatcgaggccatcctggctaacacggtgaaaccccgtctctactaaaaatacaaaaattagccaggcgtggtggcaggcgcctgcagtcccagctactcgggaggctgaggcaggagaatggcatgaacccgggaggcggagcttgcagtgagccaagattgcaccactgcattccagcctgggcgacagagcgagactctgtctcaaaaaaaaaaaaaaaaaaaaaaaaaaagatgatggaaacagagtagaaatgatgagaatgatgaatgatgcctggagcttggttcctgggttgctgtggtgttagatggtcacagagcagctttttggaagcttatgtccatgtctcctgctaacagtagatacttgattagaatggaacagaatgtttacctgatttttacttatagcacctggaatgctagtagtaaaatgtaagccctttggagacagaaaatttttcaattctgtgttttcagagcctaggataattcctctgacctcactggtgagaatacgtaggtgttaaactaatgcacggattaaactataagggcaaagaaaaaagttcccctttgtcctctgaaggttcactgaaaaatcaactggcaaaaggaagattaatagaagaaaaggtatgtaaaattttattttaaattgcatagggagggaaccacaaaagaatgatgacccagtgaggtacacacgtttatatatctgttttcatagaggaagaaggcgatgtgtaacatagactattattttaagaggcaatagaccatcaaggagaatgaacagacccaggaggcaggaagcagacattaggagaaggtgaggtgcagagctacgcaggaagagaggttgttgtttaatgcaaattaagtcctccagataatctcttggagctgacctcaaaagaacagacggtaggtgtgtctgggctggtgaggactcccagcctcttgatctttcctggttacttgatgagatccctggggaggatgttcaagaccattgcatttctttattttattttattttcagatggagtctcactctgttgcccaggctggagtgcagtggcatgatattggctcactgcaacctccacctaccagattcaagtgattctcttgcctcagcctcctgagcagctgggattacaggcgcctgccaccacacccagctaatttttgtatttttagtagagacggggtttcaccatgttggtcaggcttgtctcaaactcctgacctcgtgatccacctgccttggcctcccaaagtgctgggattacaggcgtgagccactgtgcccagcctgtaaatgcccatcccattatatttcttttgtaaagaagcttgcttggtcagataaggaaatttcagagaggctcttcctggacttgggagtgggagacaagattagagagaccttcattctgaggcaaattctaagacggctcagcatgacaaagcaccagtctttggtatatctgagccccaacaaaataaactgatttgtgtatgaagaatggagcttacagctcagacagcaaatcaatccttattgactcagttttcaacttcatctggattaccagatgcacagtgtgaaaataagtcatttgccagcctgagcaacatagcaagagcccgtctctataaaaagtgtaaaaatctagctgggcatggtagtgaccgtctgttgtcctagctactctgcagcctgagatgggagcatcacttgttacagtgagctgtgatcatgatcaggtcactgcactccaatctagctactgagtgagaccttgtctctctctctccctctctctctctctctctctctctatatatatatatatatatatatatatagccaggcgtggtggcagtcacctgtaatcccagctactcaggaggctgaggcaggagaatcgcttgaatctggtaggtggaggttaaagtgagctgagagtgccactgcactccagcctgggcaacagagcgagactccatctgaaaaaaaaaaaagaaatgcatataatatatatagtatatatagtatatatatctatatataaaatagatatatatagtatatatatctatatataaaatagatatatatagtatatatatctatatataaaaatatagatatatagtatatatatctatatataaaatatatagatatatatactatatatctatatataaaatatatagatatatatactatatataaaatatatagtatatatatgaaaataagttatttgtattcaaagcatcaaataaaattttgttttagttttctaaaaaaatacaagtaacatatataggcatgctgtttttcttcttatatgtgactacattactttagtatgtagcaaatatcatttgctagctgtagtaaatgtgcattgtcacattttgtccaattttgttcaaactttaatcaaatgcctaagaatttaaaattaccttaattttgtagaagcaaatcacagcttatcattttagatgttttacttacttatgagtctactatttcccacgttactgctgtttctggcctgcctgtggcagtattgccattcactggaacctgcttccataggaggagcatcctgatgtgtttaggaatactaaaattcagatcattccccatcagagttgtctattctgtttctccctctcatccccataatgaatgcatacattctttctgtttgtttggtaattattgggtcatttaaaatgaagactatgaaatgagaacagaaccactgaccaaaatgtacaactttttaaacgtaccatggggaagaaaggtccagaacctatgcgcggagtatgttactaatccagagagaaagtatatttaaaaacaacctgagtggtcaggaagtcaatttcttttttctttatttttttaagagagacagggtctcgctttgttgcccaggctggtctcgaactcctaggctcaagccatcttccctcttcggcctcccaaagggatcagtttctgaagtgagatgagtgagttgattccttgagcattgtcttaatatgctacggctaccataacaaagtaccagagactgggtggcttacgcaacagaagttaacgttctggaggctataacgttctagaggccggcaaggttgtattctttgtgacctctctacgtggctggcagatggccaccttctctctgtgctctcacctcttccttcccctgtgcttgcacatccctggttctctcatccaagcattctattcttatagggacaccaggcagataggatttggcccaccttaatgacctcatttaccttaatcatctaatagaaggccctatgtccaaacagtcacattctgagacactgggggtgagggctctgcaggggagaaaaataatacctttccttcacctgctgcaaggttcgtggctgagtcctcataacaaaatccagattaacaaaagaaaagtatgcaaatgcattttttttttgagacggagcctcacttctgttgcccaggctggagtgcagtggtgtgatctctgctaaccacaaactctgcgtcccgttttcaagcgattctcctgcctcagtctcccgagtagctgggactataggcgcccaccaccacacccagctaatttgtgtattttttagtaaagatggggtttcaccatgttggccaggctggtctcaaactcctgatctcaggtgatccgccctgctcggcctcccagagtgctgggattataggcgtgatccaccacgcccagccacaaatgcatttaatgtaagttttatgtgacacaggagactacggaaatgaaaactcaaacatctagggagaactgtgcatttttatggacagtcatttagaagtatgattggaggacaaaagggtatgatctaatggtaataaactgggaggaacttaccaaggcctgactgttcaggttcttcttggcctccaagtttgatattccttcccttcgggcatagggcagaatacctgtcacatgagggtcttcaggagagaagaggtgggagcaggtcatttcaaacctttctccctctggagttttctgtctcctccagcttaaaatccttagtgtgccagggtgccatacattggggtagtatttcctgtactccagtagcttcaatgtataaatcttagccacaacaagcatgaatagagatttcaagctacagaaggaagcaaaggactaccgagaggtaaagatgtccaaaggtaactctggcgaaaagaatgaactccttgtacagctgtgaatgggagtttgggcaagcgttaagtctgaacctacctataggtgggactcttaaccattttatatttatgcagagcgagtaaatggaaaaatcccgtggaaaaacactaatcatatattgcgacttgagggggctacagatttttttttttttttgaggtggagtctcactgtgtagcccaggctggagtgcagtggctgcgatcttggctcactgcaagctccgcctcctgggttcacgccattctcctgcctcagcctcccgagtagctgggactacaggcgcccaccaccatgcctggctaatttttttgtatttttggtagagacggggtttcaccgtgttagctaggatggtctcgatctcctgacttcgtgatccacccgcctcggccacccaaagtgctgggattacaggcgtgagccaccatgcccggcttggggggctactgatttaaagaaagaaagattaaaaggattttgatgcaataactctttaaattttttttttttgagttggagtctcactctgtcgcccaggccagaatgcagtggtacaatcttggctcactgcaacctccgcctcctggttcaagggattttccagcctcagccttccaagtagctgggattatagcatgcaccacaatgcccagctaatttttgtatttttagtagagacagggtttcaccatgtttgccaggctggtcttgaactcctgacctcagaagatccgcctgcctcggcctcccaaagtgctgagattacaggcatgagccactgtgcccggccaactctttatttatttatttttttttttttgagacggagtctcgctctgtcgcctaggctggagtacagtggtccaatctcggctcgctgcaagctccacctccctggttcaagtgattctccagcctcagcctcccaagtagctgggactacaggcacctgccaccacgcccaggtaaaatttttgtatttttagtagagacggggtttcaccgcgttagccaggatggtctcaatctcctgacctcgtgatccacccgcctcggcctcccaaagtgctgggattacaggcgtgagccaccatgcccggcgccaactctttaatttttaaaattgggtttctggaggtgatatccatccttttccagtacacagtttatagagtttcaacaaatacatactgtcatgaaattaccaccgtaatcaatgtttcccatagtggccacagcttgggaaatcctaacaaaggctttaggcttcctggcctctgctgccatgaccctgtagaaagaatggattacgagattcgttcccacctgcccctccctgggtctcagatcttccctatctatcagataaggattggattgagctggtgtagccagtttgtctgtccctgtgctgaggttactacttctgctggcacccaaagcacttgttatagatctaaacaagttgatttcagtcatccagtccagcaagggaggacatgtcctatataaacttgatgtgcctgataacataagccaccccactggaagtatcagatgtttcccgcactactagagggttcctagcaccctggtcctccctgatcctgtcccccaacactgtgagatcccatagaaagtgggggtcaccttggggaacactgccataaaattagagttagggggccctttctggggttttatggtggcctgaaccacaaaccacccccaagaacatgcactttgaagagaaaaggaaaaagaatggtagggaacactgaggttggaatttcacaggaacagcctaattagccagctacctggtccacctccatccacatcaagctcagtgtttcccaacatgtgctgcagtgccccatttcccatgcattggagtgtagtgtttagtgttcatactactagatagaagtaccgcctcctgagcaggccttcttgatgtcctatcttcagttgctttggctgttccattgttcagtagctccattggcttgcagatgacagggtgcatacaaagcccatcatattccatgagagcatggccattgttttgctggtcatgtagtgaaggatgcttcttggtgagactgaggtcctctggggtgttcaaaatcatgacataagttctcctcaataacagcaatggtagtatcagcatccacaagcgtgcatattttttgtcctttccaagtagcaagctgttttgatagtctttgtccccacaaagaggctctttaaatattctagtcactcaattgccattccctgatgaggtatgtaggctgtcagcaacggcccacacattggtgaaatgcaggaagacctggtggtaggggtggcctgcatggtcatcacaaatgcgtgttgtttggtccactgggcaaattgccaaggtttattctgacaaatgatgatgacaaccacagcctaacagaccccatctgctctgttgtttcactgagccatcagtaaaccatgccacaccatcagcaggcttgtcttggagccttaggctccagacagccatgggaggagccaaagcacacccagtggttctcttggtgtcttctaattagctagccatttgttcacggagcctgctggtcacatgtggtcctagctgggcctgaacttgaatgcaccacttccatttgataagtgaagtctatggagcctgtctaattttattggttgagcttgtgagccatccagagagaaatggcagttcaggttgcagagtttcatctggcattctggccacgaggtgcccagtccaaaacagtacccaatatcaagtaaggattgccatttaaaagagggatataggccgggcgtggtggctcatgcctgtaatcccagcagtttgggaggccaaggcgggtggatcacctgaggtcaggagttcgagaccagcctgaccaatgtgatgaaaccccatctctactaaaaatagaaaaattagccggacatggtggcatgcgcctgtaatcccagctattcaggaggctgagacaggagaattgcttgaacccgggaggcagaggtttcaatgagccgagattgcaccattgcactctaacctgggcaacaaaagtgaaactccatctcaaaaaaataaaataaaataaagagggatatttggtggctgcctgaggcaacttatgtgtccaagatctgagaggctggtacaccccagtgtcagttttctgttgccagagacatccatcactgtgcatcaggttgcacacaactgtgatttcatctggctagcacatttaaggtttaaaaggaagtgcctgagacacaaattgttgtaaacctgctgctgcaaagggttccattcaaagtgtgtggctttattggttaccttgactctgggtgccagaagaacccccatgtgagatgcatgttgtctccagtacccaaagcgacctaaccagctgccaggcctcctttgtatccgtgagtgcagccaggggcttgcctgtatctgggatactgttttggcttcttgctcaggtagctttggcattcattgtgcccatggcctttttgaccagctaaactgggctgttacattgtgacaggtgggttgtcacttttttctttttttcgagacggagtcttgctctgtcacccaggctgacctggtgcgatcttggctctctctaacctccgcctcccaggtttaagcacttctcctgcctcagcctcctgagtagctgggattataggcgcccaccaccatgccctgctaatttttatattttagtagagacggggtttcaccatgttggccaggctgggcttaaactcctgacctcgtgattcacccacttcagcctcccaaagtgctgggattacaggcatgagcccccacggccagccggttgtcacatttttatctgtaacaagtaaatccagaattaataaaatagtgtcattgttccatttagtatgcagtaccactttttttaatgattcagtgcggcttgggtagcttaggtaacaggcaggagtggatacggcccactattgtgtcttagttcttagctgtgagggggcataatcttccaggacatcaatgcctataatgcactcagggtgggaaccagagccacctgcataaaaagttgctcacagggctctacccacaagtacataagcattgtgtgcagataagcatcacgggccaccagtttgttcccaaacctcccaatgtcatccgtttaattattctcctaaaaggacccagaaacattgtcatgtgggttccggtatccaagcacctgagaaaaaactgaagtcttctcttttctcctcttatcataacaagggtataaggccagagggcttcagtagggacctagaggccttggccccattcttaactgtgtcaatcagaccaagacacttaggtggcagtgttcctttatcaaacactcacaatagccacactgcgtaagatttccctggtcttcctccttatcctttcgagcctgactcttcccatcttctgggctgacattgtacgtgttagttcctctcatgcctcagggaccatacaaggacctctctctagtttcttcttgggtgcctcaggggctgtctgaatactcaccattcaagctcttgggccctgacaataagggatcacataagtgcccagcacctaggggaccttgaactatgatctgctgtttccacattcctttctctctgtctcagtccatgcagccagctcacttacatctgtggggaggagagtgacatgtcccatttaccacccatccttatccataactcatccaggtacatgtccagcccctgtgctcctgggctgatgtctctgccttgggctgagtactgggtggtattgcccctcccactttgccagaaagccatgtttctctgaccgaaccttacccactgcaccaatttttcaaagcaggttcaccaattaccaatcccaagggaggactccaccacacagaggacagcaaaggtcatcactataccagccatcaggaataggagtccagacacttctacccactgcatcctccgctgcagtgctacaactgcctgagagcagtgagacagaacacattctcaggcagtaagttaaaggatgcacatttattatttacagatagggagaaagtcttccttcaaaagaagcctaggctccattctgagctcatccccaaaggctcaagaagggttcccagggcagatgaagtctggattgcaaatgcccccctttcacacagctgaggaagcccaaaaggcagcccaccctgggttacatatctcagggcagacatggcgcattgagcaaagctttaaggaaatactgctttcagggcagagaggaacaaaccccagctctcctggacagtccctccctaactaaagatgtgacattccttaggaagggccagaacaaggccagggttgttccagacagtccctccctagctcagaatattgcattccaggctgatgctacacttattcttgacaaattaaaactgagaaaatgggaataattgaatccatccaaggccacctggaggactgttttgcattttcaccccaaaagttccttgtagtagtcttcccaccatatttagttttggaaattattgatatctatctccataactttgccttttacagaatgtcatataaatgaaatcattctgtatgtaatctttcagtaacactttcgagatatgtcatgtttactgtatcaatggtttgtttctttttgaaactgacctgtgctatattcaatgaatgtaccacaatttactcaattgtttatgtttttttttaagacagagtttcgctcctgttgcccaggttggagtgcaatcctgcaacctcggctcactgcaacctccacctcctgggctcaatgattctcctgcctcagcctctggagtactcatcatttttattaatataaaatgttataaatatggataacttgatggatatttgtgttgaggtattatatggttactacaagcatatggtttcattcatcttgggaaaatagatcttagcgctgagatgctggatcatataacaaaagtatgattcagaaggctggttgtggtggctcatgcctataatcccaacactttgggaggccaagatgggaggatcacttgaggccaacagttcaagagcagcttcgccaacatagtgaaaccccatctctactaaaaatacaaaacttggccgggtgcagtggctcatgcctgtaatcccagcactttgggaggctgaggcaggcggatcacctgagatcaggagttcaagaccagcctggccaacatggtgaaaccccgtctctactaaaaatacaaaagaaaattctccaggtgtggtggtgcatgcctataatcccagctactcaggaagctgagacaggagagtcacttgaacccacgaggcagaggttgcagtgagccgagatcataccactgcactccagcctggatgacagagtgagactccatcacaaacacacacacacacacacacacacacacagaaaacttagctaggcgtggtggcacacgcctgtaatcccagctcctcatgtggctagggcatgagaatagcttgaacctgggaggcagaggttgcagtgagctgagatggtgccactgcactccagcctgggcgatagagctgactctgtcttgaaaaaaaaaaaaaacgtatgattcactttacaagaaactgccaaaatgttttccaaagtggctatcattttgcatcctaacagaaaatatgggaatccccgttactccacatccttaccagcacttggtttggactctgtgtgtttgtgtgtgtctgtagtgtgtgtgtgtgtgtgtgtttgtgtgtgcgcatgagtaaatatatgtgtatatatgtatatatatcgactcttaataattccagtagggacatagtggcaccttactgtggtttcaataatttacatcttcctgctgataatggcattgaataaaactcattaacttgttcgtcatccatatctactatttgactgtcactcttctcatttcaaaaaatgtttattgttgtattattaaatttaactatgtatatgtataattttgatatgacctacatctgttaagtaccgaaaatatttttttctgagcctgtgccatctcgtctttctcttaacagtgtctgtcaaagagcagcatttattttaattttgactaagaataatttgtccttttttgttgtttttttttgagacagagtctgtctctgtcacccaggctggagtgcaatggcacagtcttggctcactgcaacttccgcctcctgggttgaagcgactctcctgcctcagcctcttgagtagctgggattacaggcaccctctatcatgcccggctaatttttgtacttttgtagagatggggtttcaccatgttggccaggctggtcttgaactcctgacctcaggtgatccacctgcctcagcttctcaaagtgctgggattacaggcatgagccactgtgcccagccaatttatccatttttaaattttgtgcttaatatttattccctaccattatatattgcttaacacaaggtcataaagattacctacagtattttccttagaaattttatgtgttaaggatttacatttatatctgtggtattttgaattaattttatatctagtgcaaaaaagggtgaagagttttgttttgtattttggcatatgaatgctctgttgttttaggagcttttgctacaaatactctcctttcttcaattcaagaaaattgaatttccgtggcacatgagtcaaaaacctaccaaccatatatgtatatgctataatgctccagttatctaaatatttatccttatacatatccatatatgaatatgcatatgctatacatacatacatatatgtatttgctatactgttccatttatctatttatccttacaccaataccacactatcttgactaataccacattatattaaacttgaaataatggccaggtgcggtggctcacgcctgtaatctggcactttgggaggccaaggcaggcagatcacctgaggtcgggagttcgagaccagcctgaccaacatggggaaaccccatctctactaaaaatacaaaaattagccgagtgtggtggcacatgcctgtaatcccagctactcgggagtctgaggcaggagaatcccttgaacctggcagacggaagttgcagtgagccgagatcatgcagttgcactccagcctgggcgacaagagcaaaactccgtctcaaaaaaaaagaaaagaaaagaaaacgtgaaataagtagtgagtcccccaatattgtcccttttcttctaaattggtttggctatactaattatttagtttcttacataaattttggaatctacttctcagtttctaaaaaaaatataaaaaatcagctgaggattctactgaatgtatagataaatatgtaagaattgacccttggtcaggcgtggtggctcaagactgtaatcccagcactttgggaggctgaggtgggtggatcacgacgtcaggagcttgagaccagcctgaccaaggcatggtgaaaccctgtctctactaaaaatacaaaaattagccgagcgtggtggcaagcgcctgtaatcccagctactcaggaggctaaggcaggagaatctcttgaacttgggaagtggaggttgcagtaagccaagatcgtgccactgcactccagctggggtgacagaacgagactccgtctcaaaaaaaaaaaaaattgatccttaatattgagctttccaatccattaaattggtatatctttatatttatttagatttttttgaatatcaatctgatcagcattttctaattcccagagcacacattttgcacacattttgtcaggtttatctcgaagtatatcacgtttttatgctattataaaatacattttaacttctatagtcaatttttcattatcagtataaaggaagtcaaccgattttcactcactcatttttacaaactaagcaaatctagtggcagccatgtggtatatacattgctacttgtgagggatggataaatgaaaaacatttctcctttatttgaggcatttgtcaagcagagatatgaacaaataggcaatgcaaatcagaggggttgtagtagggaatgtgcattattctgtggaaatccacaaaatgcatgggcatacaaaccaaatttaaatagtcatagaaggaatcctgcaggaagtaatttatgattgaataaagtagctgaaaaccatgcaaattagaattagacaagacaaaagaaggattagtattcaggtagagaccagggtgtgtctacaagtcaacatttttgagacatcacagggagagtaacaatttcagtacactgaaggaagttagaaatctatgtcagggctagatttttaagaaattttgttctgtgtcaataagttaggatttttatagttttctaaggttctattcagctactatggggtcgactcaagaatacagctgttgtaattgttaaaatgggaatttgggagtcttttgaatttgaaagaaaaaacaaatgtgcgggattgaggctcagaccctgtacaggcaaagaaaaagttaaaagtgaggaaaatgagagacaacataaactctgggaaaagtgttcacaaaaaattttagtattttcagggtagaagctcctcttgattgagtcataccttcctgcgaaagatacaaagtcagaaaagaaatcctctacctagaaaacgacattttggcaccaagcataggttactttcatgccttaatttcaccttaccagcatttcaaaatacctgctacactgtggtttgaggaatgagactactatgctcacagcgccacctagcatcaacagaaagggaggcccatggcaaacttaataacaagaggcgggaaaaaaaaggtgaggcccaggaaccggaaacttaatttgagcaggatttttcttatatttatttaaaaactaaaatattggccgggcactgtggctcatgcctgtaatcccaacacactgggaggccgaggcgggcagatcacttgaggccaggagttcaagaccagcctgggtaacacggtgaaaccctgtctctactaaaaatacaaaaattagtgggcatggtggcgggtgcctgtaatcccaactactgggaggctgaggcaggagaattgcttgaacctaggaggtggaggttgtagtgagccgagatcgcgccactgcactccagcctgggtgatagagtgagactctccctcaaaataataaaataatattgctgcaggggtcagtggtgaaatgcaatccataaccattcccagtaaacactcagcgagtcctggcccatgcccacttttcctgtcatttaacgcaagggttaaatatcaaagtgaatcccattatgctaattgatttacaaatacggatgtataggagtgtgataccctgagcgcaatcatacttcggatataactgtaaaacgacttcagctgactttgcagtgttgcagtgtcacattaaaccctaagttgtttgtgtttccctacacatcactctccaggagcattatagttcagaagattagagtaatttcttagactaaagccttgatgggttattattacataaaacgttttccactctgatggagaagtcaggtgcattcgctcatgtctccgtggcagggccgggactcctggtcccccgcgattctgagcggtgcctcacagcctaggtcctccaacctcacagggcggcccgcagcaaatgcgccactgtccggtgcggccaaccagctcgtggtgcgctgtgggaaggtcacaggacggagctggggggcgggggcggcggtgggggcgggggcggcggcgggggcgggggcgggggcgggggcagatcctatttgcgcctgcgcgggactggaggattcggtgttgccctttccccctgctatttccgtttccgcgcttcaagcggatctcttccggttatggcgcccgctgggagtgtcttatcagccgcttataccgcggaaactttaacctgcgttttcccgtaaaattttcctctctaggtttcgtatcattgtcttgtttcttactcttgtattaactttgttttaacctaaggtttctctttcccaaaaactgtggtgtttctttacaacctctttttatagttatataaacattgcaagaaccatgattttatattcttccttttcagtattaataacttcaatgtcttttttggcatttgtctgaaaatttgaaatatttttcaatttactgaactgattatcgttttgtaaatatcggatactactttaatcatttgtgtattggccttaagattctctatttttaactcttccaccaacatacctttaatctgagaggtgttgtaggggcttcaagatcaaactttccccacagtctctattttcattataaaataccgtgttttaagaaaaaatgtacaaggttgaaagaagtttcactactacgtgttttttttttaatttttattttattttattttattttgagacggagtctcgctctgtcaccaggctggagtgcagtggtgcggtctcggctcactgcaacccccgactccctggttcaggcagttctgccgccgactccctggttcaagcaattctgcctcaacctcccgggtagctgggattaccggcacatgccaccacgcccagctaatttttgtatttttagtagagatggggtttcaccatgttggccaggatggtcttgatttcctgacttcgtgatccacccgcctcagcctcccaaagtgctgggattacaggcgtgagccaccgcgctcggcctctactatgttttaaaacagtggctaggtcatgcttttctgtgtatccttacttcccttattccatcacctcatccatcactttacaactgatcatacaattacaaaattattttactaatcagattaaatgtgtgccttccatttgaagaagaaaggtctactaaaggcttagttttccctaggacactgggagaatacaggatctggtttccagtgccacagtggtgatcacacaggaataaacgggacacaggtcagacaacagccagaaagtcatctgccagtatatgtttcctgtgagatggacacctggtcccaggtcagacacaggtgttagagtgtcagctaggtaaaagaagtaacctgaaagagacacgctgtgaacaactatgtccacctccccttcatttcctagtattggagggctgctagctgctctgttactaggacccagatttagttggggcctctcagaacaggtcagaattgacctatgcacagtacctgtgggagtctggatgagggccatccactgaaagttagtgaatcaaagatttaagattgatctaaatgcaaatagatctgtgtcaaacgactatacgcataattgccttattttatacttattgaaaaaatcctcgtaaaattataaaggcataagatttacttgttatgaaaatgaaggcaataatgaacgtaattcataagtgaatttgcaaatatcttgaaattccaattctgatttttccaaattagattttgattcagagtcatcgatgtcttcacaccaccctctgtggcatgaacagagatggtaatgaagcatttcttagaaaacaaggctggaccactgtctgtgtgatttccacctttcttgctgacaccattctgcatgttttgatgtaagtgatgttaccagaaggaaacagcagaaggttgcaaaacaagtgcaaacaatgaaagccatgtcatggctgccaacaggctaatagtgattgtaacaacacttgacaaaataatttttaaaaattattcaaatatgataactaataacgatacagaattatcaagggaggtccaatttttttttttgtctgagacggagtctctctttgttgtccaggctggagtgcagtggcacgatctcggctctctgcaacctccctgacccaggttcaagcatttctcctgcctcagcctcctgagtagctgggattacaggcggctgccaccacacccagctaatttttgcatttttagtagagacggggtttcaccatgttttttggccaggctggtctcaaactcttgacctcaggtgatccacccgccttggcctcccaatgtactggaattacaggcgtgagccactgcacccggcctaagggagctctattaatggagctgaatctatgaaacaagaacatcttccttcatcaagggagcaaaactgtccagaaaaaaagtacagatgaggtagaaggagcctggtctatgtgttcatctttgtggtggattgagaatagggaggctggagaagaggctgagggggaagtcagggctcactcctgtcctaaaagcaaaagggagcaaaagaaccatgttcatcttcagattcacacattcttcactttgaaagaaaatttaagtttattaggaaaccatatctgtgaggagtttttattttttttttgttttctttttttgaaacagggtcttattttgttgcccaggctggagtgcagtggcatatacactgttcactgcagcctctacctcctgggccctagcagttatcctacctcagcctcccatgtagctgggaccacaggcatatgccaccaagccctgcctattttatttttttgtaaagacgtgtctcactttgttgcccaggctggtggggggaagttttagagattcattaaataatttgtgaaatttaaaataaaggaaaatattctgttttgggttttgcccagtgcatgtttggggctcataggtgaacaacatggacaaaataacctctgatatttcagtccagtagtgattcaaggactgtaacccaaatctcaaatgtaggagttttgggttacaaaacttttgggagctgagagcacaggcatcagacctgaaatggaatggacaaggaaggcctctaggaggaggaacattggaggaggttctggagagcgtggagcagtgaatctggcaaacaggagaaagagaagaggaaaaaatgtgtctgtggcacaggccagggcatgagaaggggacagtggattagaaggactgctgggattagcaacatgtaaggagggcaggagcgggaagggcagaccatggagaggctgtgaaggggagagtgggcaggtcaggaagtgacacagggccggccagcccactaaggaatgcatttgttgtgctggtagttcaaatatcagtctcgttccttgcaacagtacctccaggtcaagaagagtgaggatagcctctgtgtctgaggaggtccctgtgcattatgaggaattggttctaggaagaagggagagtgaagaggaacagagaggaccctccagatccagtacgggccaactaagggaacttggatgctcctgttcatgtccctttctccatcactgagactcgccccatcccaccctgaatgcaggttcctttcccctcggttattttgtgcgtctcagatgatgacatgtattgtaactttattctatcacatatgacttttacattatatcatagaaaaagttacttacataaattacttaatggtggattagtcatagttaaaatgttgtcagcttggtaaacaaatgaaattatcacactttagtttttcttcgttgatcatttatgaagattagtgtctcctcatttcatggatgtcacaactacatgttcttaagtaaggtgtatgcttggggtgttgtgttttccctgttaatgttggatactccagtgttcagcaaactataaacctatcaacacacatttgaaaaatccagttgttttgtgttttatttcgtgtatcctgtctttacaatattatatcttttcttctgcttacttgaaatttaatttgctcttctttttctaggttcctaagatggaaacttaggcgatcattgggcatcatcatagggtctacctgccaaatcaggtcttcttcattctgcaaaagtttctcagtcaccacttatatttcatgactttgacccttgtgaaaataccagtcagatatcttgtggaatgtcccacaatgtgtatttgtctgatggtttctcataattagactagaaacaatgtgtaaattaaacatatttttccaaattagaaaacaagaaaaacagaataacatattagttagaagtattaacatagggctggacgcagtggcttatgcctataatcccaacactttgggaggtgaaggtgggcagattaattgaatccagcaattcagcaattcaagaccaatctgggcaacatggcagaacgctgtttctaaaaaaaatgcaaaaaattagctaggtgttgcagcatatgtctgcagtctcagctactcgggaggctgaggtgggaggattgggagggtggcctgagcttgggaggtcaaggttcactgagctgtgattgtgccatagcgctccaacctgggcaagagagtgagaccatatctcaacaaaaaagagagaaaagaaaaaataacagagaaaaataatttttaaaaatcaggtaatgacaaatagggaattccaaatatattgctaatggtctgttaagcttgacagtgcttttagaaaacttgttctgtttagaatagtgttagactcacagaacaaattggtaatataaagagtttacatataccacacacagttttccttattataaatcttaacattagtgtgttacgcttgttacaattaagaaccaatgttaaacattatcattcactgctatccatgctttattcacatgtccttaatttcacttaatgtccattttttgattctggaatcccatccaggatgacacatcatatttagatgtcattcctctttatgcttcataagctgttgacacttccttcaactttcctggtctttcatgacattgacatacttcattaggaagttgtctgattttttttttttttgagatgactctcgttctgttgcccaggctggagtgcagtgacgcgatctcggcttgctgcaagctccgcctcccaggttcacgccattctcctgcctcagtctcccaagtagctgggactacaggcgcccgccaccacgcccagctaatttttcgtatttttagtggagacggggtttcaccgtgttagccaggctggtctcaatctcctgacctcgtgatctgcccacctcggcctcccaaagtgctgggattacaggcgtgagccaccgtgcccagccataggttttcaaaaggaggactacacagggaaattgccattcttatcacatcataccaatgttacatactaatagcatgtcatatcatgttgaccttaatttgattacctatttgaattacttcttatcagattcttccactgttaaattgctatttgttacacttcctgtgttgtacttttgaaaagaagtcattaggcttagtaagaagtgggaagtcattcttcacctctttatgggaagagtatctgcaaaaataatttggaatccttcaacatgtgaaatgtgtcagttttcctccatttgttttatatattttttcactcatttatttatatcaatatgcaaacatggatctttattttacacttacattttactagtttattttgttgttcaaaattttctactcttggctattggaaggtcttttaattggctactatatcattttcgtatacacactcctagtataatggcatgaatccgtttatgaggctaaagccctcaaggcctaattaccttttaacagccccaccttttaatactgctacagtggcagttagtttccactaactgtaggggacaaaaattcaaaccatagcaagaacataccaaaaccatttttaaaaacaataatgcatttatttctgcaaaaaatggccataaagggccacctttatatgtgatcatgtagatcaccctctatatgataaggaagacaaatggagaacgaattagatagagaactgttgtgaattaaagtattaggtttggaatacaactttttgggttgattgctcatatttcttagaacagaaattctcagtgtacaactttaactctgaagaaagctacccatccaatgaagaagtagcaaagtgactgtttgccatttctatcttccttctcaatagatttattgaaacatagcatatacatcacctctccacatttgttgtacttttgttatttctagttcattcttgaggtttctctttaacacagcgactattaattctagcccagttggccaggagctgtggctcacacctgtaatcccagcacttgaggttgaggtgggtggaatgcttgagctcaggagttcaagacctttgggcaacatggtgaaaccccatctctactaaaaacacaaatttagctgggtgtggtgatgggcacctgcagtcccatcaccatactcgggaggctgaggcaggagaatcacttgaacttgggaagcagaggttgcagcgagccgagattgtgccactgcactccagcctgggtgacagagcgagactccgtctcaaaaaaaaaaaaaaaattctagtgctgctcaagaagcctctagaagatttgttcatggatgtttacattgtgcctttcagggtacacttttttaaatcttattttacagccaaatacataattatctgatttgtcagtggttttattctccattgtgaaatgtaaagtaatgatgcaacctataattgatgtgaataatttattttgcaattactatttatgtcagtatcagcaaatactacattcatttgtatagatgatattaatctacaggttttatggattattagttcatttcatcctcacagcatctcaagaggtcggcactagttttactcccaatcacctagtgaatttgatctaaagccctacaagaaaggaatggatgaaacttgattttgactgagtctatctttgaagtctttacttacatcacgtgttttagaatatctttttttgtatggaaaacacattctaggaccggattaagaaatgttactctagggccaggcgcagtggctcatgcctgtaataccagcattttgggaggttgaggcaggcagatcacgtgaggtcagaagtttgagaccagcctggccaatgtggcaaaataccgtctctactaaaaatacaaaaaaattatccaggcatgctggcgggcacctgtaatcccagctactcaggaagctgaggcaggagaattgcttgaactcaggaggaggaggttgcagtgagccaagattgcaccattgcactccagcctgggcaacagagcgagaatctgtctcaaaaaaaaaaaaaaaaaaaaaaaggtattctaccccggaagtcatgttcccaaattagatgtaaatcctgtgttaaattgatttaatatttaggtctaagatccacctaggaatgattttatgtgtaatgtgaggttatagatcagattttatttttccctgtggatatatttcttgaaatatttatagaaaaattcacatttccccaattaatcttataaattatttgtgtatatatgcttgtgtctgatttgctctctcctttttttttccattggtttatttctctgtgaaaatatcacactattttagtaagacacttcatttaacacagaattttctctctagggccttctcttagccaagtgtgctattatataaagaagaaagagtgaaaacctctatgccttgaacctacaccaatattctcagttgtcccttgaataaagagcagaatttagaactcactattactgatgacacttaggtctttaatgttcttgtgaatcttagacaacccccacaacatcattccctgctttatttgcttagtccattcttggtggattttatgagatgtcaacactcctcattaggattccctccttctgaagcctttgggattttctacccacccagcaaccaccagaggtggcagaaacccctgcagacatccttcttgcgcaagcgcagttgtaccatgaatgcggtcgtcctgctgcagaccacgcccaccaagggcggggccacatccactgcagctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttcctggtaatattcattcttgcttttgtgtttttgttttaaggtccaaatatctttaatacttgtatgcagttttcttttttataatttcacataaacatcatctaaaaccaacttcgcatgttcgcattctgtattaacaactttcgtttttgtatttaaaaatacattcataatcactttttcaaaatatcttgtcagttattttcatcttttccatgatcattctttaccagtgcaatggaaatattacttttattaggaaaagcagatgtcacgcggtttttagtgttgtcgagaaatttcctatgaaacatctctggttgaaaaggagaggaacaaaattttatgtgaggcacaagatcacatatgctcagaatcgcatgctttaataaaggctgtgattatttgcattatattgtttagcttgttctaattgtaaaaggtagacaaagaattaatttgtgtagacagaacattgcgactcccattctaaatgtagagacagtcactgcactgcgcaaataggaatgtcgtcatgttgtttgcttttctccttaccccaaaactgtagacattggctagagtctttgatttttttcccaacttgcttttgtaattgtcggcatgatgtttgcacagataaccaatgatatagatatatatttttttcttactatttgatgaatgattaatattttgggttttttttatgttttcagtgaatcaaaaatatcattcagaaaatgttgtcatccatatccaggtagcatatagttttataatctgatcttgtaataaggaaattacagtccttattgattttctgttattagttagcattttttaagttttcatgcttgtgagtatttgggaattttttttttactctgtcaataatttaacacctttgtattggtcatctgggtcgatgtctattgtttaggctcaacctttgacactcctctgaggtagtttttatgtgaatttgtaaccacccaagggattcaccttgccagctgtctagacagagccgatttatcaagacaagggaactataatagagaagcaagaattcacccagagccggctgtgcaggagaccatagttttattattactcaaatcaatctccctgtagggggatcaggggtttctaagaataatttggtgggtagggggtcggaaagtggggagtgctgattggtcatgttggagatgaaatcatagggagtggaagctgtcctcttgcgctgagtcagttccccggttggggccataagatcagatgagtcagtttattgatctgggtggtatcagctgatccatcgggagcagggcctgcaatagatctcaagcactgactgagcttaggtttcacaatagtgatgttatccccaggagcagtttgaggcagtttagagtcctgcagtctccagctggatgaatcctaaaccgtaatttttaatcttgtagctgatttgttattcctacaaaggcatgatggaggggggttgttttgggaaagggctgttactgtcttcatttaaaagctaaactataaaccgaattcctcctgaagttcgcggggaatgaacaagggcagcttggaggttagaagcaagatggagtcagttaggtcagatctctttcactgtaataattttctcagttatgattttttgcaaagatggtttcaaattgatggcttagtgtcctgggtagtgaaaatggaattcctcaacctgaattgaacatggatttcctcctgaagaaacaatttagggctccaaaaagtaaaccaggagcctggcacagtggtcacacctgtaatcccagcactttgggaggctaaggcgggtggatcataaggccaggagtttgatactagcctggacaacatggtgaaaccctgtctacttaaaaaaaaaaaatacaaaaattagccgggcatgctgatatgcacctgtaatcccagctactcgggaggctgaggcaggagaattgcttgaacttgggaggctgaggttgcagtgagtcaacatcgagccactgcactccagtctgggtgacagagaaagactctgtggggtatgatgaggcttctcttcaaatagcctgatcaatcgtttattctttaattaatagtaacccccacccccttttcctttttctcttttttctttctgcctttgttgcatgcccggacatgccacagtagcaggcttatcagtaccagctcacattcctttccttatttggaaaggagactagctctctagctcattgcagacaccccttccccttttcccctctctcccttatgtgcccaccttatctaaagaaagttcaattgtctagccaaccaggattagttcagactgtgcgacctgacctccaccaatgggaaaagggtacaggggcaggacttggggcaggaataaagactcttgtgcccctttgttctggtgtgctttcatggcgactggccaaggagaagcacccctctgcgcagaagtaaaattgctttgctaagaatcctttgtttgagtgttcaatctcccttaggattttgagcattattcccaaccattcaatccaaaaaaaaaagtagaccaggattgatttagggcctgtattataaattgtacaaatgccaacaagattgtattccactagaggaacgcattctctagtgaaggaagcattcctgcaggatgagtccctgagactcactagcaaatttcatacaagtaatgaaatcctcagtctaatggaataaaaacaattccaggggcatttgttaaagatgtataagatgtgagaaaccaacagactaacagcattgatactttatggatatttttattccaaattaatagatgtgttacaggaaaagggtcctgatccagaccccaagagagggttgccgatattcagggccagtctgcagagtaaagtgaaagcaagcttactaagaaagtaaagcagaaaaagaatggttactccatagacagagcagccctgtgggctgctggattcccattttcatggttatttattgattatatgctaaaccaagggtggattatccatgcctcccctttttagaccatataaagtaactttctgatgttgccatggcatttgtaaactgtcgtggtgctggagggatgtagcactgaggacgaccagaggtcactctcgtcaccatcatggttttggtggattttagccggcctctttactgcagcctgttttatcagcaagatctttatgacctgtatcttgtgccagtctcctgatgtgacttaaaatgccttaaccatctgggaatgcagcccagtaggtctcatcctcattttacccagccctattcaagatggagttgctctggttcacatgcctctgacagatggacatttgtttgccaagcaatgctgcaatcaggggctctggatttcagtcctccatacagagaatgtcaagggcagaccttaataaaaataaataaatgaataatcaaatttttaaaattacctctttcattcttttattgtattatgatctgacaccattaactttaattttcttgcatatggagagcaacttgatacaaactggtatttatttagtgaagaaaagagataaggtgattcccaaatttaaaggaaactggaagttttgtgggaaacaaatggaggagataagacttactagtttctacttattttaatgagaattgtgttgttcatttataaatacaaagctccatttaaattacagatgcttttgatttatgatgaggttacttccagataaacccatcacaagttaaaaatgtcatcagtcgaaaatgcattgaatatacctaacttagttaaaatcacagcctagcctatcatccttaagtgtgctcaaaacacttatattagcctaacgtttgggaagatcatccacacaaagcctattttatcataaagtgttgaatatctcatgcaatttattgaatactgtactgaaacagaaaaacagaaagattggacactcaaagtatagtttccattaatgtgtattgcttttatttaatttaaaaattttaagttgaatcatagcaagtgaggaagcccatatattataaaatgtaataagtttaccagccacaaataacaacaaatcataggaaatgcagggattgggttgaggtgaggtggttcaacctattatacccatttccttcatctctaatgggctgcccttcatccttggggttgttgcagggtggctgtgcagtgcaaagggcacacaagaattgcttgaacctgggaggtggaggttgcattgagctgagattgtgccactgcactctagcctgggcaacagagtgagaccccatctcaaaagcataaataaataaaaggataatatctctgtcaaagtacagtgatgcattgcttaatcatggaaataccttctgagaaatgcattgtttggtgatttcatctctgtgcaaacatggagagcattacacaaacctagaaggcatagcctactacacatccaggctacatggtacttactattgctcccaagctataagcctataagcatgtgactgtcctgaatactataagcaattgtaacacaatgataagtatttaaacatgtaacctatctaaacatagaaaacataaaaagatggtataaaacaaaaaatattgttcagttgtatagggcagttgccatgcctggagcttgcaggactggaagttcttctgggtgagtcagtgagtgagtggtgagtgaatgtgaagacctaggacattactgtatgctactgcagactttagaaacactgtaaactaaggctacacttaatttattaaaaactaaagtaattgtgctatggcatcgtgacagctttgacatctctaggtgataggaagttctcaggtcaattataaccttatgagagtaccctcctatatgttgtctttccttgacagaataaaatatcattttgagagccatgactaataaacacataagagtcgatttaatatttattttaaaagcccttccatagttataaaagcataagttttagtcacatcaaaatataaacaatcttgaaattaattcataagtaaatcaatagatatcttgaaattgtgcttatgatagttctaaaccagactttaatgcagaatcttggatatcttaatcgcactgtgtggcaggaagactgatggcaataaaacatttcttaaaaaagaggctgcagcattttctgtgcaatttgcaccattcctgttcacacctgttctgtaagtgttgctgcaggcgatcctgtaagaaatgacagcgggttgcagcgcaagttcatgcaaacaatgaaaagcatgtcatggctaccactaggctaacgctattgtaataaaatttgaaataaaatagactagaaatgatgaaatatgagaacaacattggaaatatttatcaagggaaccatattaatgtaagcgaattttagagaacaaaatacttttcctaggtctgcaaggacaaaactgtccagaagaacagaagagggacagatgaggtagaagcagcatggcccatgagaggggctctgcagtggattgagggtggggaggctggcaaaaaggctgggcagaatcagggctcacatcctgacctgagaacagaagagagcacaagaaacaggttcatcttcaggcacaaatcctcttcagattgaaagagagatggagtgtctagggaagtaggcaagcatttggggaaggagagtcactgattcattagtgaaacacaacaaaaaaacaaaatcttctgtgttgctgtttgtccactgcatgtgtggggctcacaggggaacaacatagacaaagtttccaaattctcaggtgtttaagacgagtgaggattcagaaaacttaacagaaactaaactgcaagtgcaagagctgcccttaggaactcaggggacaggcatcaggcctgggatgggatggacaaggggggccttcaggaggaggagcattggaggagatgctgaagagtgaggggcaggggatccaccagacaggggaggtaaagggaagaggaaacagtgtgtctggcacagttcagggcatgagataagggcagtgggttggaaggatcgctgggatgaataatatatgaggaggcaggagcaggaaggacagaccataaagggcctgagcaggggagggaggacagctctggaagtgatgcagaggctgctccctgcggactgccttctgtggggaggagttcgaatgccttttcttcttttaagtgttactcacaatccatgagatctactgacaaggaagacagttggaacaagtaagaatagtccttgtttgatgggaaggagcagtagcattaccaggaggggttggtgttggggaggggcaagggtggggaagggcagagaagtttctgtcccctcagccattttgcagatgtaggttggatcactggatcacaaattcacagtggctggctcatggccaccttgcatcacagggtgagagcagcctcacaggaaactgcagataaggggggttcccagctgcacagaagaaggacagcaggtaactttcagtcaaggttggcagggggctgcagaggtggcagcaatgatggtggtgggcagtgtgcagccttgtaggccactgtctccatggacatacagatttgcacgcatctgtgtctgcgtgtcctctcggtgtgctgacattcttacaaaatcctcatgaatttctcattgttctgagaccataacatgtattttgacttttttctaccacatgtaccctttcatgtgtacctagcaaaattgaccaaaattccttattggtggattattcatagctacagtattttccaacttaataactaaatgaattgccctgctttgtatatgtttgcctaatcattcctgaagattcatgtctcctcatttcagggggagccacccctgcatgttcataagcaggagttcagtttagggtgttctgttttcctagttaactgtggacacatctgcgttctggaaactattaaactctcaatactcatttgaaaattccagttactttatcttttacttagctttcactttatttacagtactctctcttttctcctgcttactttggatttcgtttgctctacttttaagtttcctatggaggaaatttagattatcgatttttagatgttttttcttttttaaattttatttatttatttatttttattttattattatttttttttttggagagggagtctctctctgtcgcccaggctggagtgccatggcgtgaactctgcttactgcaagctccgcctcccgggttcacactattctcctgcctcagcctcccaagtagctgggactacaggcgcccaccacaacgcccggctaattttttttgtatttttagtagagacggggtttcaccatgttagccaggatggtctcgatctcctgaccttgtgatccgcccgcctcggcctcccaaagtgctaggattacaggcaagaaccgccgctcccggcccctcttcttttctttttttttttttttttttttttggtggaattttgcttttgtcacacaggctagaatacaatggcgcaatctcggctcgctgcaacctctgcctcccgggttcaagcgattctcctgccttagcctccctagtagctgggattacaggcgcccgccaccacgcccagctaatttttgtatttttagtagaaacggggtttcgccatgttggtcaggctggtctccaactcctgacctcaggtaatctgcccacctcagcctcccaaagttctgggattacaggtgtgagccactgtgcctggccaatgtttttttttgtttgtttgctttgtttttaatagatacatttcccccctatgctccctcactgcattctacaaattttgataagatgcattttaatttaaacttagttcaaaatgttgtttaattttctcttgagatttcttgcatcatgtgttatttaaaagtgtgttagttaatctccatgtattttgaagtttaccagttatgtgccttttattgatttctatcttaattttattggggttttagggtatatatttgttaacataaaaatcatgagatctataaatttggaaagaaaaagagctataaatattcttgaaggtagccctacagcatgtatactgaacaaacatgcacgtaacctatgacccatgttcaccttggtgtggagactgagcttttttttttttttttttgagacagagtcttactctgtcccccaggctggagtgccatggtaccatcgtggctcactgcaacctctgcctcccaggttcaagcgattcacctgcctcagcctcccaaataactgggattacgggcacctgccaccatgtccagctaatttttgtatttttagtagagacagggtttcaccatgttggccaggctggtcttgaactcctgacctcaggtaatccacccgccttggcctcccaaagtgctatgattacaggtgtgagccaccacgcccagctgagacttaacatttaaatgtattacagttaggccctacacacaaaagcccctttcaggacacaaaggcagacaagtacacaatctctagaaaccagtcagacccagtccatgtttggtgggctcttatcaggagaaagttactgaaatcagtctcttgtgcaatcaaggctgtagcgatggctgttggaacagaggctggagttagcgtctggcggtggatgagctgcaaattgttttaagattgtttatgtggaagtcagtgcttgcttagctgctagagaaaaagataaacctcctgtcagttagaacatagtttattcttcaactataggggtgagtgacttaacccttgcctgtcatggccttaggtcttatttataatttgatatcttattgccaccaagaagagttcattccttcattcttatgatctctattttaatatgaatgctggtcagttgttgtgtctaaactgcaaaagagacagatgataacgaggcatgtcccacttcctgtcccatcatgactggaaactcagtttgtatggtttccctgcggtcctgtctgttcagtcagttggggggcttaggattttatttttaattctcatagaggagtgttgaagtcaccgaccgtaatagtggattcatctatttttcctgttttaacggtttctgcctcgtagttttatgttctgttgctacatgttagaattattatatcttcttggaaaattgaccccactattattatgtaatgcctttctatttccctgataatttttctgactgtatagtcagctttttctgaaattaatatagctactcctgctttttctatttgcttgctatattttgttccatctatttactttcagttaatatgtctccatttttattaaataacagataaaatgagatgtatgtactatgtataacatgaggtttgaataataatgtgcattgtggaatggctaaatccagctaattaacatgtgtattacctcacatagttatcatttttgtggagagaacactttctatccactttttaagcatttttttaaatagacacaggctctcgctctgcacctaggctggagtgcagtggtttgatcacagctcactgcagtgtagacctcctgagctcaagcaatcctcctgcctcagcttcctgagtagctgggactacaggtgcacaccaccatgcccagctaatctttagcgttttaaaaataagacttatgtttttaactagagaaaccatatggtacaatagatctcttgaaattattcctcctctctgactgaaattttgtatccatccacaaaacttctgcccaaccccaccctcaaccccaggctctggtaactaccgttctacatccccacttgtatgaaatcacattttttagatttcacatgagtaagatcttgaggtatttatctttgtatgcttaacatttcagttaacataatgtactccaggttcaaccatgttgtcgcaaatgacaggatttcctttttatatgcctcagtagtattccattggggattatatatataattttctttatctgtcaacggacacataggttgattccgtatgtttgctattgtgaacaatgttaaacacttctcattgaggagtgttgaagtcaccaactataatagtggattcatctatttttcctgttttaacaatttctgcctcatagtggtttgaacactgctaaaatatacatgagtgtaggtatctcttcaacatactgatttcattttctttggatatatagccagcgttgggattgctagatcttatggtagttctatttttaattttttgaggggcctctatacttttttcgataatggctgtaccgattaacattctcatcaacagtgtgcaggggtttcctttacaacacctgttatctttactctttttaataatagccttgtaacaggtataatatctcattttgattttaatttacatttccctgtatctgtctttatatttaaataagttttttttttttgggggggacggagtctcactctgtcgcccaggctggagtgcagtggtgtgatctcggctcactgcaagctccgcctccctggttcacgccattctcctgcctcagcctcccgagtagctgggactacaggcgcccgccaccacgctcagctaattttttgtatttttagtagagacagggtttcaccatgttagccaggatggtcccgatctcctgacctcatgatccacccgcctcggcctcccaaagtgctgggattacaggcgtgagccactgcgcccggccttaaataagttttctctagagaacatatggttaagtcttgttttttgatccactccaacagtctgtgtcttttcattggtggttttgagccattgaaagtcaatgtgattattgataatagcagattgctatctaccatgtttatttctgcttttcatttgctgcccttgttctttgttcctcctcctgtcttccatttgtttgcttccctttatggttttaattgagaatttcatatgatccaattttctcttcttagcatatcattatattttctttttatttttaaatattttagtagttgccatatgaaataaaaactttttcatattttagttgatataacagataacagtttgttaaaaacaaaaattgtagccatttatttgatgaggtattcttatgtttatagtttgagtgtgtgtgcatgtatatgggtgtgtgtgtgtatatatatatatatacacacacacatatacatatgcatgaatgctcatatataaatgcaatgaatgacagcaatagtacaaattaccaaagtacaaatgactattgtttccttattataggcaactcacactacttgtgaactgatagagtgttatttgaaagggagtttgaattaactgtaaatttagggactggctattggattaagatcctccattccttggctggctgttgtccagaggctgcattcagctccttcccatgttggcttctcccacatggcagaatgctccatcaaagctacaaggggagagtttgctagcaagacagaagtaatgattttacatagcataattacccatgtgatgtaccttcagctgtgctctattctcttgtttcaaaataagtcaaggttgctgcccacacttacagggagaggattagaatgcaaggttgtgttcaccagcaggtgggaatcactgggtgccaatctagggtctgcttgctgtgtcagatcttctccaacctgcaacagtttctcagtgttcaattattttgtataacctgaattcttttgaaaagtaccagtcaggtgttttgtggaatttcctacaaaatggattagtctcatgggtctcattattacaatagagatatgcattaatttagacacatgtatgtgggtgttaagaaaaactgaacaatgtattacttagaaatacaaaaggagagaccaggtgcaatagctcacaccggtaatcccagcactttgggaggacgaggtgggaggatcacttgaggccaggagttccagactagcctaggcaacatagccagaccctatctctaaccacaacaacaaaaatttaaaattagccaggcatggtggtgcacacctgtggtccaagctactagggaggctgaggcagcaggatgtcttgagcccgggaggtcgaggctaaagtgagccatgatcacaccacagcgctccagcctgagctacagagtgataccgtgtctcaaaaaaaatggggatatgcactcaggggttttcaacaatattgacaaggtttggcttattatactgggaagggaatttataaaaaagaaacttgttaaattttagaatagtttagatatacacagcagttgccaagataatacagatcatttccttatgcttagcatatagtttcccttattattaatcccttacattagtgggtgatatttgtcacaattcataattcagtagtatacattatccttctctatgattcacattttatttagaatttttcttctaccgaatgaacactttgtgttccaggattccctccaggagaccacatcacatttagaaatcccatctcattaggttccttctgcctgtgacagtttctcagactttccttgttattgatgacattaacatccccaatttgggatttctctgacatttttctcatgattatactggagttgggtttggggaaggaagatcactgagagaaaatgtcattgtaaccacatcatatcacgggtgtctactatcaacatgattcatgcctgttgatagcaatttgattacctggacaagttagcctttgtcaaatttctttactgtaaaattatttctttctccactttccctgtttcactttttgaaaataagtcagcatacatagcacatacttaagaacaagaaagttatgctctacctccttatgaactgaggacctaaaacaagagttgagaactctttactgtatacagttggcctgttctccaccatgatttcataccatttatttatactgtattgaatatgatatgaaattagatatattcagttcacatctcccttatactcctttatttcatagctcgaattgttccattgttggccattggaaggtctctcagttggctcccatatcattttgaaatagccacattattttggttagattttgcttgtttggtggttcaattgtaatgtttcatagtttcttactttcaggcactacagggtcctccaggccaattgtgtttatttcgtgcccaagcctggtacccatcatttcttcaagggtcctagtttcttttattggaaaatggcttttaaaacaaagatacagacccaggtatattcactgatactgggtcatctgtcgatttgaggagtagtcagctgacaaaacaatgaaacgtacctgtgtatactaacccacacatatacacatatgtgtaaatatttcctcatatgttcatatataacctgattaacttaaacataaattcctactaatgtctccagcactacatgaatataatataacttgaatcaatctccccattcccactacttggttgtaacccccactctaacagtgagtgagttggccttgttaacttaatcaccaagttagaggctacatgcatagtggcttcagaattgttcatccacactctcatgaagaacaacattaccaactaaagtacagtgctcatagacaacttcttggacctttagatgcagaatcttcactttgtacccaagttacttaggtcagttctttcccccgcctcccagcttcctttagtgaggttatatcatacatttcttattcatttttcttattttctctgtattcctctatgggatccctcaacctacaaataattattttctctgtattcctctatgggatccctcaacctacaaataattttttttttttggttttttgtttgtttgtttctttgttttttgagatagagtctcactctgtcacccagcctggagtgcaatggtgtgttcttggctcactgcagcctccgcctcccaggttccagcaattatcttgcttcagcttcccaggtagctgagattacaggcacgcaccaccacgcccggctaattatttggtatttttagcagagatggggtttcactatgttggccaagctggtctcaaatacctgacctcaggtaatccacccacctcggtctcccaagtctcccaagtgctaggattacaggcgtgagccaccatgcctggcttacaaataatatttttaatttccgtacatttaggttcactgtttgtattataaagttatgcagggtttcaaaaacaatatgatgtagcgaccatgcaggaagtttttattaccctaaagaaattccatctacttcacctatttcactgtcctccttggagagtccctagttagcattaatctgtttactatctctattattttacctttcccagggtgtcatatacatggaattgcacagtctgtcatcttttcaaactggcttccttaacttaaaaatatgcctttaattttatgaagtatatcttacggtgatttagatttgcattgctgaaggactaatgatgtcaatcatctttttatgtgccctttggggatacatattctttgaagaaatgtctatttatacaatttacccatttttagttggtatttgtcttttattttttgagatgtgacaatcttttatatattctgaacagtagaccctcattacctatatgactagcaaatattttgtctcttttttttttgagacaaagtctcgctctgttgcccaggctagagtgcagtggtgcaatcttggctcactgcaagctccgcctccccggttcacaccattctcctgcctcagcctcccaagcagctgggactacaggcgcccaccaccacgcctggctaatttttttgtacttttagcagagacggggtttcaccatgttagccaggatggtctcgatctcctgacttcatgattcgcccacctcagcctcccaaagtgctaggattacaggcgtaagccaccacgcccggccttttgtcctctttttagggttgttttatacttcttgatagtatatgttgaatgacaaacattttaaaaaatagatgaatttatctatttttgcttctgttacttgtgttttttgtgttatatcttagaaaccattaatttcagaccatgaagatacatttttaaaataactttttttttgagacatgagtatcacttttgttgcccaggttggagtgcagtggcacaatctcagctcactgcaacctctgcctcctgggttcaagtgattctcctgcctcagcctcccaagaggctaggattacaggtgcctgccaccacactaggctaattttgtatttttagtagagacagggtttcaccattttggccaggctggtctcaaactcctgacctcagatgatccacccacctaccatacccagtcaaaaatacatttttttttggaaaatatagtttaggctgggcgcagtggctcacgcctgtaatcccagcactgtgggaggccaaggcgggcggatcacctgaggttgggagttcgagaccagcctgaccaacatggagaaaccccgtctctactaacaataaaaaaattagctgagtgtgatgaaacatgcctgtaatcccacctacttggcaggctgagacagcagaatcgcttgaacctgggaagcagaggttgtggtgagctgagatcccaccattacactccagcctgggcaataagagtgaaactccgtctcgaaaaaaaaaaaaaaaaaaaaagctgggtgcggtggcttacgcctgtaatcccagcactttgtgaggctgaggcgggcggatcacactgcactccagcctgggtgacagagcgagactccgtctcaaaaaaaaaaaaaaaaaaaaaaaaatagttttcctcattgaattgccttggcaacttttgcaatccatagaccataaatgtcagggttaatctttggacagtcacttatattccattgacctatatcactgtccttatgccagtaccacaatgtcctcattactatcactttatattgtttagaaatcccataatccaactttgttctgcttctcattaccagtgtggttcttttagatctcatgaatttccatatgaattttagaatcagcttaccaattactcccgccttgcccgcaaaaaaaaagcaacagggattcccatagcacaacgacatcactctgctggacagcaagagggtgtgttcaggaaccatacctagtctacaaagccatgggactacataccacagtcccagggacaaccacaaaatcaagactcttcttttgtttttgtttcttttttttttttttgaaacggagtattgctcagtcacccaggctggagtgcaatggcacgatcccgactcactgcaacctctgcctcctgggttcaagcaattctcctgcaaatattttgtctctctttttttttgagacaaagtctcgctctgttgcccaggctagagtgcagtggtgcaatcttggctcactgcaagctccgcctccccggttcacaccattctcctgcctcagcctcccaagcagctgggaccacaagtgcccaccaccacgcctgcctaattttttgtatttttagtagagacggggtttcaccgtgttagccaggatggtctcgatctcctgacctcgtgatccacctgcctcggcctctcaaagtgctgggattacagacgtgagccaccgtgcctggccaactcttctttttatggtctgaaatcacggagtatattctctacatctcattcctaccttcaatgaggaaattagttcctgggatctgatgacctggagtgagagatgcagctgatctagaccacatttctcacttctgagatcagaatagcaaatatgtatgtactagtaatttggacatttgcaattcaagaaacctcgcacctcccacagcatacttcattcactccatgagaaaaaaacaaactcacttaaatattcatcttcagaaaaaaaaaaaaaaggctgcccgctgcggtggctcacgcctgtaatccactttgggaggccaaggctggcagatcacgaggtcaggaaatcgagattatcctggctaacacagtgaaacctcgtctctactaaaaatacaaaaaattagccgggcgtggtggcaggcgcctgtagtcccagctacttgggaggctgaggcaggagaatggcatgaacccgggaggtggagcttgcagtgagccaagatcgcaccactgcactccagcctgggtgacagagtgagactctgtctcaaaaaaaaaaaaaaaaaaaaaaaaggcagagtggcagaccaaaaacgagccatatgtcaatctggagtaggagtgaccaatgtcagagtggaaaatgagggctgatgagctttggttctcaggctttagagtaaaggtggtagatgcaaaactgtctatccaccgtgggtttatactgataagtgggcagtaaatgaaagaatagtgtaatcagctgatgttagagtgcaccttttaacaacgttcaagtacagatgcatcttaaaattgacattgtaaaaacaaagtttgccagaatctagtcataatatggctgtccttgtctgcacatgcatgaacttgatctgaaaacctttgattgacgtcttctggtgatatgatcaccatcaaaacttacagagatgctgtcagtaggttgaataatctcataaataggagagtaggactctgtcaagaaatgtgatgtcaccaaagttcctgattagcaaagatgatgacaatgtggggtaaatcatggacagggtgtgttgaaggtgattcagaagagtttgatctgagtgacaggaattttaggaatgctgttgttagtgtattctgcttatattttccatctttgtcatcatagaagtgatataagactaatacctgcatttatagtagttgaaagtttttttcagtaataatataaaattgtaagtgataagatgtatttgtcctatagtctacgaatttattcctatattgtgacataaaataatgatgcattttacaattgactcaaataataactatttcaattccttagaaaacactgtatgagaaaatgctgacttcatgtttagtatagatgtgctattagtctacaggttttaagtattattagttcattcaattctcacaacatttcaagaggtaggcaatattaccactcccaagttccagttgtgaatctgagctaaagccttacaggaaaagagtagaaaaacctgagcttgactttgtctgtctccagaatctttgtttacatcaactatgttagaatatcttttctatgataaatacatcctaagtctagtttcagaaattgtgctttacacaatagtcatgaaattatttttctcaatttcaatctaaatgctacattaaatcgtttttaagttcaggtcaatgaaccatctggtgatcattttgtatgtaatgtgaggtcaaaggtgagatttttattccctcccccaccgcaacagaagaatattcaatttcctagaacattgatagaaaaatcaattttccccccattgaactttaatatgtatgtataagagttttccactgggcatggtagctcacacctgtaatcccagcaatttaagtggctgtggtgtgaggactgcttgagcccaggagtttgagaaaggcctaggcaacatagcaaaacactgtctctacagaaataaaaattttaggccgggtgcggtagttcatgcctgtaatcccagcactttgggaggctgaggcgggcagatcacctgaggtcaggtgttcgagaccagcctggccaacatagtgaaaccccatctctaccaaaaatacaaaaactagccagacatggtggcacatgcctgcagtcctagctactcgggaggctgaggcaggagaatcgcttgaacctggcaagtggaggttgcagtgagccgagactgtgccactgcactccagcttgggcagcagagtgatactttgtctcaaaaaaaaaagaaaaaaaacaaaaaaaataaaaattttaaaaataaggagtgttcaacactctttctacttgctaacacttatgcaggttcaaatcttgccttttaatatttgtttttaatttgtcttgcagactaatgtctttatcacttgtgtacattttttttcctttggccacataagtatcatctacaacccaaaatacatttctcctttatttaaagcacaagtcaagcagacgttcaacaaataggcaataaaaatcagattaaagatactgtaggtccaggagctgtggctcatgcctttaatctcaacactttgggaagctgagatggtggatcacctgaggtcaggagtttgagaccagcctggccaacatggtgaaacgtcttctctgctaaaaatacaaaaattagctgagtgtggtggcgtgcgcctgtaatccaagctactcaggaggccgaggcaggagaatcgcttgagcccaggaggcagaggttgcagtgagctgagattgctccactgcgctccagcctgggccacagagcgagactccatctcaaaaaaaaaaaaaaaaaagatgctgtagtaggaaatgtgcattactctgttgaaatccacaaaatgcatgagcatacaacccaaatttaagtggtaattgaaggtttcctcgaagaggcagtttgtgattgaatagatgaagaataagcagctgaaaaccatgtaaattagaactaataaataacaaaggatgattagtattgaggtagagaatgggaatgtatagaatgcaaaaaaaattgagacatcgcaaggagagcagcaatttcagtacacttgaaggaagctagaaatatataccagggctagatttttaagatatttaatgccgtgtcaatgtgttggtattttataattttctgtagttccagacattagctagggtgtgctcacttaggaacacagctgttgaaattgtaaaatgagaatttgggtctcatacatttgaagaaaaaaatatatggggtttaggttcagattctgtacagacaaaggaaaagtatgggtggggaaaatgtgagacagcctgaggtccaggaaaaatggccacagaaaattttcgtattttcagataaaatctactcttcaagttagacctccctacgaaagatgctagttcaataatgaattctccacctggaaaaggacatttcagctccaagtccaggttgctttcatgccttaaagtcaccttatttgtatttcagaagcacgtgctacactagctttagggaatgaagaaccatgtgctgacagtgccatctagcatcaacagaaacaggaaccaatggcaacctaaataagtacagaaaaaaaggtggggtccaggaaccaagaatgactgctgatttgagcaggatttttacaatttgttttaaaacttaaacataatgcatagatgctgtggaattaaaaaatgcaacctaggccgggcgcggtggctgacgcctgtaatcccagcactttgggaggccaaggccggcggatcacctgaggtcaggagttcaagaccagcctggccaatatggtgaaacatctctacaaaacacacacacacacacacacacacacacacacacaaacacactagccgggcgcagtggcgcgcgcctgtaatcccagctactcgggaggttggggcaggagaatcgcttgaacccgggaggaggatgttgtggtaagccaagatcgggccactgcctggcgacagagcgaaactccgtctaaaaaagaaaaaaaatgcaatctaataatgtccagcaacgatacagggaagcctggcccatgctcacttttccagtcacctgctcttaagtagtgcacgggttaaagaacgatgtgagtgctagtggctgattctttcacttacaaacatgcatgtacacgattgtgttaccatggacaaacacataaaatttgattgtaaaactagttgactcttaactgtgacacattaaatccttgagtaaatgagtgtgtgtttccatacatatattcagtaccactacagttcacaaaatgaacgggacttcttaggttaaagccttgttaagttattctttaaaacgctttccaatctgatagagagctctggcgtattcgctcaagtttccgtggcgggtctagggctcctgaagccccacgggtctcactgctacccacatggctattaccgcaaccaccgctgccacgcagcccgcaagaaatgtgccaccgttctgagcggccgacaaacccgcagtgcgctacgggaaggtcacctgacagttggggagaacggcagcccgcaggggccgatcttcggcgcgcctgcacagcgcaggcggaattggggcgccttttctccttccggtttccgtttccgtgcgccccgagggtctgttccgcttatggcgcccgccgggagtctccctttcttcgcaagcgttaacctgcgttttactcgtaaaaatttgctttctaggcttcgtataattgttctggtcttgcactttatgtgtgcattagccttgagtttgcttgttgttttcccatgaaaaattgtattgtatttctgtaacagcccctcctcttgttacataaacattgaccagtaattgtatatccttccctctcaatattaacaattttatcttttttgcgttctttgaaaaaaacgaaatccttttcaaaaatactgaacttgtcatttttaagaaatgagatactactttaatcatttctgtattgtccttaagattctttatatattctttattgtttatcttttccactaatatacctttaatatgagaggacttgtagaggcttcagggtcacactttcgaaacccagagttttagtatctccttatagaatatttgtaatttaagaaaaattatacaaggttgaattttcaaaaatatatttttaaaatatatttaaaaaagtatttttaaatatagtcctccggaatgcaaaaggacaatactactttcagctagtactttttaagtgattattttccgccacgtattcttttgaaattatgcatttaggccgggtgcggtggctcacgcctgtaatcctagcactttgggcggccgaggcaggcagattgcctgagctcgggggttcgagaccagcctgggcaacacggtgaaacctcgtctctactaaaatacaaaagaaattacccgggggtggtggtgttcgcctgtagtcctagctactcgggaggctgaggcaggagaattgcttgaacctgggaggcggtggttgcagtgagccgagatcccgccactgcactctagcctggaggacagagtgcgattctgtctctacaaaaaaaaaagaaagaaagaaattatacatttaattgaagctcagaaaatatatgtgtgatgttttctatgaaatgaaacattgtttagatgagaaaataaatgtaaaatgcatttgccttttcaaagcagcaattagtggcgaagtgtgaatacaaaaccagtcttctttctgcagagaccatgtctgtcacccttgtgctggaatgaacaacatcacatatttttttgtttgcatatggcctgagggtcaaattctgcccagcatgtttgctttcttttttaaataaatatttattggaacacagctatgctgttcatttttgtattgccgatagctgccttaatgctacaatggcagtagttgcaagagacagaatgacccataaaaccaaaattatatactctctagccttcctatcacccactgttctgtctggtgttggggcaattcagtctttggtatgctaatttggatgagattcacacttgggctgttggagaggagtgggtgaacctgttgagttaatcagcaactccaagaggtccatttcccaagcatctttccttccataacttcacagtaattttcgtttccttatgtctcctctggccaatatttttctacttctggggtaggcggtcagaggaaagagaaaaaaaggaaaatggtgaagttggacccactgtcttggacctatgacgactcctggcagagaaaggttttcccacttttcgtttttgttcttgtgaactccctgagcagccactgtcatgacaacatgatggtctgagaggtggagtagaagagattggagaaaagggcgacagagtgagaccttgcctctaaaagaggggggtggtggtggagggatgggaggaaagggggattcttcactcttgagttccgttttcaatcctcgaacttttcctggagcccgcagtctgcaccacagcctcacttctgggtttctgcctgtcttaaattcaggcctggggataagtgagtggtaaaaattaaaattcatcaccaatttagtagtacttcacagtccagtgttattccttcatttctgttactacttagtcctcaaacagctgttccatacattttatccaagttttatagctatattcagtaggagagacagggcagaaaatactttttctttcctgaaaatggaaccctaatgggagcctgatgaattttttaattgaagccaaaataaaaaaattaatatgtgctcataaattcatatttatactcataaaatatgacattcaacccaagttcttcattttaacacttacgcctttttttttgagacagagtcttgctctgttgtccaggctggagtggaatggcatgatcttggctcactgcaacctctgtcatcagcgttcaagcaattcttgtgcctcactaccgggtcttactacattgcccaggctggtctcgaacttctgggctcaagtgatcctcccgccttggcctcccgcagtgctgtgattacaggcataaacctctacaaattttaatctacaaaaaacaaaattatattcgctttacctgtgtgacatttgaataatgacggtccatgcaggctttacatttcacttttatgaactaaaaaaaaattgagcctccacagggcaagtcctctgctgtgcatggaagataggcaggtgttcaaagcatagaaaggtactgctgccccaggtaatgcagtcaagagggaattcaagcatatggaggtgattttcattgctatcaagagtgtggtttaaaaagtcacagtaagggctggatgtggtggctcatgcctgtaatctcagcactttgggacgccaaggcaggtggatcacctgaggtcaggagttcgagaccagcctggccaacatggtgaaaccttgtctctactaaaaatacaaaaaaaaaacaatgagctgggcatgggggtggacacctgtaatcccagctacttgggaggctgaggcaggagaattgcttgaacctgggaggcagaggttgcaatgtgctgagattgtgccattgcactccagcctgggcaacaagagcgaaactccgagagagagagagagagagagagagagagggagggagggagggagggagggagggagggagagagagagagagagagagagagagagagagagaaagtcacagtaaggcaccctagcagagtgaaacaaaaactaaaaaaaaatcgtgttccagcataggcctgagcatttaaaaatcgaagaaccgtggaaatattaacaattacataaagtgcatctagattttgaagtcatttcatgcaatattcatgagttctgggtttatcagttattcctcagctttatttggtgtatcagttttaggaatgtgtatgtataatcgtcaagtcttctatctgaaaggtaccagaacaaagcctggctttaggatcagatcctgggcaggcaaaagagcgctagaggcggaacaagatatccttcctatctgaagtggccatgggttttcaactgacagccttctcctcatccacttccaccttccccgatgctctcagaggtagactatgaaggcctctccctaaccactttctagctgcctcttcatatccttagtgtatcatttctccaagctgtaggtgtcctgctaattgattttgaatttttatgttcttctgtgtgcgaatgattaaatattaaatacaaaagtcggttcatttgtttgttttttccaggcttgtaatctctaactttcatttttgctacaaagcctttaaaaaaaaaattcagttactctagattcagattttaattaaaatttatttttgaaggtaaacatcttacataaaatttggctaaaagggaagaaaaaaaactacctaaagtttatgtggtcatcctacttgcaatattttagcaagcatgatttttatttaatgagtttcaaaaattttgacaatgaatactatcacagagactaagagtgtgtgatttcttccactttcatagcacagatgctcctcgacttacaatggggttatgtccccaataaacccatcataaattgaaagtatcttaagttggccaggcacggtggcttacgcctgtaattccagcactttgggaggctgaggcaggtggatcatgaggtcaggagttcgagaccagcctgaccaacatggttaaatcctgtctctactaaaaatacaaaaattagctgggcgtggtggtgcacatctgtaatcccagctactcaggaggctgaggagaagaatcgcttgaacccaggaggcagatgttgcagtgagccgagatcataccactgcactccagcttgggcgacagagcgagactccatctcaaaaaaaaaaatatatatatatatagtgagttgaaatgcatttaatatatctaatctattgaatatcattgattggcccagccttgagcacttaaatttgctcaaaacacttacattagcctacatttgggcaaaatcatcaaacacaaagtctattttataataaagtgttgaatatctcatgtaattcataaaatactggaagtgaaaaacaatggttgtgtgaattctcaaagttcagtttctactgaatgcttatcactgtcacaccatcataaagttgaaaaattgtaagttgaaccatcttaagttggggactatctgtactgtgaaattccaacttctggacagtcaagaaggaagccagtaaaatcagaaaccagcggctttgcagccaagtaagcagggaggccaagcgtattccttggatggtctgcggtgggcagtctctgccaggatgtgcccacttagcacacacagccctgtacatcagcctgcaggaaaggcaccttggccagagcctcgggctcaccctagagcactatagaaaggtcatctggctgtctgggaggacagtagcccacaggggctgaagctgggcacacccactgggtggctcagggccagttttataatccctaccccctcaacaaacacactccactcttgaccactgcactccaacctctgtccctgcatcctccaccaggctttacacctgcaattgcactttggataataacaggcatcattggcaatatcttacactctatcatttcagataaagccttgaaaaatatgtgcaattatatctgtgcttctttgtggatatatgttttattatattcactatatgattataataatattagttactactagtatttatcaagaatgtagggctgaagctgggcacagtggctcatgcctgtaattccagcattttgggaggctgaagcaggtgtatcacttgaggtcaggaatttgagactagcctggccaacatggtgaaacctgatctctactgaaaatacaaaaattaaccgggcatttatgcctgtagtctcagctactcgggaggctgaggcacgagaattgcttgagcctgggaggtggaggttgcagtgagctgagatcgtgtcactgcactccagctgggacaacagagccccactctgtctaaaaaaaaaaaaaaaaagaatgtagggctgggcatggtggctcacgcctgtaatcccagcattttgggaggctgaagcaggaagattgcttgagctcaggagttcaagaccagcctgggcaacatggcataaccctgcctctacaaaaaaaaaaaaaaaagatctatatacacacacacaaatgccaggcatggtgacacatgcctgtggtcccaactacttgaaaggttgaggtgggaggatcgcttgagcccagaaggtcaaggctgccgtgaggcatgatggatccacggcacttcagcctgggtgaaagagcgagaccctgtctcaaaacacaaacaaacaaaaagggtgtagtatattcctggtattgattgtgcttttcatagtttaaaagtaagacttggtgtaaaggtatgcattgtgtagtataaatgcacagagaggaaaggagagattgggtacaaattcaggaaggcatgaagtgttgatgtcatgacacttagcccatccttgctctgcacagaccacgtttctcaccactgtgctggtatgtagacaccagcatgatcttctgaagcctcggataatttggtgtggatagctttcttttggattcttttaaattttgttatcttaaagctttccatagtatttcatatggataggccacagttactttccatttactattatacttttatatattttttcttattttgatatgagaaacaatgttggaataatcatgcctagacataaataagccaatttcaaaatgtttgtaggggagactcatagtgttgccagaaaaaggggccctgacccagaccccaaaagagggttcttggatctctagcaggaaggaattcaaggcgagatgcagagtgcactgaaaagagagagtttattgaaagctactcagctatagagtagagcatcctcagaaagcaagaggagaaatgccttgtatttaagttttttttatgtaagtgtcttgtctatgtaaagactaaactaagctgtgtctacgtgcagatgggttgagagcatgacaaaatttactattctgttgatttaaagaaaatggtccttgacattttagtaagtacatcaaagccataactgtaagtaacttgaaagcatatattgttatgggtattgggacatctggattttgtgttgttgtaggagtgtatccttgcaccggtagcctaggtattgttaagctgtttcctcaattataaacatgactatgggttgtgaccagcaaggaatgtgccttagttaatctcaagatggagctgaacttaaaatgccattactttggctctaaccagctcctgcttccataacagtggggtcaaaaggtgttcctttaaaatcttcctagacactgccaaattgcttttggaaacttctcacctggtgagatggcatgagtatctttggctcatttttctacatagacttggaaacagttttatgtttataaaatatgtatcacctcatttataaatttgtttgaataatttaaccattttgcttttattagctattttgctactctctgttttccttgcctgagtctttcccacatctctgcaacattgtatcatttcccacacctaaaaccaaagagggacaggcaagccagtggagagagcagaggctgatgagaacgaaggattttccaggaaggaatctggggctgtgtgtgtgtgtgtgtgtgtgtgtgtgtgtgtgtgtatgtctgggtgtgtgaatattgtttttattagcctgtagcccacgtgttgcatggccatatttttactatcaggatataaaacacacttacacacagctgcatacaaatgcaatgagtttatttttcatatacatttcaaaataatagcgtgaacagaccagaactcttcttcaaagttcaagaatgtcctcatggatccagcatccgtctggtttctgtttctgcattctcagtacatagcctcacttctctttctccaattttggaggatgtgtaaaaaattttattcttaaccaaacattagtcaggctccggaacgttctcttaactccatccatgcactttcttgtaaaatgcagttttaacaagaacactgctaagttagtttagcaagacccccacaccttagacatctgatcaccttctatatcttatcaggttcctcatcctccaccatcccttaagtgatcatcccagcttgtcttcagcaagaatcctattagatcaatttagccagaatccctcttgcccctgatgttaattcttagtaattttccaaccactagtccccaccctgttccttggctataaattgccacttgcccatgctgtacttagagttacttagagttgagtctcactctctcccacactgcaaggccccattacggcggtccctaaatctattgcagtggtcccgaataaagtcttccttactatgcattaacacgtatcattgaatatgactttttctttaacagatactttgacgaaggtaattgggactcccatcaagtctccacacagctagcagccacgtggggcacttctccaggtaaggattgtccctgttccacttatgttcctgtcagtaaaatggtaggttcagtgtcaggctttaccattttcttcagggagagacccatctgatatttagtcagccatcagatgggtccagccatagcacacattagctgtgacatgacgtcgtttatgacaatgactttgagcagagttgcacacctaaaaagggactcaattaaaattatcattcattttagttatttctcagatgcatttattatttccattttccaaaactcctaatgttacatttcttcttcacatgttagatatgaacaaagtaagactaactgtggccacatcctctttacttaggaccctacccaaagtggcaggaatgggatgtaaagtgacataatcagacacagtcaaactggcttttaatcgttaagtatcattgtcatctcaaagcacttggcatagttactgaccccttaaatgtcctttctccatcttatcttctcctttgttctctgtatcatcttccggtcctatagaaatatatccccacgagcacacactgaggtctttttttttttttttttttgagacggagtcttgctctgttgcccagactggagtgcagtggcatgatctcagctcactgcaacctctgcctctcgagttcaagcgattctcctgcctcaggctcccatgtagctgggattacaggcatgcgccaccatgcctggctaatttttgtatttttagtagagacaaggtttcaccatgttggccaggctgctctcaaactcctgacctcaggttatcctccggcctcggcctcccaaagtgctgggattaccagcatgagccatcgcacctggcctcactgaggtcttaatgctgagttgaactttgtctctggccatgagcatcagtccatgtattataataggtttgggttgggtgtggtggctcacacctgtaatcccagcactttgggaggccgaggcaggctcacaggtaaacaatttagacaaagttttcacattctctgagatttgtatacattggagattcagaaaaatgtaaccgaaaattaaactataggtggaatagctgcctttgggggctgagaagacaggcatcagacctgggatagacaagggaggcctcttgttccttgaaatgataccccagcccatgaggtctgcatgccaggaagccaaatgagtgaggatggtctgtgtccgctggggaggtccctggatgttgccaagagggatagggtctgggaaagagtgaggatggagtcaggcagagaggaccccccaggctcatggatggactgacctgaggacttatattaagtcataggacagtagagaaagtaagagccaagcataatgtaatcctaacaatgtaaaaagtattaatcattttattattagttaatgtcactgaactgtacacttaaaatggctaaaaaggtaaattttaggttacatatattttaccgtaatataaaatgacaaatatattagaaatgacttttttttttttttgagatgtagtcttgctctgttgcccgggctagaatgcagtggcacaatctcggctcaccacaacctccgcctcccaggttcaagtgattctcctgcctcagcctcccaaatagctgggattacaggtgtccgccaccatgtccaactaatttttgtatttttagtagagacaggtttcactgtcttggccaggctggtctcgaactccagacctcgtgatccacccacctcgggttcccaaagtgctgagattacaggcgtgacccaccacgcctggccaggaatgactgtcaactatattttcttaacatatgtattcctacacaacatcagttttgtaatagtttatttttgttttgttttgcaatttttttcttttattgtaaggaaagaagtacattttttcagcgtgtaagaatgcaaaagtaattatcagatgtttgtcacatcttaacaaaataggaccttattttcctagatgttgctgcattcagtccctttcttggtatggtaaaagcatcaatcagccagggaggcaactataaatacagaagagcagtttcctacagatagtcaaccatgctacccctcttactgacttaattttaatattggagcctggcacaattaacctagtttcctcgtaaacacaagaacaacgtactgcaatcaatgtaggcatatacaggctcttaaagttctgagaagcagcaagtaagttcatcatttactaagatccttgacattcttctgtttctgtgaaatttatgcatctgtgagaagtttcttttctttttttatttttttttgagacagagtctcgctctgtcacccaggctggagtgctgtggcacaatcttggctcactgcaacctgaacctctggggttcatgccattctcttgcctcagcctcccgagtagctggaactacaggcacacgccaccacacctggctaatttttatatttttaatagagacagggtttcaccatgttggccaggctggtctcgaactcctgacctcaggtgatccacccaccttggccttccaaagtgctgggattacaggcgtgagccaccgtgcccagctgagaagtttcttatactagaagaaaaagaaaatttgatttattttaaaatataatggtttagtctgtagcaagtaatattaatttttttatttttttatttttgagacggagtctcattctgtcacccagactggagttcaatggcacgatctccgctcactgcaagctccgcctcccgggttcaggccattctcttgcctcagcctcctgagtagctgggactacaggcgcctgccaccacgcccagctaatttttttttgtatttttagtagagacagggtttcaccgtgttagccaggatggtcttgatctcctgacctcgtgattcacccgcctcggcctcccaaagtgctgggattacaggcatgagccaccgtgcccggccctaacacgaattcttaagagaggtgaaccagggatgggattgtggatcaatcatgcaaagaccgactcctctgggcttcatttcctccatactgaatgtgcatccctacatgttcatgttgttgtttcataggtagtgcagggggtcagaataggatacccctggctgggtgtggtggctcacgcctgtaatctcagcactttgggaggccaaggcaggtggatcacctcagatcaggagtttgaaaccagcctggccaacatggtgaaaccccttctctactaaaaatacaaaaattagccgggtgtggtggtacacgcttgtagtcccagctactcaggagactgaggcaggagaatggcttgaacccgagaggcagaggttgcagtgagctgagatcgcacctctgcactccagcctaggtgagattgaaactccatttcaaaaaaaaaaaaaaaaaaaggatatcctcaattgcggtgccctggcatactgagtattttaagctgaaggaaattgagaaaaccatggaagcaggaaggccactctctgatttgctcccacttttctcccctgaagcaggtcataaaagaattatctgccctacctgtcctgaaagtaggtcataatgggaccctcatttcagaggagttctgccctatccctggataccaacaaagatctgaacaaacaggtcttatgaatttctccccaggtaattactattagatgataccctttgttccccaaagctatttcttcaaaactgtccataaaaatacacctatccagctgggcacagtggctcacacctgtaatcccagtactttgggaggctgaggcgggtggatcacgaggtcaggagttcaagacaagcctgaccaacatggtgaaaccccacctctactaaaaatacaaaaaacaactagctgggtgtggtggcacaagcctgtagtcccagctactcaggaggctgaggcaggagaatcgcttgaacccaggaggtggaggttgcagtgagccgagatcgcgccattgcactccagcctgggcaacagagcgagactctgtctcaaaaaacaaaaacaaaaacaaaaaaacaaaaaagccccacctatcccttggcctttgcatcttgatttctgaagactcacatgtcatgtaaaacttacgttaagtaaatatattatgtttttctcttgtaaatctgtcttttgtaatcaggatctcagccatgatgcattttggcttgtcagaaataatcacaacatgtggagaaatagataaaatgccatttttaaaattattattattttttatttttttgatagagtctcgttctatcgcccaggctgcagtgcagtgtcatgatctcagctcactgcaacctccaccacccaggtccaatcagttcttgtgactcagcctccccagtagctgtgatttcaggcatgcaccaccacgcttggctaatgtttgtatttttagtagagatgggatcttgctatgttggccaggctagcctgaaactcctggcctcaagtgatctgcccgccttcgcctccttaaatgctgggaatacagttgtgtaatggtatttttttttgagacaaggtctcaaaatggcattttttttgagacagggttgttgctctatttaccaaagactatacaagattatgtgaacttaaaataatattcgggttaatttctgtatttctaagttttaggaatacttagttatgtaagcatttacttccctttaagtcaattaaatcctcttttaaggaactttataaattaatttggtagtatcattgggcccagtagagttttttttttcttttttttgagacggattctcgctgtgttgcccaggctggagtgcaatggcgcaatctcagctcactgcaacttctgcctcctgggttcaagcgattctcctgcctcaccctcccaagtagctgggattgtaggctcccgccaccatgtccagctaatttttgtatttttagtagaaatggtgtttcaccatgttgatcaggctggtttccaactcctgacctcaggttatccaccctcctcggcctcccaaagtgttgggattacagggatgagccaccacacccggcaaatttcttttaagatattttataaattaatttggtaataccatcagaggcagaaaaatttcacacagatggagagacatacataaacatacaggcaaatatcaaaagagatcttctagctatcattctaaaatcttagccatgaatcagaaacacatagtaatacaaagtcactgttttatatgtaacagttatctctcatattttctccatttcatattttttccctattgtccctggtaaatgggacaagttaaggctatgtactaaatattaggcctaatgctttttaccaatattcatggagaaggtttttaagatcttcatttgccctgtgaagcccttttgaaggctgtggactaaatgttaaatgagtcactgcaaagacatctaacagctatcgaaatgtctccaccacccatctgagtggataaaatatccagtctatttccaaatagtctttttttcctcttcagccttggtacttacttttggaggactctgagtcccttgacagcagggtggactaaagtttaagagaagaagtctgacaggggaggaagacagagagatggagaaggtaggagtttgaagggatcatatccaggactcaaaggaactgaatggaagattgaaagtggcaagagtaggaaggaggaacagaaagagggggaaggaagaggtcttaagggaaccagctgggggagatattaaattccccaaagaggctagtgaagctccaaattatccttagcaaaatcaggccgggtgtggtggatcacttgaggtcaggagtttgagaccagcctggccaacatggtgaaaccctatctctactaaaaatacaaaaattagttgggtgtggtggcacatgcctgtaatcccagctactcgggaggctgaggcaggagaatcgcttgaacctgggaggtggaagctgcagtaagccaagatagcaccactgtacttcagtctgggtggcagagtgagactccatctcaacaaataaataaataaataaataaatatccttagcaaaatcatgccaaaaagagggaggtaggcagaattgtgaaagcttatagccaacagaggttcaagaaaaggctttttgtcaatggataagtttacatgggaagatccggatcaaaaggagagaacagagaggacttaagaaaattgttcctattggctgggtgtggtggcttatgcctgtaatcccagcactttgggaggctgaggcaggcggatcacctaaggtcaggagttcaagaccagcctgatcaacatggtgaaaccccgtctctactaaaaatacaaaaattagctgggcatggaggtgcacgtctgtaatcccagttattcggaggctgaggcaggagaattgcttgaatctgggaggcagaggttgcagtgagccgaaatcgagccactgcactccagcctgggtgacagagtgagactctgtctcaaaacaaacaaacaaacaaacaaacaaaaacagaaaagaagaaaagaaagtttttcctataagtctgtaactatcagcttcccattaggccaactattgatcatagaggtcttaaaaaatcctttcaggctgggtgccgtggctcatgcctgtaatcccagcacattgggaacctaaggcggtaggattggttgagcccaggagttccacaccagcctgggcaacgtattgagacctcatctttactaaaaataaacaaaattagctgggtgtggtggcatgctcctgtagtcccagctactcgggaggctgaggtgagaggatcacctgagcccaggaggtcaaggctgcagtgagctgtgattgtgccactacactccagcctgggtgacagagcaagacactgtctcaaatatatataatttttttcaaatatcttatcaggttttggtcaagaggaaaggtaaatattcctgatagtacattcccattaaaaaaaaatgtacccgttacaagtgacttggaaccaaaatccatagattctttcatggttctttatcggtatggtgatagggttttcatattcatgtgtgagatgtgcctccctcagtccttgttatgacatcattacgtgtctgacatgacaaaaaggaaaagagaaaaaggtggagaaaggtaaaaaataggaaaagaaaaactgaaggaaaaaggaaaaaaacccaatccgtaagccttttatgacttacccatgaatgcagaggcatcttcaaagagggtgcaaaaaatgcagccctctaaagatgccaaaccactctcaaagatagccaaaagaaaggcaggcctagatactccccctgagagctggcaatagatgttagctgcaaatgggttgcaacccacatgtctgtccagctgtattcccacagccccccaacctgatggttggctgcttgcacacacaagaaccaacaacttgtacgccccatcaagtggaaaaccaagccaaattcttttttttttttttcctttgagacggagtctcgctctgtcgcccaggctggagcgcagtggtgtgatctcggctcactgcaagctctgcctcccaggttcacgccattctcccgcctcagcctcccaagtagctgggactacaggtgcccgccaccacgcctggctaattttttgtatttttagtagagacgggctttcaccatgttagccaggatgtgtcttgatctcctgacctcgtgatccgcccgcctcggcctcccaaagtgctgggattacaggcgtgagccaccgtgcccagccgaaacaaagccaaattcttgacacaaaatgacagaaacagaaaagcaatagctgctcctgggagggaaaggatcaataaccaataggcaccacaaaatcaagctacagtcacaatctagataatgaatttttataatttttttcctatccatctgcattgggaaaataagggacaaggagtttttactttcttctcttgaccaggaactactgacagagatctgggagagctgactttggtgaaaattctcaccttgcacaggcttgtgtctgttttccagaatcctacctgcagactccagaatgaagtgtcccagctgtccctttctcgttgccagaaacttctacccttctcattcctttgcttgtccccctgtaacaagagacagattaatgagagaaaatcatgcaagttgatttactgtatgttttatgtaacatgagtcttcataagaaaactaagcccaaaagaagcagttaaacctgagtgttttttttgctggtctgatgaagagcgaagagtcatggagaaatgtaatgggaccaaaaggtgtcagctaagtgtaataaactgggggaaacagcaagggctattccttcagattcctctcagtgtccctgtgtcttcagagataaagatcttttcctctgggtaaagcgtggcagctctcacatgagggttttattacttgcttcagcagaaagtcaaaaagcccttcccaggttttatgacctctttcagcgaaaggtgagaaagtccttcctacacatttggtttctgaaattccttcagcttaaaatattcattatgccaactttccatattttgggttggcatgtcctgaatatattgtcagagcattacagaaaaaatacacccaaacacacacacacacacacacacacacacacacacacacacggacaacacattccctatgactatcttaaaattgattaacctcaaacatttaattttggatgactgagtcaaaaagagaattgaaattgccatcacatatctggtcaagctgaaagatggcatttggtattggaaattgatggctgctggtcatttaacacccatgcctcagttacatatctggctcatgagataagaatgctaaacagtataaacaagacacctcagtatgaaaacgttctgccgttacaaaggtactctctttgtgttactctgcattctctcccagccctgtagcaatttatcctttgtccatatattgaagatagatttgtttacatctactcttagccttcctgaatatcctttgctccaggagagccttaagccaagggtagaaatgacaagacagactctatgtttgcagaacaccacatagtcacagcgatgcaaatggaaaggaaaatatgagaacaaggtctttcaatccagatttggcctatgtttgtattaaaggtgttattcccatgtaagaccttaagacataatattaataataattcagctatgaaaggttcatgttgagttctacttgcatgggcaagctattaggtagaagttaaagatgcacagaacacattagttctttctaggtatatccttagcagagcaaaattgcaacccaagttagaacaggaaaaacttgatgaagcatgaaattaccagctggtctgatgggagatatgatgtggccctgaggtacagtaggtggtgcctgaagcatggtgacagtagtggaaacaccttagggtgacccacaattagtcactctcattcaattccctttccttgggtgtgggaagaacctgccaatagcatgtggcaaaggatatcgttactgtgtttatgctatgttatatgtcaaaagtgaagatatagtgcagatgtaattaaagaaatcagttggctttgagttcattaaaaggcagaatagcctatgtagacctccccttatcagatgagccacttaaaatggctcctaggcagatcacaaggtcaggagatcgagacccccccgccggctaacacggtgaaacctcatctctactaaaaatacaaaaaaactagctaggtgtggtggcgggcgcctgtagttccagctactcgggagactgaggcaggagaatggtgtaaacctgggaggcggagcttgcagtgagccgagatcgtgccactgcactccagcctgggcaacagagcgagactccgtctaaaaaaaaaatggctcctaggccttccctgatgtcagggaaaatagaaaagactctgtctcttcactgttgcctttgaagaagcaagctgccatgaattctatagccattgtaaaatgaattctgccaacaagcaaatgagcttaaaaagtaacagagtctgcgcacagtggttcacgcctgtaatcccatcactttgggaggctgaggtgggtagactgcttgagcccaggagtttgagaccagcctgggcaacatggtaaaacttcatctctatagtaaaatacaaaaattacccgggcacagtggcatgcacctgtagtcctagctgctcaggaggctgaggtgaaaggatggtttgggtccaggaggcagaggttgcagtgagtcaaaatcacccctctgcactccagcctgagtgagagccagactctatctaaaataaacaaaaacaaaaacaaaaacgtaatacaggccactgacaccttgactgaatccctgtgaaatatttcacctgaaaatccagctaacctgtgcccactgacccacaggaatggagataatatatttacattgttgtaaactgctaaattgactggatgtggtggctcacacctgtaatcccagcatcttgggaaaccaaggtggggggaatcacttgaggccaggagtttgagactagcctgagcaacgtagcaagaccctgtctctacaaaattaaaaaattagccgagtgtggtggtgtgtgcttgtagtcctagctattctggaggttgaatgggaagatttctttagcccaggagttcgtggttacagtgagctatgatcacaccactgcactccagaatggatgacaacgtgagaccttgtgatatggtttggctgtgtctccacccaaatctcaccttgaattataatcccatgtgtcaagggtggggccaggtggagataattgaaacatggggggtggtttcccctatactgttctcttggtcatgaataagtctcattagatctgatgcttttataaatgggagttcccctgcacaagcgctcttgcctgccaccatgtaacatgtgcctttgcttctcctttgctttcctccatgatggtgagggcttcctagccatgtggaactgtgagtccatgaaacctctttctttataaattacccagtctcagatatgtctttattagcaggctgagaatcaactaatacaccctgtattaatgtattaatacatgaataaaaaaagttgctaaatatgtagaactacactctgtgtcttccctttagtgttaggaagatcaaataggcactacaagagcattttcttggtaaatggtatctaaattccctcttatcaatggcaattactcatttggactgctaacaccataggggcaaaaatcctgacatgtatgaatcttgtgggagaagcacttggaaaaaaaacaaaaacaaaaacaaaaaacagagacaaacatttctgagcaaaaatgcaagctttttaaaaaaaatagtttgttttgatcagttcacatcatgtaggtcatttcatccggcctcattggcatataagtagtatatattgagctaggcgtggtggcttacgcctgtaatcgcagcactttgggaggccgaggcaggcggatcacgaggtgaagagatcgagaccatcctggccaacatggtaaaaccccgtctctactaaaaatacaaaaattagctgggcatggtggcgggctcctgtagtcccagctactcgggagagtgaggcaggagaatcacttgaacccgggaggcagaggttgcaatgagcgaagatcgcaccactgcaccccatcctggcgacagagtgagatctgtctaaaaaaaaaaaaagtagtatatattgaaagtataaaggggtgaaccactttgaattgcgtatgacaaaagaagctcagagttcaggtgaaaaatgtgttattacaaactcaactatcaatttaatctgtctttaatgtatgagtcaaaattaagtgttttctgttggggtgatcggacccaacaccaggccgtgggggcgatgaagtcccacggagtcaaaggaatgagaaaagacaagttaagagagaaactgggaccaggggccaatgctagtatggaggctgcgaaggccccaagctctgggaccccatgctatttattggtgatcaaacaaagaaacaggtggcgaggctgtgggggttgaaaggaagtggtgtatcaagcaaatgagctacagctgtgatggtttagcattttctttgaaacatatggctacttgagataatgggagtgctagaagcaaggagccagcaagtctagacacattccaaaggccacaaggggttttagaccctggaccccagacacgttccaagactcttttacattatgtcagacatccaggccctgcctcaaattctctcccaacactcagcttttctcccaacactttctattacaaacatcaacggaaaaatcaatgatctgtttaaaatattgtaaataccatcactatgtttgaagatatgttttaattttttattattcctttaattaaaagaactgtatgccaattaataagctgttgccttttagatcaaaattaatcattcattgcctgctctgtgaaaattgagtcagatacccttaaaaatatattgtgttgcaatagtaagttttttcagtaattgaaggtggttggacattgtaaaaagagattttcctttctgattccactgtggtctctcagccgtttcccatagcatgcatgcctttctccagcactatatttctacagtatgcatgagcaatcctgcagcaacaatggcttttctagcatcaggctcctacaacgcatgacagtcagcagcactagtggtcagccacttcctatatcccctacccttaggtggtttctagtgtagtgcttccaataatatacctacctgtgaacacctttccctggcacctaagtgggaagatttctggaaagttccactggtgccgcacactgtgactattctgtgtagcctctaacaagctctggattgcaatccacttatagtaaataaatgtccacttcaaacattccctcctcaaattcttgtgttttgtctgcctcctgattggaccctcactgaaagaattaatgctggcattgttccaagagatatttccacagagatgaatctgggaggttgtgttggtcattcctttatgtttgggcacattccacagctccttgtcaatgtgcaatgggatactagcaacctatgacatgcagtggtatcacaattaatcaagcaatgacctgtggttgattgtggcaaagtgccaactgaaacacgtgccttgggagcccgagtgactgctgcactgaatgttatggcagtcaagataactgtaaggactgtggggtggaatggattcagttgagggtccttgagtgattacgaacagaaaataacaagcttaggttccttaattctcagttcaagccacggtttgaaaacctgagaacttccatggcgactataaaggaaattcatttgttgtagctgcagggctgatattgttaaatatcaaaaccaagaatgagatcctgaaacttggaatgggtcaggaaacttggaatgggggaatctgtttagactcagttgaaactgaccatctggaaacagaaagtcaggctgagcctttcttaccagtttaagtagcttgtctctattgtttgaagaaaatatctttcccttgcacaaaagctgggttagataccattaaaggggatgcccatttttcttaaagtcccctacaaatcatcactttttgctagtagcatgactagaccccataactaggattgaatagcaacctattcctaagggataggtacacactatgacctgtaggaaacagctacatgcaaaaggaactgtgacatatattggaagaaacctggggaatgttggaagagcattctaaggccgttatactaaggaggacaaaatataacagtagattgggttaattaatctcagtgctattactggggattcaagatttattgtgctgcaggcatgtggctcacacctataatcccagcactttggatgccaaggcaggaggataagatgagtccataaatttaagaccggtttgggcaacataaagagaccttgtatctacaaaaaataaataaataaataatccagtgagagtggtgcacctgtagtcccagctacttgggggctgagatcagaggatcacttgagccctggaggttgagggtgcagtgagctgtgatcatgcaactgcagtccagcctgggcaacagagccagaccctgtctcaaaaaattaacaaaaaaagatttattttgtagttctcctggtagagatctttcatctccttggttagatgtattccttggtattgccgtcttaggtagaggaagagggctcaaacatcttgcttatgtgataactttgccaaagacacaatgtacaatttgttttaaaggccagtgagggatgtaccagtaatcagaatgttttggcaaacagaagactttggtggtagctaactgatcacagggtccctagaatgaaatagatgagaagcatacttagagtattgtttgatctctatatcaagaaaagttccgggtctggtagtcaaatgttcaacagatgcctacctagctttcaaccctaagtcaattcacagttgcagagtgataccacacggaccatgaaaagaacacttgtttgtatgactgagacaaaaaagaatgtcatcgtgttctaccttacctgggaatatgctcaattggtgacaaaattgttgccactctgtgcatgaccacaaaagtaccgcaggtattgattttgaagttacacataaactttagtgagtgggcatatttgcaaatatgtaacctgagaataatgaagattaactatctttaaacaacataaggagtcaacatcagtttctgaagtaaaataatgactaagttaaattttcaagggcaaattcagattccaagtgcacagaacataggaagaaaaggacatgcaaatcagaaaaattcacaagtgtaatgaggcgagaagggacatggcgcaccaattacaaaggaatcagaatgatctgttcatagagttgtaaatggggttgtggaggaagaaatgaggatgaacagataggcaagacaagttcttttccttctatgtaaataagagaaactgagaaattgtaacgtaagacaagatctaatattatttttggacttcagaatggtattgcataaatgcttaattgttcctgatttcgggaggggaaaatggaaatagcatttccgttgcatttttgtgaacaaaatttgagtgatcatgttctttgttgcatgtggtagatggagaggtgaatgaaagattcagctttcttcctgtacttgaggcatctgtgaattgggaattcagacaaacagataagcaactaattctggatataaaatttgtgatttaggctatgcattctactggggaatttcagatgtataggaatgtagttgaaatttaagtggtcagggaatgctatctagaggaagaaaattatgactagagacaagaataaatagtagtaacttaaaaaaatatatatcagggaagaaaaaatggatttttgttccaggaaagaaactaagtatgaacagatgatgaactatttcaggaactgtgtctgcaattcgttccttccagtgggttcttggtcttgctgacttcaagaatgaagccgtgcaccctggcagtgagtgttacagttcttaaagatggtgtgtccagagtttgttccttcagatgctcagatgtgtccagagtttcttccttctggtgggttcgtggtcttgctgacttcaggagtgaagccacagaccttcgcagtcagtgttacagctctcagtccggagttgttccttcctccaggtgggttcatggtctcgccggcttcaggagtgaagctgcagacctttgcggtgttacaagcgttacaagctcgtaaaggtagtgtggacccaaagagtgagcagcagcaagatttattgcaaagagcaaaagaacaatgcttccacagcgtggaaagggaccccagtgggttgccactgctggctccggtggccagcttttattcccttatttggccctgcccatgtcctgctgattggttcattttacagagtgctgactggtccatttttacagagtgctgattggtgcgtttacaaacctttagctagacacagagcactgattgttgtgtttacaatcctttaggtagacagaaaagttttccaagtccccacccaacccagaagcccagctggcttcacctctcagaaccacagatacaaattattttatttacctgaatcaatctgaaagcatatgctggggctggatgttgaggatacttaatggcacattaattctttgattttgtatatgtttagatacattcattagctacagtttgcagcttcctaacagggattccacagatatgactgtaaattgagaattttggtttcccagtgtctgaaaagtggttaacccaaagttttggctttagagaaagagtctatacaggcaaaagcgtagagggtttggcagagaaaaaacaaaaacaaaaacaaaacatcctaagggccaaaggaaatggttgcaaggaaaacggtcaaaaacttgcatcattctcttcatccactcacaccactctatgcaggatcccaaatcagtccttgaatgtttcggcacaggttccattcatgctttccaatggaaacttcatttggtttataggattcaggattgtggaaccatccggtatcaagaaaataaaaggccatgaaaaagtttacagaatgttggtataagcagctgctagggatattactgagttttaatgggagagatagtcccagaaagctggaagaagaaagatcagggccaagcgcggtggctcacacttgtaatcccatcactttggaggcagagaggggcggatcacttgagtccaggagttcgagaccagcttgggcaatgtggataaaccccatctctacaaaaacatacaaaaaattgctgtgtgtggtggtgcacgcctgtggtcccaggtatttgggagactgaggtgggaagatcacctgagcccaggaggtggcagttgcagtgagcagagctgaggtctggccactgcattccagcctgggctacaaagcaaagtcctgtctcaaaaaaaaaaaaaagatcggagcaagaaaaaggaaaaagatgggtaaaaacatagaaacgactaagttcatttcagcaggaatatatttttaaatatatttcaaaactgaaacaatgctatgttttgctgcagtgtgtgagggaacacaattcaggctaatgcacagtaaaaatgcagggaagcctggccccgtaaccacttttaataccacatactacagttaacagttggtgagaaccctattaggctgatttcaattacaaacatggatgtacaggagtatgttttaatggcacacatgcatagttcatattttattagaaaatctgttcaggccggctacagtggctaacgcctgtaatcctagcactttggaaggctgaggcgggtggatcacctgaggttaggagctcaagaccggcctggccaacatggtgaaaccccgtctctactaaaaatacaaaaattagctaggcatggtgccgcgcgcctgtaatcccagctactcaggaggctgaagcaggagaatcgcatgaacccgggaggcagaggttgcagtgagccaagatcgggccactgcactccagcctgggcaacagagcaagactccctcttgggaaaaagaaaagaaaagaaaagaaagaaagaaaatccgggctgggcacagtggctcacttctgtaatcccaacattttgggaggatcacttgagatcaggagttcaagactagccttgccaacatggtgaaaccttgtctctactaaaaatacaaaaattagctgggcatcagctactcttgaggctgaggcaggagaaaggcgtgaacccgggaagtggagcttgcagtgagccgagatcgcgccactgcactccagcctgggcaacagggcaagactccgtctcaaaaaaaaaaaaaaaaaaaaattagctgggcgtggtggcatgtgcctgtaatcctagctacttgggaggctgaggcaggagaatcgcttgaacccagaattcagaggttgcagtaaactgagatcctgccactgcactccaggctgggtgagagagcaagactccgtctcaaaaaaaaaaaaaaaaaattaaaaattaaatccaccaaattagctcaagaacacttccttgactggctcagaaatcccatccgattttaagatagatgttaaaaaataacagggaggaccgggtgcggtggctcagacctgtaaacccagcactttgggaggccgaggtggggggattatgaggtcagcagttcgagaccagcctggccaatatggtaaaaccctgtctctactaaatatacaaaaattaactgggcatggtggcgtgcgcctgtagtcttagcagctcaggaggctgaggcaggagagtcgcttgaacccgggaggcggaggtggcagtgagccgagatcaagccactgcactcgagcctgggtgacagagtgagactccatctcaaaaaaaaaaaaaaaaagacacattatttcattttaataatgttagtcaattttttttgttgtcgatgagttgcgttttgttcattaagaatcagctgtaacatttgttgggacttggtagaagataactgctaggtggttgtagctgccaggcttttaatgagaggagcttagtttagcgaaaataaaagaaaaacaaagattaatatttggaataaactgtaaactcagcttctgagtccagagatcagccagtcaagattgtttagacttgagcttatctttagatggtgaagttaggaaggtagtgacagtctaatgagttttcctagtttacagtttgtatgtctttggtgattacatccagtgttctggtgaacttcctgaggggcccacccagcaacagacacaaaggtgatttatttgaaactgtaggaacgaaaaagtaatatattttcatcacccattacaaggttaacgagtgagactcctataacaaaagacatattaataagaaaaaataatatcaaatgtagttactaaaagtattatgtgacatgggagcttttagaaatgaagatcaaaagaaccagggagaatcctgggtttttttgtttttgtttttgtttttaattgagacaaggtctggctttgtcaccctggctggagttcagtgacacgatcccaggtcacttcaacctccacctccatgggctcaagccatattccacctcagcctcccgagtagctgggactacaggtgggtgccactgcacctggctaatttttgttttgttttgtttttgtagagatggggttttgccttgttgcccaggctggtcttgagctcccaagctcaactgattcacccaccttgacctcccaaagtgctgggattacagacatgagccaccgtacatggctggaaaaatctatttttacagagagctatgcaaatgtgtgattggaaaacaaatgggtatgacctagtggcaataatctgaggagaaattagccagatctgttcagattcttcttggtctctgcgtatagaaaaggactgctcctgagtgaggaatttatgacctactttccggggaggtaggtcagagaattcttttgtgacccacttcagggggaagaggtcaaagactgtgcttcctgcatctattatctcaatttctgaggtgccatatttgggggcattatttacagagactcaagggggtgtaagtgcctattatcagaggtcattcttacggaggctattaacgaaattttaggtgaatggctgagcagacatctagaagttgtcatccagtctatttctaattaggttttttcttttctgacgcaggtagttgattttgcaggatctgctgtcccttaggagaagagggccctaaagttcaagtgattgtgggactggaggagataaaaggctggcaggggagggcagagggagggaggatgaagcagttaggggcttgaagggggaaatatcaaaggaggcaagagaactgaagggtaaaataatgccaaaaaagaggtggacagagttggcaaagcatatcgtaagcagggatttgagaagaggggattcagatgacagagaacatcccaagggagaagcagaatccaatatagagaatggattggtcttaaatagagctgggagtaaaagattcgcagcccaggaagtcagggaataatacctacggaggaaggacttccaggccaagtatccagggaataatccccactgctatggttctaatgatggtgccctctcaaaaattcgtgttgaggccgggcatggtggcttatgcctgtaatcccagcactttgggaggccgaggcaggcggatcacaaggtcaggagatcgagaccatcctgactaacatggtgaaaccccgtctctactaaaaatatagaaaaattagccaggcgtggtggcggtcgcctgtagtcccagctactcgggaggctgaggcaggagaatggcatgaacccaggaggcagagcttgcagtgagccgagatcgtgccactgcactccagcctgggtgacagagcgagactccatctcaaaaaaaagaaaaaaatcatgttgaaatgtaatcttcagtgaaatagtatgttgcccaggctggtcttaaactcctgggctcaagtgatcctcccacctcggcctcccaaaatgctggcactataggcataagccaccacgcctggccaagacactaccttgaaagcacagagtaggccaggcgcggtggctcacacttgtaatcccagcactttgggaggccaaggtaggcagatcatgaggtcaggaattcgagaccagcctgtccaacacagtgaaaccctatctctactaaaaatacaaaaattagctgggcatggtggtgggcacctgtaatgccagctactcggggggctgaggcaggagaatcacttgaacccgggaggtggaggttgtggtgagccaagattgcaccactgccctccagcctgggcaacagagctagactccatctcaaaaaaaaaaaaaaaaaaaaaaaaaagaataagaaagaaagaaagcacagagcagcccttactagacacaaattatgccagtgacttgatggcgtaattggacttcctgactccagaactgtgagaaacaaatttctgttctttatagatttcctaggctcagttattatgcttagcggcacaactgactaagatagaaattggtactgagaagtggcagtgttgcaataacaaatacctaaaaatgtagaggctgctttggaactgagtaatgggtagaggctggaagagtttggaagtgcatgctagaagaaggctagtttgccatgcattaaggcgattctgacgaggcttcagaagatgaaaagccatagagaaagcctccgtctttgagattatctaggtggttgtgaacagaatgttagaaagaatatggacagtaaaggacattctgatgaagtcttagatggaaatgagggatatcttattggaaactggaggaaaagccatccttgttacaaagtggcagaggatttgttcctggaaagaacagaacaaggtctgggaaagaagggagtttatttctgcagctggttacagggagaaggccggagtaactcaccataccaactcaaagttacaagtttttttctagtgcttatatacattttaagctcccatgctaggagtggaattgcacctccaagcaggagtgtttccttcaatctatatctaaactttaactaggacctagggtctggaaatctttctctagagtcttggaaagctttttaatctttttttctttttctttttttttgctgtccataagtttattgtctgtatctgaaaaatcatcatagaaaattgtttggtttagctctcagcagcctgcttctgagctctgaggaagcttgcattcttttgagctacccaatccttcttctgagcaagggacattttgggatggttccacctcttctttttaacttctttcttgggcttattttcatagactggattctctcgtatagcagcatgagcttccttatacatttcctccatcatgtctggagttaccctgttctttatgtattgagagaactgtttcttgtaagcattttcatcttcttccattaagtagcacatgtaatcggcaacattctggcccatgatgtgcttccggtgtacttctgcattaaattccttgctttcagaaccataaccagggaattgtttggtactgtgagggatagacaagcctccatccacagctcccttcagggcaccaaaaactttattgccagtggtagttctggcaaggcctgcatccaaatagcaggtaaaggcacttggctgaccatcaatgctttccacaatgtattcatcgccagtcacctccacttggccttcatagatcttgtccatgccaaacctactgagaagcctgcgggccagcggcaggccagtacaatatgctgcagcataatttgtcgggccaaccttcacaccatattttggcagttcgtgtgcatatgctgtgcagactatcatatccccctctatatgggcataagcaatctgacaaatgatatctctgtttgttacacgaactatcatcctgtatttgagtgtgttgtatttatttttatcctgtatcaccaagcgtttccgagtatcgtaatcagttttaccctctcatcatcgtcttctaaatttcacttggtatctcttaaagtaggccttattcttaacaactttaacaaaccccatcctgcagaacagagacccgcgtccacagctcaacagagaccagcaggcacagcggcgctggggcagggagaaggggaaagctttttaatcttcagtgggtacctggaacaaggtatctgtgtaaaatgcttttattattcaaccagactttaggctaagaaagcccattttaatgggtttattttaatattccagccctcatgctcagtcacctgtttctccagttctttaatgtttaacttatacattcattagaattataatagagggtcagtggaaactgactgttctggttgctaatgggagcctgccctgccacaaacttggtggaagtatttctgtgtcttaatagttttttggagggtagaatgtaagagcgatgaactaggacatttggcagaagaaatctctaagccaagttttcagggtactgcatagcttctcttaactgcttatagtaaactgtgagaagagaaaagataggacttctaatcaaaagggaagcagattagctgggcatggtggcacacacctgtagtcccagctactctgcaggctgaggtaggagggttgcttcagcacaggaggtcgaggcggcagtgagctatgatcgtaccacagtctgggcaacagagtgagatcccatctcaaaaaaaaatgctaattattattattattatcattgagatggagtcttgctctgtcgcccaggcaggagtgcaatggtgcgatctcggctcactgcaacctctgcctcctcccgggttcaagtgattctcctgactcagcctcctgagcagctgggattacaggcgcccgccaccacacccggctaatttttgtatttttagtagagatggggtttcatcatattggccaggctggtctcgaactcctgacttcgtgttccacccacctcagcctcccaaagtgctggaactacaggcgtgaggcacctcacctggccaaagactattattatcattattttatccaaaatgtgtttattgagatggtttcccactcatcttgattcagggtgcttttagtgctgctttctcctgaaggaccatccttccataagccttgcttttcctcctgtaggctggcagaggaaagtgcagcagccaacacccaaaaccactgttggcacatggctaaagaccgtggtgattttatagcatcctgggcatttcacatccatgaagtaggaattggggctctgcaccaggtgtttcttcttgtgtttcctcttctcctcttctggagagggatgaaggagatcctttgcaagaagcatgttcttgtgggtaggtcgtcagtgctggaaagggccaaagaaaattatttttaaagggaagttgaacataaagatttggaaaattaacagcctggccttgtaaagaattttttaaataagttcaggagacaaaaccaactgtgtggccaactgaccgtttcataaggagattagtatgactagaatgccagatgctattcattaagacaatgggagaatgaccctgaagacatttcagagagcactgagaatgccacaaccatcacaggcccaaagtgccaggtccttgagggaataacaattttaaggaaggagcccaggattccagtgcaacccaagatgcctgtgggaacttggggctcactgactatgctgcctcatgtatctgctccctgaagtcaagcaaagcttccccatctgtggttcaggtgggcccaggtacagctcagatcactcctccagaaaacacaagtagtaaaacatggggcagcatgcatgtggtgctaactgcaggcatgctaaatccacagctgtgaaggcatggctttctccacctaatttccaaggaagccttgaagaatgcctcagggcccaatcagagaactgctgtaggggcagggctgccatagaaagttcccactagggcaatgtccagcagaactattgggttggggccaccacagagtgccctcactagggcaatactcagtggagccatagggacagggccacccctgagttcctagacccagacctgtagatccggtagtgcgtattccaacctgtaatagacatagacacctgactacaacctgtagaactgtggcatgggctgactccagcagtcatggcagcagggtcccctgggggcttgggaacctaagcactaccccagtgtctctgtaaggtgagaggtagaatcaaaaaagctgactctcacacctcaagattgaattttgttggccttgttgggttttgaagttatgtgggacatgttacccctatcttcttgcctatttcctccaccaaccttttgtttttgccatggggtcgagctatgtcacccaggctggtctcaaattcctgggctcaagagatcctcctgtctcagcctcctgaatagctaagactgcaggcaccatgcctggcttatttctgacttttataaagggaatgtttatcctgtgcctgtccaaccattgtattttggaaacacataatctgtttgacttcacaggttcacagctggagagccattgtctcgggattaattgtaccttgagcatcacctatatctgatttagatgatatttacatgcgactttcgacttacacttgaaagttgatgctggaatgagttaagacattttggagttactaagatggaatggacatattcttgtgggtgagaacgacatgaattctcatgtcatggcaagggtggagtgctatggtttgaataatggtgtcccttctaaaattagtgtggaaatttaatgcccaatgcaacagtattaagaggtttggcaattgcgtggtgactaagccatgagggctctgctctaatgcatgagattaacatctctataaaagtgtattaatttaaagggagtactttcttgcccttctgccccattcaccatgtgaggacatagtcatggctcctccacaggatgcagcaacaagacatcatcttggaaacagacagcagccccgtttagacctccttctgctgctttgatcttggacctctcatcctccagaaacacgacaaataagtttatgttctttataagttactcattatcaggtatttatttatttatttttttgagacagagtctcgctttgtcgcccaggctggagtacagtggtgtgatctcagctcactgcaacctccgcctcctgggttcaagtgattctcctgcctcagcctcctgagtagctgggattacaggcatgcactaccacacctggctaactttggtattttcagtagagacagggtttcaccatgtttgccagtctgatctcgaacccctgaccttaggtgatctggccccatctgcctcccaaagtgctgggattacagacgtgagccactgtgcgtggccaatatcaggtatttctaatagcagtacaacggactaagatactcaggaaaacagagccaggaggaaaaatattctatctcagggagttaaggaatcatgcccactcaagaaagagtataagggctgggcatagtggctcacgcctgtaatctcagcactttgggacgacaaggtgggcagatcacttgaggtcaggagtttgagaccagcctggccaacatggtgaaagaccacctctactaaaaatacaaaaattagccaggcgtggtggcacatgcctgtaatcccagctacttgacaggctaaggctggagaatcgcttaaacctggtgggaggcagaggctacagtgagccaagatcacgccactgcacttcagcctgggtgacatagtgagactccgtctcaaaaaaacaaaacaaaacaaaacaaaaaaaacaaagaaaaagagtgtaggggaaaaataacactcagtttattttttagtccaaacagacccctttaacaaaataaagattaacaagagaaaagcaaacaagtttattaatgtgtgtatttcatctacacatggaaaatacccagagaatgaatagttatcaaagaagtgctttgaattccagcatatatagcatcttcagcagagaaccgtacatttttagagaagtgaaaagataaagaaaaaggagattgtgtccgtaggggtgacaacttacggaaaggcaaataaattgcagataaattcagttactaagcatgttgctataaattcctttggtatcatttccaggctgaccagggtctaaagttttcttcagtggttagcctttgttctccctggtaaaagcgtgagtgtggagagtggggagggagagggtaccttttgtcttcgcaactctatatcttgcttttcggccagtaaaggaagaacaaaaaacttccctgcatctgcttcttcttaattgtcttcagctcaacaatgcttccagttttagggtggcatattctggcctcccacaagagccaggaagaacagatgtgcagcccaacggtgaggaaataattttcaccctacaaagagccaggaaaaagaccttccattccaggaagtacctttcaaaagatacctgggagtctaatccagcttcaaactatactctgaattcttaagaatcaaggccaggtgtggtggcttatgcctgtaatcccagcattttgggaggctgaggcaaggggatcgatcacttgagcccagggtttgagaccagtctgggcaacatagcgggatagtgagatcctctccacacacaaaaattaaaaataaaaataaataaaaaaaattaaaacctatccttacaagcttcagtggacacttgtccagagcaatcaatggctccagagtctaattcaccagtggatccccaatcaacttattaggaataaagacaaggtttcaaaggtgcaccctgaggtcctgggtgagaggtccaggggaccaaaaatgaataactgaaaaaattatatattcagtgatacttattaaagcatggtaaagaaaactttattcaggaccattgtgatagatacagggaccaatgcaatgggattttgcaatggaatagagagattgctctgaactccaaatagatcatgggaaaaagggacgttataaccaagaagcagggttggggtgtagtgggtgaaggaatggaaaattactaaaaggaaacatcagggataagggggattctggctaaactgacacctaacaagattcttgttaaagatgggccagagtggtcatgtatcacttggaagatggtggaagatgaacctgatcagatatcaagggtgatcagatatcaaggagaagagggttcttttttatatttatttatttatttatttttgagacagagtctcgctctgtcatccaggctggagtgtagtggcgtgatctcggctcactgtaacctccgcctcctgggttcaagtgattctcctgcctcagcctcctgagtagctgggattacaggcgtgcaccaccatacccggctaatttttgtatttttagtagagatagggtttcaccatgttggtcaggctggtctcaaactcctgacatcgtgatctgcccgcttcggccacccaaggtgctgggattatgggggtgagccaccttgcccggccgagaagagagttcttgataaacagacttccttgttaaaactagattttataatgaggtccacagatgggtggaggagaagcctgagtaaattttggttaagcagagaaactttgtcatccctcctgtatgcattatgctcccttttctccagtggagctctcttcaaccttgatgttattgtccaatcagtttgttttcccagtgttgatgttctgatttcatcctacaaaaatatagcataaacttgtatttgttgcattctacaacataagcctgacaatataacaaactgttcccaaagttataaattcctcgtctttttatttgtaatttgacttttaaaaatctatgtaattatagaagaatgttgctactataaaaattttaaggggtggcagggaataattccaaaattataaaactccttgtgacaaatttaggaatgatattcagctagttctatagttttttattccttgaataatcagcgatatacatctgattatatacacacattgtggtttttttttggccaggttgactttttttttttttttttttttgagatggagtctcactctgccacccaggctggagtgcaatggcacaatctcggctcactgtaacctctgcctcccggattcaagtgattctcctgcctcagcctcccattacaggcacccgccaccaagcctggctaacttttgtatttttagtagataatggggtttcactacgtgggccgggctagtcttgaactcctgacctcgtgatccacccacctcggcctcccaaagtgctgggattacaggcgtgagccaccgcgcccagccttggttgacttattcttttaaggagcaatgtgggttaatgtttcaaagtgaaaaaatttaaaaacttaggggaaagtggggggagagagagacaaagacagagacagaaagagagacagagtgagagatggagagagatcagataggtacataagcttagtgactcagcctgtagtcccagttacttaggaggctaaggcaggaggattgcttgagcccagaaactcaagttttcagtgagcagtgatctgcaacactgcactccagcccatgtgatagaaccagatcgtctctagaagaaaaaaaaagaagaaaaaaatacatatacatacatacattggtgtttgtttctacatatgcttcatagtatatgtgtacatggattataggtagatcatataatggtaacagtattaaattaggtgtcagcatttgttgaggaagtagtacgctcgtgtttgaaattttaattaagaattgtgtacggagttggttccttccggtgggtttgtgggtttgtggtctcactgacttcaagaatgaagccacaagccttctgaaccttcgtggtgagtgttacaactcttaaaggtggcacagacccaaggagtgagccgcagcaagatttattgtgaagatcgaaagaacaaaatttccacagcatagaagcagactgagcaggttgccactggtggctggggtggagtggccagcttttattccttatttgtccccacccatatcctgctgattggtccattttacagagtgctgactggtccattttacagggtgctgattggtccattttacaaacctctagctacagagcatcgattggtgcatttttacagagcactgattggtgcattttacaaacctgttgtaagacagaaaagttctccaaggccccacctgacctacgaagtccaggtggcttcatctctcagaatcagcttttaaaggccataaatttccaggtaagtaggaatagaagaaatgaacatttcctttgagatctatgatgtcatatttttttctccatcaacgatttagttccttctggatcaaatactttttaaatggatgtatgttttatagtagatgttatgttgtcttaattattttaaaactcctattcctggactctcctgaagaggagaatttagtaatttcgaagtattttttgaggctagggaagaaaaaccaagattactgcataaggtttcaggggatgttccatgcctgccacctggtgaaaatgagggagctttcctcctacctgccaccattacacctgcctgcaggtaataacgccatcatttcaacgcggcctggggtattctgggaaggtgacgtgtgggggcgcagtgaccgctagcaggggccaaacccgccctggtctgcgctgcagtgcgcagtgaggatgttggtgctgctcttcagggttttctttccgcagccacgggaagcccgtgttccatatttgtttttcatgttctctcgtttttatgttgtggatttagttttttaaaaaccataaatgttcctctacagtcttaacaatgtaccctgtaaaataagattttaaaagagccaacttccctattaatcttatacttttttcttttcgttctggctttaacaaatgtgacctaaagagagctcttgattttatgtagaacaatacaagaatagttttacattaatcttatggttagaaaaatcatttatgggcaaatttgttcccatgccttacttttaaaatattgtgttgtctttaattttcaaaatactttaaatatttttcagtaagtttgagggtagaatttattttaatgagactcctcttataaaaagtacgtatctgtatgtgcatatgtgtatactgaatttgctttgcttttgattctatcattctgtcacttttctatcaaaatatctctaatggacagaggccagagacaaggacttttacagcaaatttgccacagtaccacacattttatcttaaaagatggtatggattttgcataacatatatatgcaaacatatatatatataacataatatatatgtgtatatatatataacattatatatatgtgtatatatataacataatatatatgtgtatatatataacataatatatatgtgtatatataacataatatatatgtgtatatatataacataatatatatgtgtatatatataacataatatatatgtgtgtatatataacataatatatatatgtgtatatataacataatatatatgtgtgtatatataacataatatatatgtatatatataacataatatatatgtatatatataacataatatatatgtgtgtatatataacataatatatatgtgtgcatatatataacataatatatatgtgtgcatatatataacataatatatatgtgtgcatatatataacataatatatatgtgtgcatatatataacataatatatatgtgtgcatatatatataacataatatatatgtgtgcatatatatatataacaatatatatatgtgcgcatatatataatatatatatgcgcacatatatataacaatatatatatgtgcatatatatataacataatatatatatgtgcacatatatataacataatatatatatgcgcacatatatataacataatatatatgcgcgcatatatatataacataatatatatgtgcgcatatatatataacataatatatatgtgcgcatatatatataacataatatatatgtgcgcatatatatataacataatatatatgtgcgcatatatatataacatagccgtttggtttattttatgtgtgtgcgttaaaaagttattcaattgctgggcgtggtggctcacgcctgtaatcccagcactttgggaggccgaggcgggcggatcacgaggtcaggagattaagaccatcctggctaacacggtgaaaccccgtctctactaaaaatacacaaaaaattagccgggcgtcgtggcgggcacctgtagtcccagctactcgggaggctgaggcaggagaatggcgtgaacccgggaggcggagcttggagtgagccgagatagcgccactgcattccagcctgggcgacagagcgagactctgtctcaaaaaaaaaaaaaaaatattcaattatgcttgttaaagcaaggtaagggtcaccatggtgataggtacagggacctctgcagatagagattgggctaactccaaacagcgtaggcaagcggaaatttataaccaaagagcaggctgggaggtctgtgaatggaaaattaccaatgagaaacctcaaaggttagggggattctggctaaaccagcctaacaggatttttgctgaagacaggccagggtgatcaaacatcacttgggggatggtgcaggatgatgaacctggtaagatattaagggtgatcagatatcaaaggtaaggaagttcttgctaaagctggatttgacaaggaagtgcacagactggagaaggttcaggtgcctgactaatgtttgatcaagcaaagaatctttgtcagtgtacagaacgctatgtttttataaaatgttcctctgccccatttgtatctccccttttcatggaacacaaagcacgttttgcataacttctagatacatgtacttctattttgaatgacctgatatatcttttttctttacaattctcaacctcagcatatgtaagtggaactcagaaggcaacattccctgaacatactcttccaccagaatctcctctacagatttttgctgccccttttaccagtggctgaatctactttctcttatgtaagtagaaattttatatatctccagcctcttcctccttaccttccacttgcatgcacatcctgtctagtctgtgacctcctctgttataaatgcttgtaaacctttttttctgaatcagaaacgtgttgtgttgctcaagccgtgttcattttaattacgatttaactgcataatttaattatttccccattttttggatacagtgtttgcttttctccggttactttgttctagtatatccctctggcaagagcagtcatttccccacttgagtgtgcattagtatcacctgggggcttgttaaacacagcgtgcaagctccatcccagggtttctaattctcagggtttggtttgcggcagaagaatctgcatttcgaacaagtgccaggactggtctgaggaacacacgttgagagaggtgggattcgggttcactaacctgggttagagaaaattacagtaatgtgccaaatctgaggagggagcagagctgaagcccagtttcaatatgtgaatgagtgctttatacactcaaaccccctcaagggctggggagtaagggagaacgtgggcgggcagcgggcgtgtatagaggcataaactcaatcccagacctatggattcagaatcacatgttaacaattcttccagtgttttgtatgtttattatagtttgagaatgactggaccaaattgcctccaaaatcttaagtcccagcagtgaagcgaagctcagacatcatttgcatagctattgctttgtgtctgtgttttaggtcagctgctgttaaaggtttgtttcggagagttacccaggtgtagtacccttccaagtagataatgattgaaagagtatgtgctggaggtgtatgatattttccatccacttcagcccatttttctgatgggtcagtgacagtccatgatttgtctggtgtaatacaaattctggaagtggcatatatccaaggacagccataatattccacttggccaaggctcttctgacaggctcatgttcatgcaggatcagatctgacccagaatcaacagaactgaagctgcaaattcagctttgtgaaggcttcagatgtagccatggttaaagaagattgacattaagcaggtgagcagagtttgcttgaggttcacccagggaattcgtgaggatgcaggtgcgtttttttatggcctgaaaagcccagtttttgaggagttacagtccctctcagaaactgttcctgcagagtagccctggaaacatgtttgtctgcattcaagaaagatcttccttctgttcatataaaggaagccaaacttatttcccaggtaagggagtggaagcaactgtgatacggaatcctaaggcatgggggttagttgtaatccaggcaatatgtagggtcaggttctccaagtcctcctgtggttaaagggctccaccctaggaaagtgagccacccagggcttggtaaatgaccttatgatcagcccttggcctgttaacatgtcgtaactgaggcacaggactgggttcttggtttgaatttgctagtcagatggccattgcagaaagggaagagagcacagtccttcaggccaactcacttggcctattgaaactggcttttctgagcacagtctagtattgttgcgaattaaatacagcagaggatgtaagttaccagtattagtcactatcagttgagtacttattctgtatcagccactgttcctcttttccatttccacctgttatatgttagtgacgataaaaatgccatacagaccgggcacggtggctcacgcctgtaatcccagcactttgggaggccaaggcaagtggaccacctgaggtcaggagtttgagaccagcctggccaacatggtgaaacctccgtctctactaaaaaaaaaaaaaaaaaaaaaaaaaattagccgggcaccgtggcgggctcctgtaatcccagctactagggagactaaggcaggagaatcgcttgaacctgggaggcggaggttgcagtgagccaagatcgtgccattgcactctagcatgggcgacaaaagcaaaactccgtctcaaaaaagagaaaagaaaaagccatacaaaaaggctaagagccttgttcaacctcacacatgaaagtggcagggctggggtattaattcaggcattcacaatccagatcctctacacatttcactgacatgaaacccagaaatttcaggtctactaccttgaacccagaactatttttctcaaacttgttttcttgtgagctatatatagggaaaaattgcatacaatacagtactgctttacaaatatatcatctaatacccaagtcaagaaagacatgatcctgagctccctcaaaactcgtgggtatcccttctgaatcttgaccttttattctgactgagatgaatcctccatgctgctctttgtaattttattcctcgtgattacatacttaagctacaggaatacatcttacgtagttttgtttattcttaactgtatgtatttttttgtcttttccacttgatattgcattttctgtatttatccatgttgtgtgtaattccagcttcttaatttttattgatggtgttctctcattatatataatatatacagcatgtagcatgtatctttctcactgtgtatgtatacagagtgtatgcatatcactataggtatacagacatatcattatcctagtatttccatatctatgccacagtaggcagatccttttttttttttttttttttttttttgggaagacagagtctcgctctattgctcaagctggatggagtgcagtggcgcaatctcagctcactgcaacctccgccttctgcattgaagcgattctcctgcctcagacccccatgtaactgggactacaggcacctgccaccacacccagctaatttttgtatttttagcagagatggggttttaccatgttgtccaggctggtctcgaactcctgacctcgggtgatctgcctgcctcagcctcccaaagtgctgggattacaggtgtgagacaccatgcgcggctgcagatcccttctatacctgatgattgtttgggttgtgtctagtctgcagttatcaccaacactgcaatcgtaatcactgaagtatgtgtatcctgatttatataggtacacatctctcaaggatctgtaactggtagtggaattcatggatcttcaattcaaatgttgctcatggcagtgttaattataacaaccactttggtaaactacctgctattacctacaaaaccatgtgtaccttacacacgcaccatccattctactgtgtggagtaggccacggaaaagtacatgcacagttgatgaaaagacatgtatttaaatgtttatagcagcattatttgtaatagccaaaactggaaataaagcagagtgggtaagtaaatggtggtataggaattcaatggaattcaactataaataaaaaataatgaactgtatctacatgtaaaaaccttgatgaattttataaacacaaagttgagcaaaataatctaggcaaaaacatacttgtctgagcccatctctgtaacattcagaagtcagtatgacaagtcaggatggtggttacctgtgacaggagagaggctgttttgggaagggctcacttgggtcttctcagttgctggagttcactgtgataaatttaggatttgtttctttttagtgccgtgtatgtgtgtgtgtgtgtgtgtgtgtgtgtgtgtgtatataaacatttttttttttttttttttttttttgagatggagtctcactctgtcacccaggctggatgcctggctttttgtagtttagtagaaatgaggtttcagcatgtagctctggctgatctcaagctcctgaactcaggagtctttcctcctgtacaggagggaagacctttcctctactttctgagaattcaataattgagtccttgaaagaaattgacagtagtcagattaatgggagaaaaggtatacaaattagatatggacacagggacatcacatgaaagaaaagcgaatatcccagaacccagtgagattcagaagcttatgtaccctcttcttaggacagagggtataggtgattaggtaacttaggggagagtaaacagtttgggggaaagataaatggactgtcagaagaacaggtaacagccggtgacaaagtctgcgtgtgttatcaaggtctactctcctctcctgtgataggagccaatcttccctggttagtgagtttcctggggaggggattcatgacaattaagttccttttagataatctgtctttagataaggaagctcagagaaaacctctgcctgtatgagctgctccccacataacctcagttgaaagtaatcagcacaccaaagcatcatattttggggtggagatcctcccgcctcagtctctcaagtagctaggaccagaggcatgcaccatcatgcccggctactttttttttttttatttcttgcagagacagagtctcaccatgttgcctaggctggtctccaattcctgacctcaagtgatcctcctatctctgtctcccaaacagctgggattacaggcatgagttaccatgcccaggctaggggtggcatttcctgaactccttcagccctcttgggaaatgtgcaggcaggaagaaagaaaagaatacccttgtccacagccaggtcttgttgagcttatgcttggcagaatagaaccttacacccagccacgtgaaaactgggatgataaatgtctgcatgtctgacagaaggtttggcctctgattcagctgtggtgatttttccatctacttaactccaaattctattagctagtataaactctctattggactatgaacacagtaagtacacaatcatatgattattttatctattgacttaaatagaattgtgtatgaaggctgtactgaagttattcagggttgagtcaggaaaagctaaatttcaacctcttttaagaaaaatattgatgcctccaaatccatagtatatatgttgcttactagcttataaagggcccctggaagaaaggacatttccggtgttttatgtcaatcataggaaaataagctataagcttttttttaattctttgattctcaaaagtaggattgtggccaggcatggtggctcacacttgtacagcactttgggaggctgagatgggaagatcgctcaaggccaggagttcgagaccagcctgggtaacaaagcaagaccccatctctacaaaaagaaaaatgtatgattgcgtccccctaccactccccaacacttccctggctccacaccccagttcctctgctctcatttctgctgtgtcttactccatgaagctttcaaaactgcttttatagagtcctccttttcttttttataaatttattattgttgttgtttaattaaaagacaggatctcactctgttgtgcagttgtgcgatcactacagcctcaatctccaagcgatcctcccatctcagcctccccagtggctgggaccataggtgcataccaccatgcccagctaattttttttttttttgagacagagtctcgcactcttgcccaggctggagtgcagtggcgcgatctcggctcactgcaagctctgcctcccaggttcacgccattctctggcctcagcctcccgagtagcggtagcgcccgcaaccacacccggctaattttttgaatttttagtagaaatggagtttcactgtgttaggcaggatggtctcgatctcctgaccttgtgatccgcccgcctcggcctcccaaagtgctgggattacaggcctgagccaccgtgcccggcccactaatttttaaatctttttgtagagatgggatctaactatgttaaccaatctagtttcaaactcctggcatcaagcagtccttctgtccaaagtgctgagattgcaggcatgagccactgtgccaggcccctcattctttaaatagctactttagattctattgtaaggatattttaataattttccaacttttattatattgagtaggtgattcctttttaaattatatatgtaaatttttatttatatatttgaataatatgtttacatagttaaaaatcaaaatatacgaaaggcatacagtaagaagtcatctctttccacccgtaatgacaatatatccccttttgcctggcacagatgcacacataaattattgtcctgacatgattatgaataatcctgctttctctcagaagtgtgctagtttgaatgataaattatgcagacattctgcttgtatccctgcttcttcaccatgctgttatattccttccaattcagaggcaaatgtgatatcattgcctatgtgtcttccagaggaattttatttatattttgtaagtacatacatggattctggttttttttttgcactttttaacaaatagatgtatccatgctattttattttaaatttttactttgaaacaaccttaaacttacagaagttaaaagaatattagtagcaggtgtgctggctcacgggtataatcccagcaccgtgggaggctgagatgggtggattgcttgaggccaggagtttgagaccagcctgggtagcataatgagacctcctctctacagaaaaaaaaaatgtaaaagttagttgggtgtggtgttgcatgcctatcgtcccagccactcaggaggctgaggcaggaggatcgcttgggtacaggagttagaggctgcactagaccatgatcacaccactgcactccagcctgggtgacagagtgagaccctgttgcttaaaagaatattttaaaaaaaacctaccctttatccagattcacaaatactaatattttttcacattatttaatcaatttttctccttccctccctctttcatttctcccccttttctttttttttggagacatgatcttggtttgtcacccaggctggggtgcaatggcataatcatagctcaatggcatttcaaactcctgggttcaaagaaacctcctgcctgagcctccagaatagctgggactacagtcatatgctaccgtacctggctaatttttaaaattttttatagagacaggatcttgccatgttgcctaggctggtctcaaactcctaggctcaagtgatcctcccaccttgacatcccaaagtgttttgattacaggcatgagccaccaagcctggcctcctttccctcttttttttctccctctgtttcccactgcttataaagtttttaaattttttttttttttttttttttttttttttttttttttttttacttttgaccactttgagagaaggttgcagacatcatgtccctaatgcatttcctgagaaccgggatatacgtttggataatcatagtaaagatattaattcaggaaatataacatttatacaattattttatctaatctacaggccataacccagtttcttcatttgccccaataatgttttttatagctttttcatgttaaatatcttgtttggcactaagtatcttatcagtctgccataatgtttaatatctttcctctgaaatggttcctctgcctgcctttgcctttcatgtgtttgtgacttttgaagcatgcatgctaggtatgttacggaatgtcctcagcttgagtccatctgaagtgttcttaagactggattctactgatgctgttttggttggcacaacacggtgtttactattgtggtcgtcaaaatgatgttttatggctaaaccattctttcaacatttaatcatcaaggaaatataaatcaaaaccacaatgagatatcatctcatcccagttagaatttgctgttatcacaaagacataaaaataaatgctgatgaggatgcagatgacagggaactctcctatacttttggtgggaatgtgaattagtatagtcattatggaaaacagtatgcagagtcctcaaaaaactacaaatggaactaccctgtgaaccagcaattccactactgagtatttatccaaagttaaatcagtgtattgaagagagagctgcactcttgtgttcattgcagcattattcacgatagccaagatatggaatccaccgaagtgttcatcaacagacaaatggattaaaaaaatgtggtgcatatacacaatggaatactatttagccataaaaaaagaatgagatctggacattcacagcagcatggatggaactggaggacattatgttaaatgaaataagccaggcacagaaatataaatagcttaaaaagttgacctcatagaagtagagagtagaattgtgattaataatcacaattataaataatggtcagtatcaaaaaaaattgtcattctacagtgctgcagaacattagaacttgttttctctatctagctgtaattttccctcttttattttttttgaaacagggtcttgccctgtcacccaggcatggcataagcacggctcactgcagctcaaacaatcctcctgcctcagcttctggagtagctacaggcacatgccatcatgcctagctatttttttttaattttctataaaggtggggtcttgccatgttgcccaggctagtctcaaactcctggcctaaaacaatcttcctgccgtggtctcccaaagtgctaggattacaggtgtgagccatcactcccagctccaatttttagatactgaccccatttagatacatgacctcagaacacattccaagctcatgttgtatctctcttgtccccactattaaatcagctgtgttttttccaaggaatcctgatttctattgtggagaagcgtacttagaaaccaaggtcttggtgctactggtatgttattgcttttaggcccttccagatatacgggatataaagatatagctatatgtatgtgactatatgtattgtgtatatatgtatgtagctatatgtgtgtatgtgtatatatatcttcatgtatttatagtgatattttccatcccaatctacaccgcagggtttttccttgccttcctatttgtagagcttccttccacattaagaaccctctctcccagtgagtgtcaccccatttctgtttcatctctttccctactctcccccttgcctcctagggtcccctttcctctcatcagttgccagacaagaggagcatcatcatacacacatcatagatttaatattaaacttttaaaattttcagataaatgtaagcaggcttctgcagtgaaaggggccaggtctaggaagatggggaatacttgcaggcacctgggaagctcagggaagctgcaggtaccctgtcagttgggtgtcccctcatgagggtggcagactgtctccttgagttctgggtggcagaaatggcccagggccctgggctgagacccagccaactctctatggggctgccacacgacttcctaaaaaggcataaacacattttcttccaagtggagtccagcatattttattttcctgttgaatggtagacagcatgagagcagggtccatgtgatgatttttctgtcagtatcagtttctgcaagagcaaaaattacatatttttatttttcaaataaaatcaattgagacagtaacaaatttgctcaaagaatcaacctgaacacatgtacatctattatgtatcaataaaaaaatggccaggcacggtggctcacacctataatcccagcactttgggaggccaaggcgggtggatcacgaggtcaggagatcaagaccctcctggctaacgcggtgaaaccctgtctccaccaaaaatacaaaaaattctctgggcgtggtggcaggtgcctgtagtgacagggcgagcttgcagtgagccgagattgtgccactgcactccagcctgggtgacagagcgagactccatctcaaaaataaataaataaaaataataaatttttttctagataaaaaatataaaaattacaccacagtccaaaaaaaaaaaaaaaaaaactgttcaagactgatctttcatagtgattgggtctatgagtaaatgttaaatagatgatttattaggtttctttttatttcaatgatgagatggagaaatatattattttacatgagggcaaaaaatattttatgcatagatattttttattttgcctatgtccttaaattctcagaatatagattattgccttcagaaatctgtctaggttcacctataccttattagaactcagctttgctggctgtggtacacctgtaatcccagcactttgggagactgagaagggaggatcacctgagctcaggaatttgagaccggcctgggaaacatagggaaaccctgtctctacaaaaatacaaaaaaaaaaaaaaaaaaagtctgggtgcagtggctcacgcctgtaatcccagtaaatcccagtactttgggaggccgggccgggtggatcccgaggtcaggagttcaagaccagactggccaacatggtgaaaccccgtctctactaaaaataaaaaattagcagggcatggtggtgagcatctgtaagcccagctactcgggaggctgaggcaggagaattgcttgaacctgggaggtggaggttgcagcgagccaagattgtgccactgtactccagcttgggcgacaaagcaagagtctgtctcagaaaaaaaaaaaaaaaattagccaggcatggtggtgcacacctgtagtcccagctactcaagaggctgaggtggggagccctagtgggtgcagtgagccaagatcacaccactgcactccagcctgggcgacagagtgagactctgtctcaaaaaacaaaaaagtgagctttaataaattctataaaacttttttctagttgagagtacgttactacaagctaacttttaaaaaagtcatattatttgattactaggaactttgcaattagttttgcttcttctggtttttatttttgcctggcacaacatttccttccttggcccctgtctgtattaataatgctgccaggatatactgaatgattttattccagttttttctaccttaattatgttaaagaaaaacaaaagctgggtattagttatagtggtaaggacacattttaatcactaataactattgtaatcgtgaagaaagtccagcatgaactgaactcaactttggtgtgtacagaggtgactgggtattttaaaggaagaatgaagctgggtgtctactggacactggaatgaagctactgcagaggctgaggcagaaggattgcttgagccaggggtttgagaccagcctgggcaatacatcaagacctaggctgggcggggtgccacacgcttgtaatcctacactttgggaggtggaggggcggggggtgaatggcttgagttctggagttcgagaccagcctgggcaacatcgtgaaacactgtctctacaaaaatacaaaaattagcagggaatggtggcacatggctgtagtcccagctactcagggggctgaggtgggagaatcccttgaacttgaggagacagaggttgcagtgagccaagatctcaccactttactgtagcctgggtgacagagtgagaacctgtctcaaaaaaaaaaaaaaaaaaaaaaaaaaaaaagactttgcttcacccacaaagggaaaatcagggaataggagggagttgagttgtggggtagggtatgctcagttgagtcagagaagtaaaaatttaccaaaagtggtggttccatgtaaaacctacctgggattgctaactggtgctgtttgaagttagactatgaccctcgcacagaggccaggagacaggggccctatcttctgctgttggctggaacaaagagtaaattcatttgggaggcttcacttttttcaggcaggctatttaagggggatacagtcaaccaggggatatggccttgagatgctagaatctatgttagtattttgttcaaatatttataggccagggttaagactgactttgtttctttgttttttgagatggagttttgctcttgttgcccaggctgaagtgcaatggtgcgatcttggctcactgcaccctccgcctcctgggttcaagtgattctcctgcctcagcctcccgaggagctggcattacaggtgctcgccaccacgactggccaatttttgtactttagtagaaacggggtttcaccatgatgtccaggctggtcttgaactcctgacctcaggtgatccgcctgcctcagcctcctgaagtgctgggattccaggcatgagccactgtgcccagcgtaagacctagttgagaaggcagctcagaggaacctggctagagtttggtcaagaagactatctctgtcaatcataatgtgtattccaccaataagagtcattgagtctgtaaatgtttttttttttttcctttgagacagagtttcactcttgttgcccaggctggagtgcaatgacacaatctcggctcactgcaaccttggcctctcaggttcaagtggttctcttgcctcagcctccaaagtagctgggattacaggcatgtgccgccacacccagctaattttgtatttttagtagagatggggtttcacgatgttggttaggctggtctggaactcctgacctcaggtgacccacctgccgcagcctcccaaagtgctgggattacaggcgtgagcccccatgcctggccaagtctgtaatcttgattgaaagtttacttttgactgggcatggagctcatgcatgtaatcccagcgctttgggaggctggggcaggaggattacttgagtccaggagtttgagaccagcctgggcaacacagggagacctcttctctacaaaaaataaaattagccgggcttggaggtgcgtgctgatagtcctagctacttgacagactgaagtgtgaggatcacttgagcctgggaagttgaggctgcagttagccaagatccatgccactgtgctctagcctgggcgacagaatgagaccctgtctcaaaaaaacaaaaagaaaagaaaagttgactttttgccagctgttaggaaaacatctgtggctctggagggcggctggtttaaagaaaaaaaaaaacaatcagacatacctgatatctacaagaggataatgagcttagtatggtgtgtgtaggagcctagaggagagaggctgggaggggattcttggggaaaacggtggttgagttggggttcagaggcaagcccctaggtcttaggctgggcacggtggctcatgcctgtaatcccagcacttcaggatgctgaggtgggcggatcacctgaggtcaggagttcgagaccaggctggacatcatgatgaaaccctgtttctactaaaaatagaggagaatttgatggccattcacagtcaagggaactgaacacatcaaagggattgccagaagggcagaagtcctgacttacaggtataaggagaaacagaagaggagacaaggtgtggggtctaccaggtgggcaggcccattgagtagagggtacatggcattcattgaaggattttcatcaaggcagtcttctggtaagatacggggaagtccacaggctaattggaaaacagaaagaatgagatcatggagacaaatttagggactgactccgtctgtattaatttataccaggggtcagccaagtgcaacctgtggctaaatttggactgctatgcatacatgtatggcttgtgagctaacaaagttttttatggttttaaatacttgagccaggtgcggtggctcacacctgtaatcccatcactttgggaggccgaggcgggcgaatcacctgagtttgggagttcgagaccagcctggccaacatggtgaaaccccgtctctattaaaaatacaaaaattagctgggtgtggtggtgcatgcctgtagtcccagctactcaggaggctgaggcaggagaatcatttgaacctgggaggcggaggttgcagtgagccgagatcatgccattgcactctagcctgggcaacagagtgagactctgtctcaaaaaataaaataaataaatacttgaaaaaagcaaaagaatagcatttaataaaaattatataagattcaaatttcacggtccataagtgaagttttattggaatacactcatgcccacttgtttacatattgtctgtgactgctttcacacttcacactacaaaggttgagtagttgtgagtgatcgtcctcaaagcctaaaatatttactctctggctctcctctctacagaaaaaggctgctgatctctgcctgattcattgattgattattatttgaaatggggtttcactctgtcatccaggctataaagcagtggcgtcatctcagctcactgcaacctccacccgccgggctcaagcaatcctatctcagccttctgagtagctggaagcagaggcgtgtgcctccgctcccagctaatcttttgtatttttggtagagacggggtttcaccatatttcccaggctggtcttaaactcctgagctcaagtgatctgcctgcctcagcctcccaaagtgctgggattataggcatgagccaccgtgcttggctgacctctgatttatatggccagatgggggcaggtactcagttgcttgtgcatattttgttgggagatcacaagttagcaagataaaagtgctttcatcacagaggtttcagtctagtagaagttaaatttttgtgccgggttcagtggctcacacctgtaatcacagcactttgggaggccgttgcaggccggttgcctgacctcaggagttcgagaccagcctgggcaacacagtcaaaccccatctctactaaaatacaaaaatctagctgggcatggcagcatgcccgtatagtcccagctactcgtgaggctgaggcaggagaattgcctgaacccgggaggttgaggttgcagtgagccgagatcatgccgctacactccagcatgggcaacagagcgagactttgtctccaaaaaaaaaaaagttcgatttttgtttaataggtgagatcatatgaaacataaatataagtactgatgtagggattgtgctttgtgaatgggtctctgcctgcaaaacattcctgagaagctttctgaagggttcaagctgagaacagaaggatggagaaagagattctgtaagttaggaggcaagaatctgagctaagatttggatgtgacaggaccatgagtggatagggaatgttttgtttcttgagtgggaagtgggaagcattttgggaacaaggtaaggaagagagaggaggctgcagtgtttttaaggagtcctgcccacgccaagaagtctggactggaggtcatttgctttaaacatgtcatctcaagcatgtgtgatctatttggagcaaatataatcaagggaagttttaaacaggagagttttcagagcagtggagtctgaaaagttgccctaaaataaggttgagcataagaaagtccttcttgcttctggaaaaagtggactatgggtgctcactctttggggccagacagagaagaattaaaaatcatgggctgggtgcggtggctcacccctgtaatcccagtactttgggaggccaaggtgggtggatcacgaggtcagttcaagaccagcctggccaacatagtgaaaaccacgtctctactaaaaatacaaaaattagctgggcatggtagcgcatgcctgaagtcccagctacttgagaggctgaggcaggagaatcacttgaacccaggaggcggaggttgtggtaagccgagatcatgccactgcactcccgcctgggcaacagagcaagactctgtctcaaaaaaaaaaaaaaattgtgttatttctcccttttgcacctaatctcccactgaagatgactgcaactttcctgtgaattctgaacctgctgccaaaagatacttctttatattccatgattttgtgtaaaactttgtggtgagaattagagaaagcttaatttgctgcttggcatccagaattaggaggccaagttaggctcccatgttaattttcagaaagcccatgttcctgatatctggtagggatggcggtgctgaactgtgaaggtgttggaaaccagaattttggcagaaacggagtcagatttgaacatggtacaaatttggaccaagggcctagtgatagttaggtcaggaaattggggactgtattggtccattcctgcactgctataaagaactacccgagcctgggtaatttataaagaaaagaggtttaattggctaatggttctgaaggctctaaaggaatcatggctggggagtccctaagaaacttgcatcatggcagaaggcagaggggagtcaggcacatctttacatggcagaagcaggagagagagagcaaggggaggaggttccacacactttcagacaaccagatcttgtgatatatcacaagaagagcaccaaaggggaaatccacccctgtgatctagtcacatcccaccaggccccacgtccaacattggggattacaatttgacatgaaatttggatgggggcacagactcaaaccacatcagggaccaaagaaatattttacttattttcagttatcaatggaatttactgctgatgagaaataaatgtatcttgccagtaacttataaagtaataaaaccggccaggtgcgatggctcacgtgtgtaatcccagcactttgggaggctgaggtaggtggatcatgaggtcaggagatcgagacaatcctggccaacgtggtgaaactctctctactaaacatacaaaaattagctgggcatggtggtgcgtgcctctaattccagctacttgggaggctgaggcaggagaatcacttgaaccagggagccggagattgcagcaagacgagatcatgccacaccactccagcctggcgacagagcgagactccgtctaaaacaaacaaacaaacaaaaaaatcaaaacaatttccctagaaatgtataattattgacactttttagtatttaaaaaattttcagtgataccctgtatttacaaaacaaaacaaaacaaaaaaaacgaaaaagcaagacaaaaacaaaacaggcatggtgatgtgcacctgtagtcccagctactcaggaggctgaggtgggaggactgcttgagcctaagagttcaagccatgatctcaccactgtactctagcctggatgacagagcaagactgtctctaaaaatttttttaattaaaaaaaaatttcatcttgacttgcttttcatgtgaatctagtgtatttgctactttttgataatgctttgcactttttaaattgtaaaaacattacataaaattttcatcttacccgtttcaggggcactaagtgcattcacattgatgtgcaaccatcaccactgtctagctctagaactttttgtcttacaaaactgaaaattgcccattaaataataactccgtttcctcctccccacaccccatcccctggcaaccaccattctacttcctgtctccatgacatttgattagtctggatatctcgtataaatggaatcatacagtatttgtccttttgtgacaggcttatttcattctgtgtagtgtttccaaaattcatccatgttgtagcatgcatcagaatgtacttcctttttgaggttgaatgatactccattgcatgtatgcattacattttatttattaatccatcagtggatgtttaggttgcttctgccttttgggtaatgcaaataatgctgctatgaacatgggtgtgcagatacctctttgagtttctgcttctaattcgttttttttttttttgagctggagccttgctctttcgcccaggctggagtccagtgccacgccatgatctcggctcactgcaacctccacctcccaggttcaagcgattttcgcttgattctcctgcctcagcctctcaagtagctggaattacaggctcaaaccaacacaccaggcgaactttttatatttttggtagattgggggtttcaccatgttggccaggcaggtctcaaactcttgaactcaagtgatccacccaccttggcctcccaaagtgctggtattacaggtgtgagccaccatgcctggccttctgcttctaattcttttagatataaccttgaagtgacagtgctaaatctagcactgtctggtcttgaactcctgacctcaagtgatctgcctgccttggcctccgaaagtgctgggattacatgtgtgagccaccatgcctggccaattgaagatttttattacttacattttcccagaaagggggcatgccacactacaccacatcacgtgaggagcactaggttttggtcaggaggcagaagataggagtgaagggaaaaatctagggcaaagcctttactggggactccaagggaaacacagggcaggtttgagcataggatgggttagtttaaataattctggttggctttgggctacagggatggtctctagtgacttggtttgtgccctgggtatatagaatatgggaaatagtggccagcgagagttagctaaggagttggctgggctacagactgggattggttgtttggcatatgaaagacatgcttatagacaaattgttattatattcgagaattagctagctttgggaaggacattctctcccatgatttgcaaggccctcaaaagccagagcaacaaaaatacagaaaataagatatagttaatataattggcttggtgatgaacggatcccaaatagtcaaacacagaagctaagaaaacccagaacacatggtaattcttctgttgcattttttttaggaaaccacatagtgttttgcatagtggctgtaaaaattttccattcctaccaacattatacaaggttttcaattcctctggtcttcaccatgacttacgttctgtttcttctgtgttttatagtagccatccaaatgggtgtgaagtggtatctcactgtgattttgattttgattttgatttccctgatgattagtgatgctgagcatctttggatgtgcttcttggccatttgtatgtctttggagaattcttattaagacgtttgcccatttttatgtatgtatatatgtatgtatttatttattgagatggagtctctttctgttgcccaggctggtgtgcaatggcccaatctcggctcactgcaacctccgtctcctgggatcaagcaattctcctgcctcaacctcatgagtagctgagattacagatgtgcaccaccatgcctggtcaatttttgtatctttagtagagacggggtttcaccgtgttaaccacgctggtctcgaactcctgacttcgaatgatccacccacctcggcctcccaaagtactgggattacaggcgtgagccgctgcacctggcttggcccattttaaaatcaggttttttttttttttaaagttgattatagaattcttctttttttttttttctttttgatacagagtctcactctatcgctcaggctggagtacaatggtgtgatcttggctcactgcaacctccaccttccgggttcaagcaattctcttgcttcagcctcacaagtaactgggattacagacgtgtaccaccatgcccagctaatttttgtatttttattagagatgtgatttcaccatgttggccaggctggtctcaaaccattggcctcctgtgattcactcaccttggcctccccaaatgctaggcttacaggcatgagccactgtgcctggctgaggagtcttatatctattcggactattaacatcttatcaaatatatgatttgcaaatattttctcccattctgtgtgttgccttttcactctgttgattgtgtcctttgatgcacagaaggttttgattttgatatactccagtttatctatttttgtgtttccttagcttttggtgttgtagtcaagaaatcattgccaaatgcaatgttatgaagcgttttttcctgacagttttatagctttaggtcttatatttaggtctctgatccatttcaagttcatttttgtatatgatgtaaggaaagggtccaacttcattcttttgcatgtggatatccagttttcccagtaccacgtgttgaaaaggctgtcctttccccattgaaggtcttggcacaattgttgaaaatcatttgaccatatggaagagtttatttctgggatctctattctattccagttgtctatgttttgcattctttttaaaaaatatttttagtctttacatttcagaatcagtatttcaaatgtgacttgtaggactacgtgcagtgaggaagattgttaatcatcctattctgaccaggagttctgacaactttggtgctgtaggcggtgtctaaggcaggtgtcagcaaattttcctctaaaggagctgtgtgtgtgtgtgtgtgtttgtgtgtgtgagtgaaaaagaggtgagatttattttaaatttattttaagaaattggcttacatgatggtacagtcttgcaagtcaaaaatctgcagactaggctggcagtctggagacccagggaagagttgcggtgttaagtgttaagtctgaaactagtctgaaggcagaattccctctcttcctcaagagatcttaatctgttttcttttgtttttgtttttgttttgagacagagtctcacagcccaggctggagtgcagtggcacaatcttggctcgctgcaaccttcgcctcccaggttcaagcgactctcctacctcagcctcctgagtagctgagaccacaggtgcacactaccatgcctggctaatttttgtatttttagtagatacggggttttaacatgttggctaggctggtcttgaactcctgagctcaggtgatccatctgccttggcctcccaaagtgctgggattataggcgtgagccactgcacccggcctaacaatgacattttatatacacacaggcacatacacaaacctatttataaaagatgaaatactcaagacaattacagttctgatttctgtaactggtcaggtggtcacagctcatatttgtaattacctttgtctactactcattatgtatttccattgtcctcagcaagcaccacggctggttgtgattatttatctggtggggtgacccaaacctttgatttctgaagggtctaggccagtcatagtcctgcctgaatttcgttgttagagttttccatgggctttggtcacagagcttggttaatcctgaaataccctaagggatcccttgtacttcatatgtattcttccttacttcctttgtgaagcagaagtccagtttctccttggtaatcaggatgagtggcactagccagcacaacaattcccttctttgttgattcaaaggcatgaggagcctaaaagggttagatggcagttttttgtttttatttatttatttatttatttattttttagacagagtctcactctgtcacccaggctgcagtgcagtggcgcaatctcagctcactgcaacctctgctgcccggggttcaaacaattcttctgcctcagcctccccagtagttgggattacaggtgcctgccactgtgcccagctaatttttgtattttcagtagagatggggtttcaccatcttggccaggctggtcttgaactcctgacctcgtgatccacccaccttggcctcccaaagtgctgggattacaggcatgagccaccgtgcccggcctagatggcagtcctaacttctacttcagtccaattactgctatatctactgatggaaatattcctgctgttggaactaagactgccagaccagaagagtatgagatcatggggacaggaaacacaaattttgctagttggtcaactagggatatttgtggagggctgccactcccatttctatcttttggtttctagacttgtcaaccccgactatgggagaaacagcaatatattggacactgactcagacagtatacagcctcctgaaaagccttaccccagtcctgtaaagtattaccaaatagctggtactgtaactgaatcttcaaaaggcctttccaccattctatgaaatcatctgccttaggatggcggggaacatggtaagaccaccaaattccatgagcatgggcccattgctgcatttcctttgctatgaagtgagttccttggtcagaagcgatgttgtttggaatactatgatagtggttaaggcattttgtgattttacagagggaacttttgacagaagcattgcatgcagtgtaagcaaatctgtatccagagtaagcatctgttctagtcaggacaaaacactggcccttccatgatggaggggattcagtgtaatcaacctgccaccaggtagctacctgatcactgtggggaatggtaccatagtggagactcagtgttggtctctgctgagggtagattgggcactcagtggtggccatagttaggttggtcttggtgaatgggagttcatgtggccaaacccatgcgtaaccttcatccctgccatcatggccacttcgtttataatcccattgggcaatgacagaaaaatgagcctgactgtacatatgaaacaggtcaccctatccactttgtcataaaaatcctcctctgctgagtgggcattcacatggccacaaatgtctttacctttttttttttttggggctgatttagaggggtctatctataagtccatctatctcttcccaaggcttccttgtcaccaattttccaatcatgctccttccacattactgaccagccaaaccattgaccacggcctataaattggtatataattgtatatctggccatatgtccttccaaacaaaataaacaaccaggaacactgtcccaagctttacccactgggaggatttgtcttcaccactcttcttcagggaggtcttcagaaaggctctgtagtgcagcagttgtccacttctgggtggtatgtgcatgttttgtagaaccatctgtaaaccaggcctgagtcttctctttttccatcatctgattgaagggaaccccccatgagccataggtgcagctgggatagagaaagcagtgtagcaggagtgggggccgtggacatttgagccacttcttcatgtgacttagttgtgtcttcagatcatgttctggctgtgtaggcttaactttacagctgggctggtaagataacacccagttcatgaagggcagcttaggttacatggtaacttggtgtcctatggttaagcctttagtctccactaatgcccagtagcaggccaacagctgtttctcaaaaggagggtagttaactacagaggatagcagggctttgctccaatatcctaaaggcctatgctgcaacttaccaatgggggcctgcaaaaagctccaaaagacattactgtctgctactgacacttcaagcattattggttcttttttttttaatttttttatttttcgagacagggtctcgccctgtttcccaggctggagtgcagtggcatgatcctggctcactgcagccgctgtctcccaggttcaagcaattctcatgcctcagcctcctgagtagctgggattacaggggtgcactaccatactcagctaatttttgtatttttagtagagacggggtttcaccacgttgactaggctggtcttgaactcctgacctcaagtgatctatctgcctcagcctcccagagtgctgggattacaggcatgagccaccacacctggctgcatcattggttcttgcagaatcatgtgaccatagaggcagagaaatttatgttgcagcctggacctgttgcagaagcttctgttgttttgggatccactcaaaactacagcttttcaggtcattaatgtagcacatgagctgggtgtttgaatccctgagctaattttccccctactttgttcagtgaaattaggtgcaactagacagtctcattatacttgttagtttgacaaaatgtttgaaggtatcatacatgttaacccagaaccttgccttttatacttatttaatttaaagtatctgggctgggcgttgtgggatcccagcactttgggaggccaaggtgggtggatcacctgaggtcaggagttcgagagtggcctggccaacatggtgaaatcccatctgtactaaaaatacaaaaagcaattagctagtgttcttttgattactcgtaattaatgcctttaaatctagttagtttagagtaccaatttcagaaaccaaccccagaactaattcagaaaatttattcttaagatctggttcaggtagagctactcttgctaccgaaatctgtgtgtgttagggttctccagaaaaacaaaatgaactaacaggatgtgtatagtctcagtctctgtttctctttctcagaattggtcatgtggttatggaggctggctagtccaaaatcttcagagcaggctatggattcagggaagagttgatgttgtagctctagaccaagggcagtctggagagaatttcatcttctttttctttggtttgttttctcttatgggtttcaattgaatggatgaggtccacccatattaaagaaggtatctgctttactcaaagtctactgatttaaatgttaatcccatctcaaaacatgccatcgtggcaccatccaggttaatgtttgaccaaatatctgggtaccatggcctagccccattgacacataagatcactatcacagtcagataacaaatgtttagctttgtgggtcatatggtttatgttacaactactcaactgtgtggttgtagtcatagacaatacataaacaaatggctgtggctgtgttccaagaacactttatttatagatactaaaatttgaacttcatataatgttcacatcataaaataaacttttccttggatcctttcctcctttcctcctctccccctttcccccacccaccatgtaaaaaaaaaaaaaaaaaaaaaaagtaccacagccagttgcaatggtaggtacctgtgcatatcactatgcctgtaatcccacctacttgagaggctgaggcaggaggatcacttgagcccaggactgcaaggttatattgtgctataattaaacctgtgatcgtgccactgcactccagcctgtgcaatatagaaaggccccatctctttaaaaaaaaaatatacaggcagcaggcaggatttggcatagtttgctgaccgtcaagggctctcttttctaaaacataggcatggtaagaatatgtgcaaaggccatgggtgaagagctttttattttgttgcttgtgttccagttggtgcattctcaagagtaggtactttcttttcttgttcattctcttcctgagcctatcttgggattttctaagaaggttgctattagtctagtctttttccagctgctccctagattgaggcgggagaggagaaattcagcaaagatttctctctcctcatcaaggctgtcccttgcctgctttcctgtgggacagatggtgcatgtaggcaaaaggctggaacatgttggctgctcctgttacttggtgctttgagcagaaaggcctgttgggttagttcctgggctccagtgctcaatgtgtgtgtgtcctgttttgtgtttttacccatctttctgccttggctttaggtttatatgtttgcatttataaaaacttcttatggaatagaattataatgaagaggagcagcaaagagttgtggttgagagctggcagtactggaatcagaatgcttggcttgaatctgggctcaaatgcttgagagctgtgtgactttgagtacggttcttttcttttctgggcatcagtttcctaatctgtaaaagggatggaaatagggccaggcatggttccttatgcctgtaatcccaggtactcagaaggctgaggtgggaggatagcttcagcctaggaggtcgaggctgcagtgacccatgattgtgccactgcactctagcctgggtaacagagtgagaccctgtctctaaaaaaaataaaaagaaaagatggaaatgaaatagtaactcacacggtttttttgttttgttttgtttttttgagacgaagtcttggaatctcactctatcacccagactagagtgcagtgatgtaatcatggctcgttgtagccttgacttcctgtgctcaagcaattttcctgtcccaacttcctgagtggctggagctacaggcacgtgctaccatgcccagctaatttttgtatttttagtagagatggggtctccctatgttatgcaggctagtctctaactccaaggctcaggtgatccctctgctcagcctcccaaaatattgggattataggcatgagcctgcagtggccatcacatggtttttattttttgttttttatttatttttaattttttatggatctagtcctgaatccagaacatgatttttaaatgaactaatgttaaagtacttagaaaagtatctgctgcatagtaaggatatgtggttgtacaataaataaaaataaagagagctgctcacatagagtgcagatttcaaaccatctagtctttctcgttttattacattgaatttctgcttctgaatttttaattttgttataagaaggatgttagtccctctaaagtatcatttccaatattttgtttatgttccataaattttaaggttattttacttcaaattattttataatgtatatgccttttatatttgttttagttatatcaaaatgcagctttcaaaaatattttagtgtgtataattatttcagattactattagtagaagtgcttttttaaaagacaaatattatatttaagagaccctgccacaaaagtactcctcatggaagggaagatggactggggatgatgtggcagttatacagggaaaacttcacattattttgtatttaaaacataacctgaggctgggtgcggtggctcacgcctgtaatcccagcactttgggaggcagaggcaagtggatcacgaggtcaggagttcaagaccagcctgcccactatggtgaatccccgtctctactaaaaatacaaaaattagctgggcatggtgacatgcacctgtagtcccagctgcttgggaggctgaggtagagaattgcctgaacccgggaggcggaggttgcagtgagctgagatcgtgctattgcactccagcctgggcaacagagtgagactctgtctcaaaaagaaaaaaaccaaaacagaaaaacataacctaattttatattttgttttgtcatacagttgtatttgttttaaaatatctttccaccccttccaaaagtattttatccaagtagcagcacatcttatttccatgtctgggttggactttatttatacttgtctgaaactaaggaaaaagaaagtaatttatatcagttaaaagacctctacttctcaataagttagggggcggaggaatgggtctcaatctaccactcacttttctgctagaatttttttttatattgatacctcccattctttttttattttattttatttattattattatactttaagttttagggtacatgtgcacaatgtgcagattagttacataggtatacatgtgccatgctgtagaatttcttaatgttgcatcagtgtttcacaatgtaatcgaaaactcaaaatagcaatcttccttttttattttattttattttatttatgttttgagatggagtctcactctgtcgctcaggctggacagtgcagtggcatgatcttggctcactgcaacctccagctcccaggttcgagtgattctcctgcctcagcctcctgagtagctgggactacagatgcatgccaccatgcccagttaatttttgtatttttagtatagacggggtttcatcatgttggccaggatggtctgaatctcctgacctcgtgatctgcccgcctcggcttcccaaagtgctgggattacaggtgtgagccaccgcacctggcctcagaacagtttatatttaaaaattatttcaaagataggagagagttcccatgtgtctcatatgtttcccctattaacatgttacgcttgtttcattgatgtaccaatattggtacatttttattaactgaaatttatactttatccagatgtctttggtttttctaaaataccctttttctgttccaggatctcacccaggaaatcacagtacagctagtactcatgtgtctcaaggttgttcttggttgtgacattttctcactttgttttgatgaccttgacagttttggggattactggtcgaatgtttgtagaatgtccctcaattagggtttttaaaaactgatttataattcacatagtataaaatttacccttttaaaatatataattcagtgcttttgagtatattcacaacgtttcccaaccatcctatggttggaaaattagataacctactaattccacaaaatccagaatattttgatcatcccagaaagaaacctcataaccaacagcaattactctcctttcactcctctcccatcccctgaaaatcactaatctgctttctgtctatatggatttgcctattctttttttttttttttttttttttttttttgagatagagtctcactctctcacctaggctggagtgcagtggcgcaatctcggctcattgcaacctccgtctcctgggttcaagtgatcctcctgcctcagcctcctgagtagctgggattgcaggcacgtgccaccacacccggctattttttgtatttttagtagagacaaggttttgccatgtcggccaggctggtcttgaactcctgaccttaggtgatccacctgcctcggcctcccaaagtgctgggattacaggcgtgagccaccacacttggcctggatttgccaatccttaacagaacatataaaaagaaccataaaaacgcctgacatgttgcctcatgtctgcaatcccagtactttgggaggccaaagtgggatgattttttgagtgtaggagttggagacctctctgggcaacatagttagaccaggtctctacaaaaaaataaaaaaattacctgggcatggtggtgcatgcctgtagtcccagctactaaggaagctgaggtgggaggattacttgagcccaggagatggaggctgcagtaagccatgattgtgccaatgcactccagcctgggtgacagagtgacactctatctcaaaacaaacaaacaaaaaaccccataatatgtggcctttttctgtctagctgctttcactcagcataatgttgtcagggttcttccatgttgtttcatgaatcaacactccattcctttttatagcagaatgatattccattgtaccatgccatagttgtttcctttttcttttctttctttctttttttttttggagaacgggtctcactctgttgcccaggctaaagtgcaatggtgtaatcatagttcactgcagcctcaacctccctggctcaagcagtcctcccacctcagtttgggtagctgggactagaggtgcacaccactatgcctaactaattaaaaaaaaatttttagtagaaatggagtcttgctatcagggagatcttggactcctgagttcaagcaatcctctcgccttggcttccaaaagtgttgggactgcaggcatgagccattgcacctggcctcacattttgtttattcattcatcagttgatgagcatttgagttgtttccagtttttaactttttttttttttgagacggagtctcactctgtcacccaggctggagtgcaatggcagggtcttggctcactgcaacctccgcctcctgggttcaagcgattctcccacctcagcctcccaagtagctgggactacaggtgcgtgccctcacacccggctaatttttgtatttttagtagagatggggtttcactgtgttggccaggctggtctcgaactcctgacctcgtgatcagccagcctcagcctcctaaagtgctgggattacagtcatgagccaccaccagttttttagctattataaataaggctgctatgaaaatgcatatacatgtttttgcattaagatatgttctcatttcttttttttttttttttttttttggtgacaggttttgctccatcacccaggcggagtgcagtggtgccatcacagcttactgcagtctccacctctcaggctcaagtgattctcctacctcagcctcccgagtagctgggaccagaggtgtgcaacaccacatttggcttttttattttttattttgtagagacgagtcttgctatgttgcccaggctggtctcgaactcctggattcaagcgatctgcctgcctcagcctcccaaaggattgggattacaggcttgagcccctgtgcccggcccctatgttttccttttttttttttttaaatttgaaacggagtcctgctctgtcgcccaggctggagtgcagtggtgcaatctccctcaccgcgacctctgcctcccgggctcaagggagtctttagtctcagtcccaagcagctgggactgcaggcgcccgccaccatgcctggctaatttttgtattttttagtagagacagagttttaccatgttggtcaggctgatcacgaacctcctgatctcaggtgatccacctgtctcggcctcccaaagtgctgatattacaggcgtgtgaaccaccgtgcctggccgttttcatttctttgtgatctgcttaggagtagaattgtaggtcatatggtaacttcagggttaacatttgtaagcattgccaaactcttccactgtggctgtgctgtttcacatcccaatcagcagtgttagagggttccaatttctccacctcctccacaacccttgtcattgtctttttaattctagccccaagtggcatctcattgtggttttcatttgtacttctctaatgacttaacgattgtgtcttttcatgtgcttattggccattggtatttaagaactattttaatcctttgcccattaaaaaaaaatgtttttgtccttttattgttgaatagtaacacttttttttttttttgagacagtctcactctattacccaggctagagtgcagtggcgtgatctgggcttactgcaatctctgcctcctgggttcaagggattctcctgcctcagcctcccgagtagctgggactacagacatgtgccaccatgcccagctaattttcatacttctaataaagacggggtttcaccacgttggccagaatagtctcgaactgctggcctcaagtgatctgcctgcctcagtctcccaaagtgctgggattacacttatgagtcactgcgcccagccaagtactaacacttctttatacattctggatactacactcctagtagctttatgtttagcaaatattttctcccattctcttggctgtcttttcactttcttaatgtcccttgaatcgaaaacttttatgtaactgtgatgaagttcagtttatttattatttttggttgcttttgttttaggtgtcatatctaagaaactgttgcctaattcaaggttacacggatttatatatatacacacatatatttatacatgtatacataagtatacatggaatatatgtgtaaaatatacacatacacaaatgttatatatcacatttatacataggtatatatgtgtacctgtatacatatataacatgtatatatatgttctataacaagtgacttatattttattgatctattttgagttaatttttgtacatggtatgatgcaagggttctgattagtttttctagtctcctttgtctattctgtacagaatagttttattgcagttttagtgtcctttaagtacataaccttaagtgtttggcttggggataaatgtagactttgggaaaattgaattgttgggagacctatcagggtctactagcatgtcatagtggagtttagtggcaatgtctccttctctgtatcttcactccccagttgtaggatatgttgaatcagacctattattaactaacataaaatataagtgagcctaatggcagttctctttagattttctgtaaagcccaggacacccattgtgacctctcagactccaaagcgaatttcctaatggagtagaacaaacaggaaattatgaggaaaggcagtcagagtttgaaaagagaacacaccagaaacaatggaagataggtccaagaaactagataagtgcgagttgagaattgaatataattttatttaattttaataatactttaattgtaaaagtaattcataatcactgcaaaaagtaccaagcactgtaaaaattaaaaatacaaaacaatctcaaattgtgacagccaagagaaacctaaagaaacatgattataatgtttgtggcatgtaagtttggtgtccacaatggaaaaaggatattaggaaaaaaaagaaatataagatatagaaattagttaaaacaatgagaataaaaaatgaacacccaattcctgctcctagaagaagtagtactctaacatttggtgaagttctaagagccaacatttttacccagcttatactaggacctgttctaaatagtattttagctcatttaattgttaagccattgtataaagtaaacagaatcccttcttttgttacagattaggaatttaatgcacagagggttagataacttgctcaaagtaacattgtggtcaagagtcaaagctagaatttgaatcaaaagagcctgagtccaaaggcatggttttcatcactggactataatggtgtgtattctttcataattttttcagtgtaaaactgaacatacagtatgcttttattttatttatttttttgagatggagtcttgccctgtcaccaggctggagtgcagtggtgtgatctcagctcactgcaacctccgcctcccacgttcaagcaattctcctgcctcagcctcccgagtagctaagattacaggcatgtgccatcacgcccagctaatttttctgttttttgtagagatgggtttcaccatgttggccaggatggtctcgatctcctgacctcgtgatctgcccacctcggcctcccaaagtgctgggaatacaggcgtaagccactgtgcccagcctacattttatttttcgattgactcccgtgatcagagtcaacttcccatgttattttatgtgaatatgtatcaatgaactattagaaattgcaatgtttttgtaggtcaaaacaattcaatattgacaattttatatgattcagcctaatacatcattttttccatcagccatattgcatgttattatttatatatacgtttatttagttagcctatctgttctctgtgaggaacattacacagtttctgagattttgttacgatagaagtcagcattgataagcctctgcgcacctgttttaatgtaggatcattgggaactgagcagtagcttacagggcttgggaggggatttaaccatttagtcaacctccactcacatcaccctcccttcttcgataatgggcaattgagaaagggcaaatgtgtgtaaaaactatgcagatgcagtttcaggattattttcttcttttctgcagtgtcttttcccaagctacatcagcgtctaaattttggagttactgatgcttccgttatttctgcagatagaatattatgtcgtaaataatgtttacttgtccattagtattatataaaagtgcctgtttctccccactccagctatcattgattattggtaaaaattttaatgtatccaattctaataggcaaagaaaggctctcctacttagatcttaggtgggggtctaagttcatatttttgttttacaaaaattgaatagccagtgtttttgagttgaatgatctatccattccgtataggagagtttaattatattgtgattttgggggagataattttcacaatttaccccctcaaaatgtagaaagtagaaaaagggtagaaaaatcgcaccaaatttgaacaatgtagcatgcttttagagttagggatattttcttttggaaggatttcaagtctggcgtatttgcattgattgtggttatggcgcatttaacttttccaaaccagcttttttgtaccgcacataggaagacctgagggtgagtgtaaattaggattgtttggccagtggtgtgtgcaaaaatttattgtagaaccaagaattatttctttagtattttacacattttaaaaaacaggtagacatgtccattgatcccaggttgcttatggtttctagaggccccctctcattgcaacagtgctgtggggccctaggggtccagtagccccctccccccaggtcattccggtgagggagggagctgggacccctgcactgcggcaaacaagcacgcctgcgcggccgcagaggcaggctggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactgaataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtgcatagggattttaggcggaggtaggtatattggagtgattgtggcggggcgaaggtacgtgaagtgatcggtatttagggggtgttgagcgcaggtaggtgtataatagtgaccactgcgtggtggagcagggtacgtggggcgactggggggggaattcgtcgcagtgaccgaggcgaggaggctatggcagtggaccagggggatgagtcggtgtgacagtggtgggggttgtgttggtggtcgcggcgcggggagagtccgtaggaagtggctgggaggtagggggaaggcggcgacagtgggtattggcggcggtgggcattggcagcgggtaggcatggcggtggtggactttggcggcggtaggcatggcggcggtgggcatggcatggaggcggtgggcatggcggccgcggggcctgtcgctgtccggagtgactaagggacgctgaatgattgctgtgtagaggagggggcatcagaaggggcagtagcacagtccgcagcctttaattttcctgtgacctgcgatggtcatctggtttgcctactgtggtggtggtgcttttttattaaaactgcgcaatgcctacactgccgcaggggctgcagaaatgcgtggaatccttgcgtaccctttaggaaccctcgctttagaggctatggcataagaagactggaatgatgtgcagaacttgcatttacagatcttttgactgataggccaggtgatgcctgggggttacttttttttcattgtttctctctgttgggaaccaggtcttggaaggctatgtcgaaataacctgggggtctgtgttgcgtcactgccattgtgcagctccttcaagatggccgccgctgcagcggcttagatctgcgcaagcgcttcagcgggggggtggccgcttcctccctgtagagccgccagtggggagggggcaggtggtgtgtgttcagcttctgctgtttcggagtttcagccgtaccctctttagggtgcagtggtaaggagaggaagccggccaaggtgggcggctgccccctccccaaagtgctgcttgggaaaggatgcaggttgcgcagacgcagcagaggtgacagtcgcctccgcttgcagtggggcgagacgtggggcaggggagcgagggcttacgcagcttttgcctggaaggaatggcagccctccccttcacctggctgatacagcagctgttcctttccggttgtggcgcagtagaggggggaggagggagatgggttggcgcaggctccgcctagcaagcttggcagccaccccttacccacggtgcagcagtagaggactggaggggaatgtggctagaggccaggcatttgtaccacctccgcctgtgtgggatggcagctgcactgggctactgcttttcagctctgcagtaaactagagtggtggcggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataaatgtcaccatttaagattcagttatccttcttaatctctggatagtccattctgatgcactgcatactttccttaaatgggttgggggagaggacatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggagtctgggattttatatgatatttataatttacccttttttttctgcttgcatgaagatagcagttcacatacatatatttcttggtttaacttctggtcatttggctatttgcaagctgagtatttagtctgatccgccattttgtagtcttgcattcaggcccgggatcctaatatggcagatccctttggaaaggcctcttgaagtttcaaggtctgtgtcctactcagtgaattggctctgtgctagggctttttggaggcagggagtggcagcccttcctgtgatgcagaggaaggaagcttggttgagagacccttatgttgttgtctaaggcagggtactaactgatttggatttattcacagaccttgccttatcttgatttcactattctatctgaccagtgtgtcattgccgaaatgttttccacatttatagttactctgtatctttatgtttcccttaccctgttccttttcctaataaacatctttgttttacaaaaaattttgtttataaggtgtcaaggatgccaagataacctcctttgtttatcagcgccctctgtttagctattttttaggaagaatcatttaagcaggttgtgagtactgccctcaattacttggacaatgaagttttaaaaatcttatttagacctgtcactggtcctgtctcctttttttttttttttgtggcccagggccagaaagcttgagtgagaattgttactacttaaggtagcctctctccatttctggatgctagctggctcaaagttttttttttttttttttttttttttttttttttaaatagaccagggtctccctatgttgtccaggctgaactcgaactgctagactcaagctatatcctctccctcctcagtctctctctggccactgtggctggcccaaattctctttttgttaattctcctcagatttgttttggaggcaatgaggtttcttatattcatggggtacagattagcagcctatcattaaccttatttttttgtttttaggagacagggtctggctatgttgcccaggttggagtgcagtgatgcagttatagctccctgtaacctcaaactcctggatcaatctagactcctgcctcagcctcccaagtgcctgttagtacaggcttgaggtactgtgcccagctaactttttatttttttgtagagaggggtctccttatgttgcccagactggtctcgaactcctggactcaagcagtgcccctgcctaggcctcccaaagtgctggcattgcagccatgagccgctatacctggccaactttgtttatttttattcttgagatcttagttaaattttatggaaaatttaggccgtaataaaattgggattccattgctttttgcttttcaatatatttccggattattactttcagtgtaagtgatctgagggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcagcctggccaacatggtgaaaccctgtctctactataaatacaaaaattagctgggtgtggtggtgcatgcctgtaatcccagctactttggaggctgagtttgggtcttgtaatattacttcatctagcagtagagttagtgtcatatgttactttcatgattaacatttttaggaagttggcaaagtctatatataacactttatgtttccaccagcagtttccccacatcctttacaaatattgtggtgtcagatggtggcatttcagtgggggttttttcattttgaggcagggtctggctctgtcacccaggctggtgtgccagtggcatgatctcaggtcactgcaacctctgcctcctaggctcaagcgccctctcaccttagcctcctgagtagctggtaccacaggcatgcaccaccacacccagctaatttttgtatttttttgtatagatgttgcccaagctggtctcctgagctcaagtgatcgctggcctcagccttccatgaaccattgcgccctgcctcattgggattttgatttgcattttttagtgactaatgttcagcatcatttcatatagattagccacttgtatgtgtttggaggactgtctattcaagtgttttacccatcgtagcaatagaatttgcccttttattgttgagttgtgagagttccttacatattctggataccaaacttgaaaaaatacttttttgaggtgtgagtgacatacaaaagctgtagatagttaatgttaaaagttgatatgctaagagataagtacatgcctttgaaatcattcttatcaaaattagtggcataaatgtgtctgtcacctgaaaaagtttctttgcctctccctaccttcttttttttcattgtttggattttctttttgtttgttttggatactagaaacttagctgtatgttaagcaaatattttttcctattctggttatcctttcactttctttagtgttttcggaactttattttttgatgaagtccactttattttttatactgcttgtaattcaggtgttatatttaatagaccattgtgtaatcaaaagtaataaacattatcagtgtataaaattttaccatttagaaatcaaatatgtgtgtatggcttgattagaacatttaaactcttgaaagaataaaacagctgtgcgttattggtaagctattttaccaatctaaaagtctaacatgacttaaaaacatctagggttcagagaattattaatagcttttggcatgtatctttgaattttgcttttgagatattacttgtgttactttagtgaaaggtcctgctgacctttctgatttatcatctttaaaggttcataggtggtttctgcagtccctaatatggctagtctggtgtgggatttcatgttctgttcccttgagcagccattttatgaggggttctgcagacgtaacatggcgggttttttgtttgtttgtttgtttttgctatgtggatagtttttagcttgagcagctcttctattgctttgcaaatcctaaagaaagcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttaactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcctaaaaatacaaaaattaaccgagtgtggtggcacgtgcctgtaatcccagctacttgggaggctgaggcaggagaattgtttgagcccaggagacggaggttgcaatgagctaagatggcaccactgcactctagcctgggtgacagagcaagactccatctcaggaaaaaaaaaaaaagaaaatgcagtgtatgaatactaatttattttatttttttcaaattaaaggtttttcctcatagtaaaaactgagtagtagtttgtgtgtcttttgttatttcctcattttatatgtgaaaagttgagctggatgtggtggctcatgcctctaatcccagcatgttgggaggctgaggtggatcacttgagcccaggaggtggagaccagcctgggcaacatagagagacctcctctctacagaaaaataaattagccaggcgtggtgttgtctacctgtagtctcagctacctgggaggctgaagtggaagggtcacttgatcccaggaggttgaggctgcagtgagccatgtttgtgccactgtactccagtctaggtgacagaatgagatctagtctcaaaaagaaaaaaaaagttgtaaaacatctgttagcaagttttaaattatggtgagggtaaagattttttttttattttttcctatttattttgccgatttttactatagtgagtatatttaagtacattttcattttttaaaattgctttggaagacgtattttatgtacgttttgtttgtatattggtaaatattttgaaagtattttgtgtaatataatttgtcctttatatataataggttattcgatcattcattttatttgatatgaaatctcttttttcatctcttcattctttttgagacggagttttgctcttgttgcccaggatggagtgcaacctccgcctaccaagttcaagtgattctcctgcctcagtctcccaagtaactgggattataggtgtgtgccaccatgcctggctaattttgtatttttttagtagagacagggtttctccatgttggtcaggctgggctcgaactcccgacctcagatgatccgcccgccttggtttctttcccaaagtgctaggattacaggtgtgagccactgcgcccagcctctcccttcattcttttgcagctctgacgtttttttaaagtgccattactattccctgagtttctagaggtagttcagagatggtggtggaggtagggctgaggtttaggactcttaggtttaggactgttaagtgggtgaaggttctatcttgctatatttttgttacagtttttttcctatgtaacctcagtgtggactaaataacaggtagtctcatcctcatcttgttgtgggatgacgttagccttctaggcatcttgtccatatttatggaaacattttgatggttttgaagaagaaataacttgagtttttcttatctgcactgcatatatatgtacaaatactgcagggtcttgagttgggggaatgatctgagtaaagtgtagagttagggaaatagtataatttttcccccttgtgcgttttcattttgagagtaattggattatggaatgggtaagcaggattggttaacactgcctcattgtccatgtgtttaggattctcaggattggtatacttagaatgttatactagaagtgttcaatatttacccattcatctcctacttcctaccaaatcataagtagtattgggaggcagtcttcctggaggagttgtgtggttattagccctaaagatcaatgaaggaggctgggtgcggtggctcacgcctgtaatcccagcactttgggaggcgaaggtgggcagatcacctgaggtcaggagttcaagaccagcctggccaacatggtgaaacctcatctctagaaaaataaaaaaatcagccgggtgtggtagtgtgcacctgtaatcccagctactcaggaggctgaggtggaagaatcgcttgaacctgggaggcaaaggttgcagtgagccgagatggtgccattggctgtgcctgggtgacatagcaagactccatctcaaaataaagtaaaaataaaaagttcactgatttattttaaattttttattctgtctttcagtgtatttgtcactaaattagctcttattctttggggctggatgatgtatcgtgagttcgaagggaaattggaaattggagctggagagttgtcttaatatattttatgctaagcttcacatgtcttttcaaattaatattctgcactctatgaattaaattctgtgtaggctgcctcattttctcagtctttaatcttctattgggttacaggttagatctgagggggacattgcaatagagaattatcttacgtttcaagataacattatatatatttttttttactgaaacactttttagacctttatgaataataatcagaaacttagttgtcatttgtaaacagaggttagagtggagaatgcccaaattaagatttatttattcagtgattagactatgaattagagtataaagtagactatgaattagagtgtgaagatttagaggtatgtgcagtgcaattctgactacttggagttagtgcaaatttcacagttgtctagatgccctccagaacattcccctcaatgcagacaccaactccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgcttaccagtagatgattggtttacatattttaagagcccttaaatagccctggaagttctatatttcaggtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtaagtatcttaagtatccactagtcccttgtacaatctctgtgtagagattcctgttttgtgttataatttctcataagatagtgtcatcctctgaccctaaagaaagatcttcttccctgggcgtggtggctcacgcttgtaatcccagcactttgggaggccaaagtgggtggatcacctgaggtcatgagttccagatcagcctggccaacatggtgaaaccccatctctactaaaaatacaaaaaaattagccgagagtggtggcaggcacctgtagtctcagctactcgggaggctgacactggagaatggcgtgaacccaggaggcggagcttgcagtgagcccagatcgtgccactgcactccagcctgggcgacagagtgagactctgtcttaaaaaaaaaaaaaaaaattagctgggtgtggtggtaggtgcctgtaatcccagctacttgggaggctgaggcaggagaatcacttgaaccccgaaggcagtgtttgtggtgagcagaaattgcttcattgcactccagcctgggcaacagaatgagaccctgtctggaaaaaaaaaaaaaaaaaaaaggaatatcttcttaaatgtaagggtacctagttttctttcatatggtttcctataaagacaaatgtatttttatcatttatatatattgtgctcttgttgtaggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagttacaacatactttcacagcattattttaattcaaatatggtttatgtcagtgaattataaatacacagcacataattaacaatgagtattagagaatctaaatactttctcatgcttatttactaattcctttttgttttgtctttttctcacttttctgttttaaccaatgtatttcctctttgaatcagcagacaatgtaataaaaatattattcataatttttcaatgtgatgtagatttatttagttctttttatgttgctttcattttttaggaaaaagttattacaaagtcgattttgatttgttttcttgtttttcctctgtgatttttctttttttctactttaagttttagaatgccctcatttctgagagtttactatttactttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccaggaaaaataagaaaataaactattaatgtggccgggtgtggtggctcacgcctgtcatcctagcacttggggaggctgaggcaggtggatcacctgaggtcagaagttcgagaccaacctggccacatggcgaaaccccatctgttctaaaaatacaaatattagccgggtgtagtgggggacacctgtaatcccagctactcgggaggctgaggcaggagaatttcttgaaccctaggggcagaggttgcattgagcagagattgtgccactgcgcttcagcctgcgtgacagagcaagacttctatctcaaaaaaaaattgtgttatgaatattctgtttttctttggtacctaaatatttaccagggtacatatccaactggatacctacctagtagttgggatgcagggtgtaatattagtatgacttttaaacgtttttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtctcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgaccactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggaccgctaagcttgtgggagttatttatatcctattgctcaaggtcattgccaaggtctgatttttcacaaaaaaattccaacctctggcataaatgggttaaaaacggctttagtgatgtagtgctgataaacataaaattcacccaatttaagtgcatgaagcaatgatttaagtaaatttacagaactgtgcaatcattgccatgaactactctggaaacattttcatcaccacagtaagatctgtcttgctcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaaaaaaaaaaaaaaaaggatattgctaatgagtctcatataccatgttttcttggatttagactgctttataaagaatcataagataatattcaaaacttctaagttatagtccttaaactcttactcatatttaggacagaaactacatttaatttttgtggaggtctttgtttgcttatttgaaaagttcttttgagatctttataggttttatttaatacattttttaatgtacagacatcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgttgggattatgggcgtgagccaccacacccagcctcttctctgtttaacattgtattgtgagtgttcatagtatgcaggatagtaacatgatatacaggtttgtagcctaggatctaccatattgcctaagagtatagtagactctgtgtatcctctaggtttgtgtaagtacactgttcatactgtgatgaaatcaccaaatgcatttctcctaatgtgtccccattacgtgacttatttatttattttgagatgaagttttgctcttgtccctccttgttgcccaggctggagtgcagtggcgcgatctcagctcactgcaacctctgcctcccaggttcaagcgattctcctacctcagcctctcaagtagctgggattacaggcacccaccaccatgcctggctaatttttttgtatttctagcagagacgggatttcaccatgttggccaggctggtctcgaactcttgacctcaggtgatccacctgccttggcctcccctggtgctgggattacaggcgtgagccacctcacccggccgttaacgtgatttataactttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtgaggaaccagcagagggttttatattattgggagaatatgactaagccggaggccgaggagatttaaaaacctaagtgtatgtgtcatacaatgtaaacagcatatggtttaggaggaaccaaaacacagatatatgggaggaagggaataaaactagctgcttaaaatggtcattgggtgattaaagttacccaggttactcttggcaagagtaacttgccactagtggtgagtgaacagaatgcatggatataccacagttgaaaagaccaaagggctttttggatgtcagtgtactaagattagtttttaaaatatgggaataggccgggtgcagtggcttacgcctgtaatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 546 - DNA, 154936 bp, Homo sapiens; identical to SEQ ID NO: 545

SEQ ID NO: 547 - DNA, 154936 bp, Homo sapiens; identical to SEQ ID NO: 545

SEQ ID NO: 548 - DNA, 122032 bp, Homo sapiens
agctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttcctggtaatattcattcttgcttttgtgtttttgttttaaggtccaaatatctttaatacttgtatgcagttttcttttttataatttcacataaacatcatctaaaaccaacttcgcatgttcgcattctgtattaacaactttcgtttttgtatttaaaaatacattcataatcactttttcaaaatatcttgtcagttattttcatcttttccatgatcattctttaccagtgcaatggaaatattacttttattaggaaaagcagatgtcacgcggtttttagtgttgtcgagaaatttcctatgaaacatctctggttgaaaaggagaggaacaaaattttatgtgaggcacaagatcacatatgctcagaatcgcatgctttaataaaggctgtgattatttgcattatattgtttagcttgttctaattgtaaaaggtagacaaagaattaatttgtgtagacagaacattgcgactcccattctaaatgtagagacagtcactgcactgcgcaaataggaatgtcgtcatgttgtttgcttttctccttaccccaaaactgtagacattggctagagtctttgatttttttcccaacttgcttttgtaattgtcggcatgatgtttgcacagataaccaatgatatagatatatatttttttcttactatttgatgaatgattaatattttgggttttttttatgttttcagtgaatcaaaaatatcattcagaaaatgttgtcatccatatccaggtagcatatagttttataatctgatcttgtaataaggaaattacagtccttattgattttctgttattagttagcattttttaagttttcatgcttgtgagtatttgggaattttttttttactctgtcaataatttaacacctttgtattggtcatctgggtcgatgtctattgtttaggctcaacctttgacactcctctgaggtagtttttatgtgaatttgtaaccacccaagggattcaccttgccagctgtctagacagagccgatttatcaagacaagggaactataatagagaagcaagaattcacccagagccggctgtgcaggagaccatagttttattattactcaaatcaatctccctgtagggggatcaggggtttctaagaataatttggtgggtagggggtcggaaagtggggagtgctgattggtcatgttggagatgaaatcatagggagtggaagctgtcctcttgcgctgagtcagttccccggttggggccataagatcagatgagtcagtttattgatctgggtggtatcagctgatccatcgggagcagggcctgcaatagatctcaagcactgactgagcttaggtttcacaatagtgatgttatccccaggagcagtttgaggcagtttagagtcctgcagtctccagctggatgaatcctaaaccgtaatttttaatcttgtagctgatttgttattcctacaaaggcatgatggaggggggttgttttgggaaagggctgttactgtcttcatttaaaagctaaactataaaccgaattcctcctgaagttcgcggggaatgaacaagggcagcttggaggttagaagcaagatggagtcagttaggtcagatctctttcactgtaataattttctcagttatgattttttgcaaagatggtttcaaattgatggcttagtgtcctgggtagtgaaaatggaattcctcaacctgaattgaacatggatttcctcctgaagaaacaatttagggctccaaaaagtaaaccaggagcctggcacagtggtcacacctgtaatcccagcactttgggaggctaaggcgggtggatcataaggccaggagtttgatactagcctggacaacatggtgaaaccctgtctacttaaaaaaaaaaaatacaaaaattagccgggcatgctgatatgcacctgtaatcccagctactcgggaggctgaggcaggagaattgcttgaacttgggaggctgaggttgcagtgagtcaacatcgagccactgcactccagtctgggtgacagagaaagactctgtggggtatgatgaggcttctcttcaaatagcctgatcaatcgtttattctttaattaatagtaacccccacccccttttcctttttctcttttttctttctgcctttgttgcatgcccggacatgccacagtagcaggcttatcagtaccagctcacattcctttccttatttggaaaggagactagctctctagctcattgcagacaccccttccccttttcccctctctcccttatgtgcccaccttatctaaagaaagttcaattgtctagccaaccaggattagttcagactgtgcgacctgacctccaccaatgggaaaagggtacaggggcaggacttggggcaggaataaagactcttgtgcccctttgttctggtgtgctttcatggcgactggccaaggagaagcacccctctgcgcagaagtaaaattgctttgctaagaatcctttgtttgagtgttcaatctcccttaggattttgagcattattcccaaccattcaatccaaaaaaaaaagtagaccaggattgatttagggcctgtattataaattgtacaaatgccaacaagattgtattccactagaggaacgcattctctagtgaaggaagcattcctgcaggatgagtccctgagactcactagcaaatttcatacaagtaatgaaatcctcagtctaatggaataaaaacaattccaggggcatttgttaaagatgtataagatgtgagaaaccaacagactaacagcattgatactttatggatatttttattccaaattaatagatgtgttacaggaaaagggtcctgatccagaccccaagagagggttgccgatattcagggccagtctgcagagtaaagtgaaagcaagcttactaagaaagtaaagcagaaaaagaatggttactccatagacagagcagccctgtgggctgctggattcccattttcatggttatttattgattatatgctaaaccaagggtggattatccatgcctcccctttttagaccatataaagtaactttctgatgttgccatggcatttgtaaactgtcgtggtgctggagggatgtagcactgaggacgaccagaggtcactctcgtcaccatcatggttttggtggattttagccggcctctttactgcagcctgttttatcagcaagatctttatgacctgtatcttgtgccagtctcctgatgtgacttaaaatgccttaaccatctgggaatgcagcccagtaggtctcatcctcattttacccagccctattcaagatggagttgctctggttcacatgcctctgacagatggacatttgtttgccaagcaatgctgcaatcaggggctctggatttcagtcctccatacagagaatgtcaagggcagaccttaataaaaataaataaatgaataatcaaatttttaaaattacctctttcattcttttattgtattatgatctgacaccattaactttaattttcttgcatatggagagcaacttgatacaaactggtatttatttagtgaagaaaagagataaggtgattcccaaatttaaaggaaactggaagttttgtgggaaacaaatggaggagataagacttactagtttctacttattttaatgagaattgtgttgttcatttataaatacaaagctccatttaaattacagatgcttttgatttatgatgaggttacttccagataaacccatcacaagttaaaaatgtcatcagtcgaaaatgcattgaatatacctaacttagttaaaatcacagcctagcctatcatccttaagtgtgctcaaaacacttatattagcctaacgtttgggaagatcatccacacaaagcctattttatcataaagtgttgaatatctcatgcaatttattgaatactgtactgaaacagaaaaacagaaagattggacactcaaagtatagtttccattaatgtgtattgcttttatttaatttaaaaattttaagttgaatcatagcaagtgaggaagcccatatattataaaatgtaataagtttaccagccacaaataacaacaaatcataggaaatgcagggattgggttgaggtgaggtggttcaacctattatacccatttccttcatctctaatgggctgcccttcatccttggggttgttgcagggtggctgtgcagtgcaaagggcacacaagaattgcttgaacctgggaggtggaggttgcattgagctgagattgtgccactgcactctagcctgggcaacagagtgagaccccatctcaaaagcataaataaataaaaggataatatctctgtcaaagtacagtgatgcattgcttaatcatggaaataccttctgagaaatgcattgtttggtgatttcatctctgtgcaaacatggagagcattacacaaacctagaaggcatagcctactacacatccaggctacatggtacttactattgctcccaagctataagcctataagcatgtgactgtcctgaatactataagcaattgtaacacaatgataagtatttaaacatgtaacctatctaaacatagaaaacataaaaagatggtataaaacaaaaaatattgttcagttgtatagggcagttgccatgcctggagcttgcaggactggaagttcttctgggtgagtcagtgagtgagtggtgagtgaatgtgaagacctaggacattactgtatgctactgcagactttagaaacactgtaaactaaggctacacttaatttattaaaaactaaagtaattgtgctatggcatcgtgacagctttgacatctctaggtgataggaagttctcaggtcaattataaccttatgagagtaccctcctatatgttgtctttccttgacagaataaaatatcattttgagagccatgactaataaacacataagagtcgatttaatatttattttaaaagcccttccatagttataaaagcataagttttagtcacatcaaaatataaacaatcttgaaattaattcataagtaaatcaatagatatcttgaaattgtgcttatgatagttctaaaccagactttaatgcagaatcttggatatcttaatcgcactgtgtggcaggaagactgatggcaataaaacatttcttaaaaaagaggctgcagcattttctgtgcaatttgcaccattcctgttcacacctgttctgtaagtgttgctgcaggcgatcctgtaagaaatgacagcgggttgcagcgcaagttcatgcaaacaatgaaaagcatgtcatggctaccactaggctaacgctattgtaataaaatttgaaataaaatagactagaaatgatgaaatatgagaacaacattggaaatatttatcaagggaaccatattaatgtaagcgaattttagagaacaaaatacttttcctaggtctgcaaggacaaaactgtccagaagaacagaagagggacagatgaggtagaagcagcatggcccatgagaggggctctgcagtggattgagggtggggaggctggcaaaaaggctgggcagaatcagggctcacatcctgacctgagaacagaagagagcacaagaaacaggttcatcttcaggcacaaatcctcttcagattgaaagagagatggagtgtctagggaagtaggcaagcatttggggaaggagagtcactgattcattagtgaaacacaacaaaaaaacaaaatcttctgtgttgctgtttgtccactgcatgtgtggggctcacaggggaacaacatagacaaagtttccaaattctcaggtgtttaagacgagtgaggattcagaaaacttaacagaaactaaactgcaagtgcaagagctgcccttaggaactcaggggacaggcatcaggcctgggatgggatggacaaggggggccttcaggaggaggagcattggaggagatgctgaagagtgaggggcaggggatccaccagacaggggaggtaaagggaagaggaaacagtgtgtctggcacagttcagggcatgagataagggcagtgggttggaaggatcgctgggatgaataatatatgaggaggcaggagcaggaaggacagaccataaagggcctgagcaggggagggaggacagctctggaagtgatgcagaggctgctccctgcggactgccttctgtggggaggagttcgaatgccttttcttcttttaagtgttactcacaatccatgagatctactgacaaggaagacagttggaacaagtaagaatagtccttgtttgatgggaaggagcagtagcattaccaggaggggttggtgttggggaggggcaagggtggggaagggcagagaagtttctgtcccctcagccattttgcagatgtaggttggatcactggatcacaaattcacagtggctggctcatggccaccttgcatcacagggtgagagcagcctcacaggaaactgcagataaggggggttcccagctgcacagaagaaggacagcaggtaactttcagtcaaggttggcagggggctgcagaggtggcagcaatgatggtggtgggcagtgtgcagccttgtaggccactgtctccatggacatacagatttgcacgcatctgtgtctgcgtgtcctctcggtgtgctgacattcttacaaaatcctcatgaatttctcattgttctgagaccataacatgtattttgacttttttctaccacatgtaccctttcatgtgtacctagcaaaattgaccaaaattccttattggtggattattcatagctacagtattttccaacttaataactaaatgaattgccctgctttgtatatgtttgcctaatcattcctgaagattcatgtctcctcatttcagggggagccacccctgcatgttcataagcaggagttcagtttagggtgttctgttttcctagttaactgtggacacatctgcgttctggaaactattaaactctcaatactcatttgaaaattccagttactttatcttttacttagctttcactttatttacagtactctctcttttctcctgcttactttggatttcgtttgctctacttttaagtttcctatggaggaaatttagattatcgatttttagatgttttttcttttttaaattttatttatttatttatttttattttattattatttttttttttggagagggagtctctctctgtcgcccaggctggagtgccatggcgtgaactctgcttactgcaagctccgcctcccgggttcacactattctcctgcctcagcctcccaagtagctgggactacaggcgcccaccacaacgcccggctaattttttttgtatttttagtagagacggggtttcaccatgttagccaggatggtctcgatctcctgaccttgtgatccgcccgcctcggcctcccaaagtgctaggattacaggcaagaaccgccgctcccggcccctcttcttttctttttttttttttttttttttttggtggaattttgcttttgtcacacaggctagaatacaatggcgcaatctcggctcgctgcaacctctgcctcccgggttcaagcgattctcctgccttagcctccctagtagctgggattacaggcgcccgccaccacgcccagctaatttttgtatttttagtagaaacggggtttcgccatgttggtcaggctggtctccaactcctgacctcaggtaatctgcccacctcagcctcccaaagttctgggattacaggtgtgagccactgtgcctggccaatgtttttttttgtttgtttgctttgtttttaatagatacatttcccccctatgctccctcactgcattctacaaattttgataagatgcattttaatttaaacttagttcaaaatgttgtttaattttctcttgagatttcttgcatcatgtgttatttaaaagtgtgttagttaatctccatgtattttgaagtttaccagttatgtgccttttattgatttctatcttaattttattggggttttagggtatatatttgttaacataaaaatcatgagatctataaatttggaaagaaaaagagctataaatattcttgaaggtagccctacagcatgtatactgaacaaacatgcacgtaacctatgacccatgttcaccttggtgtggagactgagcttttttttttttttttttgagacagagtcttactctgtcccccaggctggagtgccatggtaccatcgtggctcactgcaacctctgcctcccaggttcaagcgattcacctgcctcagcctcccaaataactgggattacgggcacctgccaccatgtccagctaatttttgtatttttagtagagacagggtttcaccatgttggccaggctggtcttgaactcctgacctcaggtaatccacccgccttggcctcccaaagtgctatgattacaggtgtgagccaccacgcccagctgagacttaacatttaaatgtattacagttaggccctacacacaaaagcccctttcaggacacaaaggcagacaagtacacaatctctagaaaccagtcagacccagtccatgtttggtgggctcttatcaggagaaagttactgaaatcagtctcttgtgcaatcaaggctgtagcgatggctgttggaacagaggctggagttagcgtctggcggtggatgagctgcaaattgttttaagattgtttatgtggaagtcagtgcttgcttagctgctagagaaaaagataaacctcctgtcagttagaacatagtttattcttcaactataggggtgagtgacttaacccttgcctgtcatggccttaggtcttatttataatttgatatcttattgccaccaagaagagttcattccttcattcttatgatctctattttaatatgaatgctggtcagttgttgtgtctaaactgcaaaagagacagatgataacgaggcatgtcccacttcctgtcccatcatgactggaaactcagtttgtatggtttccctgcggtcctgtctgttcagtcagttggggggcttaggattttatttttaattctcatagaggagtgttgaagtcaccgaccgtaatagtggattcatctatttttcctgttttaacggtttctgcctcgtagttttatgttctgttgctacatgttagaattattatatcttcttggaaaattgaccccactattattatgtaatgcctttctatttccctgataatttttctgactgtatagtcagctttttctgaaattaatatagctactcctgctttttctatttgcttgctatattttgttccatctatttactttcagttaatatgtctccatttttattaaataacagataaaatgagatgtatgtactatgtataacatgaggtttgaataataatgtgcattgtggaatggctaaatccagctaattaacatgtgtattacctcacatagttatcatttttgtggagagaacactttctatccactttttaagcatttttttaaatagacacaggctctcgctctgcacctaggctggagtgcagtggtttgatcacagctcactgcagtgtagacctcctgagctcaagcaatcctcctgcctcagcttcctgagtagctgggactacaggtgcacaccaccatgcccagctaatctttagcgttttaaaaataagacttatgtttttaactagagaaaccatatggtacaatagatctcttgaaattattcctcctctctgactgaaattttgtatccatccacaaaacttctgcccaaccccaccctcaaccccaggctctggtaactaccgttctacatccccacttgtatgaaatcacattttttagatttcacatgagtaagatcttgaggtatttatctttgtatgcttaacatttcagttaacataatgtactccaggttcaaccatgttgtcgcaaatgacaggatttcctttttatatgcctcagtagtattccattggggattatatatataattttctttatctgtcaacggacacataggttgattccgtatgtttgctattgtgaacaatgttaaacacttctcattgaggagtgttgaagtcaccaactataatagtggattcatctatttttcctgttttaacaatttctgcctcatagtggtttgaacactgctaaaatatacatgagtgtaggtatctcttcaacatactgatttcattttctttggatatatagccagcgttgggattgctagatcttatggtagttctatttttaattttttgaggggcctctatacttttttcgataatggctgtaccgattaacattctcatcaacagtgtgcaggggtttcctttacaacacctgttatctttactctttttaataatagccttgtaacaggtataatatctcattttgattttaatttacatttccctgtatctgtctttatatttaaataagttttttttttttgggggggacggagtctcactctgtcgcccaggctggagtgcagtggtgtgatctcggctcactgcaagctccgcctccctggttcacgccattctcctgcctcagcctcccgagtagctgggactacaggcgcccgccaccacgctcagctaattttttgtatttttagtagagacagggtttcaccatgttagccaggatggtcccgatctcctgacctcatgatccacccgcctcggcctcccaaagtgctgggattacaggcgtgagccactgcgcccggccttaaataagttttctctagagaacatatggttaagtcttgttttttgatccactccaacagtctgtgtcttttcattggtggttttgagccattgaaagtcaatgtgattattgataatagcagattgctatctaccatgtttatttctgcttttcatttgctgcccttgttctttgttcctcctcctgtcttccatttgtttgcttccctttatggttttaattgagaatttcatatgatccaattttctcttcttagcatatcattatattttctttttatttttaaatattttagtagttgccatatgaaataaaaactttttcatattttagttgatataacagataacagtttgttaaaaacaaaaattgtagccatttatttgatgaggtattcttatgtttatagtttgagtgtgtgtgcatgtatatgggtgtgtgtgtgtatatatatatatatacacacacacatatacatatgcatgaatgctcatatataaatgcaatgaatgacagcaatagtacaaattaccaaagtacaaatgactattgtttccttattataggcaactcacactacttgtgaactgatagagtgttatttgaaagggagtttgaattaactgtaaatttagggactggctattggattaagatcctccattccttggctggctgttgtccagaggctgcattcagctccttcccatgttggcttctcccacatggcagaatgctccatcaaagctacaaggggagagtttgctagcaagacagaagtaatgattttacatagcataattacccatgtgatgtaccttcagctgtgctctattctcttgtttcaaaataagtcaaggttgctgcccacacttacagggagaggattagaatgcaaggttgtgttcaccagcaggtgggaatcactgggtgccaatctagggtctgcttgctgtgtcagatcttctccaacctgcaacagtttctcagtgttcaattattttgtataacctgaattcttttgaaaagtaccagtcaggtgttttgtggaatttcctacaaaatggattagtctcatgggtctcattattacaatagagatatgcattaatttagacacatgtatgtgggtgttaagaaaaactgaacaatgtattacttagaaatacaaaaggagagaccaggtgcaatagctcacaccggtaatcccagcactttgggaggacgaggtgggaggatcacttgaggccaggagttccagactagcctaggcaacatagccagaccctatctctaaccacaacaacaaaaatttaaaattagccaggcatggtggtgcacacctgtggtccaagctactagggaggctgaggcagcaggatgtcttgagcccgggaggtcgaggctaaagtgagccatgatcacaccacagcgctccagcctgagctacagagtgataccgtgtctcaaaaaaaatggggatatgcactcaggggttttcaacaatattgacaaggtttggcttattatactgggaagggaatttataaaaaagaaacttgttaaattttagaatagtttagatatacacagcagttgccaagataatacagatcatttccttatgcttagcatatagtttcccttattattaatcccttacattagtgggtgatatttgtcacaattcataattcagtagtatacattatccttctctatgattcacattttatttagaatttttcttctaccgaatgaacactttgtgttccaggattccctccaggagaccacatcacatttagaaatcccatctcattaggttccttctgcctgtgacagtttctcagactttccttgttattgatgacattaacatccccaatttgggatttctctgacatttttctcatgattatactggagttgggtttggggaaggaagatcactgagagaaaatgtcattgtaaccacatcatatcacgggtgtctactatcaacatgattcatgcctgttgatagcaatttgattacctggacaagttagcctttgtcaaatttctttactgtaaaattatttctttctccactttccctgtttcactttttgaaaataagtcagcatacatagcacatacttaagaacaagaaagttatgctctacctccttatgaactgaggacctaaaacaagagttgagaactctttactgtatacagttggcctgttctccaccatgatttcataccatttatttatactgtattgaatatgatatgaaattagatatattcagttcacatctcccttatactcctttatttcatagctcgaattgttccattgttggccattggaaggtctctcagttggctcccatatcattttgaaatagccacattattttggttagattttgcttgtttggtggttcaattgtaatgtttcatagtttcttactttcaggcactacagggtcctccaggccaattgtgtttatttcgtgcccaagcctggtacccatcatttcttcaagggtcctagtttcttttattggaaaatggcttttaaaacaaagatacagacccaggtatattcactgatactgggtcatctgtcgatttgaggagtagtcagctgacaaaacaatgaaacgtacctgtgtatactaacccacacatatacacatatgtgtaaatatttcctcatatgttcatatataacctgattaacttaaacataaattcctactaatgtctccagcactacatgaatataatataacttgaatcaatctccccattcccactacttggttgtaacccccactctaacagtgagtgagttggccttgttaacttaatcaccaagttagaggctacatgcatagtggcttcagaattgttcatccacactctcatgaagaacaacattaccaactaaagtacagtgctcatagacaacttcttggacctttagatgcagaatcttcactttgtacccaagttacttaggtcagttctttcccccgcctcccagcttcctttagtgaggttatatcatacatttcttattcatttttcttattttctctgtattcctctatgggatccctcaacctacaaataattattttctctgtattcctctatgggatccctcaacctacaaataattttttttttttggttttttgtttgtttgtttctttgttttttgagatagagtctcactctgtcacccagcctggagtgcaatggtgtgttcttggctcactgcagcctccgcctcccaggttccagcaattatcttgcttcagcttcccaggtagctgagattacaggcacgcaccaccacgcccggctaattatttggtatttttagcagagatggggtttcactatgttggccaagctggtctcaaatacctgacctcaggtaatccacccacctcggtctcccaagtctcccaagtgctaggattacaggcgtgagccaccatgcctggcttacaaataatatttttaatttccgtacatttaggttcactgtttgtattataaagttatgcagggtttcaaaaacaatatgatgtagcgaccatgcaggaagtttttattaccctaaagaaattccatctacttcacctatttcactgtcctccttggagagtccctagttagcattaatctgtttactatctctattattttacctttcccagggtgtcatatacatggaattgcacagtctgtcatcttttcaaactggcttccttaacttaaaaatatgcctttaattttatgaagtatatcttacggtgatttagatttgcattgctgaaggactaatgatgtcaatcatctttttatgtgccctttggggatacatattctttgaagaaatgtctatttatacaatttacccatttttagttggtatttgtcttttattttttgagatgtgacaatcttttatatattctgaacagtagaccctcattacctatatgactagcaaatattttgtctcttttttttttgagacaaagtctcgctctgttgcccaggctagagtgcagtggtgcaatcttggctcactgcaagctccgcctccccggttcacaccattctcctgcctcagcctcccaagcagctgggactacaggcgcccaccaccacgcctggctaatttttttgtacttttagcagagacggggtttcaccatgttagccaggatggtctcgatctcctgacttcatgattcgcccacctcagcctcccaaagtgctaggattacaggcgtaagccaccacgcccggccttttgtcctctttttagggttgttttatacttcttgatagtatatgttgaatgacaaacattttaaaaaatagatgaatttatctatttttgcttctgttacttgtgttttttgtgttatatcttagaaaccattaatttcagaccatgaagatacatttttaaaataactttttttttgagacatgagtatcacttttgttgcccaggttggagtgcagtggcacaatctcagctcactgcaacctctgcctcctgggttcaagtgattctcctgcctcagcctcccaagaggctaggattacaggtgcctgccaccacactaggctaattttgtatttttagtagagacagggtttcaccattttggccaggctggtctcaaactcctgacctcagatgatccacccacctaccatacccagtcaaaaatacatttttttttggaaaatatagtttaggctgggcgcagtggctcacgcctgtaatcccagcactgtgggaggccaaggcgggcggatcacctgaggttgggagttcgagaccagcctgaccaacatggagaaaccccgtctctactaacaataaaaaaattagctgagtgtgatgaaacatgcctgtaatcccacctacttggcaggctgagacagcagaatcgcttgaacctgggaagcagaggttgtggtgagctgagatcccaccattacactccagcctgggcaataagagtgaaactccgtctcgaaaaaaaaaaaaaaaaaaaaagctgggtgcggtggcttacgcctgtaatcccagcactttgtgaggctgaggcgggcggatcacactgcactccagcctgggtgacagagcgagactccgtctcaaaaaaaaaaaaaaaaaaaaaaaaatagttttcctcattgaattgccttggcaacttttgcaatccatagaccataaatgtcagggttaatctttggacagtcacttatattccattgacctatatcactgtccttatgccagtaccacaatgtcctcattactatcactttatattgtttagaaatcccataatccaactttgttctgcttctcattaccagtgtggttcttttagatctcatgaatttccatatgaattttagaatcagcttaccaattactcccgccttgcccgcaaaaaaaaagcaacagggattcccatagcacaacgacatcactctgctggacagcaagagggtgtgttcaggaaccatacctagtctacaaagccatgggactacataccacagtcccagggacaaccacaaaatcaagactcttcttttgtttttgtttcttttttttttttttgaaacggagtattgctcagtcacccaggctggagtgcaatggcacgatcccgactcactgcaacctctgcctcctgggttcaagcaattctcctgcaaatattttgtctctctttttttttgagacaaagtctcgctctgttgcccaggctagagtgcagtggtgcaatcttggctcactgcaagctccgcctccccggttcacaccattctcctgcctcagcctcccaagcagctgggaccacaagtgcccaccaccacgcctgcctaattttttgtatttttagtagagacggggtttcaccgtgttagccaggatggtctcgatctcctgacctcgtgatccacctgcctcggcctctcaaagtgctgggattacagacgtgagccaccgtgcctggccaactcttctttttatggtctgaaatcacggagtatattctctacatctcattcctaccttcaatgaggaaattagttcctgggatctgatgacctggagtgagagatgcagctgatctagaccacatttctcacttctgagatcagaatagcaaatatgtatgtactagtaatttggacatttgcaattcaagaaacctcgcacctcccacagcatacttcattcactccatgagaaaaaaacaaactcacttaaatattcatcttcagaaaaaaaaaaaaaaggctgcccgctgcggtggctcacgcctgtaatccactttgggaggccaaggctggcagatcacgaggtcaggaaatcgagattatcctggctaacacagtgaaacctcgtctctactaaaaatacaaaaaattagccgggcgtggtggcaggcgcctgtagtcccagctacttgggaggctgaggcaggagaatggcatgaacccgggaggtggagcttgcagtgagccaagatcgcaccactgcactccagcctgggtgacagagtgagactctgtctcaaaaaaaaaaaaaaaaaaaaaaaaggcagagtggcagaccaaaaacgagccatatgtcaatctggagtaggagtgaccaatgtcagagtggaaaatgagggctgatgagctttggttctcaggctttagagtaaaggtggtagatgcaaaactgtctatccaccgtgggtttatactgataagtgggcagtaaatgaaagaatagtgtaatcagctgatgttagagtgcaccttttaacaacgttcaagtacagatgcatcttaaaattgacattgtaaaaacaaagtttgccagaatctagtcataatatggctgtccttgtctgcacatgcatgaacttgatctgaaaacctttgattgacgtcttctggtgatatgatcaccatcaaaacttacagagatgctgtcagtaggttgaataatctcataaataggagagtaggactctgtcaagaaatgtgatgtcaccaaagttcctgattagcaaagatgatgacaatgtggggtaaatcatggacagggtgtgttgaaggtgattcagaagagtttgatctgagtgacaggaattttaggaatgctgttgttagtgtattctgcttatattttccatctttgtcatcatagaagtgatataagactaatacctgcatttatagtagttgaaagtttttttcagtaataatataaaattgtaagtgataagatgtatttgtcctatagtctacgaatttattcctatattgtgacataaaataatgatgcattttacaattgactcaaataataactatttcaattccttagaaaacactgtatgagaaaatgctgacttcatgtttagtatagatgtgctattagtctacaggttttaagtattattagttcattcaattctcacaacatttcaagaggtaggcaatattaccactcccaagttccagttgtgaatctgagctaaagccttacaggaaaagagtagaaaaacctgagcttgactttgtctgtctccagaatctttgtttacatcaactatgttagaatatcttttctatgataaatacatcctaagtctagtttcagaaattgtgctttacacaatagtcatgaaattatttttctcaatttcaatctaaatgctacattaaatcgtttttaagttcaggtcaatgaaccatctggtgatcattttgtatgtaatgtgaggtcaaaggtgagatttttattccctcccccaccgcaacagaagaatattcaatttcctagaacattgatagaaaaatcaattttccccccattgaactttaatatgtatgtataagagttttccactgggcatggtagctcacacctgtaatcccagcaatttaagtggctgtggtgtgaggactgcttgagcccaggagtttgagaaaggcctaggcaacatagcaaaacactgtctctacagaaataaaaattttaggccgggtgcggtagttcatgcctgtaatcccagcactttgggaggctgaggcgggcagatcacctgaggtcaggtgttcgagaccagcctggccaacatagtgaaaccccatctctaccaaaaatacaaaaactagccagacatggtggcacatgcctgcagtcctagctactcgggaggctgaggcaggagaatcgcttgaacctggcaagtggaggttgcagtgagccgagactgtgccactgcactccagcttgggcagcagagtgatactttgtctcaaaaaaaaaagaaaaaaaacaaaaaaaataaaaattttaaaaataaggagtgttcaacactctttctacttgctaacacttatgcaggttcaaatcttgccttttaatatttgtttttaatttgtcttgcagactaatgtctttatcacttgtgtacattttttttcctttggccacataagtatcatctacaacccaaaatacatttctcctttatttaaagcacaagtcaagcagacgttcaacaaataggcaataaaaatcagattaaagatactgtaggtccaggagctgtggctcatgcctttaatctcaacactttgggaagctgagatggtggatcacctgaggtcaggagtttgagaccagcctggccaacatggtgaaacgtcttctctgctaaaaatacaaaaattagctgagtgtggtggcgtgcgcctgtaatccaagctactcaggaggccgaggcaggagaatcgcttgagcccaggaggcagaggttgcagtgagctgagattgctccactgcgctccagcctgggccacagagcgagactccatctcaaaaaaaaaaaaaaaaaagatgctgtagtaggaaatgtgcattactctgttgaaatccacaaaatgcatgagcatacaacccaaatttaagtggtaattgaaggtttcctcgaagaggcagtttgtgattgaatagatgaagaataagcagctgaaaaccatgtaaattagaactaataaataacaaaggatgattagtattgaggtagagaatgggaatgtatagaatgcaaaaaaaattgagacatcgcaaggagagcagcaatttcagtacacttgaaggaagctagaaatatataccagggctagatttttaagatatttaatgccgtgtcaatgtgttggtattttataattttctgtagttccagacattagctagggtgtgctcacttaggaacacagctgttgaaattgtaaaatgagaatttgggtctcatacatttgaagaaaaaaatatatggggtttaggttcagattctgtacagacaaaggaaaagtatgggtggggaaaatgtgagacagcctgaggtccaggaaaaatggccacagaaaattttcgtattttcagataaaatctactcttcaagttagacctccctacgaaagatgctagttcaataatgaattctccacctggaaaaggacatttcagctccaagtccaggttgctttcatgccttaaagtcaccttatttgtatttcagaagcacgtgctacactagctttagggaatgaagaaccatgtgctgacagtgccatctagcatcaacagaaacaggaaccaatggcaacctaaataagtacagaaaaaaaggtggggtccaggaaccaagaatgactgctgatttgagcaggatttttacaatttgttttaaaacttaaacataatgcatagatgctgtggaattaaaaaatgcaacctaggccgggcgcggtggctgacgcctgtaatcccagcactttgggaggccaaggccggcggatcacctgaggtcaggagttcaagaccagcctggccaatatggtgaaacatctctacaaaacacacacacacacacacacacacacacacacacaaacacactagccgggcgcagtggcgcgcgcctgtaatcccagctactcgggaggttggggcaggagaatcgcttgaacccgggaggaggatgttgtggtaagccaagatcgggccactgcctggcgacagagcgaaactccgtctaaaaaagaaaaaaaatgcaatctaataatgtccagcaacgatacagggaagcctggcccatgctcacttttccagtcacctgctcttaagtagtgcacgggttaaagaacgatgtgagtgctagtggctgattctttcacttacaaacatgcatgtacacgattgtgttaccatggacaaacacataaaatttgattgtaaaactagttgactcttaactgtgacacattaaatccttgagtaaatgagtgtgtgtttccatacatatattcagtaccactacagttcacaaaatgaacgggacttcttaggttaaagccttgttaagttattctttaaaacgctttccaatctgatagagagctctggcgtattcgctcaagtttccgtggcgggtctagggctcctgaagccccacgggtctcactgctacccacatggctattaccgcaaccaccgctgccacgcagcccgcaagaaatgtgccaccgttctgagcggccgacaaacccgcagtgcgctacgggaaggtcacctgacagttggggagaacggcagcccgcaggggccgatcttcggcgcgcctgcacagcgcaggcggaattggggcgccttttctccttccggtttccgtttccgtgcgccccgagggtctgttccgcttatggcgcccgccgggagtctccctttcttcgcaagcgttaacctgcgttttactcgtaaaaatttgctttctaggcttcgtataattgttctggtcttgcactttatgtgtgcattagccttgagtttgcttgttgttttcccatgaaaaattgtattgtatttctgtaacagcccctcctcttgttacataaacattgaccagtaattgtatatccttccctctcaatattaacaattttatcttttttgcgttctttgaaaaaaacgaaatccttttcaaaaatactgaacttgtcatttttaagaaatgagatactactttaatcatttctgtattgtccttaagattctttatatattctttattgtttatcttttccactaatatacctttaatatgagaggacttgtagaggcttcagggtcacactttcgaaacccagagttttagtatctccttatagaatatttgtaatttaagaaaaattatacaaggttgaattttcaaaaatatatttttaaaatatatttaaaaaagtatttttaaatatagtcctccggaatgcaaaaggacaatactactttcagctagtactttttaagtgattattttccgccacgtattcttttgaaattatgcatttaggccgggtgcggtggctcacgcctgtaatcctagcactttgggcggccgaggcaggcagattgcctgagctcgggggttcgagaccagcctgggcaacacggtgaaacctcgtctctactaaaatacaaaagaaattacccgggggtggtggtgttcgcctgtagtcctagctactcgggaggctgaggcaggagaattgcttgaacctgggaggcggtggttgcagtgagccgagatcccgccactgcactctagcctggaggacagagtgcgattctgtctctacaaaaaaaaaagaaagaaagaaattatacatttaattgaagctcagaaaatatatgtgtgatgttttctatgaaatgaaacattgtttagatgagaaaataaatgtaaaatgcatttgccttttcaaagcagcaattagtggcgaagtgtgaatacaaaaccagtcttctttctgcagagaccatgtctgtcacccttgtgctggaatgaacaacatcacatatttttttgtttgcatatggcctgagggtcaaattctgcccagcatgtttgctttcttttttaaataaatatttattggaacacagctatgctgttcatttttgtattgccgatagctgccttaatgctacaatggcagtagttgcaagagacagaatgacccataaaaccaaaattatatactctctagccttcctatcacccactgttctgtctggtgttggggcaattcagtctttggtatgctaatttggatgagattcacacttgggctgttggagaggagtgggtgaacctgttgagttaatcagcaactccaagaggtccatttcccaagcatctttccttccataacttcacagtaattttcgtttccttatgtctcctctggccaatatttttctacttctggggtaggcggtcagaggaaagagaaaaaaaggaaaatggtgaagttggacccactgtcttggacctatgacgactcctggcagagaaaggttttcccacttttcgtttttgttcttgtgaactccctgagcagccactgtcatgacaacatgatggtctgagaggtggagtagaagagattggagaaaagggcgacagagtgagaccttgcctctaaaagaggggggtggtggtggagggatgggaggaaagggggattcttcactcttgagttccgttttcaatcctcgaacttttcctggagcccgcagtctgcaccacagcctcacttctgggtttctgcctgtcttaaattcaggcctggggataagtgagtggtaaaaattaaaattcatcaccaatttagtagtacttcacagtccagtgttattccttcatttctgttactacttagtcctcaaacagctgttccatacattttatccaagttttatagctatattcagtaggagagacagggcagaaaatactttttctttcctgaaaatggaaccctaatgggagcctgatgaattttttaattgaagccaaaataaaaaaattaatatgtgctcataaattcatatttatactcataaaatatgacattcaacccaagttcttcattttaacacttacgcctttttttttgagacagagtcttgctctgttgtccaggctggagtggaatggcatgatcttggctcactgcaacctctgtcatcagcgttcaagcaattcttgtgcctcactaccgggtcttactacattgcccaggctggtctcgaacttctgggctcaagtgatcctcccgccttggcctcccgcagtgctgtgattacaggcataaacctctacaaattttaatctacaaaaaacaaaattatattcgctttacctgtgtgacatttgaataatgacggtccatgcaggctttacatttcacttttatgaactaaaaaaaaattgagcctccacagggcaagtcctctgctgtgcatggaagataggcaggtgttcaaagcatagaaaggtactgctgccccaggtaatgcagtcaagagggaattcaagcatatggaggtgattttcattgctatcaagagtgtggtttaaaaagtcacagtaagggctggatgtggtggctcatgcctgtaatctcagcactttgggacgccaaggcaggtggatcacctgaggtcaggagttcgagaccagcctggccaacatggtgaaaccttgtctctactaaaaatacaaaaaaaaaacaatgagctgggcatgggggtggacacctgtaatcccagctacttgggaggctgaggcaggagaattgcttgaacctgggaggcagaggttgcaatgtgctgagattgtgccattgcactccagcctgggcaacaagagcgaaactccgagagagagagagagagagagagagagagggagggagggagggagggagggagggagggagagagagagagagagagagagagagagagagagaaagtcacagtaaggcaccctagcagagtgaaacaaaaactaaaaaaaaatcgtgttccagcataggcctgagcatttaaaaatcgaagaaccgtggaaatattaacaattacataaagtgcatctagattttgaagtcatttcatgcaatattcatgagttctgggtttatcagttattcctcagctttatttggtgtatcagttttaggaatgtgtatgtataatcgtcaagtcttctatctgaaaggtaccagaacaaagcctggctttaggatcagatcctgggcaggcaaaagagcgctagaggcggaacaagatatccttcctatctgaagtggccatgggttttcaactgacagccttctcctcatccacttccaccttccccgatgctctcagaggtagactatgaaggcctctccctaaccactttctagctgcctcttcatatccttagtgtatcatttctccaagctgtaggtgtcctgctaattgattttgaatttttatgttcttctgtgtgcgaatgattaaatattaaatacaaaagtcggttcatttgtttgttttttccaggcttgtaatctctaactttcatttttgctacaaagcctttaaaaaaaaaattcagttactctagattcagattttaattaaaatttatttttgaaggtaaacatcttacataaaatttggctaaaagggaagaaaaaaaactacctaaagtttatgtggtcatcctacttgcaatattttagcaagcatgatttttatttaatgagtttcaaaaattttgacaatgaatactatcacagagactaagagtgtgtgatttcttccactttcatagcacagatgctcctcgacttacaatggggttatgtccccaataaacccatcataaattgaaagtatcttaagttggccaggcacggtggcttacgcctgtaattccagcactttgggaggctgaggcaggtggatcatgaggtcaggagttcgagaccagcctgaccaacatggttaaatcctgtctctactaaaaatacaaaaattagctgggcgtggtggtgcacatctgtaatcccagctactcaggaggctgaggagaagaatcgcttgaacccaggaggcagatgttgcagtgagccgagatcataccactgcactccagcttgggcgacagagcgagactccatctcaaaaaaaaaaatatatatatatatagtgagttgaaatgcatttaatatatctaatctattgaatatcattgattggcccagccttgagcacttaaatttgctcaaaacacttacattagcctacatttgggcaaaatcatcaaacacaaagtctattttataataaagtgttgaatatctcatgtaattcataaaatactggaagtgaaaaacaatggttgtgtgaattctcaaagttcagtttctactgaatgcttatcactgtcacaccatcataaagttgaaaaattgtaagttgaaccatcttaagttggggactatctgtactgtgaaattccaacttctggacagtcaagaaggaagccagtaaaatcagaaaccagcggctttgcagccaagtaagcagggaggccaagcgtattccttggatggtctgcggtgggcagtctctgccaggatgtgcccacttagcacacacagccctgtacatcagcctgcaggaaaggcaccttggccagagcctcgggctcaccctagagcactatagaaaggtcatctggctgtctgggaggacagtagcccacaggggctgaagctgggcacacccactgggtggctcagggccagttttataatccctaccccctcaacaaacacactccactcttgaccactgcactccaacctctgtccctgcatcctccaccaggctttacacctgcaattgcactttggataataacaggcatcattggcaatatcttacactctatcatttcagataaagccttgaaaaatatgtgcaattatatctgtgcttctttgtggatatatgttttattatattcactatatgattataataatattagttactactagtatttatcaagaatgtagggctgaagctgggcacagtggctcatgcctgtaattccagcattttgggaggctgaagcaggtgtatcacttgaggtcaggaatttgagactagcctggccaacatggtgaaacctgatctctactgaaaatacaaaaattaaccgggcatttatgcctgtagtctcagctactcgggaggctgaggcacgagaattgcttgagcctgggaggtggaggttgcagtgagctgagatcgtgtcactgcactccagctgggacaacagagccccactctgtctaaaaaaaaaaaaaaaaagaatgtagggctgggcatggtggctcacgcctgtaatcccagcattttgggaggctgaagcaggaagattgcttgagctcaggagttcaagaccagcctgggcaacatggcataaccctgcctctacaaaaaaaaaaaaaaaagatctatatacacacacacaaatgccaggcatggtgacacatgcctgtggtcccaactacttgaaaggttgaggtgggaggatcgcttgagcccagaaggtcaaggctgccgtgaggcatgatggatccacggcacttcagcctgggtgaaagagcgagaccctgtctcaaaacacaaacaaacaaaaagggtgtagtatattcctggtattgattgtgcttttcatagtttaaaagtaagacttggtgtaaaggtatgcattgtgtagtataaatgcacagagaggaaaggagagattgggtacaaattcaggaaggcatgaagtgttgatgtcatgacacttagcccatccttgctctgcacagaccacgtttctcaccactgtgctggtatgtagacaccagcatgatcttctgaagcctcggataatttggtgtggatagctttcttttggattcttttaaattttgttatcttaaagctttccatagtatttcatatggataggccacagttactttccatttactattatacttttatatattttttcttattttgatatgagaaacaatgttggaataatcatgcctagacataaataagccaatttcaaaatgtttgtaggggagactcatagtgttgccagaaaaaggggccctgacccagaccccaaaagagggttcttggatctctagcaggaaggaattcaaggcgagatgcagagtgcactgaaaagagagagtttattgaaagctactcagctatagagtagagcatcctcagaaagcaagaggagaaatgccttgtatttaagttttttttatgtaagtgtcttgtctatgtaaagactaaactaagctgtgtctacgtgcagatgggttgagagcatgacaaaatttactattctgttgatttaaagaaaatggtccttgacattttagtaagtacatcaaagccataactgtaagtaacttgaaagcatatattgttatgggtattgggacatctggattttgtgttgttgtaggagtgtatccttgcaccggtagcctaggtattgttaagctgtttcctcaattataaacatgactatgggttgtgaccagcaaggaatgtgccttagttaatctcaagatggagctgaacttaaaatgccattactttggctctaaccagctcctgcttccataacagtggggtcaaaaggtgttcctttaaaatcttcctagacactgccaaattgcttttggaaacttctcacctggtgagatggcatgagtatctttggctcatttttctacatagacttggaaacagttttatgtttataaaatatgtatcacctcatttataaatttgtttgaataatttaaccattttgcttttattagctattttgctactctctgttttccttgcctgagtctttcccacatctctgcaacattgtatcatttcccacacctaaaaccaaagagggacaggcaagccagtggagagagcagaggctgatgagaacgaaggattttccaggaaggaatctggggctgtgtgtgtgtgtgtgtgtgtgtgtgtgtgtgtgtgtatgtctgggtgtgtgaatattgtttttattagcctgtagcccacgtgttgcatggccatatttttactatcaggatataaaacacacttacacacagctgcatacaaatgcaatgagtttatttttcatatacatttcaaaataatagcgtgaacagaccagaactcttcttcaaagttcaagaatgtcctcatggatccagcatccgtctggtttctgtttctgcattctcagtacatagcctcacttctctttctccaattttggaggatgtgtaaaaaattttattcttaaccaaacattagtcaggctccggaacgttctcttaactccatccatgcactttcttgtaaaatgcagttttaacaagaacactgctaagttagtttagcaagacccccacaccttagacatctgatcaccttctatatcttatcaggttcctcatcctccaccatcccttaagtgatcatcccagcttgtcttcagcaagaatcctattagatcaatttagccagaatccctcttgcccctgatgttaattcttagtaattttccaaccactagtccccaccctgttccttggctataaattgccacttgcccatgctgtacttagagttacttagagttgagtctcactctctcccacactgcaaggccccattacggcggtccctaaatctattgcagtggtcccgaataaagtcttccttactatgcattaacacgtatcattgaatatgactttttctttaacagatactttgacgaaggtaattgggactcccatcaagtctccacacagctagcagccacgtggggcacttctccaggtaaggattgtccctgttccacttatgttcctgtcagtaaaatggtaggttcagtgtcaggctttaccattttcttcagggagagacccatctgatatttagtcagccatcagatgggtccagccatagcacacattagctgtgacatgacgtcgtttatgacaatgactttgagcagagttgcacacctaaaaagggactcaattaaaattatcattcattttagttatttctcagatgcatttattatttccattttccaaaactcctaatgttacatttcttcttcacatgttagatatgaacaaagtaagactaactgtggccacatcctctttacttaggaccctacccaaagtggcaggaatgggatgtaaagtgacataatcagacacagtcaaactggcttttaatcgttaagtatcattgtcatctcaaagcacttggcatagttactgaccccttaaatgtcctttctccatcttatcttctcctttgttctctgtatcatcttccggtcctatagaaatatatccccacgagcacacactgaggtctttttttttttttttttttgagacggagtcttgctctgttgcccagactggagtgcagtggcatgatctcagctcactgcaacctctgcctctcgagttcaagcgattctcctgcctcaggctcccatgtagctgggattacaggcatgcgccaccatgcctggctaatttttgtatttttagtagagacaaggtttcaccatgttggccaggctgctctcaaactcctgacctcaggttatcctccggcctcggcctcccaaagtgctgggattaccagcatgagccatcgcacctggcctcactgaggtcttaatgctgagttgaactttgtctctggccatgagcatcagtccatgtattataataggtttgggttgggtgtggtggctcacacctgtaatcccagcactttgggaggccgaggcaggctcacaggtaaacaatttagacaaagttttcacattctctgagatttgtatacattggagattcagaaaaatgtaaccgaaaattaaactataggtggaatagctgcctttgggggctgagaagacaggcatcagacctgggatagacaagggaggcctcttgttccttgaaatgataccccagcccatgaggtctgcatgccaggaagccaaatgagtgaggatggtctgtgtccgctggggaggtccctggatgttgccaagagggatagggtctgggaaagagtgaggatggagtcaggcagagaggaccccccaggctcatggatggactgacctgaggacttatattaagtcataggacagtagagaaagtaagagccaagcataatgtaatcctaacaatgtaaaaagtattaatcattttattattagttaatgtcactgaactgtacacttaaaatggctaaaaaggtaaattttaggttacatatattttaccgtaatataaaatgacaaatatattagaaatgacttttttttttttttgagatgtagtcttgctctgttgcccgggctagaatgcagtggcacaatctcggctcaccacaacctccgcctcccaggttcaagtgattctcctgcctcagcctcccaaatagctgggattacaggtgtccgccaccatgtccaactaatttttgtatttttagtagagacaggtttcactgtcttggccaggctggtctcgaactccagacctcgtgatccacccacctcgggttcccaaagtgctgagattacaggcgtgacccaccacgcctggccaggaatgactgtcaactatattttcttaacatatgtattcctacacaacatcagttttgtaatagtttatttttgttttgttttgcaatttttttcttttattgtaaggaaagaagtacattttttcagcgtgtaagaatgcaaaagtaattatcagatgtttgtcacatcttaacaaaataggaccttattttcctagatgttgctgcattcagtccctttcttggtatggtaaaagcatcaatcagccagggaggcaactataaatacagaagagcagtttcctacagatagtcaaccatgctacccctcttactgacttaattttaatattggagcctggcacaattaacctagtttcctcgtaaacacaagaacaacgtactgcaatcaatgtaggcatatacaggctcttaaagttctgagaagcagcaagtaagttcatcatttactaagatccttgacattcttctgtttctgtgaaatttatgcatctgtgagaagtttcttttctttttttatttttttttgagacagagtctcgctctgtcacccaggctggagtgctgtggcacaatcttggctcactgcaacctgaacctctggggttcatgccattctcttgcctcagcctcccgagtagctggaactacaggcacacgccaccacacctggctaatttttatatttttaatagagacagggtttcaccatgttggccaggctggtctcgaactcctgacctcaggtgatccacccaccttggccttccaaagtgctgggattacaggcgtgagccaccgtgcccagctgagaagtttcttatactagaagaaaaagaaaatttgatttattttaaaatataatggtttagtctgtagcaagtaatattaatttttttatttttttatttttgagacggagtctcattctgtcacccagactggagttcaatggcacgatctccgctcactgcaagctccgcctcccgggttcaggccattctcttgcctcagcctcctgagtagctgggactacaggcgcctgccaccacgcccagctaatttttttttgtatttttagtagagacagggtttcaccgtgttagccaggatggtcttgatctcctgacctcgtgattcacccgcctcggcctcccaaagtgctgggattacaggcatgagccaccgtgcccggccctaacacgaattcttaagagaggtgaaccagggatgggattgtggatcaatcatgcaaagaccgactcctctgggcttcatttcctccatactgaatgtgcatccctacatgttcatgttgttgtttcataggtagtgcagggggtcagaataggatacccctggctgggtgtggtggctcacgcctgtaatctcagcactttgggaggccaaggcaggtggatcacctcagatcaggagtttgaaaccagcctggccaacatggtgaaaccccttctctactaaaaatacaaaaattagccgggtgtggtggtacacgcttgtagtcccagctactcaggagactgaggcaggagaatggcttgaacccgagaggcagaggttgcagtgagctgagatcgcacctctgcactccagcctaggtgagattgaaactccatttcaaaaaaaaaaaaaaaaaaaggatatcctcaattgcggtgccctggcatactgagtattttaagctgaaggaaattgagaaaaccatggaagcaggaaggccactctctgatttgctcccacttttctcccctgaagcaggtcataaaagaattatctgccctacctgtcctgaaagtaggtcataatgggaccctcatttcagaggagttctgccctatccctggataccaacaaagatctgaacaaacaggtcttatgaatttctccccaggtaattactattagatgataccctttgttccccaaagctatttcttcaaaactgtccataaaaatacacctatccagctgggcacagtggctcacacctgtaatcccagtactttgggaggctgaggcgggtggatcacgaggtcaggagttcaagacaagcctgaccaacatggtgaaaccccacctctactaaaaatacaaaaaacaactagctgggtgtggtggcacaagcctgtagtcccagctactcaggaggctgaggcaggagaatcgcttgaacccaggaggtggaggttgcagtgagccgagatcgcgccattgcactccagcctgggcaacagagcgagactctgtctcaaaaaacaaaaacaaaaacaaaaaaacaaaaaagccccacctatcccttggcctttgcatcttgatttctgaagactcacatgtcatgtaaaacttacgttaagtaaatatattatgtttttctcttgtaaatctgtcttttgtaatcaggatctcagccatgatgcattttggcttgtcagaaataatcacaacatgtggagaaatagataaaatgccatttttaaaattattattattttttatttttttgatagagtctcgttctatcgcccaggctgcagtgcagtgtcatgatctcagctcactgcaacctccaccacccaggtccaatcagttcttgtgactcagcctccccagtagctgtgatttcaggcatgcaccaccacgcttggctaatgtttgtatttttagtagagatgggatcttgctatgttggccaggctagcctgaaactcctggcctcaagtgatctgcccgccttcgcctccttaaatgctgggaatacagttgtgtaatggtatttttttttgagacaaggtctcaaaatggcattttttttgagacagggttgttgctctatttaccaaagactatacaagattatgtgaacttaaaataatattcgggttaatttctgtatttctaagttttaggaatacttagttatgtaagcatttacttccctttaagtcaattaaatcctcttttaaggaactttataaattaatttggtagtatcattgggcccagtagagttttttttttcttttttttgagacggattctcgctgtgttgcccaggctggagtgcaatggcgcaatctcagctcactgcaacttctgcctcctgggttcaagcgattctcctgcctcaccctcccaagtagctgggattgtaggctcccgccaccatgtccagctaatttttgtatttttagtagaaatggtgtttcaccatgttgatcaggctggtttccaactcctgacctcaggttatccaccctcctcggcctcccaaagtgttgggattacagggatgagccaccacacccggcaaatttcttttaagatattttataaattaatttggtaataccatcagaggcagaaaaatttcacacagatggagagacatacataaacatacaggcaaatatcaaaagagatcttctagctatcattctaaaatcttagccatgaatcagaaacacatagtaatacaaagtcactgttttatatgtaacagttatctctcatattttctccatttcatattttttccctattgtccctggtaaatgggacaagttaaggctatgtactaaatattaggcctaatgctttttaccaatattcatggagaaggtttttaagatcttcatttgccctgtgaagcccttttgaaggctgtggactaaatgttaaatgagtcactgcaaagacatctaacagctatcgaaatgtctccaccacccatctgagtggataaaatatccagtctatttccaaatagtctttttttcctcttcagccttggtacttacttttggaggactctgagtcccttgacagcagggtggactaaagtttaagagaagaagtctgacaggggaggaagacagagagatggagaaggtaggagtttgaagggatcatatccaggactcaaaggaactgaatggaagattgaaagtggcaagagtaggaaggaggaacagaaagagggggaaggaagaggtcttaagggaaccagctgggggagatattaaattccccaaagaggctagtgaagctccaaattatccttagcaaaatcaggccgggtgtggtggatcacttgaggtcaggagtttgagaccagcctggccaacatggtgaaaccctatctctactaaaaatacaaaaattagttgggtgtggtggcacatgcctgtaatcccagctactcgggaggctgaggcaggagaatcgcttgaacctgggaggtggaagctgcagtaagccaagatagcaccactgtacttcagtctgggtggcagagtgagactccatctcaacaaataaataaataaataaataaatatccttagcaaaatcatgccaaaaagagggaggtaggcagaattgtgaaagcttatagccaacagaggttcaagaaaaggctttttgtcaatggataagtttacatgggaagatccggatcaaaaggagagaacagagaggacttaagaaaattgttcctattggctgggtgtggtggcttatgcctgtaatcccagcactttgggaggctgaggcaggcggatcacctaaggtcaggagttcaagaccagcctgatcaacatggtgaaaccccgtctctactaaaaatacaaaaattagctgggcatggaggtgcacgtctgtaatcccagttattcggaggctgaggcaggagaattgcttgaatctgggaggcagaggttgcagtgagccgaaatcgagccactgcactccagcctgggtgacagagtgagactctgtctcaaaacaaacaaacaaacaaacaaacaaaaacagaaaagaagaaaagaaagtttttcctataagtctgtaactatcagcttcccattaggccaactattgatcatagaggtcttaaaaaatcctttcaggctgggtgccgtggctcatgcctgtaatcccagcacattgggaacctaaggcggtaggattggttgagcccaggagttccacaccagcctgggcaacgtattgagacctcatctttactaaaaataaacaaaattagctgggtgtggtggcatgctcctgtagtcccagctactcgggaggctgaggtgagaggatcacctgagcccaggaggtcaaggctgcagtgagctgtgattgtgccactacactccagcctgggtgacagagcaagacactgtctcaaatatatataatttttttcaaatatcttatcaggttttggtcaagaggaaaggtaaatattcctgatagtacattcccattaaaaaaaaatgtacccgttacaagtgacttggaaccaaaatccatagattctttcatggttctttatcggtatggtgatagggttttcatattcatgtgtgagatgtgcctccctcagtccttgttatgacatcattacgtgtctgacatgacaaaaaggaaaagagaaaaaggtggagaaaggtaaaaaataggaaaagaaaaactgaaggaaaaaggaaaaaaacccaatccgtaagccttttatgacttacccatgaatgcagaggcatcttcaaagagggtgcaaaaaatgcagccctctaaagatgccaaaccactctcaaagatagccaaaagaaaggcaggcctagatactccccctgagagctggcaatagatgttagctgcaaatgggttgcaacccacatgtctgtccagctgtattcccacagccccccaacctgatggttggctgcttgcacacacaagaaccaacaacttgtacgccccatcaagtggaaaaccaagccaaattcttttttttttttttcctttgagacggagtctcgctctgtcgcccaggctggagcgcagtggtgtgatctcggctcactgcaagctctgcctcccaggttcacgccattctcccgcctcagcctcccaagtagctgggactacaggtgcccgccaccacgcctggctaattttttgtatttttagtagagacgggctttcaccatgttagccaggatgtgtcttgatctcctgacctcgtgatccgcccgcctcggcctcccaaagtgctgggattacaggcgtgagccaccgtgcccagccgaaacaaagccaaattcttgacacaaaatgacagaaacagaaaagcaatagctgctcctgggagggaaaggatcaataaccaataggcaccacaaaatcaagctacagtcacaatctagataatgaatttttataatttttttcctatccatctgcattgggaaaataagggacaaggagtttttactttcttctcttgaccaggaactactgacagagatctgggagagctgactttggtgaaaattctcaccttgcacaggcttgtgtctgttttccagaatcctacctgcagactccagaatgaagtgtcccagctgtccctttctcgttgccagaaacttctacccttctcattcctttgcttgtccccctgtaacaagagacagattaatgagagaaaatcatgcaagttgatttactgtatgttttatgtaacatgagtcttcataagaaaactaagcccaaaagaagcagttaaacctgagtgttttttttgctggtctgatgaagagcgaagagtcatggagaaatgtaatgggaccaaaaggtgtcagctaagtgtaataaactgggggaaacagcaagggctattccttcagattcctctcagtgtccctgtgtcttcagagataaagatcttttcctctgggtaaagcgtggcagctctcacatgagggttttattacttgcttcagcagaaagtcaaaaagcccttcccaggttttatgacctctttcagcgaaaggtgagaaagtccttcctacacatttggtttctgaaattccttcagcttaaaatattcattatgccaactttccatattttgggttggcatgtcctgaatatattgtcagagcattacagaaaaaatacacccaaacacacacacacacacacacacacacacacacacacacacggacaacacattccctatgactatcttaaaattgattaacctcaaacatttaattttggatgactgagtcaaaaagagaattgaaattgccatcacatatctggtcaagctgaaagatggcatttggtattggaaattgatggctgctggtcatttaacacccatgcctcagttacatatctggctcatgagataagaatgctaaacagtataaacaagacacctcagtatgaaaacgttctgccgttacaaaggtactctctttgtgttactctgcattctctcccagccctgtagcaatttatcctttgtccatatattgaagatagatttgtttacatctactcttagccttcctgaatatcctttgctccaggagagccttaagccaagggtagaaatgacaagacagactctatgtttgcagaacaccacatagtcacagcgatgcaaatggaaaggaaaatatgagaacaaggtctttcaatccagatttggcctatgtttgtattaaaggtgttattcccatgtaagaccttaagacataatattaataataattcagctatgaaaggttcatgttgagttctacttgcatgggcaagctattaggtagaagttaaagatgcacagaacacattagttctttctaggtatatccttagcagagcaaaattgcaacccaagttagaacaggaaaaacttgatgaagcatgaaattaccagctggtctgatgggagatatgatgtggccctgaggtacagtaggtggtgcctgaagcatggtgacagtagtggaaacaccttagggtgacccacaattagtcactctcattcaattccctttccttgggtgtgggaagaacctgccaatagcatgtggcaaaggatatcgttactgtgtttatgctatgttatatgtcaaaagtgaagatatagtgcagatgtaattaaagaaatcagttggctttgagttcattaaaaggcagaatagcctatgtagacctccccttatcagatgagccacttaaaatggctcctaggcagatcacaaggtcaggagatcgagacccccccgccggctaacacggtgaaacctcatctctactaaaaatacaaaaaaactagctaggtgtggtggcgggcgcctgtagttccagctactcgggagactgaggcaggagaatggtgtaaacctgggaggcggagcttgcagtgagccgagatcgtgccactgcactccagcctgggcaacagagcgagactccgtctaaaaaaaaaatggctcctaggccttccctgatgtcagggaaaatagaaaagactctgtctcttcactgttgcctttgaagaagcaagctgccatgaattctatagccattgtaaaatgaattctgccaacaagcaaatgagcttaaaaagtaacagagtctgcgcacagtggttcacgcctgtaatcccatcactttgggaggctgaggtgggtagactgcttgagcccaggagtttgagaccagcctgggcaacatggtaaaacttcatctctatagtaaaatacaaaaattacccgggcacagtggcatgcacctgtagtcctagctgctcaggaggctgaggtgaaaggatggtttgggtccaggaggcagaggttgcagtgagtcaaaatcacccctctgcactccagcctgagtgagagccagactctatctaaaataaacaaaaacaaaaacaaaaacgtaatacaggccactgacaccttgactgaatccctgtgaaatatttcacctgaaaatccagctaacctgtgcccactgacccacaggaatggagataatatatttacattgttgtaaactgctaaattgactggatgtggtggctcacacctgtaatcccagcatcttgggaaaccaaggtggggggaatcacttgaggccaggagtttgagactagcctgagcaacgtagcaagaccctgtctctacaaaattaaaaaattagccgagtgtggtggtgtgtgcttgtagtcctagctattctggaggttgaatgggaagatttctttagcccaggagttcgtggttacagtgagctatgatcacaccactgcactccagaatggatgacaacgtgagaccttgtgatatggtttggctgtgtctccacccaaatctcaccttgaattataatcccatgtgtcaagggtggggccaggtggagataattgaaacatggggggtggtttcccctatactgttctcttggtcatgaataagtctcattagatctgatgcttttataaatgggagttcccctgcacaagcgctcttgcctgccaccatgtaacatgtgcctttgcttctcctttgctttcctccatgatggtgagggcttcctagccatgtggaactgtgagtccatgaaacctctttctttataaattacccagtctcagatatgtctttattagcaggctgagaatcaactaatacaccctgtattaatgtattaatacatgaataaaaaaagttgctaaatatgtagaactacactctgtgtcttccctttagtgttaggaagatcaaataggcactacaagagcattttcttggtaaatggtatctaaattccctcttatcaatggcaattactcatttggactgctaacaccataggggcaaaaatcctgacatgtatgaatcttgtgggagaagcacttggaaaaaaaacaaaaacaaaaacaaaaaacagagacaaacatttctgagcaaaaatgcaagctttttaaaaaaaatagtttgttttgatcagttcacatcatgtaggtcatttcatccggcctcattggcatataagtagtatatattgagctaggcgtggtggcttacgcctgtaatcgcagcactttgggaggccgaggcaggcggatcacgaggtgaagagatcgagaccatcctggccaacatggtaaaaccccgtctctactaaaaatacaaaaattagctgggcatggtggcgggctcctgtagtcccagctactcgggagagtgaggcaggagaatcacttgaacccgggaggcagaggttgcaatgagcgaagatcgcaccactgcaccccatcctggcgacagagtgagatctgtctaaaaaaaaaaaaagtagtatatattgaaagtataaaggggtgaaccactttgaattgcgtatgacaaaagaagctcagagttcaggtgaaaaatgtgttattacaaactcaactatcaatttaatctgtctttaatgtatgagtcaaaattaagtgttttctgttggggtgatcggacccaacaccaggccgtgggggcgatgaagtcccacggagtcaaaggaatgagaaaagacaagttaagagagaaactgggaccaggggccaatgctagtatggaggctgcgaaggccccaagctctgggaccccatgctatttattggtgatcaaacaaagaaacaggtggcgaggctgtgggggttgaaaggaagtggtgtatcaagcaaatgagctacagctgtgatggtttagcattttctttgaaacatatggctacttgagataatgggagtgctagaagcaaggagccagcaagtctagacacattccaaaggccacaaggggttttagaccctggaccccagacacgttccaagactcttttacattatgtcagacatccaggccctgcctcaaattctctcccaacactcagcttttctcccaacactttctattacaaacatcaacggaaaaatcaatgatctgtttaaaatattgtaaataccatcactatgtttgaagatatgttttaattttttattattcctttaattaaaagaactgtatgccaattaataagctgttgccttttagatcaaaattaatcattcattgcctgctctgtgaaaattgagtcagatacccttaaaaatatattgtgttgcaatagtaagttttttcagtaattgaaggtggttggacattgtaaaaagagattttcctttctgattccactgtggtctctcagccgtttcccatagcatgcatgcctttctccagcactatatttctacagtatgcatgagcaatcctgcagcaacaatggcttttctagcatcaggctcctacaacgcatgacagtcagcagcactagtggtcagccacttcctatatcccctacccttaggtggtttctagtgtagtgcttccaataatatacctacctgtgaacacctttccctggcacctaagtgggaagatttctggaaagttccactggtgccgcacactgtgactattctgtgtagcctctaacaagctctggattgcaatccacttatagtaaataaatgtccacttcaaacattccctcctcaaattcttgtgttttgtctgcctcctgattggaccctcactgaaagaattaatgctggcattgttccaagagatatttccacagagatgaatctgggaggttgtgttggtcattcctttatgtttgggcacattccacagctccttgtcaatgtgcaatgggatactagcaacctatgacatgcagtggtatcacaattaatcaagcaatgacctgtggttgattgtggcaaagtgccaactgaaacacgtgccttgggagcccgagtgactgctgcactgaatgttatggcagtcaagataactgtaaggactgtggggtggaatggattcagttgagggtccttgagtgattacgaacagaaaataacaagcttaggttccttaattctcagttcaagccacggtttgaaaacctgagaacttccatggcgactataaaggaaattcatttgttgtagctgcagggctgatattgttaaatatcaaaaccaagaatgagatcctgaaacttggaatgggtcaggaaacttggaatgggggaatctgtttagactcagttgaaactgaccatctggaaacagaaagtcaggctgagcctttcttaccagtttaagtagcttgtctctattgtttgaagaaaatatctttcccttgcacaaaagctgggttagataccattaaaggggatgcccatttttcttaaagtcccctacaaatcatcactttttgctagtagcatgactagaccccataactaggattgaatagcaacctattcctaagggataggtacacactatgacctgtaggaaacagctacatgcaaaaggaactgtgacatatattggaagaaacctggggaatgttggaagagcattctaaggccgttatactaaggaggacaaaatataacagtagattgggttaattaatctcagtgctattactggggattcaagatttattgtgctgcaggcatgtggctcacacctataatcccagcactttggatgccaaggcaggaggataagatgagtccataaatttaagaccggtttgggcaacataaagagaccttgtatctacaaaaaataaataaataaataatccagtgagagtggtgcacctgtagtcccagctacttgggggctgagatcagaggatcacttgagccctggaggttgagggtgcagtgagctgtgatcatgcaactgcagtccagcctgggcaacagagccagaccctgtctcaaaaaattaacaaaaaaagatttattttgtagttctcctggtagagatctttcatctccttggttagatgtattccttggtattgccgtcttaggtagaggaagagggctcaaacatcttgcttatgtgataactttgccaaagacacaatgtacaatttgttttaaaggccagtgagggatgtaccagtaatcagaatgttttggcaaacagaagactttggtggtagctaactgatcacagggtccctagaatgaaatagatgagaagcatacttagagtattgtttgatctctatatcaagaaaagttccgggtctggtagtcaaatgttcaacagatgcctacctagctttcaaccctaagtcaattcacagttgcagagtgataccacacggaccatgaaaagaacacttgtttgtatgactgagacaaaaaagaatgtcatcgtgttctaccttacctgggaatatgctcaattggtgacaaaattgttgccactctgtgcatgaccacaaaagtaccgcaggtattgattttgaagttacacataaactttagtgagtgggcatatttgcaaatatgtaacctgagaataatgaagattaactatctttaaacaacataaggagtcaacatcagtttctgaagtaaaataatgactaagttaaattttcaagggcaaattcagattccaagtgcacagaacataggaagaaaaggacatgcaaatcagaaaaattcacaagtgtaatgaggcgagaagggacatggcgcaccaattacaaaggaatcagaatgatctgttcatagagttgtaaatggggttgtggaggaagaaatgaggatgaacagataggcaagacaagttcttttccttctatgtaaataagagaaactgagaaattgtaacgtaagacaagatctaatattatttttggacttcagaatggtattgcataaatgcttaattgttcctgatttcgggaggggaaaatggaaatagcatttccgttgcatttttgtgaacaaaatttgagtgatcatgttctttgttgcatgtggtagatggagaggtgaatgaaagattcagctttcttcctgtacttgaggcatctgtgaattgggaattcagacaaacagataagcaactaattctggatataaaatttgtgatttaggctatgcattctactggggaatttcagatgtataggaatgtagttgaaatttaagtggtcagggaatgctatctagaggaagaaaattatgactagagacaagaataaatagtagtaacttaaaaaaatatatatcagggaagaaaaaatggatttttgttccaggaaagaaactaagtatgaacagatgatgaactatttcaggaactgtgtctgcaattcgttccttccagtgggttcttggtcttgctgacttcaagaatgaagccgtgcaccctggcagtgagtgttacagttcttaaagatggtgtgtccagagtttgttccttcagatgctcagatgtgtccagagtttcttccttctggtgggttcgtggtcttgctgacttcaggagtgaagccacagaccttcgcagtcagtgttacagctctcagtccggagttgttccttcctccaggtgggttcatggtctcgccggcttcaggagtgaagctgcagacctttgcggtgttacaagcgttacaagctcgtaaaggtagtgtggacccaaagagtgagcagcagcaagatttattgcaaagagcaaaagaacaatgcttccacagcgtggaaagggaccccagtgggttgccactgctggctccggtggccagcttttattcccttatttggccctgcccatgtcctgctgattggttcattttacagagtgctgactggtccatttttacagagtgctgattggtgcgtttacaaacctttagctagacacagagcactgattgttgtgtttacaatcctttaggtagacagaaaagttttccaagtccccacccaacccagaagcccagctggcttcacctctcagaaccacagatacaaattattttatttacctgaatcaatctgaaagcatatgctggggctggatgttgaggatacttaatggcacattaattctttgattttgtatatgtttagatacattcattagctacagtttgcagcttcctaacagggattccacagatatgactgtaaattgagaattttggtttcccagtgtctgaaaagtggttaacccaaagttttggctttagagaaagagtctatacaggcaaaagcgtagagggtttggcagagaaaaaacaaaaacaaaaacaaaacatcctaagggccaaaggaaatggttgcaaggaaaacggtcaaaaacttgcatcattctcttcatccactcacaccactctatgcaggatcccaaatcagtccttgaatgtttcggcacaggttccattcatgctttccaatggaaacttcatttggtttataggattcaggattgtggaaccatccggtatcaagaaaataaaaggccatgaaaaagtttacagaatgttggtataagcagctgctagggatattactgagttttaatgggagagatagtcccagaaagctggaagaagaaagatcagggccaagcgcggtggctcacacttgtaatcccatcactttggaggcagagaggggcggatcacttgagtccaggagttcgagaccagcttgggcaatgtggataaaccccatctctacaaaaacatacaaaaaattgctgtgtgtggtggtgcacgcctgtggtcccaggtatttgggagactgaggtgggaagatcacctgagcccaggaggtggcagttgcagtgagcagagctgaggtctggccactgcattccagcctgggctacaaagcaaagtcctgtctcaaaaaaaaaaaaaagatcggagcaagaaaaaggaaaaagatgggtaaaaacatagaaacgactaagttcatttcagcaggaatatatttttaaatatatttcaaaactgaaacaatgctatgttttgctgcagtgtgtgagggaacacaattcaggctaatgcacagtaaaaatgcagggaagcctggccccgtaaccacttttaataccacatactacagttaacagttggtgagaaccctattaggctgatttcaattacaaacatggatgtacaggagtatgttttaatggcacacatgcatagttcatattttattagaaaatctgttcaggccggctacagtggctaacgcctgtaatcctagcactttggaaggctgaggcgggtggatcacctgaggttaggagctcaagaccggcctggccaacatggtgaaaccccgtctctactaaaaatacaaaaattagctaggcatggtgccgcgcgcctgtaatcccagctactcaggaggctgaagcaggagaatcgcatgaacccgggaggcagaggttgcagtgagccaagatcgggccactgcactccagcctgggcaacagagcaagactccctcttgggaaaaagaaaagaaaagaaaagaaagaaagaaaatccgggctgggcacagtggctcacttctgtaatcccaacattttgggaggatcacttgagatcaggagttcaagactagccttgccaacatggtgaaaccttgtctctactaaaaatacaaaaattagctgggcatcagctactcttgaggctgaggcaggagaaaggcgtgaacccgggaagtggagcttgcagtgagccgagatcgcgccactgcactccagcctgggcaacagggcaagactccgtctcaaaaaaaaaaaaaaaaaaaaattagctgggcgtggtggcatgtgcctgtaatcctagctacttgggaggctgaggcaggagaatcgcttgaacccagaattcagaggttgcagtaaactgagatcctgccactgcactccaggctgggtgagagagcaagactccgtctcaaaaaaaaaaaaaaaaaattaaaaattaaatccaccaaattagctcaagaacacttccttgactggctcagaaatcccatccgattttaagatagatgttaaaaaataacagggaggaccgggtgcggtggctcagacctgtaaacccagcactttgggaggccgaggtggggggattatgaggtcagcagttcgagaccagcctggccaatatggtaaaaccctgtctctactaaatatacaaaaattaactgggcatggtggcgtgcgcctgtagtcttagcagctcaggaggctgaggcaggagagtcgcttgaacccgggaggcggaggtggcagtgagccgagatcaagccactgcactcgagcctgggtgacagagtgagactccatctcaaaaaaaaaaaaaaaaagacacattatttcattttaataatgttagtcaattttttttgttgtcgatgagttgcgttttgttcattaagaatcagctgtaacatttgttgggacttggtagaagataactgctaggtggttgtagctgccaggcttttaatgagaggagcttagtttagcgaaaataaaagaaaaacaaagattaatatttggaataaactgtaaactcagcttctgagtccagagatcagccagtcaagattgtttagacttgagcttatctttagatggtgaagttaggaaggtagtgacagtctaatgagttttcctagtttacagtttgtatgtctttggtgattacatccagtgttctggtgaacttcctgaggggcccacccagcaacagacacaaaggtgatttatttgaaactgtaggaacgaaaaagtaatatattttcatcacccattacaaggttaacgagtgagactcctataacaaaagacatattaataagaaaaaataatatcaaatgtagttactaaaagtattatgtgacatgggagcttttagaaatgaagatcaaaagaaccagggagaatcctgggtttttttgtttttgtttttgtttttaattgagacaaggtctggctttgtcaccctggctggagttcagtgacacgatcccaggtcacttcaacctccacctccatgggctcaagccatattccacctcagcctcccgagtagctgggactacaggtgggtgccactgcacctggctaatttttgttttgttttgtttttgtagagatggggttttgccttgttgcccaggctggtcttgagctcccaagctcaactgattcacccaccttgacctcccaaagtgctgggattacagacatgagccaccgtacatggctggaaaaatctatttttacagagagctatgcaaatgtgtgattggaaaacaaatgggtatgacctagtggcaataatctgaggagaaattagccagatctgttcagattcttcttggtctctgcgtatagaaaaggactgctcctgagtgaggaatttatgacctactttccggggaggtaggtcagagaattcttttgtgacccacttcagggggaagaggtcaaagactgtgcttcctgcatctattatctcaatttctgaggtgccatatttgggggcattatttacagagactcaagggggtgtaagtgcctattatcagaggtcattcttacggaggctattaacgaaattttaggtgaatggctgagcagacatctagaagttgtcatccagtctatttctaattaggttttttcttttctgacgcaggtagttgattttgcaggatctgctgtcccttaggagaagagggccctaaagttcaagtgattgtgggactggaggagataaaaggctggcaggggagggcagagggagggaggatgaagcagttaggggcttgaagggggaaatatcaaaggaggcaagagaactgaagggtaaaataatgccaaaaaagaggtggacagagttggcaaagcatatcgtaagcagggatttgagaagaggggattcagatgacagagaacatcccaagggagaagcagaatccaatatagagaatggattggtcttaaatagagctgggagtaaaagattcgcagcccaggaagtcagggaataatacctacggaggaaggacttccaggccaagtatccagggaataatccccactgctatggttctaatgatggtgccctctcaaaaattcgtgttgaggccgggcatggtggcttatgcctgtaatcccagcactttgggaggccgaggcaggcggatcacaaggtcaggagatcgagaccatcctgactaacatggtgaaaccccgtctctactaaaaatatagaaaaattagccaggcgtggtggcggtcgcctgtagtcccagctactcgggaggctgaggcaggagaatggcatgaacccaggaggcagagcttgcagtgagccgagatcgtgccactgcactccagcctgggtgacagagcgagactccatctcaaaaaaaagaaaaaaatcatgttgaaatgtaatcttcagtgaaatagtatgttgcccaggctggtcttaaactcctgggctcaagtgatcctcccacctcggcctcccaaaatgctggcactataggcataagccaccacgcctggccaagacactaccttgaaagcacagagtaggccaggcgcggtggctcacacttgtaatcccagcactttgggaggccaaggtaggcagatcatgaggtcaggaattcgagaccagcctgtccaacacagtgaaaccctatctctactaaaaatacaaaaattagctgggcatggtggtgggcacctgtaatgccagctactcggggggctgaggcaggagaatcacttgaacccgggaggtggaggttgtggtgagccaagattgcaccactgccctccagcctgggcaacagagctagactccatctcaaaaaaaaaaaaaaaaaaaaaaaaaagaataagaaagaaagaaagcacagagcagcccttactagacacaaattatgccagtgacttgatggcgtaattggacttcctgactccagaactgtgagaaacaaatttctgttctttatagatttcctaggctcagttattatgcttagcggcacaactgactaagatagaaattggtactgagaagtggcagtgttgcaataacaaatacctaaaaatgtagaggctgctttggaactgagtaatgggtagaggctggaagagtttggaagtgcatgctagaagaaggctagtttgccatgcattaaggcgattctgacgaggcttcagaagatgaaaagccatagagaaagcctccgtctttgagattatctaggtggttgtgaacagaatgttagaaagaatatggacagtaaaggacattctgatgaagtcttagatggaaatgagggatatcttattggaaactggaggaaaagccatccttgttacaaagtggcagaggatttgttcctggaaagaacagaacaaggtctgggaaagaagggagtttatttctgcagctggttacagggagaaggccggagtaactcaccataccaactcaaagttacaagtttttttctagtgcttatatacattttaagctcccatgctaggagtggaattgcacctccaagcaggagtgtttccttcaatctatatctaaactttaactaggacctagggtctggaaatctttctctagagtcttggaaagctttttaatctttttttctttttctttttttttgctgtccataagtttattgtctgtatctgaaaaatcatcatagaaaattgtttggtttagctctcagcagcctgcttctgagctctgaggaagcttgcattcttttgagctacccaatccttcttctgagcaagggacattttgggatggttccacctcttctttttaacttctttcttgggcttattttcatagactggattctctcgtatagcagcatgagcttccttatacatttcctccatcatgtctggagttaccctgttctttatgtattgagagaactgtttcttgtaagcattttcatcttcttccattaagtagcacatgtaatcggcaacattctggcccatgatgtgcttccggtgtacttctgcattaaattccttgctttcagaaccataaccagggaattgtttggtactgtgagggatagacaagcctccatccacagctcccttcagggcaccaaaaactttattgccagtggtagttctggcaaggcctgcatccaaatagcaggtaaaggcacttggctgaccatcaatgctttccacaatgtattcatcgccagtcacctccacttggccttcatagatcttgtccatgccaaacctactgagaagcctgcgggccagcggcaggccagtacaatatgctgcagcataatttgtcgggccaaccttcacaccatattttggcagttcgtgtgcatatgctgtgcagactatcatatccccctctatatgggcataagcaatctgacaaatgatatctctgtttgttacacgaactatcatcctgtatttgagtgtgttgtatttatttttatcctgtatcaccaagcgtttccgagtatcgtaatcagttttaccctctcatcatcgtcttctaaatttcacttggtatctcttaaagtaggccttattcttaacaactttaacaaaccccatcctgcagaacagagacccgcgtccacagctcaacagagaccagcaggcacagcggcgctggggcagggagaaggggaaagctttttaatcttcagtgggtacctggaacaaggtatctgtgtaaaatgcttttattattcaaccagactttaggctaagaaagcccattttaatgggtttattttaatattccagccctcatgctcagtcacctgtttctccagttctttaatgtttaacttatacattcattagaattataatagagggtcagtggaaactgactgttctggttgctaatgggagcctgccctgccacaaacttggtggaagtatttctgtgtcttaatagttttttggagggtagaatgtaagagcgatgaactaggacatttggcagaagaaatctctaagccaagttttcagggtactgcatagcttctcttaactgcttatagtaaactgtgagaagagaaaagataggacttctaatcaaaagggaagcagattagctgggcatggtggcacacacctgtagtcccagctactctgcaggctgaggtaggagggttgcttcagcacaggaggtcgaggcggcagtgagctatgatcgtaccacagtctgggcaacagagtgagatcccatctcaaaaaaaaatgctaattattattattattatcattgagatggagtcttgctctgtcgcccaggcaggagtgcaatggtgcgatctcggctcactgcaacctctgcctcctcccgggttcaagtgattctcctgactcagcctcctgagcagctgggattacaggcgcccgccaccacacccggctaatttttgtatttttagtagagatggggtttcatcatattggccaggctggtctcgaactcctgacttcgtgttccacccacctcagcctcccaaagtgctggaactacaggcgtgaggcacctcacctggccaaagactattattatcattattttatccaaaatgtgtttattgagatggtttcccactcatcttgattcagggtgcttttagtgctgctttctcctgaaggaccatccttccataagccttgcttttcctcctgtaggctggcagaggaaagtgcagcagccaacacccaaaaccactgttggcacatggctaaagaccgtggtgattttatagcatcctgggcatttcacatccatgaagtaggaattggggctctgcaccaggtgtttcttcttgtgtttcctcttctcctcttctggagagggatgaaggagatcctttgcaagaagcatgttcttgtgggtaggtcgtcagtgctggaaagggccaaagaaaattatttttaaagggaagttgaacataaagatttggaaaattaacagcctggccttgtaaagaattttttaaataagttcaggagacaaaaccaactgtgtggccaactgaccgtttcataaggagattagtatgactagaatgccagatgctattcattaagacaatgggagaatgaccctgaagacatttcagagagcactgagaatgccacaaccatcacaggcccaaagtgccaggtccttgagggaataacaattttaaggaaggagcccaggattccagtgcaacccaagatgcctgtgggaacttggggctcactgactatgctgcctcatgtatctgctccctgaagtcaagcaaagcttccccatctgtggttcaggtgggcccaggtacagctcagatcactcctccagaaaacacaagtagtaaaacatggggcagcatgcatgtggtgctaactgcaggcatgctaaatccacagctgtgaaggcatggctttctccacctaatttccaaggaagccttgaagaatgcctcagggcccaatcagagaactgctgtaggggcagggctgccatagaaagttcccactagggcaatgtccagcagaactattgggttggggccaccacagagtgccctcactagggcaatactcagtggagccatagggacagggccacccctgagttcctagacccagacctgtagatccggtagtgcgtattccaacctgtaatagacatagacacctgactacaacctgtagaactgtggcatgggctgactccagcagtcatggcagcagggtcccctgggggcttgggaacctaagcactaccccagtgtctctgtaaggtgagaggtagaatcaaaaaagctgactctcacacctcaagattgaattttgttggccttgttgggttttgaagttatgtgggacatgttacccctatcttcttgcctatttcctccaccaaccttttgtttttgccatggggtcgagctatgtcacccaggctggtctcaaattcctgggctcaagagatcctcctgtctcagcctcctgaatagctaagactgcaggcaccatgcctggcttatttctgacttttataaagggaatgtttatcctgtgcctgtccaaccattgtattttggaaacacataatctgtttgacttcacaggttcacagctggagagccattgtctcgggattaattgtaccttgagcatcacctatatctgatttagatgatatttacatgcgactttcgacttacacttgaaagttgatgctggaatgagttaagacattttggagttactaagatggaatggacatattcttgtgggtgagaacgacatgaattctcatgtcatggcaagggtggagtgctatggtttgaataatggtgtcccttctaaaattagtgtggaaatttaatgcccaatgcaacagtattaagaggtttggcaattgcgtggtgactaagccatgagggctctgctctaatgcatgagattaacatctctataaaagtgtattaatttaaagggagtactttcttgcccttctgccccattcaccatgtgaggacatagtcatggctcctccacaggatgcagcaacaagacatcatcttggaaacagacagcagccccgtttagacctccttctgctgctttgatcttggacctctcatcctccagaaacacgacaaataagtttatgttctttataagttactcattatcaggtatttatttatttatttttttgagacagagtctcgctttgtcgcccaggctggagtacagtggtgtgatctcagctcactgcaacctccgcctcctgggttcaagtgattctcctgcctcagcctcctgagtagctgggattacaggcatgcactaccacacctggctaactttggtattttcagtagagacagggtttcaccatgtttgccagtctgatctcgaacccctgaccttaggtgatctggccccatctgcctcccaaagtgctgggattacagacgtgagccactgtgcgtggccaatatcaggtatttctaatagcagtacaacggactaagatactcaggaaaacagagccaggaggaaaaatattctatctcagggagttaaggaatcatgcccactcaagaaagagtataagggctgggcatagtggctcacgcctgtaatctcagcactttgggacgacaaggtgggcagatcacttgaggtcaggagtttgagaccagcctggccaacatggtgaaagaccacctctactaaaaatacaaaaattagccaggcgtggtggcacatgcctgtaatcccagctacttgacaggctaaggctggagaatcgcttaaacctggtgggaggcagaggctacagtgagccaagatcacgccactgcacttcagcctgggtgacatagtgagactccgtctcaaaaaaacaaaacaaaacaaaacaaaaaaaacaaagaaaaagagtgtaggggaaaaataacactcagtttattttttagtccaaacagacccctttaacaaaataaagattaacaagagaaaagcaaacaagtttattaatgtgtgtatttcatctacacatggaaaatacccagagaatgaatagttatcaaagaagtgctttgaattccagcatatatagcatcttcagcagagaaccgtacatttttagagaagtgaaaagataaagaaaaaggagattgtgtccgtaggggtgacaacttacggaaaggcaaataaattgcagataaattcagttactaagcatgttgctataaattcctttggtatcatttccaggctgaccagggtctaaagttttcttcagtggttagcctttgttctccctggtaaaagcgtgagtgtggagagtggggagggagagggtaccttttgtcttcgcaactctatatcttgcttttcggccagtaaaggaagaacaaaaaacttccctgcatctgcttcttcttaattgtcttcagctcaacaatgcttccagttttagggtggcatattctggcctcccacaagagccaggaagaacagatgtgcagcccaacggtgaggaaataattttcaccctacaaagagccaggaaaaagaccttccattccaggaagtacctttcaaaagatacctgggagtctaatccagcttcaaactatactctgaattcttaagaatcaaggccaggtgtggtggcttatgcctgtaatcccagcattttgggaggctgaggcaaggggatcgatcacttgagcccagggtttgagaccagtctgggcaacatagcgggatagtgagatcctctccacacacaaaaattaaaaataaaaataaataaaaaaaattaaaacctatccttacaagcttcagtggacacttgtccagagcaatcaatggctccagagtctaattcaccagtggatccccaatcaacttattaggaataaagacaaggtttcaaaggtgcaccctgaggtcctgggtgagaggtccaggggaccaaaaatgaataactgaaaaaattatatattcagtgatacttattaaagcatggtaaagaaaactttattcaggaccattgtgatagatacagggaccaatgcaatgggattttgcaatggaatagagagattgctctgaactccaaatagatcatgggaaaaagggacgttataaccaagaagcagggttggggtgtagtgggtgaaggaatggaaaattactaaaaggaaacatcagggataagggggattctggctaaactgacacctaacaagattcttgttaaagatgggccagagtggtcatgtatcacttggaagatggtggaagatgaacctgatcagatatcaagggtgatcagatatcaaggagaagagggttcttttttatatttatttatttatttatttttgagacagagtctcgctctgtcatccaggctggagtgtagtggcgtgatctcggctcactgtaacctccgcctcctgggttcaagtgattctcctgcctcagcctcctgagtagctgggattacaggcgtgcaccaccatacccggctaatttttgtatttttagtagagatagggtttcaccatgttggtcaggctggtctcaaactcctgacatcgtgatctgcccgcttcggccacccaaggtgctgggattatgggggtgagccaccttgcccggccgagaagagagttcttgataaacagacttccttgttaaaactagattttataatgaggtccacagatgggtggaggagaagcctgagtaaattttggttaagcagagaaactttgtcatccctcctgtatgcattatgctcccttttctccagtggagctctcttcaaccttgatgttattgtccaatcagtttgttttcccagtgttgatgttctgatttcatcctacaaaaatatagcataaacttgtatttgttgcattctacaacataagcctgacaatataacaaactgttcccaaagttataaattcctcgtctttttatttgtaatttgacttttaaaaatctatgtaattatagaagaatgttgctactataaaaattttaaggggtggcagggaataattccaaaattataaaactccttgtgacaaatttaggaatgatattcagctagttctatagttttttattccttgaataatcagcgatatacatctgattatatacacacattgtggtttttttttggccaggttgactttttttttttttttttttttgagatggagtctcactctgccacccaggctggagtgcaatggcacaatctcggctcactgtaacctctgcctcccggattcaagtgattctcctgcctcagcctcccattacaggcacccgccaccaagcctggctaacttttgtatttttagtagataatggggtttcactacgtgggccgggctagtcttgaactcctgacctcgtgatccacccacctcggcctcccaaagtgctgggattacaggcgtgagccaccgcgcccagccttggttgacttattcttttaaggagcaatgtgggttaatgtttcaaagtgaaaaaatttaaaaacttaggggaaagtggggggagagagagacaaagacagagacagaaagagagacagagtgagagatggagagagatcagataggtacataagcttagtgactcagcctgtagtcccagttacttaggaggctaaggcaggaggattgcttgagcccagaaactcaagttttcagtgagcagtgatctgcaacactgcactccagcccatgtgatagaaccagatcgtctctagaagaaaaaaaaagaagaaaaaaatacatatacatacatacattggtgtttgtttctacatatgcttcatagtatatgtgtacatggattataggtagatcatataatggtaacagtattaaattaggtgtcagcatttgttgaggaagtagtacgctcgtgtttgaaattttaattaagaattgtgtacggagttggttccttccggtgggtttgtgggtttgtggtctcactgacttcaagaatgaagccacaagccttctgaaccttcgtggtgagtgttacaactcttaaaggtggcacagacccaaggagtgagccgcagcaagatttattgtgaagatcgaaagaacaaaatttccacagcatagaagcagactgagcaggttgccactggtggctggggtggagtggccagcttttattccttatttgtccccacccatatcctgctgattggtccattttacagagtgctgactggtccattttacagggtgctgattggtccattttacaaacctctagctacagagcatcgattggtgcatttttacagagcactgattggtgcattttacaaacctgttgtaagacagaaaagttctccaaggccccacctgacctacgaagtccaggtggcttcatctctcagaatcagcttttaaaggccataaatttccaggtaagtaggaatagaagaaatgaacatttcctttgagatctatgatgtcatatttttttctccatcaacgatttagttccttctggatcaaatactttttaaatggatgtatgttttatagtagatgttatgttgtcttaattattttaaaactcctattcctggactctcctgaagaggagaatttagtaatttcgaagtattttttgaggctagggaagaaaaaccaagattactgcataaggtttcaggggatgttccatgcctgccacctggtgaaaatgagggagctttcctcctacctgccaccattacacctgcctgcaggtaataacgccatcatttcaacgcggcctggggtattctgggaaggtgacgtgtgggggcgcagtgaccgctagcaggggccaaacccgccctggtctgcgctgcagtgcgcagtgaggatgttggtgctgctcttcagggttttctttccgcagccacgggaagcccgtgttccatatttgtttttcatgttctctcgtttttatgttgtggatttagttttttaaaaaccataaatgttcctctacagtcttaacaatgtaccctgtaaaataagattttaaaagagccaacttccctattaatcttatacttttttcttttcgttctggctttaacaaatgtgacctaaagagagctcttgattttatgtagaacaatacaagaatagttttacattaatcttatggttagaaaaatcatttatgggcaaatttgttcccatgccttacttttaaaatattgtgttgtctttaattttcaaaatactttaaatatttttcagtaagtttgagggtagaatttattttaatgagactcctcttataaaaagtacgtatctgtatgtgcatatgtgtatactgaatttgctttgcttttgattctatcattctgtcacttttctatcaaaatatctctaatggacagaggccagagacaaggacttttacagcaaatttgccacagtaccacacattttatcttaaaagatggtatggattttgcataacatatatatgcaaacatatatatatataacataatatatatgtgtatatatatataacattatatatatgtgtatatatataacataatatatatgtgtatatatataacataatatatatgtgtatatataacataatatatatgtgtatatatataacataatatatatgtgtatatatataacataatatatatgtgtgtatatataacataatatatatatgtgtatatataacataatatatatgtgtgtatatataacataatatatatgtatatatataacataatatatatgtatatatataacataatatatatgtgtgtatatataacataatatatatgtgtgcatatatataacataatatatatgtgtgcatatatataacataatatatatgtgtgcatatatataacataatatatatgtgtgcatatatataacataatatatatgtgtgcatatatatataacataatatatatgtgtgcatatatatatataacaatatatatatgtgcgcatatatataatatatatatgcgcacatatatataacaatatatatatgtgcatatatatataacataatatatatatgtgcacatatatataacataatatatatatgcgcacatatatataacataatatatatgcgcgcatatatatataacataatatatatgtgcgcatatatatataacataatatatatgtgcgcatatatatataacataatatatatgtgcgcatatatatataacataatatatatgtgcgcatatatatataacatagccgtttggtttattttatgtgtgtgcgttaaaaagttattcaattgctgggcgtggtggctcacgcctgtaatcccagcactttgggaggccgaggcgggcggatcacgaggtcaggagattaagaccatcctggctaacacggtgaaaccccgtctctactaaaaatacacaaaaaattagccgggcgtcgtggcgggcacctgtagtcccagctactcgggaggctgaggcaggagaatggcgtgaacccgggaggcggagcttggagtgagccgagatagcgccactgcattccagcctgggcgacagagcgagactctgtctcaaaaaaaaaaaaaaaatattcaattatgcttgttaaagcaaggtaagggtcaccatggtgataggtacagggacctctgcagatagagattgggctaactccaaacagcgtaggcaagcggaaatttataaccaaagagcaggctgggaggtctgtgaatggaaaattaccaatgagaaacctcaaaggttagggggattctggctaaaccagcctaacaggatttttgctgaagacaggccagggtgatcaaacatcacttgggggatggtgcaggatgatgaacctggtaagatattaagggtgatcagatatcaaaggtaaggaagttcttgctaaagctggatttgacaaggaagtgcacagactggagaaggttcaggtgcctgactaatgtttgatcaagcaaagaatctttgtcagtgtacagaacgctatgtttttataaaatgttcctctgccccatttgtatctccccttttcatggaacacaaagcacgttttgcataacttctagatacatgtacttctattttgaatgacctgatatatcttttttctttacaattctcaacctcagcatatgtaagtggaactcagaaggcaacattccctgaacatactcttccaccagaatctcctctacagatttttgctgccccttttaccagtggctgaatctactttctcttatgtaagtagaaattttatatatctccagcctcttcctccttaccttccacttgcatgcacatcctgtctagtctgtgacctcctctgttataaatgcttgtaaacctttttttctgaatcagaaacgtgttgtgttgctcaagccgtgttcattttaattacgatttaactgcataatttaattatttccccattttttggatacagtgtttgcttttctccggttactttgttctagtatatccctctggcaagagcagtcatttccccacttgagtgtgcattagtatcacctgggggcttgttaaacacagcgtgcaagctccatcccagggtttctaattctcagggtttggtttgcggcagaagaatctgcatttcgaacaagtgccaggactggtctgaggaacacacgttgagagaggtgggattcgggttcactaacctgggttagagaaaattacagtaatgtgccaaatctgaggagggagcagagctgaagcccagtttcaatatgtgaatgagtgctttatacactcaaaccccctcaagggctggggagtaagggagaacgtgggcgggcagcgggcgtgtatagaggcataaactcaatcccagacctatggattcagaatcacatgttaacaattcttccagtgttttgtatgtttattatagtttgagaatgactggaccaaattgcctccaaaatcttaagtcccagcagtgaagcgaagctcagacatcatttgcatagctattgctttgtgtctgtgttttaggtcagctgctgttaaaggtttgtttcggagagttacccaggtgtagtacccttccaagtagataatgattgaaagagtatgtgctggaggtgtatgatattttccatccacttcagcccatttttctgatgggtcagtgacagtccatgatttgtctggtgtaatacaaattctggaagtggcatatatccaaggacagccataatattccacttggccaaggctcttctgacaggctcatgttcatgcaggatcagatctgacccagaatcaacagaactgaagctgcaaattcagctttgtgaaggcttcagatgtagccatggttaaagaagattgacattaagcaggtgagcagagtttgcttgaggttcacccagggaattcgtgaggatgcaggtgcgtttttttatggcctgaaaagcccagtttttgaggagttacagtccctctcagaaactgttcctgcagagtagccctggaaacatgtttgtctgcattcaagaaagatcttccttctgttcatataaaggaagccaaacttatttcccaggtaagggagtggaagcaactgtgatacggaatcctaaggcatgggggttagttgtaatccaggcaatatgtagggtcaggttctccaagtcctcctgtggttaaagggctccaccctaggaaagtgagccacccagggcttggtaaatgaccttatgatcagcccttggcctgttaacatgtcgtaactgaggcacaggactgggttcttggtttgaatttgctagtcagatggccattgcagaaagggaagagagcacagtccttcaggccaactcacttggcctattgaaactggcttttctgagcacagtctagtattgttgcgaattaaatacagcagaggatgtaagttaccagtattagtcactatcagttgagtacttattctgtatcagccactgttcctcttttccatttccacctgttatatgttagtgacgataaaaatgccatacagaccgggcacggtggctcacgcctgtaatcccagcactttgggaggccaaggcaagtggaccacctgaggtcaggagtttgagaccagcctggccaacatggtgaaacctccgtctctactaaaaaaaaaaaaaaaaaaaaaaaaaattagccgggcaccgtggcgggctcctgtaatcccagctactagggagactaaggcaggagaatcgcttgaacctgggaggcggaggttgcagtgagccaagatcgtgccattgcactctagcatgggcgacaaaagcaaaactccgtctcaaaaaagagaaaagaaaaagccatacaaaaaggctaagagccttgttcaacctcacacatgaaagtggcagggctggggtattaattcaggcattcacaatccagatcctctacacatttcactgacatgaaacccagaaatttcaggtctactaccttgaacccagaactatttttctcaaacttgttttcttgtgagctatatatagggaaaaattgcatacaatacagtactgctttacaaatatatcatctaatacccaagtcaagaaagacatgatcctgagctccctcaaaactcgtgggtatcccttctgaatcttgaccttttattctgactgagatgaatcctccatgctgctctttgtaattttattcctcgtgattacatacttaagctacaggaatacatcttacgtagttttgtttattcttaactgtatgtatttttttgtcttttccacttgatattgcattttctgtatttatccatgttgtgtgtaattccagcttcttaatttttattgatggtgttctctcattatatataatatatacagcatgtagcatgtatctttctcactgtgtatgtatacagagtgtatgcatatcactataggtatacagacatatcattatcctagtatttccatatctatgccacagtaggcagatccttttttttttttttttttttttttttgggaagacagagtctcgctctattgctcaagctggatggagtgcagtggcgcaatctcagctcactgcaacctccgccttctgcattgaagcgattctcctgcctcagacccccatgtaactgggactacaggcacctgccaccacacccagctaatttttgtatttttagcagagatggggttttaccatgttgtccaggctggtctcgaactcctgacctcgggtgatctgcctgcctcagcctcccaaagtgctgggattacaggtgtgagacaccatgcgcggctgcagatcccttctatacctgatgattgtttgggttgtgtctagtctgcagttatcaccaacactgcaatcgtaatcactgaagtatgtgtatcctgatttatataggtacacatctctcaaggatctgtaactggtagtggaattcatggatcttcaattcaaatgttgctcatggcagtgttaattataacaaccactttggtaaactacctgctattacctacaaaaccatgtgtaccttacacacgcaccatccattctactgtgtggagtaggccacggaaaagtacatgcacagttgatgaaaagacatgtatttaaatgtttatagcagcattatttgtaatagccaaaactggaaataaagcagagtgggtaagtaaatggtggtataggaattcaatggaattcaactataaataaaaaataatgaactgtatctacatgtaaaaaccttgatgaattttataaacacaaagttgagcaaaataatctaggcaaaaacatacttgtctgagcccatctctgtaacattcagaagtcagtatgacaagtcaggatggtggttacctgtgacaggagagaggctgttttgggaagggctcacttgggtcttctcagttgctggagttcactgtgataaatttaggatttgtttctttttagtgccgtgtatgtgtgtgtgtgtgtgtgtgtgtgtgtgtgtgtatataaacatttttttttttttttttttttttttgagatggagtctcactctgtcacccaggctggatgcctggctttttgtagtttagtagaaatgaggtttcagcatgtagctctggctgatctcaagctcctgaactcaggagtctttcctcctgtacaggagggaagacctttcctctactttctgagaattcaataattgagtccttgaaagaaattgacagtagtcagattaatgggagaaaaggtatacaaattagatatggacacagggacatcacatgaaagaaaagcgaatatcccagaacccagtgagattcagaagcttatgtaccctcttcttaggacagagggtataggtgattaggtaacttaggggagagtaaacagtttgggggaaagataaatggactgtcagaagaacaggtaacagccggtgacaaagtctgcgtgtgttatcaaggtctactctcctctcctgtgataggagccaatcttccctggttagtgagtttcctggggaggggattcatgacaattaagttccttttagataatctgtctttagataaggaagctcagagaaaacctctgcctgtatgagctgctccccacataacctcagttgaaagtaatcagcacaccaaagcatcatattttggggtggagatcctcccgcctcagtctctcaagtagctaggaccagaggcatgcaccatcatgcccggctactttttttttttttatttcttgcagagacagagtctcaccatgttgcctaggctggtctccaattcctgacctcaagtgatcctcctatctctgtctcccaaacagctgggattacaggcatgagttaccatgcccaggctaggggtggcatttcctgaactccttcagccctcttgggaaatgtgcaggcaggaagaaagaaaagaatacccttgtccacagccaggtcttgttgagcttatgcttggcagaatagaaccttacacccagccacgtgaaaactgggatgataaatgtctgcatgtctgacagaaggtttggcctctgattcagctgtggtgatttttccatctacttaactccaaattctattagctagtataaactctctattggactatgaacacagtaagtacacaatcatatgattattttatctattgacttaaatagaattgtgtatgaaggctgtactgaagttattcagggttgagtcaggaaaagctaaatttcaacctcttttaagaaaaatattgatgcctccaaatccatagtatatatgttgcttactagcttataaagggcccctggaagaaaggacatttccggtgttttatgtcaatcataggaaaataagctataagcttttttttaattctttgattctcaaaagtaggattgtggccaggcatggtggctcacacttgtacagcactttgggaggctgagatgggaagatcgctcaaggccaggagttcgagaccagcctgggtaacaaagcaagaccccatctctacaaaaagaaaaatgtatgattgcgtccccctaccactccccaacacttccctggctccacaccccagttcctctgctctcatttctgctgtgtcttactccatgaagctttcaaaactgcttttatagagtcctccttttcttttttataaatttattattgttgttgtttaattaaaagacaggatctcactctgttgtgcagttgtgcgatcactacagcctcaatctccaagcgatcctcccatctcagcctccccagtggctgggaccataggtgcataccaccatgcccagctaattttttttttttttgagacagagtctcgcactcttgcccaggctggagtgcagtggcgcgatctcggctcactgcaagctctgcctcccaggttcacgccattctctggcctcagcctcccgagtagcggtagcgcccgcaaccacacccggctaattttttgaatttttagtagaaatggagtttcactgtgttaggcaggatggtctcgatctcctgaccttgtgatccgcccgcctcggcctcccaaagtgctgggattacaggcctgagccaccgtgcccggcccactaatttttaaatctttttgtagagatgggatctaactatgttaaccaatctagtttcaaactcctggcatcaagcagtccttctgtccaaagtgctgagattgcaggcatgagccactgtgccaggcccctcattctttaaatagctactttagattctattgtaaggatattttaataattttccaacttttattatattgagtaggtgattcctttttaaattatatatgtaaatttttatttatatatttgaataatatgtttacatagttaaaaatcaaaatatacgaaaggcatacagtaagaagtcatctctttccacccgtaatgacaatatatccccttttgcctggcacagatgcacacataaattattgtcctgacatgattatgaataatcctgctttctctcagaagtgtgctagtttgaatgataaattatgcagacattctgcttgtatccctgcttcttcaccatgctgttatattccttccaattcagaggcaaatgtgatatcattgcctatgtgtcttccagaggaattttatttatattttgtaagtacatacatggattctggttttttttttgcactttttaacaaatagatgtatccatgctattttattttaaatttttactttgaaacaaccttaaacttacagaagttaaaagaatattagtagcaggtgtgctggctcacgggtataatcccagcaccgtgggaggctgagatgggtggattgcttgaggccaggagtttgagaccagcctgggtagcataatgagacctcctctctacagaaaaaaaaaatgtaaaagttagttgggtgtggtgttgcatgcctatcgtcccagccactcaggaggctgaggcaggaggatcgcttgggtacaggagttagaggctgcactagaccatgatcacaccactgcactccagcctgggtgacagagtgagaccctgttgcttaaaagaatattttaaaaaaaacctaccctttatccagattcacaaatactaatattttttcacattatttaatcaatttttctccttccctccctctttcatttctcccccttttctttttttttggagacatgatcttggtttgtcacccaggctggggtgcaatggcataatcatagctcaatggcatttcaaactcctgggttcaaagaaacctcctgcctgagcctccagaatagctgggactacagtcatatgctaccgtacctggctaatttttaaaattttttatagagacaggatcttgccatgttgcctaggctggtctcaaactcctaggctcaagtgatcctcccaccttgacatcccaaagtgttttgattacaggcatgagccaccaagcctggcctcctttccctcttttttttctccctctgtttcccactgcttataaagtttttaaattttttttttttttttttttttttttttttttttttttttttacttttgaccactttgagagaaggttgcagacatcatgtccctaatgcatttcctgagaaccgggatatacgtttggataatcatagtaaagatattaattcaggaaatataacatttatacaattattttatctaatctacaggccataacccagtttcttcatttgccccaataatgttttttatagctttttcatgttaaatatcttgtttggcactaagtatcttatcagtctgccataatgtttaatatctttcctctgaaatggttcctctgcctgcctttgcctttcatgtgtttgtgacttttgaagcatgcatgctaggtatgttacggaatgtcctcagcttgagtccatctgaagtgttcttaagactggattctactgatgctgttttggttggcacaacacggtgtttactattgtggtcgtcaaaatgatgttttatggctaaaccattctttcaacatttaatcatcaaggaaatataaatcaaaaccacaatgagatatcatctcatcccagttagaatttgctgttatcacaaagacataaaaataaatgctgatgaggatgcagatgacagggaactctcctatacttttggtgggaatgtgaattagtatagtcattatggaaaacagtatgcagagtcctcaaaaaactacaaatggaactaccctgtgaaccagcaattccactactgagtatttatccaaagttaaatcagtgtattgaagagagagctgcactcttgtgttcattgcagcattattcacgatagccaagatatggaatccaccgaagtgttcatcaacagacaaatggattaaaaaaatgtggtgcatatacacaatggaatactatttagccataaaaaaagaatgagatctggacattcacagcagcatggatggaactggaggacattatgttaaatgaaataagccaggcacagaaatataaatagcttaaaaagttgacctcatagaagtagagagtagaattgtgattaataatcacaattataaataatggtcagtatcaaaaaaaattgtcattctacagtgctgcagaacattagaacttgttttctctatctagctgtaattttccctcttttattttttttgaaacagggtcttgccctgtcacccaggcatggcataagcacggctcactgcagctcaaacaatcctcctgcctcagcttctggagtagctacaggcacatgccatcatgcctagctatttttttttaattttctataaaggtggggtcttgccatgttgcccaggctagtctcaaactcctggcctaaaacaatcttcctgccgtggtctcccaaagtgctaggattacaggtgtgagccatcactcccagctccaatttttagatactgaccccatttagatacatgacctcagaacacattccaagctcatgttgtatctctcttgtccccactattaaatcagctgtgttttttccaaggaatcctgatttctattgtggagaagcgtacttagaaaccaaggtcttggtgctactggtatgttattgcttttaggcccttccagatatacgggatataaagatatagctatatgtatgtgactatatgtattgtgtatatatgtatgtagctatatgtgtgtatgtgtatatatatcttcatgtatttatagtgatattttccatcccaatctacaccgcagggtttttccttgccttcctatttgtagagcttccttccacattaagaaccctctctcccagtgagtgtcaccccatttctgtttcatctctttccctactctcccccttgcctcctagggtcccctttcctctcatcagttgccagacaagaggagcatcatcatacacacatcatagatttaatattaaacttttaaaattttcagataaatgtaagcaggcttctgcagtgaaaggggccaggtctaggaagatggggaatacttgcaggcacctgggaagctcagggaagctgcaggtaccctgtcagttgggtgtcccctcatgagggtggcagactgtctccttgagttctgggtggcagaaatggcccagggccctgggctgagacccagccaactctctatggggctgccacacgacttcctaaaaaggcataaacacattttcttccaagtggagtccagcatattttattttcctgttgaatggtagacagcatgagagcagggtccatgtgatgatttttctgtcagtatcagtttctgcaagagcaaaaattacatatttttatttttcaaataaaatcaattgagacagtaacaaatttgctcaaagaatcaacctgaacacatgtacatctattatgtatcaataaaaaaatggccaggcacggtggctcacacctataatcccagcactttgggaggccaaggcgggtggatcacgaggtcaggagatcaagaccctcctggctaacgcggtgaaaccctgtctccaccaaaaatacaaaaaattctctgggcgtggtggcaggtgcctgtagtgacagggcgagcttgcagtgagccgagattgtgccactgcactccagcctgggtgacagagcgagactccatctcaaaaataaataaataaaaataataaatttttttctagataaaaaatataaaaattacaccacagtccaaaaaaaaaaaaaaaaaaactgttcaagactgatctttcatagtgattgggtctatgagtaaatgttaaatagatgatttattaggtttctttttatttcaatgatgagatggagaaatatattattttacatgagggcaaaaaatattttatgcatagatattttttattttgcctatgtccttaaattctcagaatatagattattgccttcagaaatctgtctaggttcacctataccttattagaactcagctttgctggctgtggtacacctgtaatcccagcactttgggagactgagaagggaggatcacctgagctcaggaatttgagaccggcctgggaaacatagggaaaccctgtctctacaaaaatacaaaaaaaaaaaaaaaaaaagtctgggtgcagtggctcacgcctgtaatcccagtaaatcccagtactttgggaggccgggccgggtggatcccgaggtcaggagttcaagaccagactggccaacatggtgaaaccccgtctctactaaaaataaaaaattagcagggcatggtggtgagcatctgtaagcccagctactcgggaggctgaggcaggagaattgcttgaacctgggaggtggaggttgcagcgagccaagattgtgccactgtactccagcttgggcgacaaagcaagagtctgtctcagaaaaaaaaaaaaaaaattagccaggcatggtggtgcacacctgtagtcccagctactcaagaggctgaggtggggagccctagtgggtgcagtgagccaagatcacaccactgcactccagcctgggcgacagagtgagactctgtctcaaaaaacaaaaaagtgagctttaataaattctataaaacttttttctagttgagagtacgttactacaagctaacttttaaaaaagtcatattatttgattactaggaactttgcaattagttttgcttcttctggtttttatttttgcctggcacaacatttccttccttggcccctgtctgtattaataatgctgccaggatatactgaatgattttattccagttttttctaccttaattatgttaaagaaaaacaaaagctgggtattagttatagtggtaaggacacattttaatcactaataactattgtaatcgtgaagaaagtccagcatgaactgaactcaactttggtgtgtacagaggtgactgggtattttaaaggaagaatgaagctgggtgtctactggacactggaatgaagctactgcagaggctgaggcagaaggattgcttgagccaggggtttgagaccagcctgggcaatacatcaagacctaggctgggcggggtgccacacgcttgtaatcctacactttgggaggtggaggggcggggggtgaatggcttgagttctggagttcgagaccagcctgggcaacatcgtgaaacactgtctctacaaaaatacaaaaattagcagggaatggtggcacatggctgtagtcccagctactcagggggctgaggtgggagaatcccttgaacttgaggagacagaggttgcagtgagccaagatctcaccactttactgtagcctgggtgacagagtgagaacctgtctcaaaaaaaaaaaaaaaaaaaaaaaaaaaaaagactttgcttcacccacaaagggaaaatcagggaataggagggagttgagttgtggggtagggtatgctcagttgagtcagagaagtaaaaatttaccaaaagtggtggttccatgtaaaacctacctgggattgctaactggtgctgtttgaagttagactatgaccctcgcacagaggccaggagacaggggccctatcttctgctgttggctggaacaaagagtaaattcatttgggaggcttcacttttttcaggcaggctatttaagggggatacagtcaaccaggggatatggccttgagatgctagaatctatgttagtattttgttcaaatatttataggccagggttaagactgactttgtttctttgttttttgagatggagttttgctcttgttgcccaggctgaagtgcaatggtgcgatcttggctcactgcaccctccgcctcctgggttcaagtgattctcctgcctcagcctcccgaggagctggcattacaggtgctcgccaccacgactggccaatttttgtactttagtagaaacggggtttcaccatgatgtccaggctggtcttgaactcctgacctcaggtgatccgcctgcctcagcctcctgaagtgctgggattccaggcatgagccactgtgcccagcgtaagacctagttgagaaggcagctcagaggaacctggctagagtttggtcaagaagactatctctgtcaatcataatgtgtattccaccaataagagtcattgagtctgtaaatgtttttttttttttcctttgagacagagtttcactcttgttgcccaggctggagtgcaatgacacaatctcggctcactgcaaccttggcctctcaggttcaagtggttctcttgcctcagcctccaaagtagctgggattacaggcatgtgccgccacacccagctaattttgtatttttagtagagatggggtttcacgatgttggttaggctggtctggaactcctgacctcaggtgacccacctgccgcagcctcccaaagtgctgggattacaggcgtgagcccccatgcctggccaagtctgtaatcttgattgaaagtttacttttgactgggcatggagctcatgcatgtaatcccagcgctttgggaggctggggcaggaggattacttgagtccaggagtttgagaccagcctgggcaacacagggagacctcttctctacaaaaaataaaattagccgggcttggaggtgcgtgctgatagtcctagctacttgacagactgaagtgtgaggatcacttgagcctgggaagttgaggctgcagttagccaagatccatgccactgtgctctagcctgggcgacagaatgagaccctgtctcaaaaaaacaaaaagaaaagaaaagttgactttttgccagctgttaggaaaacatctgtggctctggagggcggctggtttaaagaaaaaaaaaaacaatcagacatacctgatatctacaagaggataatgagcttagtatggtgtgtgtaggagcctagaggagagaggctgggaggggattcttggggaaaacggtggttgagttggggttcagaggcaagcccctaggtcttaggctgggcacggtggctcatgcctgtaatcccagcacttcaggatgctgaggtgggcggatcacctgaggtcaggagttcgagaccaggctggacatcatgatgaaaccctgtttctactaaaaatagaggagaatttgatggccattcacagtcaagggaactgaacacatcaaagggattgccagaagggcagaagtcctgacttacaggtataaggagaaacagaagaggagacaaggtgtggggtctaccaggtgggcaggcccattgagtagagggtacatggcattcattgaaggattttcatcaaggcagtcttctggtaagatacggggaagtccacaggctaattggaaaacagaaagaatgagatcatggagacaaatttagggactgactccgtctgtattaatttataccaggggtcagccaagtgcaacctgtggctaaatttggactgctatgcatacatgtatggcttgtgagctaacaaagttttttatggttttaaatacttgagccaggtgcggtggctcacacctgtaatcccatcactttgggaggccgaggcgggcgaatcacctgagtttgggagttcgagaccagcctggccaacatggtgaaaccccgtctctattaaaaatacaaaaattagctgggtgtggtggtgcatgcctgtagtcccagctactcaggaggctgaggcaggagaatcatttgaacctgggaggcggaggttgcagtgagccgagatcatgccattgcactctagcctgggcaacagagtgagactctgtctcaaaaaataaaataaataaatacttgaaaaaagcaaaagaatagcatttaataaaaattatataagattcaaatttcacggtccataagtgaagttttattggaatacactcatgcccacttgtttacatattgtctgtgactgctttcacacttcacactacaaaggttgagtagttgtgagtgatcgtcctcaaagcctaaaatatttactctctggctctcctctctacagaaaaaggctgctgatctctgcctgattcattgattgattattatttgaaatggggtttcactctgtcatccaggctataaagcagtggcgtcatctcagctcactgcaacctccacccgccgggctcaagcaatcctatctcagccttctgagtagctggaagcagaggcgtgtgcctccgctcccagctaatcttttgtatttttggtagagacggggtttcaccatatttcccaggctggtcttaaactcctgagctcaagtgatctgcctgcctcagcctcccaaagtgctgggattataggcatgagccaccgtgcttggctgacctctgatttatatggccagatgggggcaggtactcagttgcttgtgcatattttgttgggagatcacaagttagcaagataaaagtgctttcatcacagaggtttcagtctagtagaagttaaatttttgtgccgggttcagtggctcacacctgtaatcacagcactttgggaggccgttgcaggccggttgcctgacctcaggagttcgagaccagcctgggcaacacagtcaaaccccatctctactaaaatacaaaaatctagctgggcatggcagcatgcccgtatagtcccagctactcgtgaggctgaggcaggagaattgcctgaacccgggaggttgaggttgcagtgagccgagatcatgccgctacactccagcatgggcaacagagcgagactttgtctccaaaaaaaaaaaagttcgatttttgtttaataggtgagatcatatgaaacataaatataagtactgatgtagggattgtgctttgtgaatgggtctctgcctgcaaaacattcctgagaagctttctgaagggttcaagctgagaacagaaggatggagaaagagattctgtaagttaggaggcaagaatctgagctaagatttggatgtgacaggaccatgagtggatagggaatgttttgtttcttgagtgggaagtgggaagcattttgggaacaaggtaaggaagagagaggaggctgcagtgtttttaaggagtcctgcccacgccaagaagtctggactggaggtcatttgctttaaacatgtcatctcaagcatgtgtgatctatttggagcaaatataatcaagggaagttttaaacaggagagttttcagagcagtggagtctgaaaagttgccctaaaataaggttgagcataagaaagtccttcttgcttctggaaaaagtggactatgggtgctcactctttggggccagacagagaagaattaaaaatcatgggctgggtgcggtggctcacccctgtaatcccagtactttgggaggccaaggtgggtggatcacgaggtcagttcaagaccagcctggccaacatagtgaaaaccacgtctctactaaaaatacaaaaattagctgggcatggtagcgcatgcctgaagtcccagctacttgagaggctgaggcaggagaatcacttgaacccaggaggcggaggttgtggtaagccgagatcatgccactgcactcccgcctgggcaacagagcaagactctgtctcaaaaaaaaaaaaaaattgtgttatttctcccttttgcacctaatctcccactgaagatgactgcaactttcctgtgaattctgaacctgctgccaaaagatacttctttatattccatgattttgtgtaaaactttgtggtgagaattagagaaagcttaatttgctgcttggcatccagaattaggaggccaagttaggctcccatgttaattttcagaaagcccatgttcctgatatctggtagggatggcggtgctgaactgtgaaggtgttggaaaccagaattttggcagaaacggagtcagatttgaacatggtacaaatttggaccaagggcctagtgatagttaggtcaggaaattggggactgtattggtccattcctgcactgctataaagaactacccgagcctgggtaatttataaagaaaagaggtttaattggctaatggttctgaaggctctaaaggaatcatggctggggagtccctaagaaacttgcatcatggcagaaggcagaggggagtcaggcacatctttacatggcagaagcaggagagagagagcaaggggaggaggttccacacactttcagacaaccagatcttgtgatatatcacaagaagagcaccaaaggggaaatccacccctgtgatctagtcacatcccaccaggccccacgtccaacattggggattacaatttgacatgaaatttggatgggggcacagactcaaaccacatcagggaccaaagaaatattttacttattttcagttatcaatggaatttactgctgatgagaaataaatgtatcttgccagtaacttataaagtaataaaaccggccaggtgcgatggctcacgtgtgtaatcccagcactttgggaggctgaggtaggtggatcatgaggtcaggagatcgagacaatcctggccaacgtggtgaaactctctctactaaacatacaaaaattagctgggcatggtggtgcgtgcctctaattccagctacttgggaggctgaggcaggagaatcacttgaaccagggagccggagattgcagcaagacgagatcatgccacaccactccagcctggcgacagagcgagactccgtctaaaacaaacaaacaaacaaaaaaatcaaaacaatttccctagaaatgtataattattgacactttttagtatttaaaaaattttcagtgataccctgtatttacaaaacaaaacaaaacaaaaaaaacgaaaaagcaagacaaaaacaaaacaggcatggtgatgtgcacctgtagtcccagctactcaggaggctgaggtgggaggactgcttgagcctaagagttcaagccatgatctcaccactgtactctagcctggatgacagagcaagactgtctctaaaaatttttttaattaaaaaaaaatttcatcttgacttgcttttcatgtgaatctagtgtatttgctactttttgataatgctttgcactttttaaattgtaaaaacattacataaaattttcatcttacccgtttcaggggcactaagtgcattcacattgatgtgcaaccatcaccactgtctagctctagaactttttgtcttacaaaactgaaaattgcccattaaataataactccgtttcctcctccccacaccccatcccctggcaaccaccattctacttcctgtctccatgacatttgattagtctggatatctcgtataaatggaatcatacagtatttgtccttttgtgacaggcttatttcattctgtgtagtgtttccaaaattcatccatgttgtagcatgcatcagaatgtacttcctttttgaggttgaatgatactccattgcatgtatgcattacattttatttattaatccatcagtggatgtttaggttgcttctgccttttgggtaatgcaaataatgctgctatgaacatgggtgtgcagatacctctttgagtttctgcttctaattcgttttttttttttttgagctggagccttgctctttcgcccaggctggagtccagtgccacgccatgatctcggctcactgcaacctccacctcccaggttcaagcgattttcgcttgattctcctgcctcagcctctcaagtagctggaattacaggctcaaaccaacacaccaggcgaactttttatatttttggtagattgggggtttcaccatgttggccaggcaggtctcaaactcttgaactcaagtgatccacccaccttggcctcccaaagtgctggtattacaggtgtgagccaccatgcctggccttctgcttctaattcttttagatataaccttgaagtgacagtgctaaatctagcactgtctggtcttgaactcctgacctcaagtgatctgcctgccttggcctccgaaagtgctgggattacatgtgtgagccaccatgcctggccaattgaagatttttattacttacattttcccagaaagggggcatgccacactacaccacatcacgtgaggagcactaggttttggtcaggaggcagaagataggagtgaagggaaaaatctagggcaaagcctttactggggactccaagggaaacacagggcaggtttgagcataggatgggttagtttaaataattctggttggctttgggctacagggatggtctctagtgacttggtttgtgccctgggtatatagaatatgggaaatagtggccagcgagagttagctaaggagttggctgggctacagactgggattggttgtttggcatatgaaagacatgcttatagacaaattgttattatattcgagaattagctagctttgggaaggacattctctcccatgatttgcaaggccctcaaaagccagagcaacaaaaatacagaaaataagatatagttaatataattggcttggtgatgaacggatcccaaatagtcaaacacagaagctaagaaaacccagaacacatggtaattcttctgttgcattttttttaggaaaccacatagtgttttgcatagtggctgtaaaaattttccattcctaccaacattatacaaggttttcaattcctctggtcttcaccatgacttacgttctgtttcttctgtgttttatagtagccatccaaatgggtgtgaagtggtatctcactgtgattttgattttgattttgatttccctgatgattagtgatgctgagcatctttggatgtgcttcttggccatttgtatgtctttggagaattcttattaagacgtttgcccatttttatgtatgtatatatgtatgtatttatttattgagatggagtctctttctgttgcccaggctggtgtgcaatggcccaatctcggctcactgcaacctccgtctcctgggatcaagcaattctcctgcctcaacctcatgagtagctgagattacagatgtgcaccaccatgcctggtcaatttttgtatctttagtagagacggggtttcaccgtgttaaccacgctggtctcgaactcctgacttcgaatgatccacccacctcggcctcccaaagtactgggattacaggcgtgagccgctgcacctggcttggcccattttaaaatcaggttttttttttttttaaagttgattatagaattcttctttttttttttttctttttgatacagagtctcactctatcgctcaggctggagtacaatggtgtgatcttggctcactgcaacctccaccttccgggttcaagcaattctcttgcttcagcctcacaagtaactgggattacagacgtgtaccaccatgcccagctaatttttgtatttttattagagatgtgatttcaccatgttggccaggctggtctcaaaccattggcctcctgtgattcactcaccttggcctccccaaatgctaggcttacaggcatgagccactgtgcctggctgaggagtcttatatctattcggactattaacatcttatcaaatatatgatttgcaaatattttctcccattctgtgtgttgccttttcactctgttgattgtgtcctttgatgcacagaaggttttgattttgatatactccagtttatctatttttgtgtttccttagcttttggtgttgtagtcaagaaatcattgccaaatgcaatgttatgaagcgttttttcctgacagttttatagctttaggtcttatatttaggtctctgatccatttcaagttcatttttgtatatgatgtaaggaaagggtccaacttcattcttttgcatgtggatatccagttttcccagtaccacgtgttgaaaaggctgtcctttccccattgaaggtcttggcacaattgttgaaaatcatttgaccatatggaagagtttatttctgggatctctattctattccagttgtctatgttttgcattctttttaaaaaatatttttagtctttacatttcagaatcagtatttcaaatgtgacttgtaggactacgtgcagtgaggaagattgttaatcatcctattctgaccaggagttctgacaactttggtgctgtaggcggtgtctaaggcaggtgtcagcaaattttcctctaaaggagctgtgtgtgtgtgtgtgtgtttgtgtgtgtgagtgaaaaagaggtgagatttattttaaatttattttaagaaattggcttacatgatggtacagtcttgcaagtcaaaaatctgcagactaggctggcagtctggagacccagggaagagttgcggtgttaagtgttaagtctgaaactagtctgaaggcagaattccctctcttcctcaagagatcttaatctgttttcttttgtttttgtttttgttttgagacagagtctcacagcccaggctggagtgcagtggcacaatcttggctcgctgcaaccttcgcctcccaggttcaagcgactctcctacctcagcctcctgagtagctgagaccacaggtgcacactaccatgcctggctaatttttgtatttttagtagatacggggttttaacatgttggctaggctggtcttgaactcctgagctcaggtgatccatctgccttggcctcccaaagtgctgggattataggcgtgagccactgcacccggcctaacaatgacattttatatacacacaggcacatacacaaacctatttataaaagatgaaatactcaagacaattacagttctgatttctgtaactggtcaggtggtcacagctcatatttgtaattacctttgtctactactcattatgtatttccattgtcctcagcaagcaccacggctggttgtgattatttatctggtggggtgacccaaacctttgatttctgaagggtctaggccagtcatagtcctgcctgaatttcgttgttagagttttccatgggctttggtcacagagcttggttaatcctgaaataccctaagggatcccttgtacttcatatgtattcttccttacttcctttgtgaagcagaagtccagtttctccttggtaatcaggatgagtggcactagccagcacaacaattcccttctttgttgattcaaaggcatgaggagcctaaaagggttagatggcagttttttgtttttatttatttatttatttatttattttttagacagagtctcactctgtcacccaggctgcagtgcagtggcgcaatctcagctcactgcaacctctgctgcccggggttcaaacaattcttctgcctcagcctccccagtagttgggattacaggtgcctgccactgtgcccagctaatttttgtattttcagtagagatggggtttcaccatcttggccaggctggtcttgaactcctgacctcgtgatccacccaccttggcctcccaaagtgctgggattacaggcatgagccaccgtgcccggcctagatggcagtcctaacttctacttcagtccaattactgctatatctactgatggaaatattcctgctgttggaactaagactgccagaccagaagagtatgagatcatggggacaggaaacacaaattttgctagttggtcaactagggatatttgtggagggctgccactcccatttctatcttttggtttctagacttgtcaaccccgactatgggagaaacagcaatatattggacactgactcagacagtatacagcctcctgaaaagccttaccccagtcctgtaaagtattaccaaatagctggtactgtaactgaatcttcaaaaggcctttccaccattctatgaaatcatctgccttaggatggcggggaacatggtaagaccaccaaattccatgagcatgggcccattgctgcatttcctttgctatgaagtgagttccttggtcagaagcgatgttgtttggaatactatgatagtggttaaggcattttgtgattttacagagggaacttttgacagaagcattgcatgcagtgtaagcaaatctgtatccagagtaagcatctgttctagtcaggacaaaacactggcccttccatgatggaggggattcagtgtaatcaacctgccaccaggtagctacctgatcactgtggggaatggtaccatagtggagactcagtgttggtctctgctgagggtagattgggcactcagtggtggccatagttaggttggtcttggtgaatgggagttcatgtggccaaacccatgcgtaaccttcatccctgccatcatggccacttcgtttataatcccattgggcaatgacagaaaaatgagcctgactgtacatatgaaacaggtcaccctatccactttgtcataaaaatcctcctctgctgagtgggcattcacatggccacaaatgtctttacctttttttttttttggggctgatttagaggggtctatctataagtccatctatctcttcccaaggcttccttgtcaccaattttccaatcatgctccttccacattactgaccagccaaaccattgaccacggcctataaattggtatataattgtatatctggccatatgtccttccaaacaaaataaacaaccaggaacactgtcccaagctttacccactgggaggatttgtcttcaccactcttcttcagggaggtcttcagaaaggctctgtagtgcagcagttgtccacttctgggtggtatgtgcatgttttgtagaaccatctgtaaaccaggcctgagtcttctctttttccatcatctgattgaagggaaccccccatgagccataggtgcagctgggatagagaaagcagtgtagcaggagtgggggccgtggacatttgagccacttcttcatgtgacttagttgtgtcttcagatcatgttctggctgtgtaggcttaactttacagctgggctggtaagataacacccagttcatgaagggcagcttaggttacatggtaacttggtgtcctatggttaagcctttagtctccactaatgcccagtagcaggccaacagctgtttctcaaaaggagggtagttaactacagaggatagcagggctttgctccaatatcctaaaggcctatgctgcaacttaccaatgggggcctgcaaaaagctccaaaagacattactgtctgctactgacacttcaagcattattggttcttttttttttaatttttttatttttcgagacagggtctcgccctgtttcccaggctggagtgcagtggcatgatcctggctcactgcagccgctgtctcccaggttcaagcaattctcatgcctcagcctcctgagtagctgggattacaggggtgcactaccatactcagctaatttttgtatttttagtagagacggggtttcaccacgttgactaggctggtcttgaactcctgacctcaagtgatctatctgcctcagcctcccagagtgctgggattacaggcatgagccaccacacctggctgcatcattggttcttgcagaatcatgtgaccatagaggcagagaaatttatgttgcagcctggacctgttgcagaagcttctgttgttttgggatccactcaaaactacagcttttcaggtcattaatgtagcacatgagctgggtgtttgaatccctgagctaattttccccctactttgttcagtgaaattaggtgcaactagacagtctcattatacttgttagtttgacaaaatgtttgaaggtatcatacatgttaacccagaaccttgccttttatacttatttaatttaaagtatctgggctgggcgttgtgggatcccagcactttgggaggccaaggtgggtggatcacctgaggtcaggagttcgagagtggcctggccaacatggtgaaatcccatctgtactaaaaatacaaaaagcaattagctagtgttcttttgattactcgtaattaatgcctttaaatctagttagtttagagtaccaatttcagaaaccaaccccagaactaattcagaaaatttattcttaagatctggttcaggtagagctactcttgctaccgaaatctgtgtgtgttagggttctccagaaaaacaaaatgaactaacaggatgtgtatagtctcagtctctgtttctctttctcagaattggtcatgtggttatggaggctggctagtccaaaatcttcagagcaggctatggattcagggaagagttgatgttgtagctctagaccaagggcagtctggagagaatttcatcttctttttctttggtttgttttctcttatgggtttcaattgaatggatgaggtccacccatattaaagaaggtatctgctttactcaaagtctactgatttaaatgttaatcccatctcaaaacatgccatcgtggcaccatccaggttaatgtttgaccaaatatctgggtaccatggcctagccccattgacacataagatcactatcacagtcagataacaaatgtttagctttgtgggtcatatggtttatgttacaactactcaactgtgtggttgtagtcatagacaatacataaacaaatggctgtggctgtgttccaagaacactttatttatagatactaaaatttgaacttcatataatgttcacatcataaaataaacttttccttggatcctttcctcctttcctcctctccccctttcccccacccaccatgtaaaaaaaaaaaaaaaaaaaaaaagtaccacagccagttgcaatggtaggtacctgtgcatatcactatgcctgtaatcccacctacttgagaggctgaggcaggaggatcacttgagcccaggactgcaaggttatattgtgctataattaaacctgtgatcgtgccactgcactccagcctgtgcaatatagaaaggccccatctctttaaaaaaaaaatatacaggcagcaggcaggatttggcatagtttgctgaccgtcaagggctctcttttctaaaacataggcatggtaagaatatgtgcaaaggccatgggtgaagagctttttattttgttgcttgtgttccagttggtgcattctcaagagtaggtactttcttttcttgttcattctcttcctgagcctatcttgggattttctaagaaggttgctattagtctagtctttttccagctgctccctagattgaggcgggagaggagaaattcagcaaagatttctctctcctcatcaaggctgtcccttgcctgctttcctgtgggacagatggtgcatgtaggcaaaaggctggaacatgttggctgctcctgttacttggtgctttgagcagaaaggcctgttgggttagttcctgggctccagtgctcaatgtgtgtgtgtcctgttttgtgtttttacccatctttctgccttggctttaggtttatatgtttgcatttataaaaacttcttatggaatagaattataatgaagaggagcagcaaagagttgtggttgagagctggcagtactggaatcagaatgcttggcttgaatctgggctcaaatgcttgagagctgtgtgactttgagtacggttcttttcttttctgggcatcagtttcctaatctgtaaaagggatggaaatagggccaggcatggttccttatgcctgtaatcccaggtactcagaaggctgaggtgggaggatagcttcagcctaggaggtcgaggctgcagtgacccatgattgtgccactgcactctagcctgggtaacagagtgagaccctgtctctaaaaaaaataaaaagaaaagatggaaatgaaatagtaactcacacggtttttttgttttgttttgtttttttgagacgaagtcttggaatctcactctatcacccagactagagtgcagtgatgtaatcatggctcgttgtagccttgacttcctgtgctcaagcaattttcctgtcccaacttcctgagtggctggagctacaggcacgtgctaccatgcccagctaatttttgtatttttagtagagatggggtctccctatgttatgcaggctagtctctaactccaaggctcaggtgatccctctgctcagcctcccaaaatattgggattataggcatgagcctgcagtggccatcacatggtttttattttttgttttttatttatttttaattttttatggatctagtcctgaatccagaacatgatttttaaatgaactaatgttaaagtacttagaaaagtatctgctgcatagtaaggatatgtggttgtacaataaataaaaataaagagagctgctcacatagagtgcagatttcaaaccatctagtctttctcgttttattacattgaatttctgcttctgaatttttaattttgttataagaaggatgttagtccctctaaagtatcatttccaatattttgtttatgttccataaattttaaggttattttacttcaaattattttataatgtatatgccttttatatttgttttagttatatcaaaatgcagctttcaaaaatattttagtgtgtataattatttcagattactattagtagaagtgcttttttaaaagacaaatattatatttaagagaccctgccacaaaagtactcctcatggaagggaagatggactggggatgatgtggcagttatacagggaaaacttcacattattttgtatttaaaacataacctgaggctgggtgcggtggctcacgcctgtaatcccagcactttgggaggcagaggcaagtggatcacgaggtcaggagttcaagaccagcctgcccactatggtgaatccccgtctctactaaaaatacaaaaattagctgggcatggtgacatgcacctgtagtcccagctgcttgggaggctgaggtagagaattgcctgaacccgggaggcggaggttgcagtgagctgagatcgtgctattgcactccagcctgggcaacagagtgagactctgtctcaaaaagaaaaaaaccaaaacagaaaaacataacctaattttatattttgttttgtcatacagttgtatttgttttaaaatatctttccaccccttccaaaagtattttatccaagtagcagcacatcttatttccatgtctgggttggactttatttatacttgtctgaaactaaggaaaaagaaagtaatttatatcagttaaaagacctctacttctcaataagttagggggcggaggaatgggtctcaatctaccactcacttttctgctagaatttttttttatattgatacctcccattctttttttattttattttatttattattattatactttaagttttagggtacatgtgcacaatgtgcagattagttacataggtatacatgtgccatgctgtagaatttcttaatgttgcatcagtgtttcacaatgtaatcgaaaactcaaaatagcaatcttccttttttattttattttattttatttatgttttgagatggagtctcactctgtcgctcaggctggacagtgcagtggcatgatcttggctcactgcaacctccagctcccaggttcgagtgattctcctgcctcagcctcctgagtagctgggactacagatgcatgccaccatgcccagttaatttttgtatttttagtatagacggggtttcatcatgttggccaggatggtctgaatctcctgacctcgtgatctgcccgcctcggcttcccaaagtgctgggattacaggtgtgagccaccgcacctggcctcagaacagtttatatttaaaaattatttcaaagataggagagagttcccatgtgtctcatatgtttcccctattaacatgttacgcttgtttcattgatgtaccaatattggtacatttttattaactgaaatttatactttatccagatgtctttggtttttctaaaataccctttttctgttccaggatctcacccaggaaatcacagtacagctagtactcatgtgtctcaaggttgttcttggttgtgacattttctcactttgttttgatgaccttgacagttttggggattactggtcgaatgtttgtagaatgtccctcaattagggtttttaaaaactgatttataattcacatagtataaaatttacccttttaaaatatataattcagtgcttttgagtatattcacaacgtttcccaaccatcctatggttggaaaattagataacctactaattccacaaaatccagaatattttgatcatcccagaaagaaacctcataaccaacagcaattactctcctttcactcctctcccatcccctgaaaatcactaatctgctttctgtctatatggatttgcctattctttttttttttttttttttttttttttttgagatagagtctcactctctcacctaggctggagtgcagtggcgcaatctcggctcattgcaacctccgtctcctgggttcaagtgatcctcctgcctcagcctcctgagtagctgggattgcaggcacgtgccaccacacccggctattttttgtatttttagtagagacaaggttttgccatgtcggccaggctggtcttgaactcctgaccttaggtgatccacctgcctcggcctcccaaagtgctgggattacaggcgtgagccaccacacttggcctggatttgccaatccttaacagaacatataaaaagaaccataaaaacgcctgacatgttgcctcatgtctgcaatcccagtactttgggaggccaaagtgggatgattttttgagtgtaggagttggagacctctctgggcaacatagttagaccaggtctctacaaaaaaataaaaaaattacctgggcatggtggtgcatgcctgtagtcccagctactaaggaagctgaggtgggaggattacttgagcccaggagatggaggctgcagtaagccatgattgtgccaatgcactccagcctgggtgacagagtgacactctatctcaaaacaaacaaacaaaaaaccccataatatgtggcctttttctgtctagctgctttcactcagcataatgttgtcagggttcttccatgttgtttcatgaatcaacactccattcctttttatagcagaatgatattccattgtaccatgccatagttgtttcctttttcttttctttctttctttttttttttggagaacgggtctcactctgttgcccaggctaaagtgcaatggtgtaatcatagttcactgcagcctcaacctccctggctcaagcagtcctcccacctcagtttgggtagctgggactagaggtgcacaccactatgcctaactaattaaaaaaaaatttttagtagaaatggagtcttgctatcagggagatcttggactcctgagttcaagcaatcctctcgccttggcttccaaaagtgttgggactgcaggcatgagccattgcacctggcctcacattttgtttattcattcatcagttgatgagcatttgagttgtttccagtttttaactttttttttttttgagacggagtctcactctgtcacccaggctggagtgcaatggcagggtcttggctcactgcaacctccgcctcctgggttcaagcgattctcccacctcagcctcccaagtagctgggactacaggtgcgtgccctcacacccggctaatttttgtatttttagtagagatggggtttcactgtgttggccaggctggtctcgaactcctgacctcgtgatcagccagcctcagcctcctaaagtgctgggattacagtcatgagccaccaccagttttttagctattataaataaggctgctatgaaaatgcatatacatgtttttgcattaagatatgttctcatttcttttttttttttttttttttttggtgacaggttttgctccatcacccaggcggagtgcagtggtgccatcacagcttactgcagtctccacctctcaggctcaagtgattctcctacctcagcctcccgagtagctgggaccagaggtgtgcaacaccacatttggcttttttattttttattttgtagagacgagtcttgctatgttgcccaggctggtctcgaactcctggattcaagcgatctgcctgcctcagcctcccaaaggattgggattacaggcttgagcccctgtgcccggcccctatgttttccttttttttttttttaaatttgaaacggagtcctgctctgtcgcccaggctggagtgcagtggtgcaatctccctcaccgcgacctctgcctcccgggctcaagggagtctttagtctcagtcccaagcagctgggactgcaggcgcccgccaccatgcctggctaatttttgtattttttagtagagacagagttttaccatgttggtcaggctgatcacgaacctcctgatctcaggtgatccacctgtctcggcctcccaaagtgctgatattacaggcgtgtgaaccaccgtgcctggccgttttcatttctttgtgatctgcttaggagtagaattgtaggtcatatggtaacttcagggttaacatttgtaagcattgccaaactcttccactgtggctgtgctgtttcacatcccaatcagcagtgttagagggttccaatttctccacctcctccacaacccttgtcattgtctttttaattctagccccaagtggcatctcattgtggttttcatttgtacttctctaatgacttaacgattgtgtcttttcatgtgcttattggccattggtatttaagaactattttaatcctttgcccattaaaaaaaaatgtttttgtccttttattgttgaatagtaacacttttttttttttttgagacagtctcactctattacccaggctagagtgcagtggcgtgatctgggcttactgcaatctctgcctcctgggttcaagggattctcctgcctcagcctcccgagtagctgggactacagacatgtgccaccatgcccagctaattttcatacttctaataaagacggggtttcaccacgttggccagaatagtctcgaactgctggcctcaagtgatctgcctgcctcagtctcccaaagtgctgggattacacttatgagtcactgcgcccagccaagtactaacacttctttatacattctggatactacactcctagtagctttatgtttagcaaatattttctcccattctcttggctgtcttttcactttcttaatgtcccttgaatcgaaaacttttatgtaactgtgatgaagttcagtttatttattatttttggttgcttttgttttaggtgtcatatctaagaaactgttgcctaattcaaggttacacggatttatatatatacacacatatatttatacatgtatacataagtatacatggaatatatgtgtaaaatatacacatacacaaatgttatatatcacatttatacataggtatatatgtgtacctgtatacatatataacatgtatatatatgttctataacaagtgacttatattttattgatctattttgagttaatttttgtacatggtatgatgcaagggttctgattagtttttctagtctcctttgtctattctgtacagaatagttttattgcagttttagtgtcctttaagtacataaccttaagtgtttggcttggggataaatgtagactttgggaaaattgaattgttgggagacctatcagggtctactagcatgtcatagtggagtttagtggcaatgtctccttctctgtatcttcactccccagttgtaggatatgttgaatcagacctattattaactaacataaaatataagtgagcctaatggcagttctctttagattttctgtaaagcccaggacacccattgtgacctctcagactccaaagcgaatttcctaatggagtagaacaaacaggaaattatgaggaaaggcagtcagagtttgaaaagagaacacaccagaaacaatggaagataggtccaagaaactagataagtgcgagttgagaattgaatataattttatttaattttaataatactttaattgtaaaagtaattcataatcactgcaaaaagtaccaagcactgtaaaaattaaaaatacaaaacaatctcaaattgtgacagccaagagaaacctaaagaaacatgattataatgtttgtggcatgtaagtttggtgtccacaatggaaaaaggatattaggaaaaaaaagaaatataagatatagaaattagttaaaacaatgagaataaaaaatgaacacccaattcctgctcctagaagaagtagtactctaacatttggtgaagttctaagagccaacatttttacccagcttatactaggacctgttctaaatagtattttagctcatttaattgttaagccattgtataaagtaaacagaatcccttcttttgttacagattaggaatttaatgcacagagggttagataacttgctcaaagtaacattgtggtcaagagtcaaagctagaatttgaatcaaaagagcctgagtccaaaggcatggttttcatcactggactataatggtgtgtattctttcataattttttcagtgtaaaactgaacatacagtatgcttttattttatttatttttttgagatggagtcttgccctgtcaccaggctggagtgcagtggtgtgatctcagctcactgcaacctccgcctcccacgttcaagcaattctcctgcctcagcctcccgagtagctaagattacaggcatgtgccatcacgcccagctaatttttctgttttttgtagagatgggtttcaccatgttggccaggatggtctcgatctcctgacctcgtgatctgcccacctcggcctcccaaagtgctgggaatacaggcgtaagccactgtgcccagcctacattttatttttcgattgactcccgtgatcagagtcaacttcccatgttattttatgtgaatatgtatcaatgaactattagaaattgcaatgtttttgtaggtcaaaacaattcaatattgacaattttatatgattcagcctaatacatcattttttccatcagccatattgcatgttattatttatatatacgtttatttagttagcctatctgttctctgtgaggaacattacacagtttctgagattttgttacgatagaagtcagcattgataagcctctgcgcacctgttttaatgtaggatcattgggaactgagcagtagcttacagggcttgggaggggatttaaccatttagtcaacctccactcacatcaccctcccttcttcgataatgggcaattgagaaagggcaaatgtgtgtaaaaactatgcagatgcagtttcaggattattttcttcttttctgcagtgtcttttcccaagctacatcagcgtctaaattttggagttactgatgcttccgttatttctgcagatagaatattatgtcgtaaataatgtttacttgtccattagtattatataaaagtgcctgtttctccccactccagctatcattgattattggtaaaaattttaatgtatccaattctaataggcaaagaaaggctctcctacttagatcttaggtgggggtctaagttcatatttttgttttacaaaaattgaatagccagtgtttttgagttgaatgatctatccattccgtataggagagtttaattatattgtgattttgggggagataattttcacaatttaccccctcaaaatgtagaaagtagaaaaagggtagaaaaatcgcaccaaatttgaacaatgtagcatgcttttagagttagggatattttcttttggaaggatttcaagtctggcgtatttgcattgattgtggttatggcgcatttaacttttccaaaccagcttttttgtaccgcacataggaagacctgagggtgagtgtaaattaggattgtttggccagtggtgtgtgcaaaaatttattgtagaaccaagaattatttctttagtattttacacattttaaaaaacaggtagacatgtccattgatcccaggttgcttatggtttctagaggccccctctcattgcaacagtgctgtggggccctaggggtccagtagccccctccccccaggtcattccggtgagggagggagctgggacccctgcactgcggcaaacaagcacgcctgcgcggccgcagaggcaggctggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactgaataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtgcatagggattttaggcggaggtaggtatattggagtgattgtggcggggcgaaggtacgtgaagtgatcggtatttagggggtgttgagcgcaggtaggtgtataatagtgaccactgcgtggtggagcagggtacgtggggcgactggggggggaattcgtcgcagtgaccgaggcgaggaggctatggcagtggaccagggggatgagtcggtgtgacagtggtgggggttgtgttggtggtcgcggcgcggggagagtccgtaggaagtggctgggaggtagggggaaggcggcgacagtgggtattggcggcggtgggcattggcagcgggtaggcatggcggtggtggactttggcggcggtaggcatggcggcggtgggcatggcatggaggcggtgggcatggcggccgcggggcctgtcgctgtccggagtgactaagggacgctgaatgattgctgtgtagaggagggggcatcagaaggggcagtagcacagtccgcagcctttaattttcctgtgacctgcgatggtcatctggtttgcctactgtggtggtggtgcttttttattaaaactgcgcaatgcctacactgccgcaggggctgcagaaatgcgtggaatccttgcgtaccctttaggaaccctcgctttagaggctatggcataagaagactggaatgatgtgcagaacttgcatttacagatcttttgactgataggccaggtgatgcctgggggttacttttttttcattgtttctctctgttgggaaccaggtcttggaaggctatgtcgaaataacctgggggtctgtgttgcgtcactgccattgtgcagctccttcaagatggccgccgctgcagcggcttagatctgcgcaagcgcttcagcgggggggtggccgcttcctccctgtagagccgccagtggggagggggcaggtggtgtgtgttcagcttctgctgtttcggagtttcagccgtaccctctttagggtgcagtggtaaggagaggaagccggccaaggtgggcggctgccccctccccaaagtgctgcttgggaaaggatgcaggttgcgcagacgcagcagaggtgacagtcgcctccgcttgcagtggggcgagacgtggggcaggggagcgagggcttacgcagcttttgcctggaaggaatggcagccctccccttcacctggctgatacagcagctgttcctttccggttgtggcgcagtagaggggggaggagggagatgggttggcgcaggctccgcctagcaagcttggcagccaccccttacccacggtgcagcagtagaggactggaggggaatgtggctagaggccaggcatttgtaccacctccgcctgtgtgggatggcagctgcactgggctactgcttttcagctctgcagtaaactagagtggtggcggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataaatgtcaccatttaagattcagttatccttcttaatctctggatagtccattctgatgcactgcatactttccttaaatgggttgggggagaggacatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggagtctgggattttatatgatatttataatttacccttttttttctgcttgcatgaagatagcagttcacatacatatatttcttggtttaacttctggtcatttggctatttgcaagctgagtatttagtctgatccgccattttgtagtcttgcattcaggcccgggatcctaatatggcagatccctttggaaaggcctcttgaagtttcaaggtctgtgtcctactcagtgaattggctctgtgctagggctttttggaggcagggagtggcagcccttcctgtgatgcagaggaaggaagcttggttgagagacccttatgttgttgtctaaggcagggtactaactgatttggatttattcacagaccttgccttatcttgatttcactattctatctgaccagtgtgtcattgccgaaatgttttccacatttatagttactctgtatctttatgtttcccttaccctgttccttttcctaataaacatctttgttttacaaaaaattttgtttataaggtgtcaaggatgccaagataacctcctttgtttatcagcgccctctgtttagctattttttaggaagaatcatttaagcaggttgtgagtactgccctcaattacttggacaatgaagttttaaaaatcttatttagacctgtcactggtcctgtctcctttttttttttttttgtggcccagggccagaaagcttgagtgagaattgttactacttaaggtagcctctctccatttctggatgctagctggctcaaagttttttttttttttttttttttttttttttttttaaatagaccagggtctccctatgttgtccaggctgaactcgaactgctagactcaagctatatcctctccctcctcagtctctctctggccactgtggctggcccaaattctctttttgttaattctcctcagatttgttttggaggcaatgaggtttcttatattcatggggtacagattagcagcctatcattaaccttatttttttgtttttaggagacagggtctggctatgttgcccaggttggagtgcagtgatgcagttatagctccctgtaacctcaaactcctggatcaatctagactcctgcctcagcctcccaagtgcctgttagtacaggcttgaggtactgtgcccagctaactttttatttttttgtagagaggggtctccttatgttgcccagactggtctcgaactcctggactcaagcagtgcccctgcctaggcctcccaaagtgctggcattgcagccatgagccgctatacctggccaactttgtttatttttattcttgagatcttagttaaattttatggaaaatttaggccgtaataaaattgggattccattgctttttgcttttcaatatatttccggattattactttcagtgtaagtgatctgagggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcagcctggccaacatggtgaaaccctgtctctactataaatacaaaaattagctgggtgtggtggtgcatgcctgtaatcccagctactttggaggctgagtttgggtcttgtaatattacttcatctagcagtagagttagtgtcatatgttactttcatgattaacatttttaggaagttggcaaagtctatatataacactttatgtttccaccagcagtttccccacatcctttacaaatattgtggtgtcagatggtggcatttcagtgggggttttttcattttgaggcagggtctggctctgtcacccaggctggtgtgccagtggcatgatctcaggtcactgcaacctctgcctcctaggctcaagcgccctctcaccttagcctcctgagtagctggtaccacaggcatgcaccaccacacccagctaatttttgtatttttttgtatagatgttgcccaagctggtctcctgagctcaagtgatcgctggcctcagccttccatgaaccattgcgccctgcctcattgggattttgatttgcattttttagtgactaatgttcagcatcatttcatatagattagccacttgtatgtgtttggaggactgtctattcaagtgttttacccatcgtagcaatagaatttgcccttttattgttgagttgtgagagttccttacatattctggataccaaacttgaaaaaatacttttttgaggtgtgagtgacatacaaaagctgtagatagttaatgttaaaagttgatatgctaagagataagtacatgcctttgaaatcattcttatcaaaattagtggcataaatgtgtctgtcacctgaaaaagtttctttgcctctccctaccttcttttttttcattgtttggattttctttttgtttgttttggatactagaaacttagctgtatgttaagcaaatattttttcctattctggttatcctttcactttctttagtgttttcggaactttattttttgatgaagtccactttattttttatactgcttgtaattcaggtgttatatttaatagaccattgtgtaatcaaaagtaataaacattatcagtgtataaaattttaccatttagaaatcaaatatgtgtgtatggcttgattagaacatttaaactcttgaaagaataaaacagctgtgcgttattggtaagctattttaccaatctaaaagtctaacatgacttaaaaacatctagggttcagagaattattaatagcttttggcatgtatctttgaattttgcttttgagatattacttgtgttactttagtgaaaggtcctgctgacctttctgatttatcatctttaaaggttcataggtggtttctgcagtccctaatatggctagtctggtgtgggatttcatgttctgttcccttgagcagccattttatgaggggttctgcagacgtaacatggcgggttttttgtttgtttgtttgtttttgctatgtggatagtttttagcttgagcagctcttctattgctttgcaaatcctaaagaaagcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttaactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcctaaaaatacaaaaattaaccgagtgtggtggcacgtgcctgtaatcccagctacttgggaggctgaggcaggagaattgtttgagcccaggagacggaggttgcaatgagctaagatggcaccactgcactctagcctgggtgacagagcaagactccatctcaggaaaaaaaaaaaaagaaaatgcagtgtatgaatactaatttattttatttttttcaaattaaaggtttttcctcatagtaaaaactgagtagtagtttgtgtgtcttttgttatttcctcattttatatgtgaaaagttgagctggatgtggtggctcatgcctctaatcccagcatgttgggaggctgaggtggatcacttgagcccaggaggtggagaccagcctgggcaacatagagagacctcctctctacagaaaaataaattagccaggcgtggtgttgtctacctgtagtctcagctacctgggaggctgaagtggaagggtcacttgatcccaggaggttgaggctgcagtgagccatgtttgtgccactgtactccagtctaggtgacagaatgagatctagtctcaaaaagaaaaaaaaagttgtaaaacatctgttagcaagttttaaattatggtgagggtaaagattttttttttattttttcctatttattttgccgatttttactatagtgagtatatttaagtacattttcattttttaaaattgctttggaagacgtattttatgtacgttttgtttgtatattggtaaatattttgaaagtattttgtgtaatataatttgtcctttatatataataggttattcgatcattcattttatttgatatgaaatctcttttttcatctcttcattctttttgagacggagttttgctcttgttgcccaggatggagtgcaacctccgcctaccaagttcaagtgattctcctgcctcagtctcccaagtaactgggattataggtgtgtgccaccatgcctggctaattttgtatttttttagtagagacagggtttctccatgttggtcaggctgggctcgaactcccgacctcagatgatccgcccgccttggtttctttcccaaagtgctaggattacaggtgtgagccactgcgcccagcctctcccttcattcttttgcagctctgacgtttttttaaagtgccattactattccctgagtttctagaggtagttcagagatggtggtggaggtagggctgaggtttaggactcttaggtttaggactgttaagtgggtgaaggttctatcttgctatatttttgttacagtttttttcctatgtaacctcagtgtggactaaataacaggtagtctcatcctcatcttgttgtgggatgacgttagccttctaggcatcttgtccatatttatggaaacattttgatggttttgaagaagaaataacttgagtttttcttatctgcactgcatatatatgtacaaatactgcagggtcttgagttgggggaatgatctgagtaaagtgtagagttagggaaatagtataatttttcccccttgtgcgttttcattttgagagtaattggattatggaatgggtaagcaggattggttaacactgcctcattgtccatgtgtttaggattctcaggattggtatacttagaatgttatactagaagtgttcaatatttacccattcatctcctacttcctaccaaatcataagtagtattgggaggcagtcttcctggaggagttgtgtggttattagccctaaagatcaatgaaggaggctgggtgcggtggctcacgcctgtaatcccagcactttgggaggcgaaggtgggcagatcacctgaggtcaggagttcaagaccagcctggccaacatggtgaaacctcatctctagaaaaataaaaaaatcagccgggtgtggtagtgtgcacctgtaatcccagctactcaggaggctgaggtggaagaatcgcttgaacctgggaggcaaaggttgcagtgagccgagatggtgccattggctgtgcctgggtgacatagcaagactccatctcaaaataaagtaaaaataaaaagttcactgatttattttaaattttttattctgtctttcagtgtatttgtcactaaattagctcttattctttggggctggatgatgtatcgtgagttcgaagggaaattggaaattggagctggagagttgtcttaatatattttatgctaagcttcacatgtcttttcaaattaatattctgcactctatgaattaaattctgtgtaggctgcctcattttctcagtctttaatcttctattgggttacaggttagatctgagggggacattgcaatagagaattatcttacgtttcaagataacattatatatatttttttttactgaaacactttttagacctttatgaataataatcagaaacttagttgtcatttgtaaacagaggttagagtggagaatgcccaaattaagatttatttattcagtgattagactatgaattagagtataaagtagactatgaattagagtgtgaagatttagaggtatgtgcagtgcaattctgactacttggagttagtgcaaatttcacagttgtctagatgccctccagaacattcccctcaatgcagacaccaactccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgcttaccagtagatgattggtttacatattttaagagcccttaaatagccctggaagttctatatttcaggtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtaagtatcttaagtatccactagtcccttgtacaatctctgtgtagagattcctgttttgtgttataatttctcataagatagtgtcatcctctgaccctaaagaaagatcttcttccctgggcgtggtggctcacgcttgtaatcccagcactttgggaggccaaagtgggtggatcacctgaggtcatgagttccagatcagcctggccaacatggtgaaaccccatctctactaaaaatacaaaaaaattagccgagagtggtggcaggcacctgtagtctcagctactcgggaggctgacactggagaatggcgtgaacccaggaggcggagcttgcagtgagcccagatcgtgccactgcactccagcctgggcgacagagtgagactctgtcttaaaaaaaaaaaaaaaaattagctgggtgtggtggtaggtgcctgtaatcccagctacttgggaggctgaggcaggagaatcacttgaaccccgaaggcagtgtttgtggtgagcagaaattgcttcattgcactccagcctgggcaacagaatgagaccctgtctggaaaaaaaaaaaaaaaaaaaaggaatatcttcttaaatgtaagggtacctagttttctttcatatggtttcctataaagacaaatgtatttttatcatttatatatattgtgctcttgttgtaggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagttacaacatactttcacagcattattttaattcaaatatggtttatgtcagtgaattataaatacacagcacataattaacaatgagtattagagaatctaaatactttctcatgcttatttactaattcctttttgttttgtctttttctcacttttctgttttaaccaatgtatttcctctttgaatcagcagacaatgtaataaaaatattattcataatttttcaatgtgatgtagatttatttagttctttttatgttgctttcattttttaggaaaaagttattacaaagtcgattttgatttgttttcttgtttttcctctgtgatttttctttttttctactttaagttttagaatgccctcatttctgagagtttactatttactttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccaggaaaaataagaaaataaactattaatgtggccgggtgtggtggctcacgcctgtcatcctagcacttggggaggctgaggcaggtggatcacctgaggtcagaagttcgagaccaacctggccacatggcgaaaccccatctgttctaaaaatacaaatattagccgggtgtagtgggggacacctgtaatcccagctactcgggaggctgaggcaggagaatttcttgaaccctaggggcagaggttgcattgagcagagattgtgccactgcgcttcagcctgcgtgacagagcaagacttctatctcaaaaaaaaattgtgttatgaatattctgtttttctttggtacctaaatatttaccagggtacatatccaactggatacctacctagtagttgggatgcagggtgtaatattagtatgacttttaaacgtttttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtctcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgaccactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggaccgctaagcttgtgggagttatttatatcctattgctcaaggtcattgccaaggtctgatttttcacaaaaaaattccaacctctggcataaatgggttaaaaacggctttagtgatgtagtgctgataaacataaaattcacccaatttaagtgcatgaagcaatgatttaagtaaatttacagaactgtgcaatcattgccatgaactactctggaaacattttcatcaccacagtaagatctgtcttgctcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaaaaaaaaaaaaaaaaggatattgctaatgagtctcatataccatgttttcttggatttagactgctttataaagaatcataagataatattcaaaacttctaagttatagtccttaaactcttactcatatttaggacagaaactacatttaatttttgtggaggtctttgtttgcttatttgaaaagttcttttgagatctttataggttttatttaatacattttttaatgtacagacatcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgttgggattatgggcgtgagccaccacacccagcctcttctctgtttaacattgtattgtgagtgttcatagtatgcaggatagtaacatgatatacaggtttgtagcctaggatctaccatattgcctaagagtatagtagactctgtgtatcctctaggtttgtgtaagtacactgttcatactgtgatgaaatcaccaaatgcatttctcctaatgtgtccccattacgtgacttatttatttattttgagatgaagttttgctcttgtccctccttgttgcccaggctggagtgcagtggcgcgatctcagctcactgcaacctctgcctcccaggttcaagcgattctcctacctcagcctctcaagtagctgggattacaggcacccaccaccatgcctggctaatttttttgtatttctagcagagacgggatttcaccatgttggccaggctggtctcgaactcttgacctcaggtgatccacctgccttggcctcccctggtgctgggattacaggcgtgagccacctcacccggccgttaacgtgatttataactttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtgaggaaccagcagagggttttatattattgggagaatatgactaagccggaggccgaggagatttaaaaacctaagtgtatgtgtcatacaatgtaaacagcatatggtttaggaggaaccaaaacacagatatatgggaggaagggaataaaactagctgcttaaaatggtcattgggtgattaaagttacccaggttactcttggcaagagtaacttgccactagtggtgagtgaacagaatgcatggatataccacagttgaaaagaccaaagggctttttggatgtcagtgtactaagattagtttttaaaatatgggaataggccgggtgcagtggcttacgcctgtaatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 549 - DNA, 23595 bp, Homo sapiens
cagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactgaataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtgcatagggattttaggcggaggtaggtatattggagtgattgtggcggggcgaaggtacgtgaagtgatcggtatttagggggtgttgagcgcaggtaggtgtataatagtgaccactgcgtggtggagcagggtacgtggggcgactggggggggaattcgtcgcagtgaccgaggcgaggaggctatggcagtggaccagggggatgagtcggtgtgacagtggtgggggttgtgttggtggtcgcggcgcggggagagtccgtaggaagtggctgggaggtagggggaaggcggcgacagtgggtattggcggcggtgggcattggcagcgggtaggcatggcggtggtggactttggcggcggtaggcatggcggcggtgggcatggcatggaggcggtgggcatggcggccgcggggcctgtcgctgtccggagtgactaagggacgctgaatgattgctgtgtagaggagggggcatcagaaggggcagtagcacagtccgcagcctttaattttcctgtgacctgcgatggtcatctggtttgcctactgtggtggtggtgcttttttattaaaactgcgcaatgcctacactgccgcaggggctgcagaaatgcgtggaatccttgcgtaccctttaggaaccctcgctttagaggctatggcataagaagactggaatgatgtgcagaacttgcatttacagatcttttgactgataggccaggtgatgcctgggggttacttttttttcattgtttctctctgttgggaaccaggtcttggaaggctatgtcgaaataacctgggggtctgtgttgcgtcactgccattgtgcagctccttcaagatggccgccgctgcagcggcttagatctgcgcaagcgcttcagcgggggggtggccgcttcctccctgtagagccgccagtggggagggggcaggtggtgtgtgttcagcttctgctgtttcggagtttcagccgtaccctctttagggtgcagtggtaaggagaggaagccggccaaggtgggcggctgccccctccccaaagtgctgcttgggaaaggatgcaggttgcgcagacgcagcagaggtgacagtcgcctccgcttgcagtggggcgagacgtggggcaggggagcgagggcttacgcagcttttgcctggaaggaatggcagccctccccttcacctggctgatacagcagctgttcctttccggttgtggcgcagtagaggggggaggagggagatgggttggcgcaggctccgcctagcaagcttggcagccaccccttacccacggtgcagcagtagaggactggaggggaatgtggctagaggccaggcatttgtaccacctccgcctgtgtgggatggcagctgcactgggctactgcttttcagctctgcagtaaactagagtggtggcggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataaatgtcaccatttaagattcagttatccttcttaatctctggatagtccattctgatgcactgcatactttccttaaatgggttgggggagaggacatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggagtctgggattttatatgatatttataatttacccttttttttctgcttgcatgaagatagcagttcacatacatatatttcttggtttaacttctggtcatttggctatttgcaagctgagtatttagtctgatccgccattttgtagtcttgcattcaggcccgggatcctaatatggcagatccctttggaaaggcctcttgaagtttcaaggtctgtgtcctactcagtgaattggctctgtgctagggctttttggaggcagggagtggcagcccttcctgtgatgcagaggaaggaagcttggttgagagacccttatgttgttgtctaaggcagggtactaactgatttggatttattcacagaccttgccttatcttgatttcactattctatctgaccagtgtgtcattgccgaaatgttttccacatttatagttactctgtatctttatgtttcccttaccctgttccttttcctaataaacatctttgttttacaaaaaattttgtttataaggtgtcaaggatgccaagataacctcctttgtttatcagcgccctctgtttagctattttttaggaagaatcatttaagcaggttgtgagtactgccctcaattacttggacaatgaagttttaaaaatcttatttagacctgtcactggtcctgtctcctttttttttttttttgtggcccagggccagaaagcttgagtgagaattgttactacttaaggtagcctctctccatttctggatgctagctggctcaaagttttttttttttttttttttttttttttttttttaaatagaccagggtctccctatgttgtccaggctgaactcgaactgctagactcaagctatatcctctccctcctcagtctctctctggccactgtggctggcccaaattctctttttgttaattctcctcagatttgttttggaggcaatgaggtttcttatattcatggggtacagattagcagcctatcattaaccttatttttttgtttttaggagacagggtctggctatgttgcccaggttggagtgcagtgatgcagttatagctccctgtaacctcaaactcctggatcaatctagactcctgcctcagcctcccaagtgcctgttagtacaggcttgaggtactgtgcccagctaactttttatttttttgtagagaggggtctccttatgttgcccagactggtctcgaactcctggactcaagcagtgcccctgcctaggcctcccaaagtgctggcattgcagccatgagccgctatacctggccaactttgtttatttttattcttgagatcttagttaaattttatggaaaatttaggccgtaataaaattgggattccattgctttttgcttttcaatatatttccggattattactttcagtgtaagtgatctgagggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcagcctggccaacatggtgaaaccctgtctctactataaatacaaaaattagctgggtgtggtggtgcatgcctgtaatcccagctactttggaggctgagtttgggtcttgtaatattacttcatctagcagtagagttagtgtcatatgttactttcatgattaacatttttaggaagttggcaaagtctatatataacactttatgtttccaccagcagtttccccacatcctttacaaatattgtggtgtcagatggtggcatttcagtgggggttttttcattttgaggcagggtctggctctgtcacccaggctggtgtgccagtggcatgatctcaggtcactgcaacctctgcctcctaggctcaagcgccctctcaccttagcctcctgagtagctggtaccacaggcatgcaccaccacacccagctaatttttgtatttttttgtatagatgttgcccaagctggtctcctgagctcaagtgatcgctggcctcagccttccatgaaccattgcgccctgcctcattgggattttgatttgcattttttagtgactaatgttcagcatcatttcatatagattagccacttgtatgtgtttggaggactgtctattcaagtgttttacccatcgtagcaatagaatttgcccttttattgttgagttgtgagagttccttacatattctggataccaaacttgaaaaaatacttttttgaggtgtgagtgacatacaaaagctgtagatagttaatgttaaaagttgatatgctaagagataagtacatgcctttgaaatcattcttatcaaaattagtggcataaatgtgtctgtcacctgaaaaagtttctttgcctctccctaccttcttttttttcattgtttggattttctttttgtttgttttggatactagaaacttagctgtatgttaagcaaatattttttcctattctggttatcctttcactttctttagtgttttcggaactttattttttgatgaagtccactttattttttatactgcttgtaattcaggtgttatatttaatagaccattgtgtaatcaaaagtaataaacattatcagtgtataaaattttaccatttagaaatcaaatatgtgtgtatggcttgattagaacatttaaactcttgaaagaataaaacagctgtgcgttattggtaagctattttaccaatctaaaagtctaacatgacttaaaaacatctagggttcagagaattattaatagcttttggcatgtatctttgaattttgcttttgagatattacttgtgttactttagtgaaaggtcctgctgacctttctgatttatcatctttaaaggttcataggtggtttctgcagtccctaatatggctagtctggtgtgggatttcatgttctgttcccttgagcagccattttatgaggggttctgcagacgtaacatggcgggttttttgtttgtttgtttgtttttgctatgtggatagtttttagcttgagcagctcttctattgctttgcaaatcctaaagaaagcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttaactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcctaaaaatacaaaaattaaccgagtgtggtggcacgtgcctgtaatcccagctacttgggaggctgaggcaggagaattgtttgagcccaggagacggaggttgcaatgagctaagatggcaccactgcactctagcctgggtgacagagcaagactccatctcaggaaaaaaaaaaaaagaaaatgcagtgtatgaatactaatttattttatttttttcaaattaaaggtttttcctcatagtaaaaactgagtagtagtttgtgtgtcttttgttatttcctcattttatatgtgaaaagttgagctggatgtggtggctcatgcctctaatcccagcatgttgggaggctgaggtggatcacttgagcccaggaggtggagaccagcctgggcaacatagagagacctcctctctacagaaaaataaattagccaggcgtggtgttgtctacctgtagtctcagctacctgggaggctgaagtggaagggtcacttgatcccaggaggttgaggctgcagtgagccatgtttgtgccactgtactccagtctaggtgacagaatgagatctagtctcaaaaagaaaaaaaaagttgtaaaacatctgttagcaagttttaaattatggtgagggtaaagattttttttttattttttcctatttattttgccgatttttactatagtgagtatatttaagtacattttcattttttaaaattgctttggaagacgtattttatgtacgttttgtttgtatattggtaaatattttgaaagtattttgtgtaatataatttgtcctttatatataataggttattcgatcattcattttatttgatatgaaatctcttttttcatctcttcattctttttgagacggagttttgctcttgttgcccaggatggagtgcaacctccgcctaccaagttcaagtgattctcctgcctcagtctcccaagtaactgggattataggtgtgtgccaccatgcctggctaattttgtatttttttagtagagacagggtttctccatgttggtcaggctgggctcgaactcccgacctcagatgatccgcccgccttggtttctttcccaaagtgctaggattacaggtgtgagccactgcgcccagcctctcccttcattcttttgcagctctgacgtttttttaaagtgccattactattccctgagtttctagaggtagttcagagatggtggtggaggtagggctgaggtttaggactcttaggtttaggactgttaagtgggtgaaggttctatcttgctatatttttgttacagtttttttcctatgtaacctcagtgtggactaaataacaggtagtctcatcctcatcttgttgtgggatgacgttagccttctaggcatcttgtccatatttatggaaacattttgatggttttgaagaagaaataacttgagtttttcttatctgcactgcatatatatgtacaaatactgcagggtcttgagttgggggaatgatctgagtaaagtgtagagttagggaaatagtataatttttcccccttgtgcgttttcattttgagagtaattggattatggaatgggtaagcaggattggttaacactgcctcattgtccatgtgtttaggattctcaggattggtatacttagaatgttatactagaagtgttcaatatttacccattcatctcctacttcctaccaaatcataagtagtattgggaggcagtcttcctggaggagttgtgtggttattagccctaaagatcaatgaaggaggctgggtgcggtggctcacgcctgtaatcccagcactttgggaggcgaaggtgggcagatcacctgaggtcaggagttcaagaccagcctggccaacatggtgaaacctcatctctagaaaaataaaaaaatcagccgggtgtggtagtgtgcacctgtaatcccagctactcaggaggctgaggtggaagaatcgcttgaacctgggaggcaaaggttgcagtgagccgagatggtgccattggctgtgcctgggtgacatagcaagactccatctcaaaataaagtaaaaataaaaagttcactgatttattttaaattttttattctgtctttcagtgtatttgtcactaaattagctcttattctttggggctggatgatgtatcgtgagttcgaagggaaattggaaattggagctggagagttgtcttaatatattttatgctaagcttcacatgtcttttcaaattaatattctgcactctatgaattaaattctgtgtaggctgcctcattttctcagtctttaatcttctattgggttacaggttagatctgagggggacattgcaatagagaattatcttacgtttcaagataacattatatatatttttttttactgaaacactttttagacctttatgaataataatcagaaacttagttgtcatttgtaaacagaggttagagtggagaatgcccaaattaagatttatttattcagtgattagactatgaattagagtataaagtagactatgaattagagtgtgaagatttagaggtatgtgcagtgcaattctgactacttggagttagtgcaaatttcacagttgtctagatgccctccagaacattcccctcaatgcagacaccaactccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgcttaccagtagatgattggtttacatattttaagagcccttaaatagccctggaagttctatatttcaggtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtaagtatcttaagtatccactagtcccttgtacaatctctgtgtagagattcctgttttgtgttataatttctcataagatagtgtcatcctctgaccctaaagaaagatcttcttccctgggcgtggtggctcacgcttgtaatcccagcactttgggaggccaaagtgggtggatcacctgaggtcatgagttccagatcagcctggccaacatggtgaaaccccatctctactaaaaatacaaaaaaattagccgagagtggtggcaggcacctgtagtctcagctactcgggaggctgacactggagaatggcgtgaacccaggaggcggagcttgcagtgagcccagatcgtgccactgcactccagcctgggcgacagagtgagactctgtcttaaaaaaaaaaaaaaaaattagctgggtgtggtggtaggtgcctgtaatcccagctacttgggaggctgaggcaggagaatcacttgaaccccgaaggcagtgtttgtggtgagcagaaattgcttcattgcactccagcctgggcaacagaatgagaccctgtctggaaaaaaaaaaaaaaaaaaaaggaatatcttcttaaatgtaagggtacctagttttctttcatatggtttcctataaagacaaatgtatttttatcatttatatatattgtgctcttgttgtaggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagttacaacatactttcacagcattattttaattcaaatatggtttatgtcagtgaattataaatacacagcacataattaacaatgagtattagagaatctaaatactttctcatgcttatttactaattcctttttgttttgtctttttctcacttttctgttttaaccaatgtatttcctctttgaatcagcagacaatgtaataaaaatattattcataatttttcaatgtgatgtagatttatttagttctttttatgttgctttcattttttaggaaaaagttattacaaagtcgattttgatttgttttcttgtttttcctctgtgatttttctttttttctactttaagttttagaatgccctcatttctgagagtttactatttactttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccaggaaaaataagaaaataaactattaatgtggccgggtgtggtggctcacgcctgtcatcctagcacttggggaggctgaggcaggtggatcacctgaggtcagaagttcgagaccaacctggccacatggcgaaaccccatctgttctaaaaatacaaatattagccgggtgtagtgggggacacctgtaatcccagctactcgggaggctgaggcaggagaatttcttgaaccctaggggcagaggttgcattgagcagagattgtgccactgcgcttcagcctgcgtgacagagcaagacttctatctcaaaaaaaaattgtgttatgaatattctgtttttctttggtacctaaatatttaccagggtacatatccaactggatacctacctagtagttgggatgcagggtgtaatattagtatgacttttaaacgtttttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtctcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgaccactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggaccgctaagcttgtgggagttatttatatcctattgctcaaggtcattgccaaggtctgatttttcacaaaaaaattccaacctctggcataaatgggttaaaaacggctttagtgatgtagtgctgataaacataaaattcacccaatttaagtgcatgaagcaatgatttaagtaaatttacagaactgtgcaatcattgccatgaactactctggaaacattttcatcaccacagtaagatctgtcttgctcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaaaaaaaaaaaaaaaaggatattgctaatgagtctcatataccatgttttcttggatttagactgctttataaagaatcataagataatattcaaaacttctaagttatagtccttaaactcttactcatatttaggacagaaactacatttaatttttgtggaggtctttgtttgcttatttgaaaagttcttttgagatctttataggttttatttaatacattttttaatgtacagacatcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgttgggattatgggcgtgagccaccacacccagcctcttctctgtttaacattgtattgtgagtgttcatagtatgcaggatagtaacatgatatacaggtttgtagcctaggatctaccatattgcctaagagtatagtagactctgtgtatcctctaggtttgtgtaagtacactgttcatactgtgatgaaatcaccaaatgcatttctcctaatgtgtccccattacgtgacttatttatttattttgagatgaagttttgctcttgtccctccttgttgcccaggctggagtgcagtggcgcgatctcagctcactgcaacctctgcctcccaggttcaagcgattctcctacctcagcctctcaagtagctgggattacaggcacccaccaccatgcctggctaatttttttgtatttctagcagagacgggatttcaccatgttggccaggctggtctcgaactcttgacctcaggtgatccacctgccttggcctcccctggtgctgggattacaggcgtgagccacctcacccggccgttaacgtgatttataactttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtgaggaaccagcagagggttttatattattgggagaatatgactaagccggaggccgaggagatttaaaaacctaagtgtatgtgtcatacaatgtaaacagcatatggtttaggaggaaccaaaacacagatatatgggaggaagggaataaaactagctgcttaaaatggtcattgggtgattaaagttacccaggttactcttggcaagagtaacttgccactagtggtgagtgaacagaatgcatggatataccacagttgaaaagaccaaagggctttttggatgtcagtgtactaagattagtttttaaaatatgggaataggccgggtgcagtggcttacgcctgtaatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 550 - DNA, 36025 bp, Homo sapiens
tgtggtgacagactttctttataaacatttggaagttttctcccccatcttcttaagaagcaggggggcaggtggaggagagtgaggggagagctgcccggtgcagacccaggacgagggctgcacttggtgtggccgtgtcctgagcctcagtgaggctgggcagatggtctcggagcctccatggggcgtagcaggaaccgggcttggcttcctattgtgactgatgagaaaagtgaccacgtgggggtcagtcgggggcaaggggctcagccccactggactctgggctgcagaggccaccccccaggtgggggtgcccgcagggatggaggcagctcctgaactggtggccagcccacggggtactggaagacagtggttctgatgggttcagccctagagagagagagagaagcggggagaataagagtgcactacagcccaggcttatgccacccccagcccacctgcctcaccaccctggctgtggggagggtcagctgcctgcatgacttttctggaaggcagagcctcgaaaataggcagaccgtttgagccagcgacctcacctctaggaactgagcccaaggaaatagcggggttgcaggcagacattgagctgcgagacaatgggaataaccttcgtgtccacctgtgggggactgattcaatacatatgcacgtccacagcagagaatgccatgcggcctgtgtaagaattaaggcagatttatatgcactgatgaggaaagacatactgtgtgatagggagaaaaagcagcttataaaataatgtatatagcatgatactatttttgtttaaaaatatataaaatatataaatgcataaaaaaatcctggaagacacagcaaaatgttaacagtggtcctatctgagtggtgccattatgggtgacttttttactcctttatatttctcaaaagttttacgagcacacaagcctttgaaatcagaaaaaaacattgtctaaatttttttttaaagcctaatttctcatgctactcactgtcctcctcctcaacgtccaccccgagccacctcccctggaacttggggtccatgtaagtacttgccctaggagaggcatcctccgtgcccagcccggggcaccctgccaaggcccagcgatggccccccaaccattcttccacctgtcccatactcagatccttctggccttgggccccacgcatgctgcttctccagggccgcatggcccttctcaggcttcgaagtactttgaacctttgagcactttgaactcccatcaccccagctgcctatacaagacctttctggaaggcagagcctcaaaaacatgcagaccctttgaaccagcaacctcacctctaggaactgagcccaaggaaatagcagggttgtgggcagccattgagttacagcaatagccgtgagacaatggaagtagccttcatgtccagctgtgggggactgattaagtacacgtgcacattggccgggcgcagtgactcacgcctgtaatcccagcgctttgggaggccaaggcgggtggatcacgagatcaggagatcgagaccatcctggctaacatggtgaaaccccgtctctactaaaagtacaaaaaaaaattagccgggtgtggtggggggcacctgtagtcccagctacttgggaggctgaggcaggagaatgacgtggactaaggaggtggagcttgcagtgagccgagatcgcgccactgcactccagcctgggcgacagagcgagactccttctcaaaaaaaaaaaaaaaaaaaaaaagtacacatgcacatccacatccacagcagagagtgccatgcagccgccgccaaaattcaggcaggagctcatctgtcttccacttaggactggagtccccagaggatgtagaccaggggataggggtaaggtgtatttgtaccccaaggcgcagggccaggcctggtgccaggaggccacccagtgattgtggaacaaacagcaatgctgaaagatcttactgaccaggtgctattctgggccacacaccatgacctagagaaaccttaagaatcctcaggcgaaccccattttatagatgaggaaactgaggtgcaaggagtcagtcacgtgaccaagtgacaccctcgggatgaggcctgagggcctggaataccagccccacatcggctgcagacacggccttcccacttcagctccctctgctctggcacactcccacaccccaacatccagccttcaggcaaggtgaggccctggcagctcctggcaggctcaggggcccagtggccagccctctgcagagagagaagggcttgggcctgcggagaggggtttggagaggcctctgacctccgagggggaggtggagagccggggtcaggagccctgggagtttcccctgctgcacccacccaacctgcccctctctggaccagacctgccatgcagagtcaaggactccggggagctctgggtgcagcctccaggacccccaggtgtgagaggacagggacatcccctgcttcatggctcactgcctgctagaaagtgcagaaggcagctcttgacatgatttatggcactggggagatttcataaactccaccagccgcagagaaggcggggaggctccgcagttgctggaagggagtgccctagctgccagccaagcctgggctccctgcagggccacagggacagtggggatccccagggagggtgtgatcctggggagccccttcccctgagcctcaggcccttcctctagaaaatggggcagattcctgggaacctgggacctcctgggtccaagtctcagccccgtgcccctgcctgccctgaggtcccgccagtagacaggcatacccagtgcctgctcacacacactggcacactgccagggccccagacacgtgagccaaagccttggggacattgaggtgcgtgtctggcacaactctgctcgtagcttctctggtgacctgtttgtcctgtgcgtgaggacaggagccactctcttgcattttcccagccgcggtcctaatcagaggaaacagagtcgaggaggaggatgggccaggatggcagcgcccgcccagagaggggtgcaaaggagagattaagagggatagagtcgcaaactgaagagccaacaatgggcagcagggccaggcctggccttgccgagggattagtctgtgtgtctgaggccgccgctgctcttgacagatccctcagggtcagtctgcggagggggataagagctatgccaccaggctggggcttcatggacccccacttccccatgtttacaaggagggctggcctggctcactggagaggctcagctcagccagcggaggttggagcccgcaggtctcggttccccgaggtggggtgggcagctctctgtgccttgtactctgggggaggaagcagataccctgagaggaagagggggtcccccaggcttccagaccaggccccacaaaaggctcgcagcactaacacctggggaacgcccgaacagcagcctaaatgctcattcatgcagtaaacctgtcctgggcacccccaagtctgcccaggccatgcaggagaagcgggggctgggaggggtgatgtctcagctagagcttccaggacaagtctgactctgccaggcagagaggtgggaggcagtttcaggcaagaaaatagcatgcgcaaggtgctccaaaatcacaaatgatgcctcatctaagctgctgccgagtgtccagtgggaccaccagtcaggccagaggcaagaggtgagaaggtgagatccgactggctgcggaggcatcagggagggtcccccgccccagccccagccccagccctgcaaatggggctgtgcggccagaggtggaggatgtggggaagcgccagggccagggtgcatcagggctgctgtgtggaggatcccccgcgggagcagagggaaggtgggagaccagggaggggccgctggggtgcccaggagagccagggtggaggaagaacattgttgctgcagcactgcctccaggctggagagggagccaggaagaaagtgaggtagccttgcgggggctggggctggaatccaccccctcccattaagcagggtagggggtgtggatgcaggggaggggctcaaagcccaggacggagggaaaggctgctaggcttcaggagaccagcctgcccggagacagttatggacgcccaaggcagcaatggcaaaagcaggaataaacggtcacctcccttcccacagcccctttttctcaaggctggacaggcctgctctgcctagagaacaattcattttggccccaagccctcaggaggcaggaggaaggcaggtggcagatcccctggaaggggccaggctgggtggccagagggacaatggcccagagcacagggctcagaccccctacagccaaggtgggctccagttgcagaacaatcattcccaaaacagtcactgccatcagggcagcctgctgctgccactgccactacccacagccacacagagccttgggccagccctgaacttggtgtcagaggcagcctggggtctagacacagagcagggacctagctctctctcaagtgagggctaagggcagcagggcacgtgtgatcaggatggccccacctcctggagaggttaagattcctcagatgcaaaatgggggtgccaatctccctgaatgcccccaaacactgggaacactgtaagcaccaaactcaattctcatatggtcaccacttcaacctgtgactaggagccagtcattcagcctcagtttccccatctggtaccctagtcccccaagtctcaaattcatagcgccttgtttcagcacagggatgcatctgtctggaacccaggcaaggactctggggcaccccatctctaccccacccattggtgctcactccagttcagccacagggactccatgaaaccttgtcacagccccaagagacagccgggcctctgtgactcgctcccagcggaggacaccatggacccagagcagggaggcgagtggctggtgcaactcggttagcaggtggcagagtgaggatgggactcataggagatcctgtccaagtagcggtgcaggggccagagctttctgggcagcctccaaccagctcaagccttttgcacacgggctgaaggagtctggggtgtaggacgtggatccctggacagcaaccagtcccaaaggaggtgctcacatgcacaaagacaggatagaacccctttagacgggacccttcagacaggaccaggaggagagaatgtcacactccaacgtttgagtcatgtctgtaccacatatacttttaaggtggggagacaaaaactgaacacggatttaaaataaaggtaaaagacaaagttagttttaaaacacctttactggctgggtgcggtggctcatgcctgtaatcccagcactctgggaggctgaggcaggtgaatcacctgaggtcaggagttcgagaccagcctggccagcacagcgaaactctgtctctactaaaaatacaaaaattagccgggcatggtggtgcatgcctgtaatcccagctacttgggaggctgcagcatgagaaatgtttgaacccaggaggcggaggttgcagtgagccgagatcgtgccactgcacttcagcctgggtgacagagcgagactccatctcaaaaaaaaaaaaaaaaaaaaaaaggctgggcgcggtggctgacacctgtaatcccagcactttgggaggctgaggcgggtggatcaggagggcaggagattgagaccatcctgggtaacatggtgaaaccccgtctccactaaaaacacacaaaaaaattagccgggcgtggtggcgggtgcctgtagtcccagctactcaggaggctgaggcaggagaatggcgtgaaccccaagaggtggagtttgcaatgagacaattgcaccactgtactccagcctgggcggtagagcaagaatccgtctcaaaaaaaaaaaaaaaagccgagtgtggtggctcatgcctgtaatcccaacacgttgcactttgggaggccgaggcaggcggatcacctgaagtcgggagttcaagaccaggctggccaacatggtaaaaccccatctctacaaaaatacaaaaatcagccaggtatgatggtgggtgcctgtaatcccagctacttgggaagctgaggcagaagaatcgcttgaacccagaggcagaggttgcagtgagctgagatcacaccactgcactccagcctgggcaatacagcaagactccatcacaaaaaaagaaagaaagaaagaaaaaaaacaccctcatagtctctttcactggagcacagagaaggcaagaagtttggccttcacctcctggcagagctccaagggaaggcctcttcccccagactatctggccaggtccccttggcccaggccaggccaccattttgtgaagccacaccacagaggtagtcaggtctgaagcccgttgcaagatggggaaagcaaggtagtcgggatgggaaaacgtgttcaaagtcgcatgcggctcctgggcgcagctttatccccttttcctcccctccctccttcaactgctggaggaagagcccaggagctcaggcttcggttttggccgccagcctttgtctgcccctgcctgccctgtgccccgttctgatgtgaatatcacccgaggcccttccctcaaagaggaggaccagggacatcacgaagcacacaccccaaggaccccgatccagcagctccccttctacttgtgagcgtcccgagggctggggccatctccagacccccttccttagaaaggcagtgggaccaggacctcgtcatcacgcctgtgcaatcccggctctacattttcccgtctgtgtgccctcgggcaagtcgcaccctccctgttttcccttctgcaaggccctagaggcaacagtgggcagcagtgcatggtgaccacagcccaggcccctccctctggcaacggacttgtgacttgcagccaaatcagctctgccgcctgcctcccctccagccagcacagactccaacaggggcccagctttgggagaggctctttcaaacacccctcagcctctggccagggcctggggccccaagggctcctcggggagctatgtgtaggcaactttattcggcccctgggcctgggcagttcatggagattcctgagcctcaggaaggggaaggcgggctggggttttgcccccagggggcacagcgggagggaaccctggggacctgtacctgctacttggggctgagctcagccgcttggctctcttctccagccagtcctccagatggccctcggggagctcaggagcatctagtagccactccctggctcgcctctcctctgtggggacagggagacaaaggcaagtgaggggtacactcctgcctgccagaaccctaccctctcacaaagcagaagcaactggtaggccctgagcaagcctgggaagttgcagcaaccttccaggaggatgcacctggactgcttctccaggccatctgtgcacgagggcccagcactcggcctcgctctgttttcccatcaaatagagacaaccccggctgcctccaagctcttggggagctggaaacaggacagtgcttgtagagaacctggccctggccaggcgtggtggctcacgtctgtaatcccagcactttgggatgccaaggcgggcggatcacctgagtccaggagtttgaaaccagcctggccaacatggagaaaccctgcctctactaaaaataaaaataaaaaaaattagccatgtgtggtggtgggtgcctgtaatcccagctacttgggagactgaggcaggagaatcgcttgaacctaggaggtggaggctgcagtgagctaagatcgcaccactgcactccaacctgggcggcaagagtgaaactccatctcaaaaaaaaaaaaagagagagagagcctggccctaaggaggggtctgaatctgaggtgcagggaggcagtgagggcagtcgaatggggtcacatctcagctctgtcacctgccgggtctttgaccctgggcagggtaatgagcctcagcttccctggtttttattctcataagctgtccaacaaaacctgttgctcaacgaattaaaaccaatcaacgaatggaatttatacaagctgggtgtgagcgtttgatggggtcagagtcgccaagtcatctgggatggagtcttgggccagaggaaagtaatcatacacttgactagcactcactcagagccaggccccagtctctggagctcactcggggccaggcctcggtctctggagctcactcggggccgggccctggtctctggagctcacttggggccgggccctgggctgtacaggtgtcatcttgcttcatccttagagacatcacattcgacaggacacagcctccaagaggttaagccacgtaccaaggttacagaggacgtggcagagctgggactgtcagagctgccagctgggactctgttcccagcctccctgggcctctccccattcctgtccccgctcggcatcgtctccagttccaggcccactgccccgtgctcgtcccaccatgggccagccgtcctctgagagcccatagccagggaagagctgcagctgccgctgctgccaggacttgctggccagtcccacaaggccttgcttccaccctggggaaaaatgctcctggaaaccctgtgttggtcccggggctgcagccacagcaccactggctcccagggcagggcacggagcctgcagtgtctaactggtcagaggggagtgaggcccgtagggggatcagggcaaaggccaagctgccccagaccttcactggctaccctgaggcctcctggacagagaagcttaagggggcaggcactgagagacctggagtctgcccccaacctgctggggggctcacgcgaggcctttcagtctgaatgttggccttagtttccccacctgttcagtgagaggctgtggaagaagattgataaacaccatctcagtcagaacttccttgttctctaactagaggagtgaatttcccaaaggcgagatgtcagtttccatggaagctgaacttgcccctccctggaatcaccaggctgtgagactccagagggcagggaaggtgcgttcctaaactccttatccctagactgtcgtaaggggtctgcttggtgccaagtggggactgggtatgctgcctgattgaggaagggatggggtgtacccaccaatgactgctgggctggccacagggtccaggtggggctgaggtgcaccttcagggctcccaggcaggaagccacacaggctccactgtaaggggacacaggcctgccttctccactcatgctgaagctgttcctaacacctggcccaaaccgggggctcagggctccgcatcaccctgggtggcccttggttgccaatgatggggagatagggaggcataggccagcttccccggtctcagagcccacatgccccagcaccccactcccgcttagcccagggcatcccgagacgtaccctccacctggatgctcagctcctgcaggtctcgctctgacatgtgggaaaatctgcagttggagccaaagtcgcactggcctgcagcaggaagacagagttactcgctgctcgggaggggctccccacaggggctgaggggtgcccagatgagggatcccagaatcttaggggcaggacttcagggcctaaagaatagcaaccctgatccgggacagaaaatggaatctctccggccctgcccattcagcagccagagcgacttctcacctatcatgccacatgctcacgacccttctccagctgccccccatgctggggatcacttccaactgaagcctgtcatgactgggcctcgcaagcctctgcaggctgtctctgtcaccagccctcccagccctgcctcgatgaactacatatgggttcctgaaagggcaatgcttcctttctccactccaagccgcagcacgtgctatgcccagcctagtattctgcctgcctacctggctcacgggagcaattggactgctccttagaaaggcttcagtggcagctttgccaaagaggcaccaaaatctggggtggcttcccctctttcaaccaaggagaccaaaatgtatgtcgagatactgggaggctggaggtgtctcaagccaggataacctaccagtgacatattcacatcaaggcaaagtctgtagggaagcccctgatctgcaggcttggtgcccatcctaggggagcttggacattcacccagtttccctagttcagctgcagcacctctccccagtgctaagctcccttacaaaccatgtgaatcatcatagttttcctctttgccatggctgccaggaagctcagagccaaacccttagagaatacataggacctcaagggcaagcatggaggagactattctcttggttttatcttatttttcctactcttatttgtatctgtctttggttccttcacttactgaggttttacctcttgctctgtctttttttaaaagagacagggtcctcactctgttgcccaggtgggagtgcagtggtgcaatcatagctcactgcagccttgaactcctgggctcaagtgatcctcctgcctcaacctccctagtagctgggactaccagtgtgtgctaccatgcccagctaattaaaaaaaatttttttggtagagatggggtctcgctatgttgcccaggctggtctcaaactcctggcctcaagcattccttccacctcagcctcccaaagtactgggattacaagagtgaggcaccatgctcggccctttatctctctgacctatatgcatctctagtagctgagtactgagcagtcaaatctacacctagcatccttggttctgatcctgaacttcctcagatcatcaaccctgttactctctgaagttctgcctgctgggaaggaggccaggttcccaggctaacttaatcaacaagtctattccacccataagtgtctcttggatttacatgtaatctcccacgccttgcttgttctaggtgagctgatataatcacattctagatctgaagagctgaggaccagactctaggaggtcctgagacacacttgggaaggccctgactggccagtcagctggagccactgctgcaaagtgggcttgggatggtggcccgggtcggggaagacactctgcagaggtccaagtggggcaggctggatatcgcaggtccccgcagggacctgagctgtgcagaggactttacctgtcagtagaaacttcctgcagggccgcttgttctgctcatccagcaagatggcagctgcatctgcgagagaagagagggacgggattcggatggttcaggctccaccaaaggaggcaggaagtggaagccacaggggcatatggaccctttatctcgacacagctgtgcagaaagaagagtttcctgttccacggaggagtggaagcaggagatgaccacaggtgggagtcctgggcagatggatccgagctgcaggtgacctcaatccatcccaccccacgcaggacgggccaaagacaaggaccaagtttcatgccagcagttctcaacttggcacgagggagtcagctggagagtctggggactttgggtttttttgttttttagagacagggtctcgctctgtcacccaggctggagtgcagtggtgcaatcatggctcactgcagccactacctcctgggctcaagtgatccttctccagtctcagcctcccaactaggtgtgactacagctgtgcaccaccatgcccagctaatattttttatctttttgtagagctggtgtctcattatgttgcccaggctggtcttgaactcctgggctcacacgatcctcccattttggcctccaaaagtgctaggaatacaggtgtgagccactgggcccagcctggaggtataatactttaaaaaaatcctggcactatggaacttctcattattatctttgcaacttgctgtgaatctataattatttcaaaataaaatgctaaaaatttttaagtaaatcctagtgcccaggaagcccaccagccaatcccaggatccaggcactgctccacaggcaagactgcaatccctggcctctgtctcccctccttccaccagctgtagggcactcagggccagaccagccaccgccgcggacaggacttccgacaatcactctgtagcatcggcaatcactctgatcctaatcttaaccctagtttcctctgatttttcctatttttcttttctttctttgagacaagttctcactctgtcacccaggctggagtgcagcggcatgatctcagctccctgcagcctccaccttctgcactcaggtgatccttccccctcagcctcccgagtagctgggactacaggcgtccgccaccatgcccggctaattttttaatttttttgtagagatggggtttcgccatgttacccaggctggtctcgaactcctgggctcaagcgatcctccccacttggcctcccaaagtgctgggattacaggcgtgagccactgtgcccagcctatctttactttcatcatataggtatggttttaaatttgcttcttgataggcaagctattaatcagtcaaaatctgtaaggaagtagggtacctgaggatggtatcctgactcaggaacccttatatccaccccaggggaggggagaggcaaggcctgggctggacattcacccaccaccttttctagaggccaaggaaagaccacaggctccagagtccaagaaacctgagctcaaatcctaacaacatatgaccacgtgcaagctgcataaactccaagtctcagtttccccatatgtcaaatgggaggatagttcccacctggcagggctgctgtgaaaatgtcatcagataatgaatggagagtgctttgcagaggaggcccgtggctcccaactctggtggtacatgagaatcactaggaaagtgaccaggtttgcctctggggccagcagtggccttagcaccatgttctccaggtatacggccaagactgggtgggtacacagcaaatggtagcaattcttcattttttcctcacaaaccctctgaacagcgcaaacatccccactttgcagaggggaaaacagaggttcagacaagggaagtgatttgccaagggcaactggtggcttgtgggaggcgggggcgggcggggggtgtggtctgctgggataaggagttggttgtcagagaactcatgccagggggaccagcagggtggggagggtctatctgttagcgccgggcttgtcagactcattgtacccagctggtgctacagacaccactgcctgcctttccctgaggtgggggggtactaggggagggcatgtggacattgccctggacccccaaggctgggatgactgaggcaggcggcgggactgagcctgggtcctatacaaggggctgtgccaggtggcttggggtgggagaagaattccaggctgcccacgtccgcttagtggttcctgaccccagccacacatcagaatcaccaggcagtttttaaagtacatggacacccggccccagccctctcaggttctcttttaattcattggaagggagggcatcagaattgtttaaagctcctcggtgactctgaagtgtactcagggttgagaacccctggcccaggccctgcacgaggaagcccatgctcttgcagtgggtattcaaggcccctcatgatctgatcctattggtccttcttgcttcatctcccagatgaacagctgcccctggtgcctcatgtttctttgctcaatcacttagacattcatctgccaaacattcactgagcatgtcctgtgtgccaggcaccacgccaggctgaggatttaagtggagaacaagtcggagctggtccttccttctggtccaacagtcacactaatccctatggatgtaagcggggtaaacatctagcgtgtagccaaacgacctgacccgttctaggggtcggggaggacgtccctgaggatttgctgcctgacttgagttctgaggtggtgggggggcctggcttggggcagggaggacagcaggaagggcatgtctacagaggggacagcttatgcccagcagatgcagtggccagggtggctgcagctggaagggagaggccggcaggtcatggaggcctgggcaggacaggggctttgcccagaacacaccattctaattgggcgcaagctcgctaggcagaggggccctattttatccacctttgaatctttagagcctgcctgggagccgcggacatgctgaatgaatgagcccatgagatgaaggctggagggaatccttctgaggacccacaggcaccatgcctacttagtaagctcttatgtgccatgcagtcatcatgaggttactgagcccctgtcatagccctggaaggtggggactgttgtagctgttttatacatgacaaaatgagggccacagtgttagtgagtgacacctggggactggtgccctgcacctgaccatggcggatggatcatcagcccctctgagggctaaggggacgtggcccaggccaagaagctgggagcaaagctgaagtcgagttcattcacacggtatatccgcaagtccctgcggttgctcagagtgagcagaagccctggggcagcctcctgaggaagtggaaagaggtcatgtgccagcttggtcctcggtagctggggacccaaggtgagggaacccactgccctggattttatttcatttatttatttttttttgagacagggtcccgctctgttgccgaggctggagtgcagtggtgcaatctcggctcactgcagcctccacctcttggggtcaagtgatcctcctacctcagcctcctgagcagctggaaccacaggaatgggccaccatgcctggctaatttttttatttttgtttttatttttttgagatggagtcttgctctcttgcccaggctggagtacagtggtgtgatctcagttcactgcaagctccacctcccaggttcaagcaattctcctgcgttagcctccaaagtagctgggattacaggaacccaccaccacgcccagctaatgtttgtatttttagtagaggcagggtttcaccaggttgaccaggctggtcctgaactcctgacctcaggtgatccacccacctcaaacctcccaaagtgctgggattacaggcatgagccacggagtctggccaaatttttttatttttagtagagatggggtttcactatgttgcccaggctggtcttgaactcctggactcaagcgatcctcccacctcagcctcccaaagtgctgggattacaggtgtgagccaccatgccctgcctgctctggattttgaagtcaccacctgtaactgggaatgcctggcttggcctgcccagcctcttacagaactgttctaaggactgaatgtgttggggatgtgaggacactgagaacacaggagccctggggcactcctgtcacctgctgcttcatcttttctataagtgacacagggacctctgccaatcagccctggatcccagcatccagctgttgacagctgagaatctgggactaggtgatctcggcccagctccctctagatcacagcccacactggatttgcacagcagggagccttagcgtaacaccagggttagagtctcctagggagctaggagaccccactgcccatgaattttcctgtggccttgcaaccacagccacgcctggcctgctgagcagcctggccaccccctcacttgaacctctgagcctcagctccctcaagtgaaatgcggagtctgggaagcctttagaaacaccatgcctagtccccaaacctgcctctggggaggggatggggttggggaatcagtggttttagcctaaaggtctccaggtgatcctaacctgcagccggagttgagaatcactgccctagagagttgtcgagaaaagcaaatgacgaactatgaaaagcaccagcatgtagcaggcatgcgatccatgctcattccttgtttgtgaactctcagtttcaggccttttttgaggcggggtctcacaatgctgcccaggctgctcttgaacttctgggctcaaacaatcttcccacctcagtgtcccaaagtgctaggattacaggggaaagccaccacacctagccccaaccagggaactctctctccacctctcctcccttcttggctgctggatttggttccttcttcggaggccctgtcccagaatcctgctcaccaacctacagggcatcggccccactctggctcattccaggagctcctggcccaccctcgccccaccgccaagtgcccatatctctcaacctggctcctgccagtcaccctctggaacctccctggctgttcctcagtgtgaatgtccagtgacagccgtgcaacagcacaactcccctctctgggcacctcccgggaaacaggccctgtgctaggcacttccgaccttagctcattcaccccaattgttcttgctctgagaggcctttcccagaagagcctgccttccttctgcaactgggttattcacccgtgcctgcagccagtcattcaactgccactgaccgcacccaactgctccccacgaagcagtctgcgctgtcaaggcaggtctggccacggcagctaaagcccttcaaaggctgctctctgcccttggaacagggacccccccacctccgccccctgcttatgatggcctccacaggcttggaagatccctgccccagagccagcttgagccctaccattctcccctggcctgctccgcccagccacaccctctccctcctgctccgagagccctggtgctggactcagggctgcctgcttctcttcacaccctccacccagaactgcatggctagctttcccctattttagctgttggctcaaacatcacctccttctagggccttcctcctgtccacagagccttcagtcagcgttgttggggaaagagctcacctaccagcctgctcctctgagggcccagtggctcaggcctccctctcttttgatcctcaaagagcccagacctagactgtcactgacccacaggagtctttgatgataagaaagatcagagagcagggctccaggagcctggcccccagccagcggcacccacctcggaacatgtcgtaccagaccttcttggccttgaggtgctgcagcccgttcaggtgcttcttgcggttgtggaggttgtcctggaaggagcggtcgcagtagtcacagaagtatcgcttccccatggccactcagagcaggtgctttgctgcctgggaagccacaaagagctcagattagaccattggagaaaacacatccctcaccagcccactgaatgcttcctgagggccaggcctgagcccaggctttactcatatgcaccccgccccattaggagtgtcaagctgatgagtatggcctaagaggcctcattccagagggatctgttaaccattctgatgcccagcctgcaacttaggccagttaaagtagaacctcagtgggtgaggcctgggcactgttttttcttgagagggtgttgctctgtcacccaggctggagtgcagtgttgcaaacacagctcactgcagcccccacctcctgggttcaagcaatcttcctgtctcagcctctcaaagtgctgggattacaggcatgagccactgtgcctggctgctgtttggtagtttttaaagtctatcaggtgattctaacatgtaagtaggctgaactgccaccttataccctgtggctggcctcccttgtctcctaccacatagggttttatttttttgagacagagtctcgctctgtcacccagggtggagtgcagtggtgtgatcacggcttactgtagctttaaccttctgggctcaagtgatcctcccacctcagtctcccaagtagctgagactacaggtgcgtgtcatcattcctaacttaaaaaaacaatttttttgtagagatggggtctcgctatgttgcagaggctggtctcctgggctcaagtgtcctcccgccttggccccccaaagtgctgggattacaggtacgagccaccgccccatcccctaccatacctctgacctccacatttgcatcatataggccacaccggcctcccctttgctcctcacacatgccaggcacatggccacctcccggcctttgcacccaaggctccccagggaggggtatgccctcctgcaaactcccgcctcacttcccctcctgaccccttccatctttgctccaatgctactttatccaagatggcagaatcttccacttagcttcctccactccctgctttattttccctcatagcatgtatcaccctttgatatggtgaggctttgtatccccacccaaatctcatctcgaattgtaatccccataatccccaggtgtccagggagagaccaggtgggggtaactgacatgggggtggtttcccccatgctgttctcatgatagtgaagagttctcacaggatctgatggttttataaggggctcttcgtgctttgctcagcacttctctctcctgctgccttgtgaagaaggtgcctgcctcccctttcccttctgccatgattgtaagtttcctgaggccttcccagccatgcagaactgtgagtcacttaaacctctttcctttgtaaattacccagtcttgggtatttccttatagcaatgtgagaacggactaatacacccttcatgcaataagttacttgttatgtttactgtctttctcccacaatgagaatataaacccatgagggcaggtttgtgttttgtttactgctggagccccagcacctaaaatagtgcacagtacagagtaggcattgaagtacttgttaaatgtatcaattctcattttccctttgggacaactgaggttcagagagggagtgtgatttgcccaaggtcacacagctgataagcagaaggcaaacccagtcccctaacgttacattgccaggtgtcctctcttccacagccagttcaaggcttagagaagccagagggcgcaggcagtgaatgctgacagcttcccaaggagatcactaaattatcaggtggcaggtccgaatccagtcacagagggaaatgaaaacattttggggtcttaagacccctcagccatggtgaccacagccaccactcctgacccaggagatctgcagcccaaggtgggtggcaattcagtgactctcatggccagcccttgggtccatgagtatggtgctgcaaaacaggaggacagacaggtccactttgggccaccaagggggatctgccaaggctgagcccagaccaactgctcaccctgtggtcagacccctcacttcacagaaaaggttcctgaggcccagatgaggaagagaaatgatttcccccaggtcacaaggtagctatccgggctagcagccaaagccctggactcccaggacctgatcaccacagtggaccaatgggggaacacagctcaggaggaggagactggggagagacacagagacagtcccaacagccaagcaggttgatggagaaagccattcttgcagcagacagggacagcagccattaagtcaggggctgtaatgggatcaggaacagacagtcattcaaaatgaaaacatataaaacctctcttctcccattactgcagagggaccgtgtcccagacacgcacacttgatatattaaatttggcagctctaatacaccccatcttgtcaataaacttataggaattggattgaaattgtaagagatgaacgtttaacggccgagtgctaaaccaagccattcagaaagcttgaagctcccagaagcttgctggcgctggagagtaatggggaagggaggggacagggagggtggttctctgggagactggaacagaacggtggctctgcggcctacttagatagacaaaaccacacaggcattgaaaagctgcctgtgtgaccttgggcaagtcacttcctgtctctaggcctctacgttcactgtgggaatatgaggcaatggctgcttgatcaggaagtggtacagagaagtttcctaatgcagatggtgaaaatgatgctgataatacctggcattaagcaagtgctcaataaatattacctattattagggctagtggtttattgaatacctactacgtgctggcactaagctgaaagctctatatgcatcatctcatttaatccccaggacaacctgtgggggagggcctgttatgcctttttagatgggggcactcaggttccagaaatgaagtgacttagccaaggtcacactgctaggaaggagccccgctgggcttggaatccaggtagcaggcctctagggtccccactcctgatcacataatgaaagtctcctccttaatcccagcattttgggaggccgagatgggtcgattgcttgagaccaggagttcaagaccagcctgggcaatagagtgaaaccccatctgtacaaaaaatgcaaaaatcagctgagtgtggtggcacatgcctgtattcccagctactcaggaagtgaggcaggaggctggcttgagcccaggaggcagaggctgcagtgaactgagactgagccattgtactccagcctggacaacacagcaagacccccatccaaaaaaaaaaagtctccttccaacaaatcataataatgacaattttcctttattaatcactagctacaccctaggaccatgctagccccttcaagccccaagaggtgtggattataatctcattcatgaatgaggcaactgaggcccagacaggtgccatgaggggccccagctcacacacataggaagggcagagcaggcctcagggtacctggggctcaggtctgccaggaaagcctgtcttcatgctgccgtgctagctgtcccaaacaccagcccaccaggaaactggaccacacgctcctcggcctgcctccccagccacactctgacccaaatggtaagcccctttggtgggctgtatgtgtgtgtatatgtgtgggtgttcatgttttcccccctctctctcaccccctccactccatggggggcaaaccagctaatggttcccttcacttcatcaccttgtcagcctcagctcagggccatggctgcccacccatgccctcctctgcccacccatcatctagcacatgagaagtgttcggccatcctggatgggtcaacacgaccccacattccagtcccagctctgccacgtggctcagtctgtgactcagccacttgccctctctgggcctcagtttccccatgtgggaagctgcagtggcaggaccagttgatctctaaaggcctctctggttctaatatccagtgatcagatgagaagatgcccaaaataacgcttttttaaaaaatgtaaatattggtctcgccatgttgcccaggttggtctcaaactcctgagctcaagtgatcctcccacctctgcctcctgcagtgctgggattacagtcgagagccaccgcaccaagccggcaatgctttctatctacctgtcacagacacatgtgcagtgtcaggccagggagaccaacgggcagcacagtccctctgggacgggaaagcatgctcactgagcaccacctgggcaggcccctccctgaccctctcaccctaagaagcaggtcacagcacccccatctcacctccgagagcgggatacccagcctggggacagcactgagcatcaggaccagctatctctgcatttctgtgcctggggaggctgtccggggacagagttaagagctggctctggagtcagatgtcagggcttacatccagtcgctactgcttcctaattttctcactcagtgatactggcatttctggccttgttttcctgctatgaaaactgggataataacagtgttcaggccaggcgtggtggctcacgcccataatcccaacactttgggaggctgaggagggtggatagtgaggtcaggagttagagaccagcctggccaacacagtgaaaccctgtctctactaaaaatacaaaaattagctgggcatagtggcgtgtgcctgtagtcccagctactcagaaggctgaggcagaagaattgcttgaacccaggaggcagaggttgcagtaagcagagatcgcaccactgcaccccagcctgggtgacagagcaagactccatctgaaaaagaaaaaaaaaattgccgggtgtggtggcgcatgcctgtaatcccagctactcgggaggctgaggcaggacaatcacttgaatccaggaggcgaaggttgcagtgagccgagatcgaaccactgctctccagcctgggtgacagagcaagactccctctcaaaaaaagcaaaaacaacaacaacaaaaaagaaccagctgtgcagagcccccactgcccagggatggcattggggtgagggggcacacattctacctacttcacagtcctgtccccacaggcatgtgcctgaggccatgttcccagacagaggctggccttcaacaagatgacctcgctcagatgtaaaattctagagctcctgaaccaaatgcctcccgctctgatgcctttgcccacattaggataaggttcaacttgcagaatcctctggacacatgcagcgccctgccagacacacaacttggcaagcagaatgccggctggagttcagctccagctcacccctcagccaggtgtccttgcacaaggtgcaacctgcaccaccgtacttggcagccgaggaggggtcagggacaggggaggaaggggacagctggagtgtctctaaatggcgcccagataccatcatggggtgctgactaagctggccccctctgctgtgattcatccccatcctctgagggtggcacacgcagcagagtgtgagcgaggtcccgtctggaacacagaaccatccggccccacgccctgccagaaacacaggtggtgccatccacccactcccagggaccaggtgcacggctgcaaaggcatctgctggatccctggagcaccagcaggtgagagtgctggcttctcttggccaaggggcagcgggcaaggctagtgggacaacctctgggtcacatgggtcacatctgaattccagctctgctgcttatgagctgggtgacccctgggaagtcatttcatctcccttgatctattcttagctataaaatatggatcccacagctgctgaggtttaccgaggcagtagtacattaaggtgcctagtagccagctgcaatggctcaggcctgtaatcccaacatgttgggaggccgaggtgggaggatcactggagcccaggagctcgagaccagcctggacaacatgggcagaccccatttctacagaaagaaagaaaaaaattaggcaggcatggtggtacatacctgtagtcccagctatttgagaggctgaggtgggaggatagcttgagcccaaggaggtcaaggctccagccagctgagattgcgccactacactccagcctgggtgacagagaccctgtctcaaacaaagaaaaaaatgtgcctagcatatagttcctgctcaataacggaggctgttactgttgttactattatcatccgggctgcccaccccctcaccctctaagtgaacacactctgaaccccactttaaaatcgcagtcaaggccgggcacggtggctcatgtctgtaatcccagcactttgggaggccaaggtgggtggatcacttgaggtcaggagtttgagaccagcctgaccaacatggtgaaaccccgtttctactaaaaatacaaaattagccaggcgtggtggcacacgcctataatcccagctgctcaggaggctgaggcaggagaattgctcaaacccaggcagcggaggttgcagtgagcagagattgtgccactatgctccaggctgggcaacaaagtgagaccttgtcaaaaaagaagaaagaaagaaagaaaaaaagaaaggagagagagagagagggagggagggagggagggagggagggggagagagagagagagaaagaaagaaaaagaaaagaaagaaaagaaaggaaagaaagaaagaaaggaaacaaagagaaagaaagaagaaaactagtcaaggcactgtggggtggcagagaggagaaaagaggctggggatggtgggtgaggggtgacagcttcagatttgattcccgcttgcttggcacttcgctttcattcccttatttaatcctcctagagacactctgagtagatatcaatatcaagtgtccattttacagaccagaaaacagttttgggaaaactcggtcctaatttgttcacagccatggccagaaagactctaataataaccataacaattactgttagtgtcagtaacaataatgacacatcaataaccaataacaaccacgtctcatcatcctgagctgccagtgggccagggtgccatggacccccacatcccctcctgtggagtcttcaccatgacactgtgaagccacgtgcctaaggccccacagccaaggcacaccagagctggcacgcacacttgggtctggctgaccccagagcccactctctctccatcccactgtcctgccgtgaggctgctacagggcaaacatttgcgcttcatcaatattctccattcctttcgttgtgtgtgtctcaggtacagaaagagctggctttggcacaaggcaaaaataagccaacagctcggcctttggccaggggctgggatgtgcactataattatcctggacttgtgctcaccacaggcgaccctgaagctcacctgttattttttctaattatggcacctccagaccccaggtaaacagtaaaccacagccagaggacggctttattgcacgcccactaggagctcggtaatgtcccagtgtcatatatgcctgccatctggagttgatggcatcagaaccaccctgtgggggtggtctgcagactgctggtgcaggaccctgttcggaaggaagcgccaaggaaatccagatgtctttcctgaccgaacccccgtatgctagaggcatccttgagatccttgggtggcagccacacacctttttcatcctgacctcatccctgtgtttgcctcctgccctcccctggggtaaggcacatcatctttttcccacaggtctaaggcagcgaggggcccacccactgcaatttctgactcggcaggtctgggacagggccaggatgtaagaaagtcctgattcagactccacagagaaatgcgagtccaggctgggcacagtggctcacacttgtaatcccagcactttgggaggccaaggtaggaggatcacttgagcccaggagtttgagaccagcctgggcaacatagttagaccccatctccacaaaaaaattttttttaatttgaccaggcatggtggcgcacacctttaatcccagcactttgggaggctgacgcaggtggatcacctgaggtcaagagttcgaggctatcatggtgaaaccccatctctactaaaaatacaaaaattagctgggcatgatggtgcatgcctgtaatcccagctagtcgggaggctgaggcaggagcatcacttgaacctgggaggcggaggttgcagtgagccaagattgcaccactacactccagcctgggcgacagagcgagactatctcaaaaaatatatatattttttaattaaaaaattagctaggtatgataacacacacctgttgtcccagctgcttgggaggctgaggtggaaggatcacttgagcccaggagttcaaggctgcagtgtgacgtgatcacgccagtgcactccagcctggacaacagggtgagaccccaatctcaaaaaaaaaaaaaaaggacttcacagaaaaaaaaaaaaaaacagaaagaaatgctagcctaaggtagcagatgatggacagaacagagagggtgagagcatgctcaaggtcacacagaacaatcctttgaagctgttttcccttaaacacaactactctaatcaccaacccaggtctgaatccagtccctgccactctcaggttgtgtaactctcagcaaactgcttacctctgagcttcatctggaagacgagggtaatgactctatttcataagattactgtgagaattaaatcatgcatgctagctgcttagcacagtgcctggcacgccaatggtgcttcacacacgcttgtgcatgttgcagccagcctccaagcccccagcaatcccacctcctgattttcacaccttgtgtagtcccctccaagctgggtcagggttggtctatgtgaccaagagaacagagcagaggtgagggtatgccatttccaagaacaggttataaaagacactgcagggagggcatggtggctcacacctgtaatcctagcactttgggaggccaaggcgggcagatcacttgaggtcaggagttcgagaccagcctgaccaacatggggaaacctcgtctctactaaaatacaaaaaattagccgggtgtggggcgtgcacctatagtcccagctacttgggaggctgaggcaggagaattgtttgaacctgggagacggaggttgcagtgagccgagatcgccactgcactccagcctgggcaagagaatgagactccatctccaaaaaaaaaaaagacactgctgcttccatctcagtgtcttctttctctgatcacttggtctgggggaagccagctgccacactgtgagcagccctgcagggtggcccacgtggcaaggaactgagaccccctgctaacagccacgtgaatacatttggaagcaaaccctctggccgcagttaagccttcagaagactccaccctggctggtatcttgactgcaacctcccaagagactcagccagaaccactcagctaagcagcgcccagattcctgaccctagaaacagtatgagaaaataaaagtttgttgctttaggttggacgcagtggttcattcctgtaatcccagcaccttgggaggccaagaaaggaggattgcttaagtccaggagtttgagaccagcctgagcaacatagtaagaccctatctctacaaacagtttgttttttttaaattagctgggtgtggtgatgcatgcctatagttccagctacttggggggctgaggtgggaggatcgcttgagcccaggagatgaaggttgcagtgagccgagatcatgccactgcactccagcctgggtggcagagcaagacctcattcaaaaaagaaaagaaaacttaataggattatgtccagatttttttcatttggtatctattttttaaagtttctatatttggcatgtattgttttaaaatttacacacacacaaaaagtcccttcaaaaaaagtggggggctagtccaagtgcagcagtgttggtgactaactgatcacaaccagatacagatttctttgttccttctgcactcccactgcctcgcttgactagcctctaaaaaagagaaaaagaacaagagggaaatttgtaaggcggggataaatcctattccttctccctctggaggctgccatggagggttccagagacctggttcactcggatgaaccagccaggggtggtaagtgaaagaaatagagcagacattcccctcaccccctggatgaagactgacaaggcaaaccctgattccaaccagacttggcctagcacaccccaaggcctggtgaaggtcggctgagcctgaatctgggctccaggaactgcgggctggagacaagtttctcatcagatagttacaggtcccaagaggccagagtttccaaataggaaaggtaaaaatagtctgaatgaggctcctgaaccagatacttggactcagaactgtctctgcctcccgcttcttctctcccgagtctgggcaccaaatatcatctgatcctctatctccactgtcactactgcccaagaaagaactcagctcctcacctctggactcctcacatctggacagccccctccattcactgtatcataagcagcatcagatcaactctccttaaatcatccctgctcaaaattttccatggcttccaagtgagaaacttattaaaaatgaatctcagctaaatgcagtgactcacacctgtaaccccagcactttggcaggccaaggcagatcagttgaggtcacgagttcaataccagcctgggcaacatagtgagaccccgtctctaaaaaaaaattttttttttaattagccagttggggtgtcatgtgtctgtagtccttgctactcaagatgctaagatgggaggatcactggagcccaggagtctgaagttacagtgaactctgatcatgccactgtactccagcttgggcaacagagtgagaccctgtctcaaaaaaataaaagggggccgggcatggtggctcatgtctgtaatcctagcactttgggaggctaggcgggcagattacctgaggtcaggagttgaagaccagcctggccaacatggtgaaaccctgtctctactaaaaatacaaaattaggccgggcacggtggctcatgcctgtaatcctggcactttgggaggccaaggtgggtggattgcctgagctcaggagtttgagaccaccctgggcaacatggtgaaaccccatctctactaaaatacaaaaaattagctgggaatggcggcacgagcctgtagtccctgctactcgaaaggctgaggcaggagaatttcttgaacccgggaggcggaggttgcagcgagccgagattgcaccactgcactccagcctgggcaacagagcgagattccgtctcaaaaaataaaaaaataaaaaaaattagctgggcatggtggcaggcgcctgtaatcccagctactcaggaggctgaggcaggagaatcgcttgaacctgagaggcggagcttgcagtaaaccgagattgtgccactgcactccagcctgagtgacagagacagactcctctgtctcaaaaaaaaaaaaaaaaaaattagctcagcgtggtggtgcacacctgtaatcccagttacttgggaagctgaggcacgagattgaacccaggaggtgaaggttgcagtgagcccagattgtgccactgtattccagcctgggtgacagagcaagactctgtctcaaaaacaaaaaaatagtctcctgggtcaggtccccagaaatcctgatttagcagatctggagggggacctagaaatctgcattttaactagcaagtctaataccccttaagaagcaaaagcctggaggaatgaactttcccttgagttccaaatgcagcctctgctggggacagttattctgggtagacacagccccctggactcatgtcccagctagaaatcagtccaattatgaataacctcaggtcactgaagtggtaatccaacttgatgctaagcacaattagttaaagtggataaagctgttttcttactagataagtgtcttgtcacactcctggaaagtttagaattaaaaatagaagcataagagcaaatcaaattcactgtattaatgttcctatcctaaatttagtaataatctgtatattttggaattaaaaagtagctgttggccaggcacggtggctcacgcctgtaatcccagcactttgggaggctgaggcaggcggatgacaaggtcaagagatcgagaccatcctggccaacgtggtgaaaccctgtctctactaaaaatataaaaattagctgggcgtggtggtgcgcacccatagtcccagctactcaggagcctgaggcaggaggattgcttgaacctgggaggcggaggttgcagtgagccgagattgtgccactgcactctagcctggtgagagtgaaactccgtctcaaaaaaaaaaaaaaaaaaaaaaatagctgtagacagggcatggtggctcacacctgtaatcccagcactttgggaggcaggaggatcacttgagcccaggagttcaaaaccagcctgggcaacataggggaaccttgtctctacaaataatttttaaaaaattagccagacatggtggtgcgggctcgggcctgtggtcccagctactactgctcaagaggttgaggtaggaggatcgcttgagcccagggagatggaggctgcagtgagccaagattgcaccactgcactccagcctgggtgagagagtgagacactgtctcagaacaatcctactgggaactgtgcatgcgagggatctaggttatgtgctccttatgagaatctaatgcctaaaacaaaaaaagtatctgtaatattgaaaaaaaaatgtgatatgttgagtgtctaacagataagcattgtgattcctatttaaaatacaaaagttaaaatatagagttagtgacaaaatatatgtcagtaattgatattagagttgtgattttagattgagaggttagcaatgattggaaatatggactgtataacagaattacctggggtgctgtaaaggttactaaggggccccccatatattcctatttcatgtcagaaatacagcctgtttttttgtttttgttctttttagctccctaaactaagagccactgacatagagaattttactaagtctgtaaaaataattatttataagaacttgaaattcattataagtttaattgattagattttgtagtaactctttactctggggaaaactgtgcttgttatgttattcatataaagtacttaaaaagaaaatcaaatatattaaatttacaaatagatttaaaatgttggcaggaatgaaattaagctgtaaatagggatgagtgtcttgagaaattcagaatcttcaacttgagttcaaatattaataaaaaaattaaggtcatttttcttatttgccgatatttatgtattgaataataatttctaagttgaaatacatggcttaaagcaggggaccccaacccccaggccccggaacggtacgggtccatggcctgtcaggagctgggccgcacagcaggaggtgagtggcaggtgagtaagcgaagcttcatctgtatttacagccactccccattgctcgcattaccgcctgagcttcgtctcctgtcagatcatcggcagcattagattctcataggagcacgaatcctattgtgaactgcgcatgcgagggatctaggttgcacgctccttatgagaatctatgcctgttgatctgtcactgtctcccatcacccccagatgggaccgtctagttgcaggacaacaagctcaggcctcccactgattctacattatggtgagctgtataattatttcattatatattacaatgtaataacagaaataaagtgcacaataaatataatccacttgaatcatcctgaaaccatccccctcctgtatcccgtccatagaaaaactgtcttccacaaaactggtctctggtgccaaaaaggttggggactgctagtttaagggaaattacgttttttaaatgattacctccgaatgagaatttaaaagataaaatataaaaccaaaatccagtactttgagaggccaaggtgggagcatcccttgtggccaggagttagagaccagcctgggcaatgtggcaagaccctctctctacaaaaaaatttttttaaattaggctgggtgggaggccgagacggacagatcacctgaggtcaggagttctagaccagcctggccaagatggtgaaaacccatctgtactaaaaatacaaaaattatccgggcgtggtggcaggtgcctgtaatcccagttactcgggaggctgagagaacagaatcacttgaacccaggaggcagaggttgcagtgagctgagattgcaccactgcactccagcctgggcaacacagcgagactctgcctcaataaataaataaataaataaataaataaggccaggtgcggtggctcacacctgtaatcccaggattttgggaggccgaggtgggtggatcacgaggtcagagattcaagaccagcctgaccaacatggtgaaaccccttctctactaaaaatacaaaaattagctgggtgtggtggcgggcgcctgtaatcccagctactcaggaggctgaggcaggagaattacttgaacccaggaggcggaggttgcagtgagccgagatggtgccactgcactccagcctgggcaacagaacgagactccgtctcaaacaaaataataataataataataaataaataaaaattaggctggggagatggctcatgtctgtaatcccagcactttggaaggccaaggtgggtggatcagttgagctcagtaatttgagaccagcctggccaacatggtgacacccctaaatttttttagtctttacaaaaaatctataagaaaaccagaaaacgaaattagtggggcatagtggcatgcacctgtagtcccagctacttggaaggctgaggtgggagtaccacttgagcccaggagttcgaggctgcagtgaactatgatcgtgccactacactccagcctgggcaacagagtaagaccctttctcaaaataataatagtaataataataacccagcatggtggtgcacacctgtaatcccagctatttgggaggttgaagcaggtgaattgcttgagcccaggagttccaggctgcaaggaactatgattattacaaccaggaattatgtgccactgtactccagcctgggcaatggagggagaccctgtctctacaaaaataaaacataataaaaccaaatgaaacaagccacacctttaactccctgtggtcttccctactcatttctccctcctctgaacttcccatcagccagattggttggaaatgattagcaagacctaagtagtcttcccctggagcctcacaacttcctgctctgaggggctcccaggatgctttgcaaatagtataaaaccacagtaaggataactcatggatgtaaagcatttcacattttaccttctgatcccctaacctggtattactgttgctctttacagatgaattaaaagagagttaaagcctgatcaatgtcagagtcagaggcagagccaggcctgcaatccaatccctagtttttgtttgttttgttttcatttgagctccatcacccaggctggagtgcagtgacgcgatctcagttagtggcagcctccgcctcccaggttcaagcgattctcctgcctcagcctcccgagttgctgggattacaagcgggtaccaccacacctggctaatttttttgtatttttagtagagacagggtttcaccatgttggccaggctagtcttgaactcctgacctcaagtgatccacccaccttagcctcccaaagtgtggggattacaggtgtgagccaccgcgcctggcccctagtttgtttttcatggagacggtctcactatacggcccaggctggtcttcaactcttggcctcaagtgttcctcctgccttggattcccaaaacactgggattataggtgtgaggcaccatccccagcccagtccctggttttgaatgccacccctatccggatgactcttctcaggctcatacctctcctctaaactacagatccatgtcctcatttgcctctagacacctccacttgatgtctgttggctagctcaaactgatgtggccaaaacagaacttaagatcattctgttgattttaaattgttgaggtcaaaacttagatgtcagctggacgcggtggctcacacctgtaatcccggcactttgggagaccgtggcaggcggatcacttgaggccaggagttcaagaccagcctggccaacatggtgaaaccttgtctctactaaaaatacaaaaatgagctgggcgtgttggcatccgcttgtaatcccagctattcagtaggctgaggcatgagaattgcttgaacatgggtggcagaggttgcagtgagccaagattgtgccactgcactccagccgcacagagtgagactctgtctcaaaaaaaaacaaaaaacaaaaaacaaaaaaaacttagatatcctcctcaattcctctttcctgtgcaccctacacacatctgctagcttgctctgtctgccctccctcccaaattacatcccaaatctgatcactgccctgctccacaccctaacctaaattaccacccatcaggccgggcatggtggctcacgcctgtaatcccagcactttgggaggccaagatgggaggatcacctgaagtcaggagtttgagactagcctggccaacatggtgaaaccctgtctctactaaaaaaaaaaattagccaggcatggtggcaggcgcctgtaatcccagccactcgggaggctgaagcaggagaatcacttgaacccgggaggcggaggttgcagtaagccgagatagcaccactacactccagtctggacgacagaccgagactccatctcaaataaataaccacccatcttccctcaaatgatctactacaataacttcccccttgcggtccactctccatagaccagccaggatgatgacattaaagtgcacattaaatcttgtcgcatttctcctgaaaacccttcaatggcctcctagtgcaactagaaaaagacaagactccttggccagacgcggtggctcacgcaccttggggggcgaggcaggaagattgcttgagcccaggagttggagaccagcctgggcaacacagtgagaccctgtctctaaaaacaaaaaccaaagaaaacaagactccgtaaggtgggttccaaggccagacatgagctgaccggagtcaacctcttcacagtccactctacttctttccctcaaacatcccaggactgtagctgcctcaaggcctttgcaccaacgttttcctgttcaactctactattcattcaggtctctagtcaagtgtcaccccccagagcagctacccagggtgcaatgtcaccaccactgcctctccagtcaaccaaagcactatctgtttgctgtactgcatctccccacccgcccactccgtagattgagcgctctgtgagagcaaggactttgttcactgctgggtccccagagcagggaccagaacaggcgctgggaaaacatctgttgaatgccccaggtactccaaagcccttgctcttttcaatcccaagcaggttccaagtctccagccttccaaaccagggttgcccggtgcgaagcccaggggtgagaggaacaggaagcagggcagatccgtccctgcccttaatccagggtgaagggtttaacctccaggacaagacttttgccgcaggctccagctcctggcctagacttggggctggtgcaggggacaaggcgaagagttgagccagggtctcgggaacccagctgccctcgcccctctatccacaccctatcccaagaaatggtgcgtcccgccgcagggcgtacgcacagagaaggaagtgttcaagtcttccagtgcggagaaaagagactaggactcgcccctcgacgtctcgcggaaggtacctggctccccggtggctgcagctccgggctcc

SEQ ID NO: 551 - DNA, 36025 bp, Homo sapiens; identical to SEQ ID NO: 550

SEQ ID NO: 552 - DNA, 128295 bp, Homo sapiens
cagtcacagccaggtaaccctggagtgaagcggtttagttagaagggagcagataaactcgtcactctagtagctttaaccctcaccctgaggcaccttagcaatcagccattgcctgcaagcctccaaagcttgtctttgcctaatatggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggactgaatacaaccagaaattacaaggtaaccaaaaagaaatcaattgtcccagttactgcactcccagctccatttctgctacgtttccaattgcaaagaaaacacacaaggcagaggggaaaattgaataccacctctccttcccacaaaataagaagatgaaagtaaatgtgacctataaattatagggaaaaaaatttattacgtgattcaatgttaaagagtcaattccgaattactcttaatattgctgtgtttttcttttttttttcctggtgagggtaatcatttttcttctaacttcctcttttcttctcccttctctacccaacttaagaagtgggaaacactggaaagcaaatgagttagaaacctacaaaagattgtttatctcaatgggtagatatgtgatattacaccatgagatatatctaggtaatggtactgaactatgattgtggttatcttaaataggggcatgaaactataatcgtgtctgtgacaaagaaggaatgttatagtcagagagacggtataaaaagatttgctgaaattcacttaggtgattatttcctttgagtaaattgaataatactcaaatatggtaagaaatgtttagcatgcttattttgaatgacatttgaggaaataacttcagtttattttgtgatggtacaaagataatttggcacagttatgatagcacatcatttgtttcagggccttaatctatatcctgtcctatctatcctttctttctctcctgtttcctgaaggtcatttgttctagtaaaatttcattttgatgttgatattgggcagcattttaagtcttttcttcggtacttgttatgtggtcctccagaacttgcctctcctgcttttagcacaaggtgtgtctgaactctcatcatcccactgtgagctgtcgttttggatttaaaaactgtgatgaggtcagaaagaccgataggacatgcttatatttaacaaatctctttccacaaatatgagcttagatttagttatgcaaattaattaagttaaataagttaaattaaatgcatttaaattaaatctaaaaattattactataagttaatgtgtaaaaataaaaaaaaaattaccagtagttcagcactaaagcacagcatcaatcttatcctcaaatactttttttttaaaatgagggagagcattgtttaatctttgaaattaatttttctccaagcaatagatacattggaaagaatggatgtcttaaaatttcaacttttattttagattcagggggtatatatgtgtgtttgttacttgcgtattttgtgtgatgctgcgatttggggtacaaatgatctcatcacctgggtactgagcatagtacccagtaggtggtttttcagcccttgcctctgtccgtttctcgccactccagtagtctccagtatctattgttgccacctttatgtccatgtatgtctaatgtttagctctcactcataagtgagaacatgcagtatttggtttgctgttccagcattaatttgcttaggataatggcctccggttgtatccatgttgctgtaaaggacatgattttgttctttcttctggctgtgtagtattccatgatgaatatgtaccatgagaatttaaaatcatacacatttagtttctaaacctggttcttcaacttactaccaattagaacttgagcaaattacttgaaatatctgagcctcaattttcctgtctgtgaaagtgggactaatgatacttgccacatagtgttgttgggagattgaaattagataattacaaaacatctagtatactggctgataaattttaggaataatgggtaccataatgataaaacagaacttgcccaatattaatcgaagtttgtataccttatttctctttttcaattcttttttgtcctttgataaagagaccacatctagaaattcaggaaaagcccattgctttatccctaatgacatgttttttctgtctgagtttcactaattcagcatctatcagagtctccattagcaaaataaaaacagaaaataatttttgctattcacaaatttttgcttactaaattttcctaaaaaaataagtctatgaccacacaagagagcagacatgggttggttactttgcagaagacctcagacttcttacgcacttcatttgatttgtggctttcctgtgctctgttggattctttgaaggtggaaggcaaaactcagcagttaatacatgcttctagtctgtgcttgagaaaaatcaccaagaagtatagaggagcacataagccataaagataggctggcctcctgagaagtaacatcttaaaaacgtaacccttaaaagaatccaagtctgattatcgaacgcctaatagagcttttagcatggttcgactagaacagggaaggcgacaagggaaggcattttctcattaatgttcaaagcaatcagttctgtgcgtttgttctctggcctgtacgatacccattattatgcagatgagtcctaaatcaccttaagaagctctttattattcaaatgccgagagattttcctctccctttcttggaactggtggtccctgggaggcactgaataaacacctggactggttagagccctcagatagatggcctaaagctcttgtgaggtcaaagagtgctttcaaatactggaatttctggcaacaccacattcctcaaattatttagctggttatttaattagttatttaattggttgtccttcaatgctatattacctgagtaaaattcactgctctaactctctggggaagcaagttctctgggttccgtaaaatgtaagatttttctttggtgctcttgagcttgtcttttaactcatgatacctagtctatctgttcaattcaatttctcacatcactttagtagcatgaaacttaagttgtaataacaattttaaaaatggtacactggctgaattaaaacgatagaacatggctctaaccaggacatcctaaaacctttgcagaagattgtgatcacatcaacatagtcattcctactaagcctggagttgtataataatagaaaggccacccttaggctcccttactccttgaacagattaattcagttgactagcatttattgaatatgttataccttgttctttgaaattaatttttctcaaggcccttgatacattggaaagaatacaaattgtaaaatcatacacatttggtaaattgacatttattgaatgttttagatgctgtgtcttgagggttacaatgaacagcaaaaacagaatatgtgccaggaattacaactacaaaatcatcaagaaaacatgtctgacctttactccaaagaggctcaaagtctggttgggaaagataagacaggtaaacaaataaatacaataaagtggcatgatagaagtggaggtaggatcagtgggtccacaaaaggaggaaacggtctattcaggactgcatgaaggaggttgtcagaaaatggtgtctctaagaaatggtaagggtagggatgagggaaggtacaggtaagagaatggcattttaacctcttcactgtatttagctctgtctgaaatggtttttgtttccttgtttatcacctgttattgactgttgttcccctcccttttctctccctccccgctcatacaccatgaaagaaaccctatctgtcttgttaactgttgcatctcagcagcccagaatacagtaaacactcagtaactgttaaatagagtgaatgacttgaatgatcaggcccaagcaggaaactggtgtgaagaaagacaccatggcctgaaataagagccattgtatttatctaaatatgtgaggacacatgtttctatcagaaagatgattcttcagttaaatgaacatcagagattaaaatgtacagaatttatataataagtaattcttagtggaagcctgtttcattcccaactcgacctttcagagcacacaacaaccatatttcaaaaattcctcttctattagtgacaagagccatcttaacttccactagctcaattcctcatttccattctactgggagccatagaaattacctaaatacaagaaatttagtggttgagttgtaaaaactcagaaagggtttcataaatacttatatacatgatctctacatttgaaatatgcctaatttaaatagttatacagaactgtgtctgtgcatatgcagatatatatgtgtatatatatgtgtgtatatatatatatctccagtatgtagatatagatatacatgtatgtacttgtatgtgttcgtgtgtgtacttgagacacttttttgcaatgattagactttttattgaaagttactataaaatttgaagaacaaaaagaacaaaagtttactaacattcaggagtcttttctgaaaaccatatatgaattatatcactgacattataggtttcctctcagtatgggtactatggactgaatgtttgtattcctctaaaattcctatgtgaaacctaatccccaatgtgacagtattaggaggtggggtctttgggaggtaattaggtattgagggtgaagctttggtgaatgggattagtgacccttaaaaaaaaaaaaaaaaggcaagagagagcttgcttctctctgctctcagccatgtcaggatacaagaaggtggccatgtgcaaaccagggagtgggctctcagcaggaataagatcttccgcattaggaataagatcaacttgattctggattttctagcctgcagaactgtgaaaaataaatttttggtaaacttaagccacctaatctctaatatatttgttatagcagcccaaaccaaccaagacgggtcgattacctttatcctctatggccacactaaacttctggttaattttctggccagtgcatatttttgtttatccaacaccaggtgaaaaggtgagaatacatgggtaaaatgctattacccattaccactgccggtaacacaaggcaaaaattacgtctccatttcttagtgtgtctgtggtaccttctatttttgcaaaggctattgtatcattctaattaagaaaggttatctttatgagacccaaagttgtcttaatatggtgcgaaagatgaaccaccctactgtatgaactttatacaaaataacagattgtgccatgtggggacaagtggctcaaataataaattagacttggtaagactatgagggcatttaatttaaaatgttttttaagaatatagacagtctgtcagggagcagaaattaacactggaagacttggtgagttttgttcaaggccaaatgaagaatggagtaaaacaaattgtccagcttcctgtgcatgtttctatcccagtgctacaaaccctttttgttcgtgtctgttctttgattagtgagtagctccttcccctttatctgccttcatacactctacagtgaaatgggaagtatttgaatcagtaatgtgacaccagtacaaacaggtgtgtgtcatagtttgaagggcaaatctttctaaaaggcaagacgctttaaaaactcagtaacttttgtcttactgcatatatagaaaccagtgtaaaacacggtattttactttcctatttttttcagtagagacatcttgcagtttttagaaggaccatttgtgtcaaataatgtgtgagtcacagaaattgagactgtttgagctattctactactaccatattgtgatgggcaaatttattcctatgtttgaccgatatgactttaggtataactttcttaaaagtagcaaacacaatttctagttgtgctttttttttttgtttataaaaattatgggtttatcaaaatgagacatcaagaggaagaaggaatgaaagaaaggaaggagagagagaaggggaggggagagacagacagaaaccaagcaagcagcaagaatgaatagaaatataccttaaaatagtaataaagttggagaaatgatgggagagagaaaagcacccaagccacattcatctttgtttctgttgacacaggaaaagaaaaaaaaaaacctctgtttacagaattactttttcttgatgccataatcatattagcatcagtacctttatgaatattgatttcctgataaaagtagaattattgcaagagttgctaaatttataagcagtatcgttcttagaaccagtcaagactcaaagttatggcttatttgggagtcctaccttcacttctagactgtttctgagactgtggaattttctgttcaacaggcctcagtactggctccaacatttgcttggaccgcttcttatcccatgctctcaagggcagactgtggttgctggtgtgcatgctcttaggcctaaggcacaattgatgatgggggtgtttctggagcttgatcatgctggagtgttcagatcatgtctaccaggttcctctgggtgggaaagctggtagagagaagagtagggattcaagcctcaagattaggtaggagtgcgtgtgtcccatggtcccctgccaaattttggcataaaactctgagggatatgagaaatctaaattagaagttggcctttcagattgttataaaatatatttatcaagacagaaggaaatatcacattttatttaatagtttgccagcttcatttataacttttaaatatgtagatctggtatgctggcctccatctgtatccttgctccaggtcccacaaaggaggcagctatgtgtggtttttgactgtaatctatttcaggatataacccttcttctatactaggttgtgaaagtaagagggaaggggagggaaggaagagattgagtattagtgttatgttatctgctaggagctatgctagccagatgctgtcacacacactgttactgaatcccaacttctcttctgttcagttctgattttatcattgagaaaaataggtggtaggccttgggtttgagatgtcacatgcttgaaatatttgcaaaatggaatgaatttaactagttgactcagtaggtattttatacatatgatttactaagaagtcaaagccatttgatggttgcagcacatgttttgtaatgtgatgacatttctctgctaccataataaagcttaacttgctgtttttcactttggaatatattttctttcttttgacttatagtggcatgtccctgccagactgtcactgtttaataaatactttttttgtttagttgtcggggaacaaaattacaaaggtaggttaagcaaaactgtcttatagtaatagcttaatgatctccatttcctgcttcattgcgtatcttgacactgaaactcatctttctttaattttatgcctgttgtcatttatttgcatctcaataaaacttaatatatatcagaataactgagagtcctattctacagcaatgagaggagggaatacatttgcaaatgaaaagaatggaattatgtgtgggaaacaagcaactttttatctggataggtgatatttcagtagaattgtatgaagtcagcttaaattgtgagtcataacttaaatgcagcaggaacacagagtgctatgatttaagactttgtccaaggttttctgaacaatgtttttcttgattaatgaatcagagaataaatgaatagtctaagatacctgcactgaagccctcgatagaggatgcaatcttagactgacatacaattcttacttaaagaagaaaacttaaaggtcatgtcatctagctactactctaagtattgtgagtcattatagcacttcacagaaactgtttttcctgaatgcttcttaatgttaggtctccagtgtcactacaaaaagccatcacagatttctccttctgtgtttgttgtgaaatggttgatgaagacattgtttacctctctcagattttattcaatggaaagctgactctccttaagaataaaaacacatcccctcccagataaaaacaagcaatttactatatttagctgctaggagcttagggtcaaatttgtttttgttccctggcctttatattaactattttgtctgtctaaaagtttctttcccatagaggcagggtgtggtggctcatgcctgtaatcccagcactttgggtggccaaggtgggtctatcgcttgagcccaggagtttgagaccagtctgtgcaacatggtgagaccctgtctctactaagaaaacaaaacaaaacaaaacaaaaaattagctggttggtggtgcatgcctgtaatcccagctacttgggaggctgaggcacaagaatcactcaaacctgggaggcagaagttacagtaagctgagatcatgccactgcactccagcctggagtctcaaaaatagagtagaataatagaatagaatagaatagaatggaatagaatagaatagaatagaatggaatagaatagaatagaatagaatagaatagaatagaatagaatagaatagaatagaatagaatagaatagaatagaatagaatagaatagaaaagtttctttccccagatctctgcaagagcagatttttatcactgaagtctctgttcgtcttttttgggagtccctccctgaccatccgacctaaagtgatgtaggtaagggaatacctttcctctaccctcttaaattctgtgactaggacctgtgaattgtatagacaaaagacatactaacaaaagaaaaagcatacacattttacttgaggttaacatttttatgtgtcgtaggaggctttgtaggaagaaagaagtaaaaacctcaaagaagcagttagacctaggggtttacataacattttaacaaaggtcataaattgtggagatatgacaaagccaaagtaaaagagtttagggttggggaaagaaattgtggaaaagtgactaggaaatacatgggagaagctaatggaagataagggttatttttgtaagatttgtttgtgtagattcatctctgtgtcaactccctgtctctgatgatgagaatattcccttcttggtgatacagggagggcacttttctcatggtaaatttacactctgcttttaagtaaaaaaggaaaaggcagagagcccttcctgcatctgctattgagcatctccagctcaaaataatcagtatcccaaagtggcatatttagggatggtgtgttctgatccccctcagtggctttcataccatctattactctatgaaattatactacttcattctatttttggcttttgctgtcatttgaatataattctccttggggaaaaagacttagcatttaagcaatgcctggtatacagttattctgctcaatgactatttattgaatgactttaaaatatccagtgaataattacaactatattgatccttatgacatacttgcttttacaattctgtcattttcacttacccactatgtaatggtagttaactttcagttaatttctttacattctttttctgtaaagaaagattataaataaataaatttaattaaagaagagactagaaagagtttcctggccaagaaaaataggatctctttttaaatgaatttattcaacaaatatttgctaggtattcgtatgtgccaggtatgactaggtcctaagaatgttttttaaaatatcagaagcacacccagcccactgagtgagacaggttgtgaacaaattattgcagtaatgtaacaagggcctgaagtatactgcaaattgggtttccgacttgcaaattctgaaatagagattcgggtggaggggaattattaggcaacattctgtgaccaccacctggggaagaaaagggaaggacataagcctgggcacagggagaggccgagctgtgatgtggtctcattggaagctttagccaactctgagggaagttctgaagacagatgattttttggagttgtctccagtgttgtgaaggacctgggcccttgtatcacactttacgtttggggatgtggctatcttgggaaaaggcatggcctgagaggtgctttcatctgagataattcctaaagagggcatatctgctggttgcactcccggcagctgaaataataatttatcccttcctttaaggggaacgggtgctaacatggcatccaccacatattaagtggttattattattagagacacaaataaagcaatataggagctatgataagaaagagcttaattgcacctctgaaatgccaaaagaaaatacactgaaatctgaatcttgaaatccaattaggacttttaggggcagaagccattccaggcagagggattatgctggtcctcatacatggaacaaggtaataatactaatttttgtatttggggatttctaaatggaagagcaggtacaaacaccaactgaacatctgtagtaggcacttaggtgcagtacgtcatttcatgctcttagcaactttgcaaataagttattgccatatatttatagatgataaaacagaggttaagagaggtataagcattctcccagtggtcacatagctattaatagcaactggtgaagtcagagttttcctgaggtttgcttggctccaaagtcagggctttttcaaccatcatgcagttttcctgttctaaccttagtttttagtagtagtacctgttttatggtttgctcttaagaaatcaactgattttaataaacttttgaacaatactcacaagcatcaagagaactgtaagttctgccaatacattcatcggcaatcttgaagtgaacagtgaccaacaagtatttttcagtagctgtgttattttatgcctctcaacaaaatgttctatgtgcttggaaattagaaagatatgtacttgcattgaataaggtccatacttcacagaaacactagaatattctgctctaaaaatacaaaactgattatctgaattatctagtctttgaaaactccttgtcatcactaactacagagtacttacctggattagggtactcagtgaaaaactgggtcagaatgtcaaactacatggctcctttgcttaacactcctcattgcttttcatttttctatagctagcagcagtacccaaagaggggaatatataaaccccaggagattttacagacaatctattgtgcaaagaaaaaaataggtttgtttttcagtattgctctttgaaaatatttattgttgtgcatgcttcataatatgtatgatacattaatatgatacgtatattagaggtgtatacacagaacagtttaactgacacaataaaaacatttgcagtaaaattctgacacgctactacatggatgatcatcaaagatattgtgctaactaaaataagctagtcacaaaaggacaaacgctatatgattctacttatatgagagtagtcaaattcatagggacaaaaagtagaatggtggtttccaggggctgggggaaggaggaaatggggaattattgtttaatgggtagagtttcaatttgggaagatgaaaaagttgtaatgattgcataataatgtgaatgtatttaatgatactgaactgtttacttaaaaatagttaacattgtaaattttatgtcctgaatattttaccacaataaaaaatgataaaaaagtttggcggcccttggtttacaatattaaaatggaatgtaaggcttttcccaatttgactctatctcatctctggcctggaggacagtgttacttttgtcaatgaaaagagtcaaactctgtgaaatatttgaagatatttattctgagccaaatatgagtggccaatggcctgtgacacagccctctggagatcccgagaacatctgcccaaggtggtcagccagcaacttggttttatacattttaagcttgggtcaggaaaggtgggacactcatcttctgctaaagactttaaataaaaacattttctgaagtacccatttatttaactcctcattgctctgtctgtgctatgctgatcactgtcggagcctgtaaattcaaaccaataccacttcagtatttttcaagacaggtaagctttgtttaattcctttttgaaatccactaatctactttctatgccaattagcagtcagaggaaataaatcacatgcccttccaatgaagataaaatattcccagccccagtatttgagctttcaaattcagagtctcagagggtctgttcctccacattttcacttaatacctcactggctcccctccaaaccctgtctgacatgcaattattttcaacctatttcacagaagtctgctccattcatctttctgtgggtcagatttccattgaaactgattttaaacgataaaagattttactgtgtgaaacgtatgttggtagggctcgacgcaatgctaagccaagatttttttgggtttattggggcagatatgaaattggcagcatggagagggatgaaagaacatttataatcatatctgggggtttcgtaatgatctgtctggaataaaactgtatattgaattatgggtgggtgtttgcactatacgggtagaaagggaatcggactgatagaggcagggagggagtgttggtcagaagttctgaactcaatttctggctttgttacttaaggtagaagacttactctctctagaaattagcttcctttttttatataatgagatagagctgagcagaacttatcaccttatctcctctacctgctcttttcctgttgttccctatttctttaaatggcaccatgacccagttaacaagtcagaaatctgagagtcagctttgacttctcctttaccctctgcattgattactcaccagttcatgctaatttcacctcttgaatttcccttgatctgctctgttctttctatcttcttggcaattagactaagcttaactccctccttctttcccctagtgactggactgtccatgcgaagagccacttcactacccacaggcttcctcctcaccctcccctctcaaatctagttcagtggaggccaaagtgatcttgctaagagaatctaatcatgtccctcatttattaaaaaattcctcattgtcgagatctgtctcctgagaatttctctagacttgtccccttttcacaacctctatcacttgtacttcagctgcactaagttgttttcgcatctttttttgccaccaagcctttaaatatactatttcttttgctcatgacacttttgcatttctcttcaccttgtgctacctgtttcagatttcaactgtgtcacttctccataggactgatgtccaggctgtgctatgcttgcatgggtcacaggttatcataattctatttatactaactacagttttaatttttttatttttaatttttgtgggtacataataggtgcatatatttatgggttacatgagatattctgatacaggcatgcaatgcatagtaattccatcaggaaaaatagagtatcaatcacctcaagcatttatcctttgtgttacaaataacccagttatactctcttagatattttgaaatgtacaattaaattatttttttattatagtcaccctattgtgttagcaaatactgggacttacttattatttctaactatgtttttgtacccgttaatcatccccctttcctccactacatcctccagactacccttcccagcctctggcagccatcttttttttttttttttaagagacggagttttgctcttgttgcccaggctggagtgcaatggcacgatcttggctcaccgcaacctccacctcccaggttcaagcgattctcctgcctcagcctcccgagtagctgggattacaggcatgcaccaccacgcccagctaattttgtatttttagtagagacaagatttctccatgttggtcaggctggtcttgaactcctgatcttaggtgatcctcctgccttggcctctgaaagtgctgagattacacacctcgcctgccatccttttactatctatcttcatgagttcagttgttttaatttttagcacccacagataagtgagaacatgcaaagtttgtctttctgtgcctgacttttttcacttaacataatggcctccagttccatccatgttgttgcaaatgatgggatattattctttttatggctgaatagtaagtactccatttacaccagtttttaaatactgaccaatattttaaaatgcaaagtgatttgtttgcagaatctttctggaataattcttaatcttttaaatttgtctcattcaactcctaatataacagcagtgctttggcaacttgactttataaaattatgtcaaaacattaaagcagttttcacagaaacatacacatggtattttaccctcatatttcattaattatgtaagtttcgttaaagtaatataattacaaagaagtacaactgacataatgaagtcagctgttgaacacaattaagtcttgaaaaatatgccccttgattgttaagtggagaagtacatagacatcagtttgtgtatttaagggagataatggaaaatgttgatttatctcatgacttcaataccctgtctttacttctagattatacatatcttgatggtaagagctgttgtttattcatttaatatacacaacacaaagcacaatatcaactcaatatccaatatgtaatttaaaaaattaatattaaattagatataaggtttttttttcttttattattatactttaagttttagggtacatgtgcacattgtgcaagttagttacatacgtatacatgtgccacgctggtgcgctgcacccactaactcgtcatctagcattaggtatatttcccagtgctatccctccccccctccccccaccccacaacagtccccagagtgtgatgttccccttcctgtgtccatgtgatctcattgttcaattctcacctatgagtgagaatatgcggtgtttggttttttgttcttgcgatagtttactgagaatgatgatttccaatttcatccatgtccctacaaaggacacgaactcatcattttttatggctgcatagtattccatggtgtatatgtgccacattttcttaatccagtccatcacatgaacagacacttctcaaaagaagacatttatgcagccaaaaaacatatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggtctataaatcatgctgctataaagatataaagttttttaactccaaagactatggaatttgtaaaattgttaacttaccttcaaattctaatattctttgatttgtatgtaattataaacatatttgtgttgtgatgaaattatatattagttaatggccagattcttgtgttgtattatctttgtgttctccacagtcaaatgactgtgaaagttgctcaataagtaagtatcaaatggtgtatgtgtgcctgcctggttggttgttgggagtatgagaatgttccaacattcttgaagtatgtctttgttagcagcatgagaacaaacgaatacatactgcattttgtttataaaagtgcatattcctgaaaattatttttagggtgagggcaagtgctgttaagtaaggcattaaacaaaaccttaagcttggtatatgaaattattcactacaactattctttactaagagatcagtaagatttcaatacaattaagaaaatctaaattcaggattatttattggtagctattgaaaaacaatatcagaggggaaccttaatctaaataaacaatgacttagaattttacaagtaataataagctgtgtactttagcaggacacagctgtttaatcatctccttgcccattaaacttgtttgagaagcacattctcagtgactgctcagaaacttatttgcattggtgatttagctttggggtaaatgattcagatttttaaaattcagatgttattatattatgctaaacaacatgccagggctatatccctagctcatttgaatttagcctgaataatagcagtgcacattaggcctggtgttgaaccgactttgtagcagtctttgctgtttttgctttttccagccaaggagggcaatttcctgatagatggtcaatctcccctcttgcccttggaacatttccaaggaaaagaaaaagagggaaagcaggtgtagccattcacaaccagatacagaataatggcaagtaaatcatggtcgtaaaaacaatgactgacattttttgagaggtttctggtatgtcagacattgaattaagcaattttcatgctttatctcaattctcacaacctcctagcagtgagcagtggttaacatgcaggttcaggagccagactggcttaggtttgaatcctggccctccactttcagtggtgtgaccttgggcaaactgcttaacctctgtgtgtgtcagcttctgcatgcgtaaaaggaagggaatatatatacatcttattgtgtttttgtgaagattgaagagaaaatgcaaaacaaactcagtatttgcactaaaaaatgttagcttttattatcatttaatattactattattctttttctctttctacagtgaatcaatttagtgaatccaaatgactttgtccaggtcacagaggaagtgggtgtcattgccagaactgaactctatgcctccctgtccagcaaaattccactacatagaacatgatgtaccatgatcacgacagttccagtcagggagtgaagggagagagcccaggcttcggagctaagcacataaagtttgaatccagctcttctgcatattctatgaatcactgaatatatttacatacattcactgtattcagtttcatctctaaaattagcataatatcccatttttagagttgtgagaaagataataaataatgcatattttaaaaactggtaaataaaaagttcttgaaagtggttgctcttattataggcttatcacaatacattataatcaaatataattgcagtaatagtgtataatgctttaatatcaaaaataatttgggggaacatacacgtttataaacaaaatgcagtatgtattagtctgttctcatgctgctgataaagacatacctgagactgggtaatttataaaggaaagagatttaattgactcagagttccacagggctggggaggcctcaggaaactcacaatcatggcagaagaggaagcaaacacatccttctcatggcaacatgagaaggggaactatgagtgaagagtggggaaaaggcccttgtaaaactgtcaaatcttgtgagaattcactgtccaaaaacagcagcctaggggtaaccatccttgtaaccatccttatgattcaattacctcccaccaggtccctcccatgacacgtagggattatgggatctacaattcaagatgagatttgggtggggacacagccaatccatatcatggtatatatacacaatggagcatcatcagccttaaaaggaaaggaaattctgataacatgatataacatcaatgaaccttgaggaaacatgatacaacacagatgaaccttgattacattccgctaactgaaataagccagacacaaaaggacaaatactgtatgacgctacttatatgaagtacatactagtcatattcatagagacaaaaagcagaatgatggttgccaggggctggagggaggaagaaatgcataagtattgtttaataggtataaaatttgcttagaaagatgaaaacattctggagacgtttggtggtaatggttgtccaacaatgtgaatgcatttaatgccgctgaactgcacacttaaaaatagttaccattatacattttatgtcatgtatattttactacaatgaaaaagttggagaaaaaagaatatatccatctacgggaggaaaaatttgttattaaaattattgaaataagaattgcagtcctaaaattaactcatacctcatcctttttttttctttttctttttttttttttttttttgagacggagtctcactctgtcacccaggctggagtgcaatggcgcaatcttggctcactgcaagctccacctcccaggttctcgccattctcctgcctcagcctccggagtagctgggattacaggcgcccaccaccatgcccagctaattttttgtatttttagtaaagacgggtttcactgtgttggccaggctggtctcaaactcctgacctcaggtgatccgcccgcctcagcctcctaaagtgctgggattacaggcgtgagccaccgcgccctgcctgctcatgcctcttcaggaagatttttgatattttgcgttgaattcctctaagaagtcatttcagtctttatatttcacagtagtgagaaggagtgcatgactgttcttacccacacatatgttccttttcgaattggcagatgagtattcatcaatgtagattctaacaatactgtcagaggagaaataatattgttgtgacaccaagagaacatttttattgtacacattaccttggaataacatttttgccaggaaatttgatgcagcatacatatggtgcctgatagaaagaagccaggcgaaagtacattagtcctgtgtgttgtacatgatatatagtcaaacagcctgtgagatagaaggatatcattaactatgaaggtcattccatcatcagtataatgtttggaacaaagatatattcagttatgctgtttactctatttatacttcaactctgcatctttataaacctacctttctatgtgatttttaaaactcacagaagacttttttttaagaagagaagatctgttttgtttaaattgccttgcactccaaataaaaactattatgaattttaaaacatgacttcttctgacattgaaactcttcttttttttccaatgactatataactgttaaaattttggaaaaatattttagtatgcccaggaagccttgctatgtctattctatttgcatttgtttcatagtctcattaggttcattttccccctaatttttcatttgtggtaaaatgcacataacaacatttaccatcttagccactttaaagtgtacagttccgtggcattaaatacattcataatgttctgtaaacatcaccaccacctccagctctcttttcatcttgtaaaaatgaaactctgtaactattaaacaataactctctcttccccccaatcctcagcccttggcaaccatctccactttccgtttctatgatttcgactattctaagtacctcatacaagtgggatcatatgtatttgccctttgtgcctggcttattttacttgccataatgtcctcaaggttcatccaggttataacatatgtcataattccctttctttttaaagcttgaataatattccattttctgaatattacacattttgttcatctatttatccattaatggatacttgggttgcttccatgctttagctattgagaataatgcaatcctaccaacaatactcaagaattccaattccaatttctccacatccttgccaacacctctggcttatattttaaaatatattagccatccttatgggtgcaaagtggtatctcactgtagttatgatttgcttttccctcatgattagtgatgctgagcatcttttcatatgctgatgggacctttgtatattttctttggagaaaaatctattcaagtgcctttgctcattttttattcaggttgtttattttgttgttgttattgttgagttttggagctctttctacattctgggtgttaatcttttatcagatatacaaatattttctcctatgctgtaaactgcttttttattttgttgatagtgtcttctgatgcacaaactttaaaattttcataagtccaacttttctgtttcttcagaaaagaagaaaaaagcctgagcctttgtcatatccaagaaattactgccaaattcaatatcatgaaatttttgccctatgttttcctttacaagttttatatttttagatttctgatccattctgagttaaattttgtatgtggtgttagataagggtctaacttcattcttttgcatgcaaatatccaattttcccggcaccatttgttgtaaagattgtcttttccccataaaatagtcttggcacccttgtaaaatatcatttgaccatatatgcaaggatttatttctggttctttattctgtttcattagtctgtatttatgccagtaccacaatatgttgatttcctgtaactttgtagtaagttttgaaatcacgaagcatgagttcctccagctttattcttctttttcaagattattttggcctattgttgtcccttgagatgccatgtaagttttaggatgggtttttttttttatttctacaaaaaaaaattggaattttgataaagattgcatagaatctgtaaatcactttgggtagtattgacggcttaacaatatcaagtctttccgtccatgaacatatcttctcatgtatttatatctttaatttctttaataatattttgtagttttcattgtacaaatctttctcctctttggttaggttaagtcataagtatttcattgtttttgatgctactgtgaatggaaacactttcttaatattttttcagattgttcattgctactgtatagaagaaatgcaactgatttttgtgtgttgactttatattctgctactttactgaatttattagttccaacagtttttggggtgaacatttagttttccacacatgagatcatataattttagaacagagagaattttacttcttttttttccactttggatgcctttatctctttttcttgcctaattgctccagctagaattttcagtactatgttgaaaagaagtggcaaagaccgggtgcggtggctcacacctgtaatcccagcactttgggaggccaaggtgggtggatcccggggtcaggagttcaagaccagcctgaccaacatagtgaaaccccatttctactaaagatacaaaaaaaaatttagccaggcatggttgtaggcacctgtaatcccagctacttggaggctgaggcaggaaaatcgcttgaccccaggtggcagaggttgtagtgagccgagatggtgccattgcactcccgcctgggtgacagggcaagactccatctcaaaaaaaaaaaaaaaaaagaagtggcaagagcaggcatccttgtcttgtttctgatcttagaagagaagccttcagtctttcaccattaagtatgatgtttgctgttaattttttatatatggcttttattatgttaaggcggtttctttctatcccttgtttgttggattaaaaaaattttttatttctatagcttttggggtacaagtcttttttggttacatagattgattatatagtagtgaattctgacattttagtgcacctatcacctgaataacgtatgttgtatccaacatgtagttttgtatcccatatagaataatggtgtccagctccatccaggttgctgcaaaagacattatttcattcttttttatggctatattccatagcacatatatatatgcacacacatatatatagcatatatatatatgtacacacatacacacacatatatacacacacacacacacacacacaccatattttctgtatccactcactggtcagtgggcacttaggttggcttcatatctttgcaattgtgaattgtgctgcaataaacatacaagtacatgtgtctttttcatataatgacttctttcctttgggtagatatccattagtgggatggctggatcgaatggtagatctagttctttaaggaatctccatactatttttcatagaggttgtactcatttacattcccaccagcagagtagaagcattctcctttcattacatctacatcaacatctatcattttttgactttttgataatggccattcttactggagtaagatggtatcccattgtggctttaatttgcatttccctaacaattactgatgttgagcattttttcatgtttgtgggtcatttgtatatcttcttttgagaaacgtctatttatgtcctttgcccacttcttgatgaggttatttgttttttccttaatttgtttgagttccttgtagattctggatattagtcctttttcagagacatagtttaaaagtattttctccactcttgattgtctgtttattctgatgattatttctttggctgtgcagaagctttttagtttaatcaggtctcatttatttatttttgctttttttccatttgcttttagggttttagtcataaatactttgcctaggccaacgtccagaagagttttttcaaagttatcttctagaatttttatgctttcagccctagacttaagtctttgatccatcttgagtttatttttgtataaggtgagagatagggatccagtttcattcttctacatgtggatatctagttttcccagcaccatttattaaatagagtttccttttcccaatttatgtttttgtatgctttgttgaagatcaactgtttataagcatttgactttatttctgggttctctattctgttcccttagtctatctgcctccttttgaaagtaccatgttgttttggtaactacagccttgtagtataacttaaagtccagtaatgtgatgtctccagatttgttctttttgtttaggatcgctttagttatttgggggcttttttggttccatatgaattttaggattgtttttgctaattctgtgaaaaatgattttggtattttgatgggaattgcattgaatctgtacattgctttgggcagtatgatcattttcacagtattgattattccaatccattagcatggaatgtgtttctgtttgtttgtgtcatctatgctttatttcagcagtgttttgtagttctctttgtagagaattttcacctccttggttaagtatattcttagttattcaattttcttttcttcttttttttttttttttgcagccattgtaaaagggattgagttctttatttgattctcagcttgctcattgttggtatatagcaagcagcactgctgatttgtgtacattgattttgtaacctgagactttactgaatttgtttatcaaatctaagagtcttttgaaggaaaatttagggtttcctaagtatagagtcatgtcaccagtgagcagtgaagtttgactttctcttttccaaagtggatccccttattttcttctcttacctgtttgctctggctaggacttccagtactatgttgaataggaatggtaaaagtgggcatccttgtctttttccagttcacaggaggaattctttcaacttttcttcctcagtgtgatgttggggtttgttgaaggtttttatcataaagggatgctgaattttattgagtgcttttttctgcatctattgagaagatcctatgatttgtgtttttaattctgcttatgtgatgtatcgcacatattgactcgtatatgtttaaccatctcggcaacctgggtatgaaacacacttgaccatggtgtattacctttttgatttgctgttagattcagctagctagtattttattgagaattttgcatctatgttcaaaagaaatattggtttgtagctttctttttttttactttctttctttaattttttttattattattatactttaagttttagggtacatgtgcacaatgtgcaggttagttacatatgtatacatgtgccgtgctggtgtgctgcacccattaactcatcatttagcattaggtatatctcctaatgctatccctcccccctccccccaccccacaacagtccccagagggtgatgttccccttcctgtgtccatgtgttctcattgttcaattcccacctatgagtgagaatacgcggtgtttggttttttgttcttgcgatagtctttttttattatatcctttcctgatttttgtatcagagtgatgctggcttcatagaataatttaggtaggattccctcttcctctatcttttgtaatggtttcagtaggattgatgccaatttttctttgaatgtctgatagaattcagctgtgaatccatctggtcctgggtttttgttgttgttgttgttgttgttggcaaatttctagttaacttctcccatctcgctgcttatcggtctaatcagggttcctatttcttcctgacttaatctaagagggttgtatgtttccaggaatgtatccatttcctataggttttctagtttgtgtgcctagaaatgttcacagtactctcaaatgatcattttttatttctgtggtgtcagttgtaatgtctcaagtttcatttctaattgagcatatttgaatcttctctcttttcttggttaatcttgctaatggcctatcaattttgtttatcttttcaaagaaccagctttttgtttcattgatcttttgtatttttttgttttaatttcttttggttctgctctgatctttgttattcctcttcttctgctagctttggattgagtttgttcttttttctctagttccttaaggtgtaacattagattgtcaatttgtgatcttttagactttttaatgtggtcgtttagcactataaactttccttttagtgttccttttgctgtatcccagggctttgataacttgtgtcattatgatcattaatttcaaagaatacttaaatttctatcttgatttcatcagtaacctcaaaatcattcaggagcagatcgtttaatttccatgtgtttgtatagctatgggggttccttgtggagttaatttctagttttattccactgtggtctgaaagatagttgatattattttgacttctcaaaatttattgagacttgttttgtggcctattgtatggtctgtcttggaggatgttccatgtgctgatgagaagaatgtatattctgcagttcttgagtagaatgttctataatatctgttaggtccatttgttatagaatataagttaagtctgttgtttctttgttgactttctgtcttgatgatctgtgtagtactgtcagtggagtattgaattttcccactattattgtgttgctgtcttaggtctagtagtaattgttttatgaagatgggagctcccgtgtaaggtacatatgaatttaggattatgatatcttcctgtcgaaattatccttttatcattataaaatgacctttttgtcttttactgttgttgctttaaggtctgtgtgatctaagaataaccattcctgttcgctttggtttccatttgcatagaatatctttttccacttttttaccatgaatttatatgaatctttacattttaggtaagtctctggaagacagttgatatttggtttgtgatttttttaatccattatgccaatctgtatattttaagtggagcatttagccacttacatgtaacattgagatgtgaggtatagtttcatttatcatgtcattgttacctagatactttcagtttttctcattatgttactgttttataagccctgtggattttatgctgtcaagaagttctattttggtgcatatcaagcctggctgttcttggtgtataggaatgctagtggggtttttttggtatgttgattttgtatcctgaaactttgctgaatttgttcatcaactgaaggagtaccaggactatggggtttcctagatatggaattatgtcatctgcaaacaggaatactttcactatttggatcccatttatttctttctgttgcctgattgttctggccaggatttccaatactatgatgagttagagtggtgagagcgggcattcttgtcttgtgccagtttttaaggggaatgctttcagcttttgcccatttagtatgttgttggctgtgggtttgtcatagatggctcttattattttaagatatgttccttcaatacctagttcattgacagtttttaacatgaagggatattgaaccgtatcaaaagccttttctgcatctgttcagatgatcatgtggtttttgtctttagttctgcttatgagatgaatcacatttactgatttgcatatgttgaaccatccttgcatcccagggatgaagcctacttgattgtggtgaattagctttttgatgtgctgctggatttgatttgccagtattttgctgaggatttttgcattgatgttcaccaaggatattggcctgaagttttctttatttgttgtgtctctgccagtctttggtatcaggatgattctggcctcatagcaggagttggggaggagtgcctcctcctcaattttttggaatagcttcggtaggaataatatcagcttttattcgtacatgtgtttgaatttggctgtgaatccctctggtactgagcttcttttggttggtaggctatttactacttactcagttttggagctcattattggtctgttcagaaattgaatttcttcctggttcagttttgggagggtgtatatgtccaggaatttatccatttcatctagattttctagtttgtgtgcattgtgtgttcagaatagtctctgatgattgtatttctgtgaggtcagtggtattacctcttttgccattgccaattgtgttcatttggatcttttttcttctttattagtctagctagcagtctatcttattaattttttcaaaaaaactagatcttggattcattgatcttttgaatggttttcatgtctcgatcttctattcagctctgattttgattagtttgtgtcttctgctagcttggaggttggtttgctcttccttctttagctcttttatttgtgatgttaagttgtaaaattgagatctttctaacttttcgatgtgggcatttagtgctatatatttccctcttaacactgccttagctgtgtcccagagattctggtatgttgcgtctttgttttcataggtttcaacaaacttcttgatttctcccttaatttcattatttacccaaaagtcattcatgaacaagttgtttcatttccatgtaattgtgtggttctgggcaattttcttggtcattaattctaattttattgtactatggtctgagagagtggttggcaaaatttcaaggatttttgtacatgtactgagcataattatatgtctgattttgtggttgatttcagagtatgtgccgtgtggcaatgagaagaatgtatattctggtttttttgtttgtgtctttgtttgtttgtttttttgagacagagtcttgctctgttgcctaggctggagtgcagtgacactatttcagttcactacaacctccaccttcctggttcaagcaattctccaccactaagcccggctagtttttgtatttttagtagaggcggggtttcaccatgttggccaggctggtctcaaactcctgacctcaaatgatccaccaacctcggcatcccaaactgctgggattacaggcatgagccaccaagccgggactattctgtttgttttttggtggagagttctgtagaggtctagagggcataatagagactgtaaggaagaagcattatttgaagtactccttgtctgtttaactcaccccacctgcaggagtagttggaggccaagaacaagtcccggtgccccgtagccccatacaggattcccagctttctctgccttgagcccagcatctgtggcttccttctgtcccctctcaatgccttttctttgaagatttactaggagtgcaccagtcttcccagtgttttggtcacttggtgggagatgtttctcctgcttgcatgtagttggccatcttggaatgaactcaggaatagcatctttcaaaaattctgaaaagctcccagctttgagcacttcaaataatgttcttccttacattctctattataccctctagacctcctagtaaacattagttgaaccttcttattcaatcctcaacatctcctaacctctctcacatattttacatgtctattgcattctataaaattttcttggcttgttcattaatctctttaactttgtataatttactatttagttcattatacaactcaactatttattcaacttagccatttattgattaaacaaaataattaaattttaattattatgagcttttattttaagattctgtattatcttttaaaatccacttgatcatttttatattctcttgtttcttgcttataatttcaaaccattacttgttttttaaacctattaagtaccctttttatatctctaataatttcagtaacttaagactttgtggatataattatgctatcaattttattttctgcatctgactcatggtatcgtgtttccgtgtgtgttttaggatttcttaaaatctcgtattcctatggccgggtgtggtggctcacgcttgtaatcccagcactttgggaggccgaggtgggtggatcacgaggtcaggagctcgagaccagcctggccaacccagtgaaaccccgtctctactaaaaatacaaaaaattggctgggtgtggtggcgggcgcctgtaatcccagctactcaggaggctgaggcaggagaatcacttgaaccaaggaggtggaggttacagtgagccaaaatcatgccactgcactccagcctgggcgacagagctagactccgtctcaaaaaaaaaaaaaaaaatctcgtattccttgcaatgtagctgcaaggaacagttgaagcctgacttgagtttctattcaatttcattaagctttgttcttaatttcctttattctattttcttttggcttattgtatttttttttttttacttatttagttaagagtcaaatcattttcactcttgcttcttttcttgtatatgaatttaagcctataaattttctgtaagcagtgctttacctacattccacatgttttaatttgtaatatttttcttatccttataacagatatcttctattcactttagtcatttcttctgtgacccatcagttattttgtaggttttggttctctattaattccaaaacaaatgagtcctaacattttatttttgttatttatttctacattaatttcatggtagttgtggttctcaatttactaattctttgaaatgttataacttaatttataatgtatttcttcaagtgtccttaaaaatactatgtaatctctaattattggagtaaatattttctgtcctaacagtctatcagttactgacagttatgtttaaaatatcactattaagactgatttgtcaaattctaccttcaactctttcactttttgcttcacatgttttgaaatcatgttatttagtacatacagaattagaattttcatatcttcctaatgaatgggacactttatcactatatagtgcccacttttatttttgccttaaagtctattttatctgtgtaaaatagctatatctcacccttcctttaattagtatttgctcagtatatatttttgtactttcatcttcttgtgtgcttatgttctctactataaatggcatatagttgttgttttttgaatacagtttgataatatggtcacttgagttatgattacacatagatttgaatcgactgccttatatttgtttttctctttcggttttctcctttcttcatttgaactgctttctctcctctactggttttgaaattttacatgctattttattttaatggttggccttgaaattttaacatatatccttaatttaaaaacatctaaagttcattaatgtctttagcttttctgcaatatcacaaaaatgtttaaatgtttaaaatacttagaagtctccacaatctctcccaagctgtcctgtccaccaaatctcttatcctctccccagcgtcctcctacctggccacacattgctctgcttcctgttccttaaataggccatgcacacgctcaccttaaggttttccactgaccagttcatctgctaaaaaccacctctcccagatatctgcatgactctctcacctttcaactctatttcaggcctttcctgccatcttatttaaaattgcacacgttttaagctcttcctagcagctttcatagcattatttttctctatatcacttatcaccttttagtatactaaataacttgtttaaattatttatgttcttcttccccaactagaagtaaagttccataaggaaaggaattttttttttattgctgtatccccagagcctaagatgattttgggctcatagtaagcccttactatttatttgttaagcattcaataatttcagatctcaaatccatatgagagccagttagtgtccttgaattgttaagggatgctatttttttttctattgatcaccaccaaggctgagacaaatcattttattgatgtctctttctttggagcattatttttacttagtgtgtttccttttctgatcctttatctggatatgtttcctgagtatgttcccttttcccactcttgatttaaaaattgcccaataaataaatatttttatctatttatggttcagttcatgaaaaacaaataggagaatagatactgtgcagacaacagcagtgtctgacacaattatgctgttgttacaaaaaagatccccactatatactgttatagttgcaaaagcaagttgcagaagaatatgtatatgagcttgttactgttaaaaaataaaacaaaaaactgaacttctgtaaatatgtgtatttgtatgtgcatggagatattttgagaagcctatacactacactagaatacaaccaataatacagtaaaaataatattacaattaataaatagggattgcatctaataataataaaacattttcaagatatccagtataatgccaggcactgttacaagtgttttacagacattaactaatttaatcttcgaaatcactttataaggctttactaacgttatccttaacttacagatgagaaaattgatacaggaagagctaagtaacttgtctgaggtaatagatctaataaatggtagtggtggagtttgaacccaggcagtctggctcccaaggctatgcacttaaacctctactatatctacatctctctctctatctgtatctatgtctatctatctatagctatagctatttctatgtctatctatatataacttagatagatattacaattacatattattttataatttacaaagaaagaaagaaagaaattacctctccttaaatccaccccaaaatggcagtagtagtagcaaaagcaagaagaaaggaaaaacaggataggataaattctaagcaaaacgtggctatcagtgaagattgtcttcagtcctcccccaacacccctttgcctttgggtgctgttgcacttctctaagagatcgaggttctccccacgcatatacccaagccagataaactgctcaggattctaaaccccagctttgttctgactttcctccgaaagcagcatccctattttttttcctcttcctcttccaactgaactagctgtccacccactttagagtcatgcatttttcttgacaagttggtaaccacaaaataatgggataattgtttgctctagatggtggaagagtttgagactgtagagaaagtaaccctatttttcccattcccacagaaatagttaacatttgtattgttttaaagatctcaaggagcttccacatggagctgctcatttaattcagtcttcatgatcacactgtgatggttttcatgcatagtttacaggtaaggaaaccaaggctctgtgaggataactattagttattagtctactgtgttctcacagctgagtggcagagctgatctcaagtcagattatccttttcccaaactgcaacaacctctttttatataaacttccttggccaggaatctccacatatattattaatgaattttgtggctagaatagtaaaaattcacatcaccactggaaaaataaagcttgagtgtgaaagaaatacagagtgaagtcaattacatggtactgctttaatatacagctgcatatttctgttatagcaatctgaatatccttttaaccttagtttcactttggctttgacattgtattttattatatgcaaactattgggaaacatttattcttaaaacaatttttccttctttcctaaatagcccctccgttgctttttttttttttttttttttttgagatggagtctccttctgtcacccaggctgaagtgcaatggcactatctcggctcactgcaatctccgcctggtgggttcaagtgattctcctgccttagcctcccaagtagctgggattacaggcatgtgccaccacacccggctaatgttgtatttttagtagagatggcgtttctccatgttggtcaggccggtatgaaactcctaacctcaggtgatccacccacctcggcctcccaaagtgttgggattacaggcatgagccactgcgccaggccccctcggttgcttcatccagaaataaaagacgggctatagctgactgctgatttgggcgatatgtgttggcaatattgttgagttccaaatacttttatatataaaagctaagtataactaaaagataaaatgtttaaatgcagagaaagatcttacaaaaacaaaatgtgtccacaatgcattgcagagtttgttggtttaagaaatgcaaacatagaaagtgtttagaaacctgaccataaaatgatgcaagtgaagtttttgttcctacaataaacttgagtcaaaagagcaaacaaagatatctcataaggttgctcaactgtaaattctctgagagatttttacacctgagggagaagttgagtattttcactgacactttatttcacccaccttgcccccacaaatttgttctcaacaagttgttgagcagtattggaaaacctaagcattttttaattgacaaaatctgatgtagtacattttaaagtgcagcaactgaaacgtctgtgaagcaggttaagttaacattgtgattgagtcctggaatttagaactaaaaggaacccaaatgcatgttttagggatattcctttgtcgacgatcaggaaaaacttccttctccttgctaggatcccaaataattcatagattaattttataaggcatagaaggtttagaacctggaaaagcaatgtcagagcagtttttcatcagcatcatttttattttcaaggaaacattaagtgataattgggcagtgtccatactggtttgtcagctctcttacgcatgagatttcctcctgtgctctatttcacatactccaggagtaaaggacgtccctcacacctctctgccctcagtctcccccacccccacccaatcatttcactatgtataatacatcaaaatattatgttgtacatcttgaatatacacatttttaaaaagaaagggccacaatgcagcctcctcactgcagctcctctcataaggtgtcctgtcttcctctttcatatccaaaataattcattgtaatgacacgtgattgtaacttgctttttcaaatctggggcactgagaggcaggctgcttctactttccaatgcaaatattacaaattaggctggtgcagtggctcacacttgtaatcccagtgcttcgggaagctcaggtgggaggattgcttgagcccaggagtttgaggctgcagtgagctgcaattgcaccactgcattccagcctggttgacaaagtgagaacctgtttctgaaaacaaaaaacaaaaaaacaaattagcaagcacccccaaattctcataatatagatcaggattggagggctacaggatatctcatgcattcattctctctccttgaatagattatctgttcttatatagctcatgtggattatgatttatgattatgattattattttgagacagagtctcattctctcgcccaggctggagtgcagtggcacgatctcggctcactgcaagctccacctcccgggttcatgacattctcctgcctcagccttcaaagtagctgggactacaggagtccgccaccacgcccggctcttttgttgtatttttagtagagatggggtttcaccgtgttagccaggatgatctcgatctcctgaccttgtgatctgcctgcctcggcctcccaaagtgctaggattacaggtgtgagccactgctcccggcctcatgtggattatttccttagcactaaatagcccaaatctcataaaaccatgtggttttggatgctatttgtcaaaacttcctgctttcctgatgaaggagggattggtaggcgataaatggttccaaacatactcacctgtgggtctggattgtccaaagatcaacctagtatagcttccaaactgatgctggaattactctccacagatgtttgaatattgagtctctgccttaaatgctgaagttagtggaccagagagagagctcattactttttaaagtgtctgttcacattcctggggcagtctcttgacatcacaccattaactcttctgctatattgtttctccagttgtcttagctttgttcccggagtcagccaagaaaacactgtttattttcactttcatacattgtgacctgtacatttattttttactgtacagactctttataggcccttttgtaaagtcccacattctcagggaatgtgtcaacattgaagatgtctcatataccagttactagaatcatgttaactttaaatgaaatataattacttctgcaactgcagagactaagatgaaaattaagcttcaagcttgaagcaaatccatttacacacactcttacatacacagactcacacactgccctgatgtttatcgccactttgatttcatggtctgtggtctggtttgtggcttccaaaattttacattgctctggggagctcgtccttgaagatacttagctttcttacttgaatacttcatataaacttttgctatgtgtgaggcttcccatttatctcattatctccccagtactgtgactttttaaattaaaactttctgttcgacagttcaagaattttgaaataacaagatatgcttggtataaaagatgaaccatgaaaaatttcagttgaaatttatttaatccaccacttcttcactcctcatggattctgatagtgaattgaaaagaaaaactccaatcatgcaattgttttccatttcattgagatttggatattacccactgagaatgagaggtaattgtttttaatagcagtgacaaaattcattttcatttactaattaaaggcatttcatttactaattaaaattcttcccttgatttaaaagcaaatgtgaacggaagttgtgaactgttttttttatacatttgatctccaggctgaataccggctttataggctaagctacaacaatgggatattttaaagaagccacgataattgagtatcatttaactcacttgttagaggaagttcgctcccacttttcttcttgcttatagttttgtaggggaatgtccatatatcacttcctaagaaaacatcatgaggataccttcagcctttttccttgttaacaaagtccttcgaaggcgttgtttgtaatgaaggaaaaagaaacctcagcagaatgcctcacctgtatatgttttcatttaacagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaaggtaaatatatatttgagatttttttttctctcccatatcataaataggatcactagcaccatgaaattgaagcactcaggtgtatcaatgggatgatgtgcctttctccccaaaacagcactgttctcagctctggggttacagtttagtacaaaacaaagtcctgcccttgtggagttcactttctagtgcagaaaaggaggagtcagacaatacacaataaataaataagcaaacaaaattaagatatgttatatggtgtgaagtatggctgaggaaactaaagcagggaaaaggaatgaaataaggggacaaggccgggtgctgtggctcatgcctgtaacccagcactttgggaggctgaggtgggaggatcacctgaggttcggatttcaagaccagcctggccaacatggtgaaacctcatctctacaaaattacaaaatacaaaaaattagctgggcatggtggcacacgcctgtaatcccagctacttgggaagctgaggcaagagaattgcttgaacccgggagacagaggttgcaatgagccaaatcgcgccattgcactgcagcctgggcaacagagtgagactctgtctcaaaaaaaaaaagagagaaagaaagaaaaagaaagaaagaaggaaggaaggaaggaaggaaggaaggaaggaaggaaggaaggaaggaaggaaagaaagaaaaaaaagaaagaaagaaagagagagagagagagatggggacaaacgagtggtcattctatttcaaatagagtggcaaatgaagacttttccagtggaggacattgagcagagaactgaaggaggtaacagaatggtccaggcaaagtggaatacaagggcaaagactccaaggagtgataactcatcattagggttgtaaatacacaaatcaaacaatatagaaaaacagaagctagaaagtgaaaatgatcagaaattccacggtcaaagaaaattaccattaacacaatcagacatatcccctcagacatctatttgaacacttacatatacatatacaagcacatatatttttacataaatgtgatcaaaactacaaataatatcttgtaacatacttgtttcatccataaatctgttacatgtatctttttatgagtactaatatttttcaatatctgtctactattacagtggttgagatgttttggatgtttgtttccttatatccttagaataaattcctagaaattaattgttaggtcaaagggtatgcatatttaagattttgaataaaatggacaactgccaaacagaaagtcaatatgattttaatattcattcctattaataatgattcagagagcattttctctgcatcctctttaatgctgagacttgttgatttcataaatgttcttttgattccttctgataaatatcttctcatatattcattggccttttctgttattcatatccatgttttttgctgttttaaaaaatgatggtttaatatttttcttattattttataagaactttctgtgtattagagttattctttttccatcccacatgttgcaaataatttttctggtaagtcttttggtttctaaccttgtttaagatgtatgtttattttgtttttgccatgtttagtcaaatatatccaactttattgattctgagacatattttaatattacccatgattataaaagcattgctagcctgtcatgcccccaactatttacaacattcaggagcagattttatatttcttaacacagtactcttctcagatttttttgttttgttttgttttgtgacagagtctcgctctgtcacccaggctggagtgcagtggcgctgtctctgctcactgcaagctccgcctcccgggttcatgccattctcctgcctcagcctcccgagtagctgggactacaggtgactgccaccacacccggctaatttttctgtatatttagtagagacggggtttcacagtgttagccagggtggtctccatctcctgaccttgtgatccacccgacttggcctcccaaagtgctgggattacaggcgtgagccaccatgcccggcctcagaaatattttttaaaaaaccatctggcctacatattagggaaaaccagtataggtcaaggcacttctgacacaaaaattgttttttggtctaagacaatgtataaagaggagtagcaaagaaggcatggaagccttttcttacacaggaagtcatcttcagtttgcctcatgacttttatttaatgcttactatatgtcagatcttgctccaggcacttcattagcattctcatttaatcccccacagttcccacgccagaattaccagacactttctgaaaacctggaaatttcttattcatgatgtaagagtagaagtaatattgatggtcgtgataaaaatttgctctttagtgtcattgctacgtatataaatgttttctgctgtgttttctttattttattaacatataaaccagatgtatttgatataactgctattctggcagatatcaatggttactaacatgttcatttacatacttattcaaatgttgattttaaatgcacatagcatcagactctgtcactacctttccttatggtacagtcctccctgtcaactcttattctttgaaaaatttggaacctagcccactgtgtctatgtattctcactctctcgctctcctccttaattctgacatcttttttaggtaatttcaatattcatgcaaataacccatgcaacattcgggcctctcagttctttcactttttcatatccaacaatctttcctcaatcccattcagccactcacgccagggtcataacctagaacttgccattaccaacaacttcatcccctcaaaatcagaatttcaagcttactattctctgatgcccaagcctactcccactggtacgatttctgacaaccttctgatggcaccgagacctccaaactatggacattactaccatttctctcttcatcgggcccaaagatgctttaatttctatgggtccttcattataatcgctccttgcacacgacctcaattcctttttctctctttctttccatttacttccctgcaacaacttactcgagtgaagttcaatttttcgtctacttcacacctttacctgtgcagcagaattaatctcttataaaattcatgaccactttctactggggcccccagtaatgtttctgaggagattctctcacattcttttcctcacatgtcaaacacccctttttcttctctcagcttatgcccttttccatcatttcataaagaaactagaaacaataagatgtgcacactcccaacaccaaatctaccaacttactgcatctctacctatataagttggcttcctcctattaccggaagcaatggttcccgcttctaatgaaggatgacctctctctgctagtgcagtggattctatcccctcagactgaaaggttttactccagtctgtgtcctttctctctcctgaataattagtttaccctccttatggaatcattcatagcactattatctactatcttaaaaaccaaaatcaaacacaaacaaaccaaaaaaattgttttcctcgatcctaaaggaatcatctatattcattgtctattttaaaattaaatataaaatatttactaggtataagaacatttgtgactaaaacatgtttcaaaataagcacaatttatcaaaaatctgtccctgcgattggctaatgatcaatataaaaaacagtaaaaaacacgcccagttgcagtggctcacacctgtaatcccagcactttggaaagatcagcacaaccaggaggattgcttgaggccaggagttcgagaccagcctgggcagcatagggagacctcatccctatttaaaaaaaaacagccaagtgtagtggcttgcttctgtagtccaggctactcaggaggctgaggtgggaggatcacttgagcccaggaggttgaggctgcagtgagccatgatcacgccactgtactgcagcctgagagacagagcaagaccctgtctccagaagaaacaaataaacagacagacaaaaacatcaaatatacaagaaaagtctttctttgaattcttagtccacatttgtatcaaatggactaagtttaccttatatgaaaatgttgccaatttaaataatctgctacattggtgagtcaaactagccccgctaaaatgaatgtcattgatagctgtattcttatatattttctccaattcttttttgtgcttttactttttgttatttttctttacttgtttttggcttcctatgaaactcttataagcagttctcagaattggtgtcttagaccatgccaggtaaaacttttccattatggtaacatttatggtcgtttatttggcacatttggcttttgctctcaatactgtgaattacaattctcaaaattctaactcacattttctaggttgttttatttgaattgtttataggttgttgatttttcacactttgaccttgttatttagctatctttcaatgctgtctgctctctgccttcctcattgtggactttaatttcattctattagttctctccactaaggtaatagcaattctcttaaggttctcagaattctcatgtcagatctgcctttttcccacttctcaaaacttttaacctttgattaagtaaataaatgttcgggtactcatatgactcttatcagcgtttatatgagtgctgaggtagttagttgacaccaccagttcattcagttcactaccttttcaatgttcgttagttctttcctgttctcacttcccttctggacatttaactaccagtgtctttgagcacaaaccacctgtcatcactgtcaaaatgtgtagattaacacatacagttttcagataactatagcaataatctgtaaaccaagcttagctaaacctggggcaacataaatattttacaactacaggttaagctaggagagaatttgggtatcatcggattcatcatcttttctctatacaaaatcaaactcagaccactcccagtaaaaacaaaacaaaacaagtcattttatttaagtgaaaattggatgaaggaagttgaaaactgaggaaagtaccagaagttcctggcttaactgagtcaccttgtatgagtgaatcagtgtacaaatgagtgattagatctagcccttgactgacaactgttctgtgacaatcgtgctgtaaactttaatcttaacttcaaggcttttctatgtcagacctttaccgaactgataatacatcaaactcagcagttacacatcttctttaatagcagcactgtgagaggttttgcaaagaaggcaaacgttatccacatcagttagtgttgaaacatttagtgggaaaacaggttctagttatttattatccaaacagggcagtgagagatactctatgtttttggctataagtcaaagtaaatcaaactagagtagactaatctaacaatggaaagggcaaaaagtgattgaaaggaatagctggaggaatttgagtactgtacttatttttatttttctttgttttttaattattttcagttgctaaaattcacatagtgcaaatctaccaaagatctcaagggggctatagaattcctcagctactcggtttcctcccctagaggcaaactccattaccagcatctttttacccatccaatgatatttcaagtgtatgtgtttgaatgcacacttggtagattttatttctataacaagaaagttatgtgtatttattttgaatttactcatatttggtttaatcatgtgccttatgctcaaaaatttgtgttttctaaaaaatggtttaaaatatatataattttgtattgacaggaattcagttggaattttctgttaaaattttgatatactatatggcaacattatataaataattttcactagaaaaaatatatagaggaaaataatcacctgtagtcttgccacttagaaataagcacaataattattttggcttattgtttatacaaacatactgaaatattttctggaataggaattataccatacacagttgtccctcagtatctacggggcactggctccaggatccaccaagaataccaaaatacatggaagcttaagtgtctgacgtaaaatgcaatggttacatttacacataacctacacacatcctactgtatactttaaatcatctctagattatttatggtacctaatacaatgtaaatgccatctaaattgttgttatactatattgtttagggaataatgataagaaagagagtctgttcaatacagatgcattttaaaaaatattcttgatccacagaggactgattccatagacatggaactcaaggattcagagggttgactgtatgccattatggaatattttcccctgatgacaactatatatttacacattttattttcagccacaaataacaaatatgaaattgaaaatttaaaaaaacttattaaaataagggaccataaatttgatgttcatgctctctctcaattcagagtccttgaatgtaaaatggtgcctattaccagtgttatcagtcatacctaggttagcagtgggctgtttcaatgtcaggatggtggggagtatattgagcaatggttctgtgtgacatcctacaaaatctctccctcagggtccaaagtgggtgaggaaagccctgggatagggaaacacaaaagagagggagttagggagggaaaattcttagctggccgctttttcaaaggagcaagggagggaaggcactccagggctcaggcattcagcttcctgcttgtgccccccaccccaaaccaagttgctgtagcgtcagccatcataccaaccctgtcagagaaggctgcgtgtgaggagggctcaccaactccctgagaacacagtatagatccaagtatccctgaaaggagacagggaggaggggaatatagatgtactataataataaaaatactgttcaaagaccataatacaatgaaaatttatatataataaagagatagccaaagtcccattgacttcctatgcattttaagctatatttactgctaaagtattcagtgaaacttgtatatccctttgctgtgtttttcatggctcttccttcaccagagtgagcccattgccgtcctatacaacaggaactgcagcttcagcacgtcatgggaatcttcctgagttccatatcctgccctctcttccgatgtttttagctggttgggcatccctggtgaccgtcatgacacctcaaagctaggttctacctctatatccagcccctggctgccttgctgtggaacagcactcccagaaattatacagtgcatagcggctctgcagcagccctgatgcactgcttactcggctctaaattttagtgtcactgcctagatgcactctctgagatgaccctcagttctatctgaatactctcaccacccttctctcccagcccagctcctcagacccccaacttgtccataacaggaattcagacaatgaaatgtaatgaaattttgctactttcattgagcagaggacagaattactgttacagtagctcactgaaatacaagataaaaggaccaaggcaaaaatattttatctagtaattatcaaaatatagccagttttcctagatagataggtggatagatagataaatgaagcttctcaaagttatttgctaaaattttgcccacataacaaatagaagaaaccagatgtaagcaaatatctttgggaatgaattttcgatggtcacagaggactcttgtcaaaattgttttctccagctgtcaccttcactaaaagacatttactgtttccaggaagaatggtctttcatttttgcttaataggcaaccatggaattctctctctctttctttttaaatcacccagctacccttcccatctctgttcacttccagaattttctgattgtagtctgggcctgaaaacacatttcatcttggctcactgaccacaactttcttaaagttggctactctctaaaactctgtctcttccatgaaattgccctgaactcagtggagttaaggtattgatttctcacagacatgtcttatttatgcaaacaattgccttatgccatttataatatgttctaccccacaacatcaaaatccaatgcacacattctattgttttgcaggatgttagccttgggggaaacttggtaaagggtacatggatctctctgtttcaattttttttacaactgcatgtgaatctacagttaattcaaaataagaactttaattaaaaacataatgcccttattttctctatcttcctccctttctctctttaaattatccttttaaatacacatgtaaaattttacatgtaaggataaaatttttcctctgatcctttaccttgtttactctcccaaactttccaattttttttttaatatattgtgttttcagaggggtagagactacgtttaagaataagggtacacattcggttgtttggaagaaattttatgatgtataaaacaacctcctatgtatcttggctgtttctcacgctatgcttgaaacaccagaaatccatgtaaactgtaaaacaaactgatgaaaaagccaagtccctttctccacttccatctcctattcgatccagccccacccactgtagagtaaggcagttcctgaggtcaaactcctcagtcacaagacctcacagactttagtgagtacagatatccaaaccaggctgataattccaaagtaaaagatgccctaaaagccagagaaaaacagggattttgttcactacattaaataaaaatctgagaaaaccagagcaattcctgccaagtataattaagatgctgggagaaatgactcaaaagaaatatacctgcctttctcattctactttgtattggcctttctgaactaaggtgctgacttgaaaatgttatactcttgctggaagtctgctttaactatcaatacaaatattcttcaatcctttacaaataccgattttcatgaagaataagatacattacaacaaaaaatcctgtaatctgtatgaccaggttagaactccattttttttttaatcaaagacttgattttcacactttctgtggaatcctagcatttattatatagtctgggccattgtttctccataataaggccagatacctgaggtctcataaagtcagaaaaaaaaaactcaataaaatttttcttgattttatgtaagtgtgttaataagggcagttcctatgtgttggaggttaaaaatgtgaaatgttaaatttaaaaataaaagtcacagtgttgccagccacaatgtgactgtgttaatacataatatctaactggcctctttctcaagtactgacactgagtcatcacacttcacttactttcccattttcccctggagggacgtttctgttttgtcaacctggaaaacacatagtttgctgtcatattggattcagatttagttgggtatgaaagtgatacatcaatattctagtatgtgaattttctttttatgggaaggaaatctcttatctttgcttgttcagaaagtctcaactcaaaaaaatgaggcattcatttttatccttgtactgtagttttatgatagaaactgtcctccttgttgttacatttataagcacctcctaagctcctttttaggacagcttcagtgctctctaatttttataatctatagtccagatcgatcagaatctgctggaccaagtgaggataaaaatgaatgcatttcccaattcagtgcaggatttgggatgcccagaattgaaaaacatagatgtgttaagcggatctgttttaatatccagaaaagtcatccctcagcctgggcaagatgatcttgtgctcattactttacttcccagaatggagatgatgcataaaccacaattttaatttgcttttttttgtgcatgtgtagaataagcgacaaaatttcagcggctgtgattattataatattgccataaacctctctaatgaaatgccagcaatgttgagacagctttattcaggcataggtcaaaatagccatgcatatcagtacagggcgataaatcctggactccaaacaataacactgggccagaaaggaagcagatattaaggaaacaattattttattaatatgcacttatgtaaggcactttagacacaggcaaggtagatgattacatgagttaattaactaattaattttaggtcatttagagtatgtaaggacatatgaaacacatttttgtgtcatcaaaaaactaagaatcccttgtgagaggcctcttatagctatgagaagataacttgtaatgcaaagtgataattgataagtgtagacaataagtgcaattggagttcagagaagggacagatcacttccagacagattaactgagctatatttcatgaagaatgtgatattttagttgaatatgcaaattaaaagattaaatgtttgtcaagtgcctattgcatgcagtgcctgctcctgagctctgcgtgggtatcaagaaaatttatgtcacagtcttgccctagtaaagtctataatgtggccaagaaaatgactcataaacatataaaacacaaataacaatcaaagatctatttcaaggcaacgctagaagtgatcatgacagaaggcagtcatgattagttgtgctcattagttatgcaaacaattaattgctttagacattagcaaaaggaggcactcacttccctgacctgttggcagcatttgacaaaaacagtgccttctgtcttccaggactctacacactctttgttctccccctaccactctggctgctgcttttcagtctcctatgctggttaatcctcatctataaacactaaagtaattgagggctccgcctgtggtcctcttctctcttttgtccacattagctctgttgcaaatctgatgtagttcatggctttaaatcccatctacatgctggtgattggcaaatttttatctccagcctagacattttccctgaagtcctcctttgtttctccaattccccactcaaatctctacttaattgtctacaagccatctccaatttaacatgttcaaaactgagttcctaatttcctctttaaaactttctcccttgtattctatctcatctcagaaaatggcagctctaccttccagttgctcaggcaaaaatccctggagtcatccttaactttttctttctcttaattcccatatcagatcgatcagcaaattctttagttctgccttcaaaatttatccagaattagaccatgtctcatctcctttcttacttccactctggttcaagaacctatcaataacctcctggatttttacaactgtcttgtgacccatctttcttcctctaccctgtttcaaccaagcagccagagtgatccttttaaaatatcagtcaaattatgtcactcttctactcaaaaccctccaatgacttcccctctcactctgattaaaacctaatatactcatgatgacctacaaggtcctacaggggctggccctcattctcactgatgtcatctatttttaccttctgacctcttcactctttcttgaacaaaccaggagcactgctgtttcaagctctttgttcttgctgttttctttgccttgaatgctcttccccaaaataacttcatagcttgctacttcatgtccgtcaagactttactcagtaaatccttccttcaccacctcaatctatcttagactggattcctcagaagcagagcctgataaaaggattttagatggtattgatttgggagatgataccctgaaatagcagtaagggaacagggaaatgagacagagaaagaagacaatatagggtacattaatgagtgggttaactctgtggccaaatagggctcatttcccactgggagcttggggaggctgtacagaacacattgtcctatgggaggagtatttaccctcctcaattcctgttagacattggctaagggatgctcctgggggtgttaattcctggcacttctaaccttgcctgtgtgtaggcagagcaggcatcagcggtcagagaaagcctttaggtagaaaatcagagatgcttacaccagaaggcccttcacatgtccaagaatattcagaatcaaggagatataagtaaggcattgccagtgctgcagcctccccaaaattccgtatcttccttttgctgtttttgttttatccctataacatttaaccctatatttaatacaatatattttccttacttatcttgtttacttttttcctttatgaatcatgaattttgtctcatttgttcactgctatatccccagcacctaatacagtgctttatacatgagcagcaataaatacttatggattgaaaaagaaatgagtggatgaacaacttcaggatgggtaagtgatccaggaagtcttagagaagggatgggatttgcactgagtaaacattggttaggtggaggcagggtcaggagagcagcccagcagtggagaaccacaggagcaagagtaggtgagctaacatagggtaagtttaaaaatgagttaattccttttgatagtagcagatggtccttataaaaataaaaataactggagtaagacgagataggtcttgtccaggcaaactgtcagactgaggaatttgagatcttttctgtaggcaactgggaagaaacaaatgttttaaaacagaggaatttaaactgtgttttaaacccaattaaacacgttttaggaagactaatctgaagttattagtaagctgatttggggaaataggaaataaaaatgagtgtagaagctttttcagaggcagaaactggggcctgatagagttttacaaagtgactaagaaaaggctaattgaatgttggagatagtgtggttaagctatcaagatcagggttagggatgacagaggggagagcctgcattgaccctaaggtctagagtctggaatttagtggtacagctaatagatgatgcacccaaagaccagtccccactccagggctcacgcttgtttccatcatcctgggcatacccagcaaaatccaaactcggctgagttttgagaatcttctggaactcaggtgacctaacattgatttgggcaccttggatttttgacaaaggtagttgttcaaaaaaaagagacaagtgagaaatttttagcaatttaaaaatgttcccagaactggctctgcttcctaaaatcagcactcactcctgctcccttccttatccttattgtctgtggttcttgggattcatactgcagcttaatgctgtggggagcatcagtctacctagtagtgcaaagatcccgccctgtctccagataaggactctggcagtcccatcattttacagatcaatgaacatctgaagcacttgtctagtttgggaactgcctttagcagctagcagtttggtcaaaattcattccacagttttcctaaaaacaacaataatagctacaatatattgagtacttattaggagccaagcattattctaaacaacttgtttatattagttaatataatcctcccagcaacttatgaagcaggtttaagtgttcctagttgactaatgaggaaaccaaggaacaaagaggttaagtaacttatccaaagtcacacagctggaatgtggctcctccttgacacctgctcaccagccagctcctgaccctcgggaggatgggtgaggagaggtaagggagggggaaggtgtacttgaactggtaccatcatagactagctttacattctttggattttctagatataataatgtggcactcttacaggtactttcctggcctttttcaggctattcccatgatggtggtgttggggagattctctcttgaaagccactagatccaattgcatctgtcccagttggtgatttgcaactctttcctgagccccgaggcatccagagtgtaccttcatattctgccattcagccttgcaggcagagtcatagatatgtttatactagcttccacacctcacagtgtctgcagctggtccataggaagcattcaagcatccctgacccccaagaactgtgggagtacagattcatcccaacatagccatcactttcctactgccacagctcctttaggtttctcaggtatgagctcaacagaggtgactttgaaacagttcactgaactttcctttgcaagttctgcatatggcaaaccatctcccgctcactttggtatctgatagctaagaaattgatgcctcaactgaaattcaggcaggaggtgtttgttttttaacctttttggtatgtttactatcttcatgggattccatggagacatcctggggaagaaaacatgatatggactagcatagtatgggccatgaaatcaaacagctcctggagtgccatgcggcaggaggcaaagcagaaaagaggtgcaaaggcaaggccacgaagagccccatgccagaagaactgacttcatgtgtgtggggaagggaaaccattggaaatttaaacagtaatgcttaacttagatgtcatgatcaagtgacattccccaagggaaaaaatgtgggaattacagtggtcaagtgattaaatcctggaaacaccagaatttacaacacagatggacttcatggatatttgttctatgttgtaccagtttcgtccgtaattcctgtgttactactcaagtctactgtcacacatctgcccaccacatctttttgagccttctgtttcagccttcttttttcctttcatttatcatctctaggaaatttttcttttcctttcttttgcaaaagcatttcctcatttttcaaattattttcagtgagttctagtttttattgtattattgaagattagaactttgtaattgtgtcattaagtctggaaaaaaatgggtgttaatgctaagtcatccctgatatcagtaatttctttcagatattgggcctaaaggatatggatgcttgttgaaaaagttatgagtattgctataagctctcagtttgagtatgtacaggaagaagaaataaacacacatgtacacacattcacacacaccctcacacagtgagtactcaagtgatcaaagcaaaaaatgtttaccccattcatcatgcccagccacaagcctttaaatataattttttggctgacatggatacattaaaaaattataaatttttcctataatctcactgattgttccaaaaagtttccaaattactttctctatatttcaacaatataaatcatagtgtttagtctatgctttctaaacaatttctgaaaagattacaaaatatactagccctccagctcaaaagacctattttttagcaggactgtttgtctttggaacatttcatataaaattcaaagtaggaaaaggaaggcaagaccaccccaaacctctgctgagtaacttcttttctgcctgtccctgtgtcaaggcagagaagagaaacaaaggcagagacctttagtcaactatttaccttttactcaaggataccaatataataactttgcttttctattactagtcaaaacaaattttctgttggacttttttttaattttaattttgattttaagttccagggctgttggacttcttaactcagggacttctcgagtttgaacccagcctctttctctggctttgactgttgcctctgtccttcctcacacacatgctgagatttctgttccagaactcccactcccctttctgcaaagggactaacatctctgtggctaatgtaggtctgtccacattagtatcttctggcctggaatgttttctggcagttatcaggtaacttaagcatttatctgcaagattagttaaaagacttgctgtatagctgtgatattgattcaactcatagtttgactcaattagccagtttcaaatccagtttcacagcaggaaatttcacacatacaaatcagcacttttgagaagcctgatgaaataatggctagtttaccctgaaacgctttgtaatctagaagccaactgtctcagtaaatgccatagtaatgagttaattatcctagcccagtggttgctggggctttctgccaacatcctttttttccacttgctgcaatttctatctcacaagcagtcctcttctcaacttccttactaaaaaataaaacaaaacctactttatcctctcagaatgtccccagtgagtctccacttctcaaatgtttggtaacccatggcagctttcttccacttccaccttactgcagtctcaatatcattgggttttgatggcttcagcattaataatggatcaatctaatttagaggatgcatccaggcctcaccaaaatgttgtgtgtggaactgtcctacagaaggagtagagggcaccaaggttctattagaccaaatcagatgatggccaaggagaatttgccctatattaattctaatgtaattactacataagttcagagcccagaattggggccctatttgaacctggatttactgcaaaactacaccaaatccaaacactgaagacttttctagaaacaatttccagaggatgatttggttggtggcaatcaccgtgacccttgaaagcagtgctgtttattttctcccttcttctacaattgttgtattaaatatatatgtcatgcacatatatatggaatttttaagttgtgtgattttgaccatcaaattaagagcccaaaaatatagttccaaattgaggtcagaacagcaatatccaattgacaattttaaatccattggttgtcagaagaaaaaagcaatgtttatttgttaatactttttaaaatcctttaaaaaattaataactttagctcagtgataatcatgagtgtgaataagactttagctaagagctgattataataatgaaaagcgtgatctatctagatttcaaaaatttatgaatggttaagtacattacagtatttccacaaaatgttaaaaatggtgcaattgaggaaaattactgacatgaacagatgttcatgttatgttgttaaggcaaaaaaaatttaaactatttgaagtatataattttttgtatggatgtacacacagacacacagagaaaaataatctagaaaaacatatctgaaaacattattagtggctatttctgtgtggtagaattacaggtgactgtattttctttcttttactttcttttgtctactcatccttaattttctacagtgacatgaactacttttataataatagcctaatttattttttcaaacaatgtttgttcctagacttctttacagtgttacttttagagatgttagtggttgggggtctgcaggacacctaagaaagtttggtttttcctccctgtgatggggttcaggccgattcatccagtgctcattaaacagaagcctataaacaggcatgtcgcaggtgtaaactagaggaagattggcttctgtcagcaaattagccagttataccaatggccaaactaagcaccccagtgtgcctttgcagataaaattaaggataaaattataaaatatccatgtaattgttttgaacaactagattggtaattttttccctttaaaccacttttgatctttgcatgcttattattcagagcctagtgaattgattacaaagaatattcatttttgactcctacaagagtaaatagatcatgtgcattgtacagattcaattcagttcaaatttttaaacttttactgagtaactctgcacatccccagaaccgtgttagacacagtagagtactcataaaggcaattcttagaggaattcacagttttgtcatagagacagataaattagtaaatatttctgataaatagaatagaatgggcttccatataagcagggagtaatacaaagcaagagtcatggaagtgagggagaaagagaggttaattctaactaaggaacaggaaatgtttcctagagaaagtaacattttggctacaattaaaagtgtattaatcttctttgggtcatagataacagaaatcaagttcaaactagcttaaataaaaaagacagtttgtcggcttatggaataaggatttcttgtttaggcaaggctggatccaagagttaacaagactttgccaccaggcttagctttcctctttgtgactttttcacagacaagttctccacaaagatgactgccaaagatagaaacttacatactatttttgtccagttaggcttctatttaaaaaaaaatgccataaactgggtaacgtaggcaacagaaacttatttctcacagttctggaagctgggaagtcccagatcaagatgccagcagattcagtgtctgatgagggcccgctttctagacagccatcttttagctgtaacctttttaatttgttgagtaacctccatactattttccataatggctgtactaatttacattcctaccaacagtgtgcaagagttcactattctccacatcctcaccaatacttgttttccttcatctttttaacagtagtcattctaacaagtatgtggtcatatctcatttgattttaatttgcatttgtctgatgatagtgatattgagcattaaatacctattgaccacttttatgtcttcttttgagaaatgtctatttagatcctttgcccatttttgtaatttaatttatttttatttacttatttttaatttttataaatatataaaacttgtacatatatgcagggtacatgtaatattttgatacaaatatacaatgtgcaatgatcaaatcttagtaattgggatattcatcccctcaaacatttatcatttctttttaaaatttattttcaaggatggtttcagaacatttataattttgtttgtgttgggacattccaaatcttttcttctagctattttgaaacataacaataaattattgttaactatagtcaccctgtatcttctttctttttttttaacttttattttaagttcatgggtacatgtgcaggatgtgcaggtttgttatgtaggtaaacgtgtgtcatgggggtttgttgtacacattatttcatctctcaggtattaagcctagtatccattagttttgcccatgttttaatgggattatttgttttcttactgagtagagctccttatatattttgcatattaacaccccttatcagatgtgtggtttgcaaatgtattctcttgtttcacaagttgtctctcaactctgattattgttttctttgctgtgcagaagcttttaagtttgatggaataccatttgtctatttttggttttgtttcctgtgatttggggtcatatccaaaacataattgcacagaccaatgtcatggagcttttcgcctgtgttttcttctggtaactttacaatttcaggtcttacgtttaagtcttcattttgagttgatttagtgtgaggtaagggtctagtttcatttttctgcatgtggatagccagtttttctagaaccatgcattgaaaagactgtcctttcccattgtgtgttcttgacatctttgctgaaaatcaatcaactgtaaaagtgtggatttatttctgggctctctattctgttgcattggtgtatgtatctgttattatgctggtaccatgctgttttgattgctatagctttgtagtagattttgaagtcactgaaaactacttaacattgataaaagaatttgaagaagacatggataaatggaaagatatctggtgttaatggattggaagaattaatactgttaaaatatccattctacctaaagcaatctatagactaaatgcaattcctattaaaatttcaatgacgtgtttcatagaaatagaaagacaaccttaaaatttatatgcaaccacacaagaccctgaagcgccaaagcaaccttgagcaaaatgaacaacgctggaggcatcacattacctgattttaaaacctagtaattatttaaatgtaatgggaactggctatttgaagtatatcttgcgataagtacttttgtaaagcaataaattaaattgccagttgaaacactggcctttaatctagaaccagaaataccatttgacccagcaatccaattactgggtgtatacccaaaggaatattaatcattctactataaagacacatgcacacgtatgtttactgcagcactgtttacaatagcaaagacatagaatcaacccaaatgcccatccatgatagaccggataaagaaaatgtggtacatatacaccacggaatactatgcagccataaaaaggaattggatcatgtcctttgcagagacatagataaagctggaagctatcatcctctgcaaactaacaaagaaacagaaaaccaaatacggcatgttctcactcgtaagtgggagctgaacaatgagaactcatggacacagagaggggaacaacacacactagggctgattagggggtgggttgggagaggagggaacttagaggatgggttaataggtgcagcaaaccaccatggcacatgtatacctatgtgacaaacctgcatgttatgcacatgtatcccatttttttcagaagaaaattttaaaaaagaaacattagcctttaatttttatgttttgtaagtctgaattattatatattgacttgacttagaatagtgtgtactcagactgtctttttttaaaaaaatgaattttaatccatttaaaatgtaattcaacttaagcttttagaacattacctgtttccagtgaatgattaataaatataaatacatgcttccttgaatttatatcagtaatcataaaatcatctatcagttttaaaagtctacgtgtaccagacatttgtttgttccttggcatagcaatgattggatatgaattcattttatgattcacagaatccccatgggctcatagtgatatgggcgtttgaaatcaggccaattgatgttttaatcctttctgtccttcaggaagaagtggaattaaaatctatgtttttgttatttagtatttgtggcactaagctaagattacagataaaatgtagaattagatccttgccaaatggattcataatctaaattaaacagatatacaggaaactgacctcgggaaataaattgtaggagtgacaaattggtgaaaaactcaggaacaaaccaaaaaatctaaacagagatagtaaagtactctattattaatatttcctggtaaagaacgaaggcatagaacaaaaaggccaatttctgaatccagttctcccctgaacttcttgcataagtttgagcatggctcctttcttcaccctgcattattttctgtatcttcaagatggttcatcctttacaaagaagttggagtcatgtatgaaataataaacatgaaacacttcaagtttctcagaataaagtttccagagcaaaatgaaataataacagggatacactgtatgatttactgctgatagtttatcttataaagcaagtaaattaggggctgaaattttatatattagaaggatttatttcaaaaatgattttaagaaatatacaatcagtaaatttgaactaaaccaatttataaaactttgattcatacacaacttttggaaaacatcttgcattattcagagttattatacctttgtggatttaattaatacccaacacataaggcaattctttaggataagtaatgtgctaaatcagtggtactcagagatatattacatttgagccattgataataatgaagtattattaaatgacaacttcatgttaactacttaataataaattattaaataataacaaaaatccatgtaactgttatatgccttttaaatattttctgtgatattaaatatactttctaatatagaaattgaaaatcttgaacctctctagattacaagcaaaaaaccacatgtgccatctcctattaaagtgaatgatcagttaaggaatattttgtgacactggattaaagaccttaagaactaatagtggttacaatgtaataattagtatggaattatagacaatttcagaatacataaaactagttttttaaaagttgtctaatcctatattgaaataaaccactgcatataatcatatgaatttgattacaaatgaggctgtgggttatcttgaggacaggatgaatgatgggaaagtgaaaaatttcccaagatggttgaaagacttgtatacagcaagaccatattgcataaaaaataactgacatagtcaccacattttgaaaaggtgccatgtgaagtcatgcttccacattcaatgacagaatatccttaccaaaataatattggtatccaatatggagaacagtggatgggacaatgtcaaaaaggaatgggatcaaaagatgagcaggttgctttcttccttaccccttgaatagaccccacacacacctgaagaaactgagtctgaaataatggaaaaaagctgtagttgttggcctttgtctgcagaattcctccatgtctcccttttatatcccttgttcccaattcccctaatttctcggcacattttctttaattggattctctgtctctttcatttccctaactttgctgagctggttttaagccagcaactctgattttcacttgtgctactcctccatgaattgattattgatgaattaattatccacctatgacctcattcacagtaagtcatgagtaaaaggcacctactcctgttccctgatgtagcccagtagagcctgcaccaatacggctgtggcctgaccagtcactatatgattatgaaaggagatccaacttaaactaaagggaattattttgaacaagattcatcaaaatcagagcacatatctcaccatattcagacagctgaggatagttgtccatccctctactaaccaatcactacctataacacagtctggattctttcgtaattcttggtacatagaagcttctcagaaattatttgatgaaaggatggataaatgaataaataaattattataaacacttgctataagatctaagaataattacactggttgttaagggtgtgcatgaaataacaaaatataatgaatccttaattagtagaatatatttaatgatttccatttacatttatatcaagaaaaaaaaaggaaaaagcaacccagcacatctacttatcatcacttttcaaacatctgtggtttaaaaaacagctttgaaaatcgttacttgcctcgggtaaggtctgacttctgctgtataagcagtaaactattctaaatccttacacactagtacatatcctcatagagggcagttaataccaattaggcccaaatcttcccattctggttcttataggaatatatagatgtatgtttgatacaaaacatattcaaaatttttttaaaaagacagaagtaacagatgcatcatcccaatttcttggaaaaaaaaactgcactctagaattcctaaataagaatgttaacagaaatggttaatggagacagcatgcgctggcatttaaaatgcttactgtttaggaggagaaaacatcctaaatacagtgcttctccatcagctcaatgttttttgtttcttcagactgataggctggatgtggatagcttgtttagcaacattgagtccgtgcatcagatatcagccaagctgctgtcattgttggaagaggccacaacagacgtggaaccggccatgcaagtaattggtatgtttattctcttctcgagttctacaatacaacaggaaataattttttaataacctccctttgctttggttttttgttcctgactcaccatgcttcccaggagatatataaatgctaaacccatctttgggctcattgtgattatgcagactctgtgtttattttcaaatgggtttatatccatttgctgaagtccctcagtagcacaaaacataccatttgctttttaatttccaatctttcaatctctttgctttccagatgttctgtaattttttttaatggctaacacttacttgatccttaaagaattaattatttaaatattctaatagctttactgatttctcattacaatgttttttagatcttatgcccatcaatcaatttttttagattataaacttcttacctgaggaatgtaaaactattaaaggaatgtaagttattaaaaatttacacaagttctactttttttcatgctctctttttttctgtattatttaccttccaaatatgtttttactgtcaatcagatatatttattttcttactatggtaggattctcaaaaataacaacagaaaatataatttgaaaagtattgagccaaatttttatgctctccatttcttgggaatttccaagggaatatgtgctatgaattccttaaaggcagtttgcacttcgagacatcatacagtgtcatgtaggctaagagttttttaaaattatcgtttctctatttcacacttaatatacaataactcctcattacaaaagtactaaaacaattcaggagcacgtagagtaacggtaaaatttcctttcatatatccctccaatgccactgccttccccacaagtaaccgcttgtttgatgtagatctttactttgagatacacacacaaagactacacacaaacactttatgtctttactgattatgtctttgttaccttttatttgttagagttataaaaatgtcatggaactggtcttgtttaatatttatagagaaccaaagtttaatgaggaaagctgatcaaagacatgaaatatagtgaaagaaatgactgggtaataaggccagcccactcagaaagatttcttccacagataggtttaaattcaattgttctttgtgatgaaatgtccccaacaaattgtaaaaatatttcctaaaagaagaactctactcattaccacactaactcattagtgtgaattcattggctattcatttattaattcaatcaatgaatagttatgaagtagcagcatattcacaagatttggtactgtaccacattgcttggtatcaaaaggtgaaagggctcatttctctctttcaaaaacattcaatcaaacagcttcttgaattgaaggtgtgggtataatacaccatcaaagcagtttctacactactgcaaaccttggaggataaagaaaacatttctagatggaaactccaaggattcttgaagatgttatttgggcttaaagtatagattctatttcaacaatagggtccatgttgaggagaagattccaaatggaaatgacagcatgaaaaacaagtgtgaaacaaatgccaaatgccaagtgtgtttaggaaatgaagagtgatcaagctggagtgaaggacagatgtaagcaagaaatgagaaatgaacctgaaagtgcagagtagggactggcagcatttggaaatgaagtttggaatttactgtacaagtaataaagagccattaaaagatttctggcaagggtgtgatgagacacaaaagtttctggagagagaaagatatggtaggtctgaacagcatgcagaggaggaactgagtcctagactagtaaataggttgttataagtaatataggcatgtggtaataagcattgagactaagggagatacagtgaaaatttttaaaaatggggtcatttcaagagaaatgtagaagaaagcataaacaagttgttgattcatgtgctgaagtcaaaaacaattccagatttaaggtgaccatgtattgtggtttgtctagagcatactgattttagtgtattacgtaagcattcagtccactttagcatttgtcatggacttttcctttttaaaaattattattattattagttgcatcagaagaggttttataagacctttacatcatacttcaacttctgacacaatctcttttagtagagtgtaatgtgcagttaacggttctcactgtaacacatggtaaactctgaaacatagtccatctctcgtatgccaaccttttctagtctcaaggaaagttctatctttctttgaattgccacatgcagggaagtggctgattaaatgatgctgtttggatatgaacagctagaaactgctaactcctttctgtcctggtggttgtggatgtgttggatgctgcagaccccgccatctactgggtgtagcagctagttgtgtcatgacccatgctgggtggcccatgtcatgacctatgagaggcatgaagccatcgggatgccagtcagtggggttaatgggacacgtttttacagaatagatgtaaataaaatatgtatggaaaatagggcctgagaaatcatgctacagagtgtctagaggctcttgctatggtaatttggttacctattgcatgttatagattgacaactcttttacaaattttttggttatgtttcattctgaaataaaccttttcagaagcaagaatttaatatattcatgtttgtattagtcagttttcacactgctataaagaactacctgagactgggtaatttatgaagaaaagaggtttaattgactcacagttcttcaggcttaacaggaagcaagcctgggaggcctcaggaaacttacaatcatggcagaagacaaaggggaagcaaagaccttctccacactgtggcaggagagagagagcacgccaagggggaagtgcgatgcactttcaaacaaccagatctcatgagaactcactcactatcacaagaacagcaaggggaaagtccacccccatgattcaatcacctcccaccaggcccctcccccatcacctggggattacaattcaagatgagacttggcaggggggacacagagccaaaccatatcaatgttttagaaaaattttgattttctttatctcaagaaagttgctgagcctataacacacaaaataccatccatcaaagggtcctcaatgctatcattgaccatagacaatcagaagatggaaatatgctgaagcagcggcaacatctatgtcaaagtttagtcattatttttaaaagactgtgctctaagcaagtgattaaatgcatgcagctgcttaaggtgtgtttacatttcactgcatgcagcatggcttctcatttaggtcagacaacagttttcctagattaattacattcattttttaattctgagtttccttaggcctatgagaaatataaaacaatggttactaatgagttgacaccgttagcaaaagagtactgcaaacagttaaatgatgacagttttatatcaatgtgagcagatgaatcgaataatagtttcaatagcagttaaaattttaaaaattcaattcacagaaccaaagaaaagcttttagaagtttatcatgtcaatggtgaattgtctgaccttattataaatgctgtcactttaacttaaaaattaaacattgtgactgcaaatgataacataaatacaaatattagtggagcacagcatcatagtaaaacaatgattttattaaaataaaaatctatagagcagacgtgtagttgaaaatgattggtgtatatatgatgaagttgtggaatttattaattgaagtaaaaactgtagtgaaaatttgcatttatttttatatacacaaaattagagtgaataacactacctgaagaataaatttgatattgaattaaaaataatcttatgtatgaaactatacactctctttcctgctggtcattaatcagtctttggaaatgtttgattctttgaagcaccactttacaaatcaaccagagtgtcctaacatggcattggactatttttgtaaacaaggcctctgaaattgaattgcattttgttaaaaatcagttggaagtctttagttaaggtattcatcaaatggagaaaataacttcaatttttaatctttacaaataacaattattaaaaacaaaattgcaaataggaagacattgaaatgtatccctatgaaaacaaggagtaagtttaaaaaaaataagcaatgagagctcatgtataaaatatttaattttgaaagtccataatcatgctttggaaaatctgacttatgaagagaagcctttgatggagctcctctttagtaggataaagtaatattctgtaccagatttcacaatctacatttgggaaaatattccaaaattacaaatagaaacaacttacttggtgagttttattttgaaaaaaagagagagagaatgaaagaaaacaattcaaatggaagcaaaaagataatgcctataaaaatatttcagctcaaatatttacttgttttaatatgtatagtaatgagagtaaagcttctatttaccataatttcctctgagctcaatagatatttccttgcttataaagtattttctcagttttaaatattatggtttacaaatttcagtagtaaaataaatatgctgatattgaattataacccacagaaatatcaatgagttcttgctgatataaataaatgtggagaaaggacagctgtccattacagattttaattaataaatagagaaagaagaacggctgggcatggtggctcacacctgtaatcccagcactttgggaggctgatgtgggcggatcacgagaccagcctgaccaacatggtgaaaccctactctactaaaaatgcaaaaattagccgggcgtggtggcacgcacctgtagtcccagctactcaggaggctgaggcaggagaatcgcttgaacccaggaggtagaagttccagtgagctgagatcgtgccactgcactccagcctgggtgacagagcgagactccatctcaaaaaaaagaaaaaagaagaaaatagaaaatcaaattcacattacataaacaccacagtcaactattgcagacaaaatctactggttgatgctatgtttagtgggtgaaagttagaggagaaatatacttttcatagtctcaaaactttctccccaagtaattattaacctcaaagggaaaggtggtaactttacattgagaaacctagcagaggccagccacctttatctagagatctagagttaattttccttctctgacaatcgtattttgatatgtaagatgttaatattggtgaagctgggtaaagagtatttgaaaactatttgcactattttttcaacttttctgtaaatcaaaaattagttcaaaatgaaaaattgaaaactatgatttacagagaaaactcaattgaagatgttcatactttcagattcactaatcatagaattccaactttgaggaaaattacagaaaattttatttaaaaaattaagacaatggggccatatttgaaaaagaatcagttggagtctcattttaatatccttatcctttgtatctgggctggccttgcgacttgctttgatcaatgaaatgaggcaaaatgatgttctacaacagcattatcacttctgccttctgcttgtgaggggagaggcccaaactgcccagccattcaaagcaacacagccaaggcctcaggcttgagagtaaggtccttgtcagctggccagctggcccccagccagtccaccaactgacgggaaacatagaagtaaaccccatcaatgccagttaaatgctgcccaattgttgacccatacaattgtgagcaaacgaacagttattgtcttaagcttttaagttttggagtgattcttttttttcctgtggtaattgctaactaatacagattaacaggtgagagactaacttatttcaactcaaatggtgagggaaaacttgatttggaagtggtttttgagcttgcacttgaaagatttagaaaagtggagattgggtgcaaaaggctttctaaatgagaaatagggtaaaggcctcaaagcaagagtacaggaaattctgaaaaaggatagcagcagccctatgtgactggagcatagtgccgagaaggcctctctgagccaaacgttgtagacagaccaaaatgagttcactggcaatttccattactaaaccttttaccaaagcactttcattccataagataaactgattgttggtgagatgtttccaaaattatgttatcacaaatgaaaagcacaggtgtcccatttctttgtccttagatggcacaaataagagtttgtgattcacagctgtagtgccaaagggagaattttcctgatacctagataaactatgaagaaaattttactcaataataacactggagtttggataaggtttaagtttaaacacaggggcatatgcttgcagatctgagagctctgaggaagttgtctgtactgtcatgccaagatacaaagtggattttaaaatcttgacttaagcacagtgtctagataggaaatgggttttcaatctttatagatgggagtatgaaatgtggctcttgtttccacttagatggcagtgtagagtttaagaacacatgggttttaatatcaggttgacttgggttacatctcgttttgtcctgttgctagatgtgcgatcttaggcaagttacaaaacctaattgaacttcagtttcttatctggaaactggaggcaatagtacctatcccatatggtttttatgaagatttgacaaaattatgtgtacagaatgatagcccagtgcctatccctaattaatatccaatagatgatgttataaattattatcccaagaatattagatttactcatctatttaaaatgcctgattttttctgtatgtaacaagtgaataaaatgtgactttttcttagaggtcctgatcatgtttttcaaacaagtcagatttgctggatgtgtgtgatttctagatgcttccaatatctatgcatcttaatgattcatggatctaatatggtgacatatttttttctgtgaagggagatttaacatatcaagtgtcattttcacatttggtagagtgaacagcaatggcagtaattagtctccaaagatggccctcaatggaccatgcctcctagttcacattgttatatgagtctagtgtcatattgactctggactggccctctgattcactattacaatgtggtgaaaatgacactgtatcagtaattgggcccaagccttagaaaagcctgacaatttctactttcataattttggaagcctgccatttaaaaagttgagataccttactggaagtatcatggagagagacagcagatgagactatgtagagtgagaaagtggcacagctatcccagaatcccagcagaggccagcctcccagctgttcctgccaaggcactagatttgtgaaattagtcatctcggacattaaaacccagataagtccttggatgactcagcctgagtggatgtcaagtgtagcaaaagaaccacagagttgagcccagtcaatctacaaaattgtgacagaaaataaaaatggctgttgtttcaagatactaagctttgggatggtttgttacatagcaataaataacccaatagcaatagtcctcttatatgtgtttgcatattataatgtttcaaagtattaaaacaagactgtcatgaacatgcttgagtctactttactggcttacctcatgcatagtgcgctgagaatcagactgaaagaagcttttgataaaggaattgtaatttcttgtatgcattttcctgagggtgactctctccttggagagaaataatttagagctttctgttctttgaaggtgtagtaggtgatgcactgttgttctatagcagtgctttgttttcctaaagcaatgtttcttgtaggtccctgaagtagaaatctgtgcctttagcagtgagtttgtgagaagagtactagttgctgacaattcatatcataatgctgtgtgggagatactacattggagctcacttaaatgaatttttcaggattattattgtgtgtaagtgtgtgcatgttttactcaggacacaaataggcttgacctggttaattttggccaactgggactggttgggagggtcctagacctgcatacttgaatgtatgaggtcagtgcggaggtttgggggacacccagatgcaacagttggaagatcagaatgcaaatgttagaagtaataggaaagctgtccgctttggagaaaatgacaatggggaaatggtattttcaggatcaaggatacaccaatcctcacaagaaagaaaaaatcagcaggaagcaggtaccaggctgtaacatgggggttggacttccagtctcctgagcggggtgaatatgggtcccagtgctgctaggacttatttcttacaataaaaataaaataaaggtggcttagtaaaaagtcttacagttctgatttctgaggaggatggtaagttctaggatgctatgctgatggagcctgccagtggaagtcagtggcttagctgtgccaggaggagtattggagagttgaggtcagatttgaatggacctgcgaaaagtcacatattgcgcaggatacacatagaaatacatttctaaatcccaggaaggaatgtaagagtctgtgagttcctgaacactttcccagcctccaggaagctaaaatgagaagtacatagaaagagtaacaaaccttgaagttgcccaatagcctggaaagagcatggcctttgaagtgaaacagatccaagtcttaatcctggctgtcatcactagtttgatggctgtgagcaagtcacttgagccagtgaggattcagtttgccttcctgtaataaaaagctggccaacagggtttgaccaaaaaggggtttatttttctcacgtcacaagaaatccgtaactcacaagtccaggactagtgcaactgcttgctgctccttcaacctcttcccttcacaatgctcagcatgtggcttttgatatcatcccttagatggctactccatttccaggcatcacttcctaaagacaatgaagcaaaatcacctcttcagaaggcttttgtcattttgggggaatataaccattttcccagtgacttctacatatatctcattctattttgcacacatgttatttcatttcacatacatacacacacaaacacacctttgcacacacacttggccatctaaataccagagatttggggaaaggtcaatatttttaactgggtgtgttaccagtccaaattctatgcctttggaagaaggaagaacagataagtaaatagcaatggattccacatgcatttgttcatcttttcaatggggacaacaagactcccatggcaggaaaatatcaaacactgggcataacccctccagaatgtacgctccatgagggaaggaattcttgtctgttttatgactgttgtgtcaccagcacccagaacagtgtctttaataactatttgctgaatggatgaaattagagataatagtaagcgtgcagtgcattggctggcacacagagggtccaggaggtgattgttgttactgtcgtcactgagtctgtctgtggtcagtgtcattgtcaaatgtcactttcaaaagtcaatgtcattgccagagattgctaagtaatatagagcaactagctacagcagaggcaagctttctcaagagaggtatttactaacgtgagttaaatggaaaatcatggattggtctaagacagggttttcctcagtgttgtcaaccttacattaaaaaaaagttatgtaccttttcctgatccagccagcaaaactttcactttctcagagaaccaatgttgccttaagatgtcagttgttaaagaatcctgacctggagttaaagtatctagaagtcaacaaggttcaggaagacatcgtgagctatcatcaaaatatgcagctgtatttttaaatgttagaactggactaatatttcaagagcatctattccattactgagacaaaaacagtaagagctgatttgcccaatttatattagtaactctggacactctcagaagggactctagctcttccaaatataggccagagctttttcctctccaaacattgaccctctccacagcccactagcaccccccagtttgtcctgctcagctgctagccacctcccatggccagatgtactgagtggatgccaccttagcttcagaacagccccttctttgagagccccaccacaattatgacattgtcttccctggcactggacacagagatgatcacgacaggttcccatcctccactctgctcttttcctttctctgtttctctctttagggtccagctcccttcattggtccctcttcttcatctctcattccctcctaaacccaaccctctaaaaatgctattactgcatcaccagggacctcagaattgtcaaatccaatggacacatattttttctgaacttatcttacgctagtgcttctgaaaaaaaatttttaccagaatattcccaatatcaagagagaaatatcataagcctcaggaagtgtggagttatgatctgaagctagagccacaggcgtgaaataatttggaagtcttattttgtcgtaagaattcatgtcagttttccagtctactcttctaggaaaccagagtttttttcttcaaatttcttaataaaatggatactcaagggatacacttgttttaatcccatggctgcatgtcccacctgctgcctgtatttggtttgaatattataaccctagccagggtctcttgggtatccacagcagcagttttatcccctaggctaggtggaagctaaatgagactgaaggcaagggagtgtggcttctttaagcagcatatactctttcagtttctttcttctcacttcctctccttgttttatgctcccttggagaacagaatgaggctaggaaagaaagggagaaagtattcagatgatctggcatttgggctggcgaatctactgccttgtttagtcatggcagctgggctcccatccaaggaggataagaagaccgcggggagcaacccttgaacttggggtgaaagctgccaggaaagctctttcactggagatggcataccatggagctttcgctcagctgtgtgtgtcactcagggaaatgacagtcagaggcctgtattgttgcacccagatctcagaccttctttccagagagtgggccatctctaccctctgttcatcacacccccttctctgtattctaaatactctgccttgaccacaagttttatttagaaccacagataacttccttttgggatatatctcaggccataatttatacatgagattttaactaaaattatttttgtaaacattatcttagttggtttttagaattgaacttactgcatagtttttcttgttaatacaagcaacatccaactttatatcctccataactaacagttcatgtcatattttcatataatttttaaatgaaatgtaaaaatgggtagtatagagggggccttaactcatcaggatttctcccaaaatattttcctgtcaaagagaaaacagaacaaaacacagtgagtagattagaattaagttcagctgggagaaacagaaacaaaaacaaaacattactagcataataagacagatgttgatttctctatgtgtaaaagtctgaaggggatgtgttctagagctgtacggcagctctgctccacaaggtgctctgggatgcaacctccttccagctcacagctccactcaccaagaggtggctgttatcttcatggacaaggtaaaggtattaatagtatccaaatcctaggtagcagatggagacaaggatgaagacagtgtaaaggctgagccagctgcctcttcaggaaaattcctggacattgtcatgggacactttcatttatatcccactgtgggctttaattacatggccataccaattggatgggagggtgggaaatgtcattttgatttggggcagccaaaacttccatttctttagaagcagattatgaccatggggagacagctagcaagctctgtcacccaccccaccaacttagtcaatcttggcagtatttctcattattttgttcttgtccttcctcatgctgatccttctttgtggctatgccttctcaggcttctctgcagtctctttttcttctataccatcctcaatgttagtgtttgccaccatctggtcctcaggcactcttttcttctcactctgtgaacactctcgcatggccacataaattcatgtcttatactacccaatttttacaaacctacatctttgtccaagatattattttcttaaatcctagattaatatatccaatttcctaaagggcttcactgcttgaatatacaataagcaactcaaactcaatacatctgaaattaaactcgtcatctttctcattaaactctgttatgccatcagtgtctacacccacatggtcacttaaaccacaattctgggatatgcctggaatcatctctcacacatgttcaatgtccatttttttcctttcctctgcatcctccttgcttttgctttgctttagttatagctaacatctattgagcatttgcatgtgccagcccctgatgcaaatatattacatattttaactcatttaatctgcaaacaaccctactattattatctgcattttacagatgaggaaattaaggaacagataagtaactttcccaactgtcacacatcgagtaaatggtaaaaccagaatttgaacccaggaagtcgactccagtgcactctctcttaactgcaataactttctgttttagcccctcattgtttatttaccttattattatagaagactttcagtttgtttatcttcttcaatctcaccaactcctccccgaaattccatctttcatacgaataactaccagaatagcttttctaaaacacaatctggtcagttacctaaaaatccatcggtgcttcaccatcactttcaggtgaaagtttcacctccttaatgttgcacaaggcccttcatgatctggccccagcacacctctacagtcccttctggaacttcctcacagacatggtcccatccagccacactagatcattccaagtttctgaacagatcttactctccacacctatctccttgctttttgcactcactcagaggtcctatgtcaaaagtacactgttatgagtgttgctcaaagctccccaagggctgaataggtaaccctctgtactttatttacttttcacatagtatggtaaacggaagttcagtcttctctctctcccttggtgtcctgtataatttccttgaaggaagagttggttctttgtatctacagtacctaccaaagtgtttggtgcatgatgatcatcgagtaattttcaaaaagggatgaactaaggaacacaactgcttcttcccttttatggcattttcctaaacaaaacccgggacaaggagatcccttgaaaatcactgactttacccttgtttacttacctgcaggagaaattcatcttggagcaggatcacaatactataaaggccacctggtttggtgtggcacatgttggggctgcacgtgagagtatggaaatagaaagagtagcatatgtttattcacatcagtaaagggaacaaattgaaacataggagtcatggtatccagacataatatcaatattttgggaagttatttttaatgaagataactaaggggacttaaaagggtgcattttttttctcctttgcatggcgattgctttttggggatgccaatgcagaaattcttgggttgtagaatttttaaaaagaagagcacactagttttatttattttacaggattctggtgcctttgtgacaggcaaccacaagtgaaattaccttcaatggtcttggcttagtccctcctctgctcctaatcatcccctcaaacccacatacattagacagagcggttgtccttcaccactaaagaaatgcagccgagagttatgttaccgtggaaacagaatcactttttgctgcaagacacactgcttcatctgcactattatgaagcagaatacattggtagggctgggaggggaataaaatattctgcctgccagtgttgtacttggcctttgggggaataaatgactttcaattagagtacttaaatatcttttaactttaataattattattagagcctcaacagaattttacttggaaaagagtaaaaaaaaaaaagattcttctgttaaagtaagagctataaattctttcaaactacaccactcctgttaaagaaaatgcaagagaatttacaattaatgggttcattgtgtataaagataagtgttttagctcttctttgttttttgactttctaatttgatcaccttgtggatttgtgagattgtccttacctctttccttttttggtctctgcttttagcttctttgtagtaagcacacttatttacagcttcatcttgtgttgggctgtgtgtatgcaggtccactgttgttgacttgctgctgagcgtccagctaagtctgtgatctaagcctgtcaccagtcccacttctgggccctcccagccaaagccactagttcccatttgctacctggttctgctactgggaggctcccttccctaaattcagtcacggttctattttgttttctttcctctacttgatagctcttactgtttgtgttgttatcagtgttgaagaacaaatccatatgacctacactagttgaaggatgaactctataggatatcagaaacaaaacaagaatcctgtgtccttcagctccaaagatgctcacagttattgagttttcttataggcccccagaaagcactactaaaacaaacaaacaaaaatcttaaaacacacacacacatgcacacaaacacacacacactcacatgtgtgcacattatctcacattacctcagagtctaactataagcatataatcacaggaaaatcccacatcatgaaaaggaaaaatattttattggctgtaaataaattagaaaagaatgtgatactttaaaagtgttagtgttttaattctagaggtagcaaagcaaccttaagagacaaatgacaattcttgagcaactagtcagtggcgggcactttttatatctatcaccccatttcattctcaaatgaatctcaatggctactattatttttattttgcaaataaaatgaaggcactaagactcaaataatttattttaaaaaaaatcattctccgattgtataattcatccatgtaaccaaaaacgactagtaccctaaaagctactaaaattttaaaaagtcattctcaaattccccacacaaaccctaaattgtttctgatttcaagtttagtgttctttccaagtgcatcacctcatacagtgctcagcaaagctctgaattgggtggctggggaggggtatgtgctaaaatccagggaaaaaataagaatacagcctctaattctgcctttccacctctagacaggacttcgggaaaatcatttatttgtttcaaattcagatttattcatcctgaattaatatggataaataaccttttatctcttcatgcaagtaggaagttaatgtgtgaaaaacatgttgaaaatactaagggcacttttatttctgtggaaagaatgacttactcctgttaactataataggtccagattaataggtccagatcactgtcaatctattcagccatcccaattaattcagccaccaaatcattattagtctcaaatctgcaatgttttgagagctgaccctgtcacatattgcttggatatctgccaaataatttctatagtgttgggttgagtagtggatgcataatacttatctttaagtaatgaagtgtggatcaaatcaaactatcgtccaatatctaatttagtcaccagttatagaccctatttcatcataataccaaaaaggattcattaaatgcctggatacaattagtctaagttgctttacgaagatacagtcataacctttgttcatggtattaaactgatttttaaaataatgatctattttattatcacatagaaggaaatattttatttctctaaactccattgcttgcctttcagagagcctcaggaaatattagtggagtaaatattgaaaaatacttacccagcacttgaaatttcaccttctgtgtctcttataaattaacaaaaaattgcttcattttgagtatttcatatgtatttactatactatgaactttacaaataccacctcttttactttttacaatgactctctaaaattgaatctattggtgtcatcaggtttaaagagtaaaaataacttgctcaagtcaaagtgccagtctgtagcacagcctgactcaaatccgtgcacaccaactctaaactgcaactcttttttttttttttttgagatagagtcttgctctgtcacccaggctggagtgcagtggtgcaatctcagctcgctgcaacctctgcctcccgggttcaagcgattctcctgcctcagcctcccgagtagctggggctacaggtcgcctgacaccaagctgatttttgtatttttagtagagacggggtttcaccatattggccaggctggtctcaaactcctgacctcgtgatccacccacctcagcctcccaaagtgctgggattataggcgtgagccactgcacctggccacactgcaactcttaaccgcaattctgcacatcaaccttgtgtgtaaagttgcctttgagaaaaccagctttcttttgctgcccatctctgataacttgttcatcctttgttttataaaagaaaaaaaagaaaagacagaaaaagagaaggagcaaagaaggaaagcagggagagaaggaaaaaggaaagaaaaggaaaaaaaaatcactcaatgttttccaccctccctgaataacctggggataaagtagatcccatccaagtttttgacacgagtcgacattgttgaaaataatcatgtgaagtgccagctttgtctgatgatgtcattttgcctttgttttgcatttatcaggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagtaaggccttttcaaatgatgattcccatctcctctcagttgcctagcagggaacattttaaatggatgtagatgaaaggtctcacataaatcctatgttttatgagacttgctgggagctctgctttgcattccctttataaaaagctgacatgccagaagccctgattgactttttttccccctgcgagaatgactaaaaataacatggaagaagatttagagctctgcagcgattgaaaaatgcaatatcaaaatataaaatgtggaagaaaagcctcttcttaaagctattgtaacttgcctggccccacgtagttcaaggattatgtgagataacacgtggccccatgaccactggagcacatgggttaatggagttaggggaatggcctacaactctgcatggccgtcttctttccccaaactcactgtggggagatgggtgaagacaagtcaggccttgttaaagttagtttcagaacaattactcatgccttcctttctcatccctaaaacattggtgggggagctacacaatgtactttttcttttctagaggaagtatctattcactgtgaaaatctgaaaaatataacaaagtatgtgtaagataaaaaccccttgctatttcactattagcccctttcttcttaataatcattttcttctgatattatttatatgtataaatgtgggtatgtgtttggattgattcttttaaatggaattggtatctttctgaatatgcagtttcctatcacatgaagcttaaagccaaaatcactaccatactccacatcttacccagtggctctcttacagactctcacttgtaagtagtatccactgtcaaataattttgattagaccaggaattaaacaaccacagagagctgtggtgtataagtcaatgtacacccgtctgatcctgtagcacacctcccccgtttactctgtgtgataggggaaagagggatccccaacggggatggggatggggatcctaacgtggtacaagaggtttttagctgcactaaattgaaatcatgatactactctggaggaggcgtttcccggctagaattgggtctgaaagtgagtttaaaatgagcccagtgaattttttttttaaataaataaaatttcaactttattgccgtctactggtcattaaattactgcagttttaaaccattcttcatgctatggaaaagaattcaagtcaccaaatcttaagcatttatttagtgtttgtgctgtgtcaagcgtagttctgggggctaagtatacaaaagtaaataagacttagattctgccctaaggaactcaatatgatcagttaagtcttaaatataagatgtaatgagcaagtagctctagttaattatttctattttcagtttaggttcagtgttagtatatcaattcagagaaacattcaaatttgaagttgtgttcattttaataaattcatatattagaagcacagtcctctaaatgttcagctgttttattctttgggaaaaaaaaggaaatggtgttatcctgggtttgaatgaacacctttcctaccttaaacaagtggcaagatctgatccaataaaagctggagccattttccttcttcgggttctagaactaagcgtgagaaatgtcacagaaagtgaacatttagcacctttgatcaaaccccacccaatgccagccctggggatggaggtccttgcctgaaaagaatgtggtgcctctactttaggcatgcgcttctaactgttcaccagaagtggagcagtctgttcagagaggaaagaacatcagtttactattcattaaacttttaacttttaagagaaagaaacagaccctgccagaagattccactaggcagtatagcccagtatcatatccccacaaagcagctaaaggcagaggtgattttagaacctcatgaagtctcagttactgaaaattattttcagacccaatggcttatttggtctttttctgcaagtttcaggtaattcccctggccatgccccaaattttgagtttagagctattctgattttaggtaacagttgcaggcactggaaggtgttaaggtttagaaagcaaaaaagccaaaagaagcagtattggcacaactatttcttaagggaaagaaaatcaaataaaatagctgaagttagagctattttcccaaaagttgcctttccatgaaaataaagttaatgatggattgtactggtctgcctgaaggctgagggcagtagaattattgacattactataatactgacctcaatcgagctaacctttaaattctgagaaacaggttttcaaacaggtttataggccaaagagagtctggaacaccctaagggcttggttttcctggccaagtaatcagtcaaagctattactgtcactctgccttttccttgtggctagataacacagcccaagtgcagttgccaatttctaatgaatactaggtgtggcctccattttatcctgtgcaaggggatattggaaatctttgttcgaagcaatatccacgagagaggtggcttcatgcctcagaagttaaggtggattttaaagcaatttaggctgctttttaaccaaaattacagtatgtttattgagggcctaataaatatttaataagagtgctaaataatgttgaaaatattttttaaaaatatataagcatagttcttgcctctcaggaacacaaaccctagttgaggagataaacaaaaccatgtggaaagtttaataacaatacaagaattaatttaaataacaccagaagctttcacagtggctgcagttcaagactaattcccaaaagagtagtagagatattacctggttctgtaaaagacccaagtttctaactttcaattattctttgaagccaattatctttcaaaagagagaataatgttgaatcctttcataacgtgagggcagtgtttttctgtgtggagttcccttgcgccagatccaccaggatggtgtattaaaagtacagattcctatgctctgcctcagaccaaaaaaaaatactatttctggtggtccagttcagggtctgctcttttaacaagccacctcaggtgattttccatacacactcaagttaagaactaaattagtgggagaaatcatacttgctgctttccctgaagcaggtgggttttttcatcaatatagatacaatctaagcagtaactacagagtttggagaccttcaaaaagaaaagattctaaggctctccaaaagcaaatacacatctgcatctatagcctacaaattggaaattagcaagtttttatttattcaacaaaaagttttgacagtcaaattagtgacccctaagattgtgtgaaatactgtattaaaatagtctccaaagttatggaagttatttgctaaagatcttattacttagccttcttggggttatttaaggtttctgatctgtatgaggaatgtgaaagatagcgtggctataaatgcaaatgtagctataattagaatagcctgtctgttgcctcctttttctgcttttccatttataaataccactaaagtccctgctgcatttcagaggccccagagatctgtttattttgtaatagaaagagaatgaaggggattttctaagtttttgatggatggaagacacatttctagcttcatgtctagttgttataaatgtatctgtatttttcttcttgctaatcaaggccatcatccccaggaggaaaacttctaacttctagtcatctgggcactttggctgctcacattactcctggagcttctccattcagggaggaagctaaaagctcatgcaatgcaaaatccaaaggaatacatttcaatttgttcaccacattttatactcattattctaatggagtgttccaagtaaaaattaaaatcacttttggaaagcccttcagttccttgttatatggcatcatgtttgaacaaagactataatccttaaggaatagtcacataaaaacttgttaattgtgagtcaaagtataatgtgttcatgagggtaggaggtatagtgataaatatattaaattactttatcccataaaagggtaaatggacacattttaaattcttccttcctgaattgcccttggttgggattagcttctgcaaagtttcagcctaaaagagatttttttaaaaatgatgaacaaataaaaagatgttataatatagtgccactactccacagattgttgttttatcctactggaaaatctctcagattccctttcataaagcgttatactacataaacacaatgtttaatttatgttatgatatttaggttttacttggctaaaataaatgaaatagaaaaaaaaaccccatgttttctgtaggagttaaaagaataaccttctctttcaacttcaatgtatgtgttttgattcctaaatgatcacattattcacttattggtttgcatgaaaaattgcatttttatttttattcattttcttccccagattttctgacctatgacgcacaaagcatatctggcaaataaaatttccctttagaagaggaaagaaggaagcatgtgagcttaaaggaaatgattggaaggaaatattgggcaggaggtggtggtggtatttctttcattgcaataggagagttctttaaacagtcgtgaataattgcctaaaattatagcagctgctgattttaaaaaaattataattctgtgcttgattcccatctaataggtcttagactaagcaaaacctagttatgttaggatgtctagcaattcactcatatagcatgtctggagattgaggaaacaattgcttcacacatgtcccccaccattttccacatatacaaagtactgagattaatggaaaaaaacttattaaatccattaaattttacaaaatgcagcttaggcacttattaaatttttcctcaatcactgaatgtaaaaagaccatctattattatggaatggatcttaaaatttttttatattgaaaacatttattgtactccaaatggttggaaaccaaagcccacagtgatcagataataaacacaggatattattttatttatccatagccacttgaggcttttagataaaaactttcatcttctttatttgttagggacatgattataaaataatgagactacttctataaggcattcatgaaaattacttattttattttacataagaaaatttaaaaggatttataatgtttgtatattaccttaaatatacagatttacatgaatttactttctttttcttctcttacaggaaaatatacatgcaagagtaagtactttttaaaataatataaatcaaatataaaaatcacgagaaaatgcagctgactgttcctgtccaaatcagaaattctgatttttctaatcatgagtattgcttttaataatccaggattgcaaaggcatttaccccattactggtgcatattttacttattaaattattatcacatatactttaccaaaccttttagaagaatcccaacatataatttactaagtttgctgatgccagaaagtctttgggaactgctcatcatacatatgtttgggaatcttaatgtgtccaaaaacacttctttctatgaaacatattagtctttaaaaaatctcagattaatatcataatgcatttgaagtttctatagattaatgcataagaaaagattattttatgaaaatattagatttcttctaatttcaagtcttgtatgatttatggagaaaaaaatcatacacattatagcatgaaaatgaaatattaaggtgaaatagttggttactaggacaatatagaaattattttagaaaaacagcgtatacaaacactctgaaagaggtccattattctagaagaaaatgtatccaggctgattaatgctgaaaggatgaaattgacttcaatacaaactccaatttatttaccaggcacatgtttggcttatgatgagcaactctttaaggtcccaagcttctagtgtgtgtttgcttgtgtgtgtgtatgtactttaaattcctaagagtttatatgaagaaataaagagcttacaaaatataaattatattaatgtaagcagcaaatatctgtcattcatattttggtgcagagcaacagtgagaacggaattctggaactgaagtgaaggagtcaggcatcatacagatctgtagaccagggctgtatatctcagtcaagttgagaagctgatttttgagacaccagacaggcaaccagttctctcactttatcagtcttttcttttcttttcctttcttttttcaaaaggaaaaactatccgacagtataaacagatatgagtagatttgtcttatgagtttccaattctaggctcatttgaattcaaagaggtgcatcggcctcctggcttctcttcaaagatagttgatgggggctgggaaatggctctgcctcattatacagcctgtgtccctggcattgtgccaaggactggagctttgcataactgagtggttagagaggaacttcatgtgctacaaattctgcttaggtttccttttctaaagcttgcattaggtctttggaaccaagaaacaagaagagaggagagagagattcagaggagaaaaagggagatattcttcttagtacaatttgcatgcacggacttctacatacagaatacttaaacagttcattgtattgaaacacgcttaaaaatggccctagcacttgctgcaatcctgctgtgtaggagttagccaggttgtgtctgctccctctagactattctatacatcaagaactaaaaaagaagagcaatcccagcatgtggctggatgcacatcaaagccaagtctgccatgaattattttccttcctgttcctttcattcaggtcatgaagcacacatactgctacaggaaagggcaaaaggcaatgtcaagtgctgtgtaattgttgggttctttagtggcaaaggccagcaatgttgcagccaaaagggcatttaagagtacaagatgtgggtttttacatggcattcaataatccctcacttatggcaatcaaaaattatccgttttttaggttttttttacaacctaccttcttaaaaatacaaagtgaaagatatttgtaatttctaaaatgtttactttgaattataacctcacgcaaacatcagacagtattaaagtgacagcaatcatagaacttcccactaaaagcaagaaaaaaatgcctattctaaacacagctatcttcagaaatgcagtgttttgttatctttatgctttcactcttttttttatgtgttccctgtcagattagctattctcaccttggatttcaaggttcctattaatcacaaaatattataaattattttctcttttctttgtattttaaaaattattgaagaaacattgcaaaaaaaggaaaataaaaatgaggacagtaaagacaatcagcagtcacattccaaagctaactattgtagcattgcagtgagtccctcacttcaccatacttttttcttcacacacatacattgactaaaataggaacactatacgtttcttgtatgtcgacttgctacctcattcatcatcaatatgttgtgaatatctttccatgtcagtaaatataaatccacattgttttatacttgcataatattctgtctgatatatatgccataatttagtttgccaaacccttactgacagttgaattttgtctgtcttattgatgtcataagtttatttttatatatgatcttggtacaataatttgattttttggatcaatttctgaaagtgaaattgctagatcaaagggcttttgatacttattgtcagaacatttcaaaaaaagctgagctaatttatattctcactactcttatgtcaattgttcatttatccactacttgccaacactagatacaaataatattgatatctttataacttgtaatgtataggcccaaatagtatcctgttattttaatttgcatttttcctatgtatttaactatttgtatttcatttctaacgaatgatgtttttaaatgattattcacttttactgagatgttcattttttctaatacgtttgtaatgtctctttaattagtgcatattaacctttgtcttatgtattatatataatttttccagtttatcatctgacttttaacacagtttatggctgtttcaggctgtttttaatctataaaattttacggagctaaatttttaaatagacatcatttttttctactgtgcctttcagattttgtgtctgccttagaaattccaacattagtttataaaggatgatcctatgatttcttcaaattcttatatggtttaatttttagatttaatatttgacctatctcgaaattattttagtgtaaagaatgaggccaaaatccatttttattgttttatttatggctagttaattctcataacatctgatattgaataattcactttttcccactgaataggattgtcaaatttaccatgtactctatttctatacatatttgtatctatttcttgattttctattttgtgctactcatttgtccataaatgtatcaataccaaactgcttttatttttgtagctttataatatattttaatattgagtatcattagtctcagctcagtacttttcttttacaattttttgagtattcttgcatattccctttttataaagaactttttattaaaaatgatatatagccctgtttcaatagccaaatcgttctgcaagatttgtcaagaaaaatagtaatcccctcttctcctgccagcccctaaattctcattagaatacattactttcacatctttagctgtctattttggtatttatctttattactctaaaaacatgcttggttgtttcctttttagatactatctttaactttctcctgtagaagacaagaatttatttctctttcctatccctatctcctctacacacaacaaacacacacacaaacgccttttccatttctccattccccctaagttgttacgctgtaattttgttagagcaataatcaatgtctgattattatatctaagtaaacttcttttcagagctaaaccttaaagtgattacttatttttctatgaattaacaattgttgattatcgttttcattgtgccctcctcctccacttcatctactttctctgctgcttcttgttcttcatttacttagttttctttgtattaacaattaatgccaaactcacagccagttaactaagtcatctttcaagacaaccagatgcattatgtatgctatcaatttcatctccccaaaagagccccttccagagtctccagtccagttggactggtgacaccaggtgcagccatcttgtaggaattcccctcccatcatcctggagattctctttgcttctttcctgtgttggttctaactcattttggtggagtacatccttcagtagtttcttctattcctcacagaatgcatgggaagtaaaatgttaagaactttgtatctgaaatacttttcttttactctcacgcttggtttatagtttgatttgctatcgaattctaaattggaaaccattcaccttcagaatttagaggtaattctttatcattttctagctttcagagttgctattagaaatctgaaacattctgattcctaattatgcatttatacctatgtgcttatttctttttctgaaggattatagagtcttctttttgtccttagcactctgaagttcatgaattccaaggtgtgactccatttcttccattgtgctggacacttagtgagttcttttaacctgcaaattcctgtctttttcttgaattatttcgctcactatttactcctcatatttgctttgttttacctttctgtgattcttattagtagatgatgaagttcctagaccagtcatctaattttctcatttttttttctattttctattcttttgtgtgtttgttcttctctttggaaagtttcaagacattatctccaacacttgtaagaattagacactttcttaaacagattttcaatggaccctccttattttggtatccagcccctcattccctatttccatgggtaaccagtgactgtaattgattaacatttgcaaaatgattaaacattgcctcaccatttcactggttctatctggtctgttacatcggttactattcatttatctcccttatgtattctaatttaataattattatgatgtatttattttcactattatcttttatttatgacaaatgctgtttatttgtgtaacaatatacagtttcctttaaaattgacttaggtattttaaaaggagagtaaattgaaaaaagtaacagcataaatgcttgtggctactgtaaaataaatattaaatttaggatgcttgtgatcatgaaataaaggaaattcaaagtaatatagttaatagttacataattattcttttttttatgtattttttccttcccattaagaaatatagatgcgctgcatgttgaatatctaatttttttttgttttccagcataatgtttatattatttaaaaatcattttaattttcattgtacttttttcttgtatttgatatgaaactctgcagcaaaactggatgctgctaaaacaaagccagctgtgtttacttgactttgtaaagacccaaaaataatttgtaatgagattagtgtagctacttttggcactaaatacttgccaaagtatttatgataagacagaggaagatgaaatagaattacaaattaataagtagtttagtttttggcccaatatatatgagcaattgttacacgtttgtttacttactgtggggagtcatgggataattgacttcctggctgagatgggttatatcacacataggactcatctgcctcgcatggttaccagaactgaatcttactgtgggagattagatggggtgaattttgtggcactgaaagcatggagtattattatcttataacactccctctatcttttctacgatattgcttgtctgtgcgatgcagttttctgaatatcattgctcatcacttgggcaactctctcaagtatatctccagacacaaaagtgtctgggagatttctcatttttgagaacgccttttttaggatttgtatttatgacttttttaggagaaacaacaatcatgtataaatactattattgtcatttgaaatataaaagggagagatagaactttaatcccaaagagtgatgaataaaaagtaatgatacaatctagacacaacagagcctaagttggttttttgatagatctggataagaaagaaatgagagcagttcttaacatttaaagttaaagttcttaacattttacttcccattcattctgtgaggaatagaagaaactactgaaggatgtactctatcaaaatgaggaagaaccaacacaggaaagaggcaaagagaatctccaggatgatgggaggggaattcctacaagacggctgcacatctgggtttttgttttttataattaaaaataagagcatatatataacaaaagaccacactaataaactattttattaaagttgaatttatattgatttaaatgtttgattatattttgatagtcttttagtgattttcaaagattaaataagttagcatttgataataaaaattcaaaagaaattctgattatattcatgtagataatatgatttcctctaatcaagttaatacctttcatatccttgacttgtttcttatttaagggaattatttctactttctacttaagtgactaaactgttgtattattgaagaacctctgcttacaatatataagaaaatgtccttcatatttaaaggttttgctactgatacaccatcagttagaaaatatcttttgggttttttgttagtttttttttttcagtataaatactgaaaacagttttcagtatttataatagatttatttttaaaatctacttcactcagtcgtcttggaaaccaataatccatctctccttccctccctctttccgagtctctctttttccctctttctgcctccttccccctctgtcactttctctccttaccttcctctttttcttccttaatagatttggtgcaaataggtatgaagtagaagatacagcctattaaagcaactctttactcccttgcagacctttaatacttattctggttttctttttaaaaaaatgttgcctttgggtttgctttagtctttgtctctcttatgctatcatcattttctctgcatgtgaacaaaattcctcagccatttattcacgtttttggaaaaaacgttcggtataagataaaagtacattacagaaaatctgagaactctatcatttctcagtccacaaatatgcattgagagaatactgtatgccatgcaggaggtagagtggagacagggaaactgatcataaactggcaaatagggaaacaagatgattccagatagtgataagtggagagatgtgatagtgactagtgtatgtttgtgaatgtatgtgcatgtgtatttctccacattgtgtgcatgtacatgtgataatacattcttttgtttctcatttatcaaatgaattgaattagatggtctctaagatgccttcctactttttttttttttttttttttttgcgacaggctctcactctgttgcccaggctggagtgcagcggctcactgcagcctcgacctccccagcttaagcaatctgcccacctcagcctcccaagtatctgagactacaggtgcctgccaccatgcctggctaacttttgtatttttttctagagacggggttttgctatgttgcccaggctggtcttgaactcctgggctcaagtaatctgcctgccttggcctcccaaagtgctgggattacaggcccaaaccactgtgcctggcccccgaccctttctaatgatgcaacttttctaattttgttcaacatttttatagctgttttactattctaataatatggtcagtcatttatccatagcaatactttaaaaaattattgaagtataaaacatccacctattgggatttgaaaacagtgtctgtatttcctatctacagtgtatctttattggtctctgcataaagaggcttttagaaatcactgccttctgtctgaatgatcaatgagagtgggctagacaatggcatgaccaagcttgtagcttcttcccctcctgtgaactgcctaaccagttggaacggctccaacttcgtctcagaagctgctaaaggaaaagtcaggcatgagtctcacttttgtgtagtcatttgaagatttgttgactaagaattccacatggaatgtcactgtgtgatagcaatgattagtgatagggatagtaataataataactaaagaattatcacatttatcagaagtcccttttggggactgtggtagaacctacaaaacattgtaaatgcaacttctcaatttggtggaagagagaggccaagacttccttttaactatacctttgcaagcctctgttaagatttttaaatggttattctcctcaataataatcaccaaaatgccatcaggaaaatgcatttttctttgttgtcatggtaaaatacgttctgaaattgtttcccattatattataaagccaattataaaaaaccttgtaaactgtacatggcatatggatgaaaatcatgctttgagacaatttgatggaaagttatacttgtttcttttaggtttttgtttcatagtagggtctttcagatttgcttctttctgtcgtcttttgctcttgcttttatttagaaattttagatatacaaatgaaaaaaagagaaaatgttttagaagtaatcataaaaacacacaaaaatgaaaatgtgttaataaaacatatgtttgtgaaactgatattatttatctgtattgtagaggcaaaccaaacttattggacatgggctctttgatgatcaaaccaattcaacgtgtgatgaaataccccctattactgtgcgaacttcggaattccacccctccctctcacccagattacagagcactggacgatgcctttgctgctgtgaaggacattaatgttaacatcaatgaacttaaaagaaggaaagatttaggtaggaagagacatgatgaattggttgttttccattattggagtgtttgctttatgtttctgagaatcagaatgtttaagtagttatagcagctgcagtgaactgatcatttgaaatctacaattagaagctggagagaagagtgtggttttgccttgtcagctgggttaaggagaagattaagaggcacaagaaatgaaattaaaaaataaatcaagcagccatatgctcaacttcattggaccactgcaatcctggtgacatattgtgggctgaagaaacccattgcatatagtcctcctgtcactggagatatgtgtggtaagaaagagaaatggccacgttgcaatagcagtgggaagcaaatgcagaaagcacccaggaaaggggaagatctaggtgacagaggccatctagtcttttggattcatctggttctggcacacagagaatggagcttttgtggcaataatttctctactgatgtgagcaagtatacttctttctagaattagcaaattattgttaactatttgtaagctaaaatataaaattagtgtttaatgtaaaatttcaaaacagaagggataattacatggttcctatacatcccagaggtagtaatgcattgagctaggctgtgggtcctccctcagtgtgatttgtgttcacataagttcttagttggtgttgtactgctattattaaatctcagtttgacattaaagccacagcaggactttagagctaaatggtctaatcactttatttatttttgttttattttctgatgtttatttcaaaagtcatatatttgtattagtaaattaaaaagaaaggtgtagaataaaaagtaaatgttatggagtaagaaaactccgtgaacaaaatgaagagatagtatacaaaggatcactgtccagactatataatcactgacattaaatcaataaaaaaacattgtaatacaaaaaggttaaaaataaaaagaagcaattcacagttttaaaattctaatcttcatttatactcagggaaatgtaatcattgaaatcacactaacataccatttccagtccaagagactggagggaaaaagtaatgaatacgctaaatgttgaatctcaatctacaggtgagaatgtacttggaatcactagtttagagaacaacttgacaatacctagcaaagttgaagatgcacagaccggagactcagaaaatgaatttctaagtatttgcccaagagagactcttgcccatgtgctcaaagagaggtgtactggtaactagcattgttcataaatgcaaataaaaaagacacattaatccagatagtggataaactgcatattatacactacaataccacaagaagataaaaattaactaaataaaaaagtaggtgtatcaatgggttaatctcaaaaacacaatccagagggttttttttttaaagtaaatttgcaagtggtagaagaatatgtgcaatatgatactattttataaagttttaaaacattcaaaatgtattttataattccaaacatccacagtaaaagcataaaaatagatacagatattataagccccaatatttaggataacagttccctttagggatcatacatggagatcagggtgcctcaactgttaggtgagttgttttaaaaataagaagactggaaacaaagcaaaatgttaagactggacaaggttttagataatggctgttacattattctttatatttttctgtttgcttaaactatttcaaagttttgaagagtaaaattcttcccttcccaccatgattccagtttgcatagctaacattttattgttttcttcagacgtactctgtcttcttttctcttttcttctgtctttctctctctcttcctctccctctctcccttttccttctttccatacttcttgcaacatatatggtactatagtttgtttttttaaaaacttaatcgtatatcatgaacattctttcaattaatattgccttctttttaatgtttccatagcattttatttatgagtatatcattatttattaaactatttctctaaggataaatatatagatgttcctaataccttgctgttagaaaaaaaatactctaacaaataaaactttgtatacttgattatggaaagcagattctctgcatgaacttcctggtaatagactatgaatattttcctttttgttagtttctgccaaattgttttctacaaaaatgtgttggtttaattctcatcagcagtctgtaagattgtccatctccctacacttttaccaacactgaatgttagagacatttaatgttttcaacattatgaaaggtgaaaatgattgcaaagataaataagtgaagctcagagaggttattcagcttgccccaaatctctcagccagtgaagaggtgctctaggatctgaggtctccttacattgggcacagttgtcttgtcttttcttttctatttttttttttttttttttgagacagagtcttgctctgtcatccatgctggaatgcagtggcatgatctcggctcactgcaacctctgcctcctgggttcaagagattgtcctgcctcagcctcccaagtacctgggactacaggcacgcaccaccatgccaggctaatttttgtatttttagtagagacgaggtttcaccatgttggccaggctgatctcaaactcgtgacctcatgatccgcccacctcggcctccgaaagtgctgggattacaggtgtgagccaccgtgcccggctgagttgtcttttcattagttagatcttgattccccattccagaggcctcagataataaatgtattatctgagacgagagggagaacttttttctagtatcagggatttctttaatattgtagataaatcaaacttaatccttgaggggcttttgtccttgtttctggaggtcagtggggtgggtgcctgactgggacatgggtggacagtggggctggagcatatggcctctgcagcagaggctcaaaaatcatatacatatttatcttgaatataaatactcgtcttgaaaactttgggtgaagtgcacactttctatgctgcatgtgttcagctacgttattacattcttccttttcagttctaaaatacaagaagaatgacgaggatgaatcacttaaagacaaattgtctaaactaaatattcattcaattagcaagaaatcaaaaagagtgacaaatcatctgaagattctgaccagaggagaatcacaggtaatttttcttcttggaccacccaccttttcccagggaacatgaatgcagatatttttgtgaggttttgttttgtgaggactatttctagaatactgagaatcaaggtaattgccctatgctgttctcttgtctccctctctctctctctctctctctctctctttctctctctctctctctctctctggaaaacaggggtgggagtgggaataggattgacactgtcttagctgtggtgcttctactcaagaaacagacaaaagagagacacggacatgggacataaggttgccccaggagtcctgatgctcatcatcaactagcacatattctccctcaaggcaatgcccttcttccatcctgttttacttctgctcttaaaagttgtacttttctttagggttcccttgatattcattttctctttatttcatctttataaacaaagtgtttagaggcataacttagtgcaattattttttctactccttatccccttcctcttccctcactccccagatgcacattatattagtgagtaacagtcctgtgtcagctgtttagcctagcttgagccactgtcatcccaatccctaataaataatagatggattagcaaagactcttaaactttaatgtgcattaagaattacctaaaaagcttgctgaaagacagattctagggttccacttgcctcaagggtacaatctagaagtctgtatttttgcaaacactctaggtattttgaagccaatgattttaaagtaagttatcaacagaacacacttgcaattctttgagaatcacaagatagaaagttcatggtcctgagatggtaatatagtgggcttctaaccaaaattagggaagatagttcttagtatactatctagtccttattttttccttctcatttgcctgtttttatcactcatgtattaatatctctaagatttttagtttgaacaagaggcagctgtatggtggttcatgttggtttcagatggctttggcagctgctgtggtcttttctccttccgttaagtctttgcagctttccaaccacttaggtaaaagcagccccttcttcctctggaaagggttaatatattgactctatatttcaatcttgacactattcatatttgcaggagtcagcacagggaagaaattaagaacaacatctttgaagttatccaaacctgggtttgaaccctacctctgccacttagtaaatgtttgtttgggggcacataacaaattcaatgtaatcatctgtaaattcggattctcctagtacttaacaaatgggatggttgtgaggattaaatgagatgatgcatacatcaagaaaacacctaacatagtgtgtaagcactcaatatactttagctgtcattattatcataaatttaatcattattattttatatcatcaccttgtatggttatttacctttgaatgtgcagacttttcttcctatgtgatgttaagtccttcatacatggtgtattaatcgtattttttactttctgtattttgtaatgttttgacattttaaaatacctttctggctgagcagactgcccttctagggctagccaattcttagggatagcaaatggctggaacacaactttcatatgcaaaccaatcaatcttgagtatatagctctaaccacatccttatctaattcttacacaccaagccaatatctcccctgccctaaatcatttcagggcccagtaccagcaactagagattacccctatatcccaaagcccattggagttatttaaaatagccagtcctaaactctttactctgcccctgcctcaccttttgcaaggaaatcccaacagaggttctggtctagactttctctttactcctatcttctgccactgcaccaaaacctggtgctttgcctctagccctgtgtggcatgtggtgactcctctctctgggacctgtgagtataataaacttcttccttccaagtcatgttcttgtttcttcttgtgactgtaccaaatttaccaacatgtacattcttagaacacaaggcttgaattatttttgtatttactccttaatatccttctaggggctaactgggtccattgcatgtaagaggttcctcttctcaacgtggaactataatgtaagaagttggggacatttatgggatatactcacatatctgagaaaggacaatgaagacatttcaactaaagacaaccatattaaaatcaaattggaaatttatttaagaagagattgtagccataatagagataggcatgtgtaaatgtagggcaaacaattccccccccaagtctttgggattttgcttctgactcaagacaattctattgaggaatagtaggcagcctctaattctgggctggcttttgaataagctgttatattctttaagacatttatcatcaacttcttatatttctcaattgtgaactaaaagtgaattgtagttaaagtagcctgaagggatattaattagatttttccccttaatcttttgagaggatgtcctgtcagcaatgaagcattttactgttaatcagaaaatcagctgcataggctggacgggaaaagagataaatctcaaatcaatcaattttgcacttgtcagcagctcaggtgaaatattggtagagttagggtataaagctattaccgaagaggaagattctattcaattcatcatacatatattgaactctcttgtacccagcaccatgttagagattgggactacaaagatgaacaggtataggttctgaattcagactgcttggggttgaatcctgatcctactataccgtgggtaagtttctttaactccccatattaactagggtaaagacaacatatctgtcacaaagagattccaaaggcatagtaggctaagtcaggtagttgtttatttctctctctctttttttaaattttttagagacagagtcttgctgtgttgcccaagctgggctagagtgtagtgccattatcatagctcgctgcagcctcaaactcctgggctctagcaatcctttcacctcagcctctcaagtagcgcagactacaagcgtgtgccactgctcctggccgctctctctgttttaagagtcctgagatgtgaatccagatgagctctgcttcataagatccttcaggaacccagttcccttagtgatttttctaaacatattgttttcatttgcctggttgaagctgtattcctgccatgtcttctttcaagtcccaaagaaatgttataaggccaagactcagacatgaaaacaaggcttcatccacatcctatttgcacaaacctggttaccagggcagagccagctgcaagggagtttgggaaatgtagtctctagcagggcagccaagtgtccaacttgaaatagaggtgtggattctatcaataaagggacagtaggaggaatgttaacaatctctgccatacctcctgaagcttctgtttctttatctctaaaatgggagtaatcataattccattatatatgtgtaaggattacaatgagaaaatggaagaaaggttttggcagtgtctggaacacagtcagtgtttaacaaatgttcgctattattttcattaaaacaacaatagttaatctgaaacaaccgaaatccatcagtggagagaatcacttaaatcattaaccagggttatgagagcacataggagagagcaattaattttctacagtgggaagaataggagaaaagggaggatttatagaatgggtgacatttgaactagtccttaaaaataaacaggattttgcaaggcaggaaacgaacagcagtatattccagcaaaagaaaacagcatggaaaagtcttgcttataggaaagtagaattgggcaatatttctcacagtgtgattcttgaaccttctactttggaatcatctgggtcctagccagatgatatacaaaataaaatatctggtgacgcctccttggaaactgcatttaaaaaaaaatctgccccagcatattgttatacacactagactgagttggagcatagcaaccctaaggcacagaatgttggattttgtggggattccaaagaactctgctgcctatttaatcaaaagctttgtagataaacaatattaagaagtttaaaaataaaataaaatgtcaccatttttgatacattgagttctaatatcaaccctcttaaatttaaaaacagatgaaccaagcactgctatggttatcacccagtgccaagcttaataatacataccctattccatgaagcatttgcacgttcacacagattttgccaggatgaggctggttccgatcttgttttgtagccattttgatagccaagaaatactgcttgctattaatagcagcaataaatgtgtgctcctagaaattgtcacagcataaaaagcatatctttctgaattctaatggatgtacatgtaagatgacaaaaaaaactgaatacatgtgacactatcttaagtctgctgagttatcttaacagaaggactatttttgctaagattatatattatccttcaagtttgagttgataaagaattttcacatttcttttttttttttttttgagacagagtctcgctctgttgcccaggttgtagtgcaatggcatgatcttggctcactgcaccctccgtcttccgggttcaagcgactctcctgcctcagcctcctgagtatctgggactacaggtgcacaccaccaggcctggctactttatgtatgtttagtagatacggggtttcaccatattggccaggctggactcgaactcctgacctcgtgatccgcccgccttggcctcccaaagtgctgggattacaggccacatttatttaaccatgaatctaagaatattttctaaataagcactgttaaataaattggaatgaatcatacgaacaaaacaagaagttctagtcaatagatcaaatgtggctattttataaacccaaaaatgtaatatggtttgcgtacatacataatatatgccattaaaaactacagagaaagttttacaataccacatctactgtgacatgggtgaagttatgtggaaattaacaacagcaatttgagttataggacttggctttactacactaactgagcatcagttgtgttatgtaccaacagagaaagtatgtgttaagacagacagcatgtcatcaaatgttttcatatcatcaaagaattttcttttgtaatgtgctggaccaatatggtctgtgctattttaaaaaatatctgtttcatttgagttatgaaaataatttcatatatattttaggttaaagacaatacctttaacagagaagaaaagctgtttagagctttagaaaagactgtgaggctttgtgtgaagaacatttcactctgtcttcaacacatacaggtaggtgagacacaactgttttcagtgttctacaggaacatctgatacaaaccattgatttccatggttgttttgaagagtaaatgtgactgttccttcctttatgttatgacaccggatcaaaattggaaggctgcaaactgctggtaaaggaagccaatatatagaggtgttttgctgtttgacctcttacctgctccactctctccccagtccaaatagtcatattgtgggacttttttgctcagatgattgcttcatggactatcagcatgctttctttgcaacagagatgagttcattaacacaaaattgcaagagacagaaaatttgtttgtttgtactaacacatctctttctagtacctaaaataagtataaaaatcaatataaaggaaaataaattgaactacaaaatcctattaactacaatatggaaatgctcccatgagattatgttagaaaacagaaatactcccagaaatttccaatcccataagaagttgtcctgaccctttgagaatcactgatttcaaccaactaattggagtacagtatgattatgctcggtagaaaaaccagtcagaggttttttctaatcgatctcataaagaggaaacagtgtccttcatgccaccttgacaatggctatgaccatgacacatagaaagttagtagtgttacatgtaaatcagttactaaattgtccccttctatattccagaagtttttctcctggatatcttagatatccgtttctggaagcagatgtttgcactcttagataaaatatcagaatgatttggagacaagtttccatgtacatgtaccattctgttcttatttattatctgatacaaagcctactttacaatccggtttgctattttcttcctaaaatgctgccttctgtgaaaagaaaaccaaaaacagttataacagccagagagtagtgggaaccccatcctttatgtatctttcaaggagtaaatgtctcttgggaacatctacaggaaagtcttctatttccactaatagattcaacaaaaaatgtaagcattttctcttaaagagagcattaaattttctaaggaaaactgatgaatttaaatcaaagaggagtgatttttaaaataagaaatttgtaagaattgcaagctaaagaatagctaatgagggaatttaagatggactgtttaatcaaagagggtcgtatacagagtactatgagaaagagacataaggaaaatgtaaggaaatatattcttacaagcaacctgattgtacagagcatttataaaatgtttgttgttcctttttaaataacctctcagtgataattaagggttatgctgatgaagtccacatttgggatatgttaattatactgacctcaaaacttgccttttttgtaactttgttcttgggtttcaggatgccatgcccctggctctgcagagtgtgatggaccttcaggagatttcatacaacaaagacgatgagatggactattctgagaccctaagtaatgccttaaattcgtgtcatgactttgtaagttatttatattcacagataaatgcaaattaaatagtgaggttgaaaggaaagctgctttttgtttgtttttctggagtcagaaataaaacatgcactaaagcaaatattaatgtcaaaattagtagatttaaatgggatttttttaaatcatttaatatttttaaagtggattagtgaggattttactatgatggaaatttaagaggaccacagattgtgtttctaggggtagccagtgtcagtgcagcttttaaaattaatatttagtttaagtctgcatgtgaaatattaagaaattattaagttagaaagctttgcttttctttttcttttttcttttttctgggacaggatctggctctgttgcccaggctggagtgcagtggaacaatctcagctcactgaaacctctgcctcttgggcttaagcaatcctcgctcctcagcctctcgagtagctggaactaaaggggcacaccaccacacctagaagattttttgcattttttgtagaggcggggtttcaccatgttgcccaggctggtctcaaactcctggggtcaagtgagctatgcttttcttaaacaagtctctggaaatgccttgagtccttacagaaagagcaaaggtactcactgaggatatgacacttattaacatgctatatactggaaggcaaagacttcctattgagaaagacttttatttaagagtcatatgttatttattttgttccacggtaaaacatttattttgtaagagttctataaaatatatcttgggaatcataaaaacatgcttgagccaataacacattttagtagtaagttactctgggtaatattaattttaatttagtgccttgtgtttctataggtattattatttcatagtagtatttcaagaattatagagaagatagactgatcatcttgaaagtggcattttcgtgttggcattataggcattttgggtaagacaaatcttcatggagtggccttttggtggaggatgttcagcatttttggcccaccaggctcaaaatctcagtaacatcccctcacatcaagacgttgtgacaaccagtgaagagcctcacataattccaaaccctaggaagtcatacagcccccgatctagtagaaaaaccaggcaggagcattttgcttttctggcactggggaatggaaagtcaggcttacatctgagctaatatgatagagaaacaggtcaacgacagatgaatggatggatggataggtacaggcagatagatgatggtgatgatgagatagatagatgatagatagatagatagatagatgatagatagatagatagatagatagtttttacagtatatgtttaatggaaaaggtgtggctagttctttatgtattttctgcatttaattatagagagcacacattctagaagtctttaaaggtttgctctttagcttagttccaatacattaagttaatatatatttattgagtaccacctgaaagtgtgatatgtagcttctccctcagcaagcatgctccagactttgatggaaagaagccagaagtgtcctgcataccttgcataaaaccacaagatgattaattaggctaagttaaaaaaattgtgagaaggctcaatataaaagtaacttttatggataacatatatagaactctttttaaaaatcaaatattaagaactcaaaatctgtctaaaggcagagcagttattcttatctaaccatgagtaatacatatctacacttttttaggacaaaataataaagtctaattcttatttgttctaacaacaattcctaagtaaaggtgaatcattttgtgtctgtgagtcactggatatatatatatatataatactgtaattagattacctgtagaatccagtcaagtcacaaacatagtaatttatcccagatacagtaaatagattctttgtttatcaagggactcattaaacagtctctaggtgtatattgactatctcataagctagacatcaaatttaatttgtgttggctattgctggtgccaataagagattggtttccctctcccctagatttcccatgagttcagaccaacttaccaggggccatttaagttaattaatacaagctgctgctcagatactgattccctaggatagctttcgggttacaaaagagaaacctacttccaaattatcataaaatatcatataagcatatatgataaagggtaaagtagggcagtcagcaaatgtaaaacagaagagaaatagaagaaattaaatctaggatgatcaggttatgtcatgaagttgggcagttctatgaagttcattttcaatgactcaggccaaaaagtgtaaacaatttaagacacagaaacagcatcagcttaatcctttaatgtatttaaaacagaatgtgtaggccaaggtgagaggattgcttgagcctaagtgctcaagaccatcttgggcaatagagtgagaccgtatctctaccaaaaattttaaaaattagccaagcgtggtgatacattcctgtagtcctagctattcgggaggctgaggtgggaggatggcttgagcagaggctgcagtgagctgagaaagtgccactgcactccagcctgggcgacagagtgagaccctgtctcaaaattaattaattaattaaaaataaaacaagttacaactctgtggtcatttctgtttcaagattaaaatacctttattaaggggttactatctgtataggggatataattccactatcaaacataagcctccagggtagccagggatttggggctgatatgggaagaatagggtacagtctcctatgggatgaactatattccttttgctgccagcagaaggtgggagcgatatggtgaatcttttacacagtcttggtagtcaaaggctagagattcccccctaccctcaagtgctggctctgggatgagaaaggaggggaatgagaaagtgttgaaggagatgacaatgacaaaaccaaagactgtagagaaaaaagtggagttatattttgggtgagcaggctttaacttttgtattcctcttcctgctcactttttaggttcaatgttacaacctagagctcctgttttaagtctttgaataggtttagccagacacaaaatgatcagatcctcttttaatctgggtaggtgctttcctgttttcttttgtgcttctcgtgggggaaaaggtaaacctatggatagcagaactggacaaggtatgggctgatcctctctctgaaatgggctcattttttcttttggcaggcatctcacttacagagactcatcctgacccccttgtcagccctgctgtccttattcccagggcctcacaagctcatccagaaacgctatgacaaactgctggattgcaacagctacctgcagcgatcaacgggagaggagtcagacttggccaaaaaggagtatgaggccctcaacgcccagcttgtggaggagctccaggcattcaaccaggctgctcggaagattctgttgaactgtctatgcagcttcattaccctccttagggacctgatgctcgtggcacagcaggcttactccacacttgtgccggtaagcacagcaccaacacctagctagctaccttggcctactggatctgctagaaaccacacccatacgaaagccctgttcagagtgtgcacatgtatgccgtgtggtgtgtgtgtatttattttaactaaatccagtcagatagtctcctgttccttatctgtcttatccatgggaaactcaaagagggtttcctagttcaggtttactgtgacttacacatttgtaattcttttttggagatgccttttcaaataccaaacacctttcagccttgctccacctgcctgatgcaacattgaagcttatcaacaatttatattttgtatttttttctgatcaatagttcttagatgttaactgtgactatttaagatgtggctctaaaaagaaggccatctcagcataatgaaagatgcaggataacattcaaaccatgctttgttttgatttcatttttccccaagaaagagaagcctggttttgtgtgtgtgtgtgtgtgtgtgtgtgtgtgtgtgtgtgtagcttcgcctcccattaggatataattttataattattttcctgatgaggaagaaagatatttacaacttatatcaacttttgaaaaattagcttggtttcttggccctacgtttcaactacactagttctcatctgaatgagatggacagctattcaatgggtaacacctggagcagaaataattgtccctactttattttctattgtgcattaattaacttttaacttatactttgaattaaattaaattgaataaacgagggctatgtttacagggttcaaaagccaaaactgtgtaaatgtataatcagtctcacactcatacctgttcctctagcatcccattcgccactctcatccccatttttgttagtttatttttatgcatttagtgctttctcatgccagtaacaataaatgcaagtatatatttttatttcttaaaagtaaaaaacagcatattatatataccattctgcacttgctctttaacaatatattctgagaatgcatctataatagtacataaagagcttcctcattcttttttttttttttggtggggggggatggagtttcacttttgttgcccaggttggagtgcaaaggcccaatctcggctcactgcaacctccaccttccgggttcaagcgattttcctgcctcagcctcctaagtagctgggattacaggcatgtgccatcaagcccagctaatttttgtgtttttagtagagacggggtttctccattttggtcaggctggtctcgaacttctgacctcaggtgatccactcgcctcggccttccaaagtgctgggattataggcatgagccactgcgcccagcctgagcttcctaattctttttacagctttatagtaacttactgcatggctgtataataatgtataaccattccctttttttaaaataactttattgtgatataatttgtataccatacattccacctatttaaagtatacaatttgattatttttagtatattcacaagagttgtgcagccattgccacaaccaattttagaacattgtcgtggccccctaaaggaaccctgtacccatccacattttttcctaacctccccagctctaggcaactatcaatttactttctgcctgtacagattttcctattctgggcattttgtataaatgaaatcatacagtacatggttatttgtgactggcttcttctatttagcataacatttcagggtttcttcatgcctagcatgtttcattatttcattcattttatcgccaaataacattccattgtatgaatataccacactttacttattcattcgtcagttgacgggcatttgggttatttccattttttggctgttattagtaatgcttctgtaaacattcaagtttttagtggatatatgttcccatttctgttgattatatacctaggagtggaatttctggatcatatgttaactctatgtttaaccttttgaaaaacaaccagactgttttccaaagtggctgcactattttatcttctcagcagtatcgactgagagtttcaatttctccacacctctttattattattattattattattattattattattattattattgttatagctatcctaatgggtgtgcagtggtatctcattgtggtttttatttgtatttccctgatcagcactgttttaaaactcattaaattgaagtaataacttctatacattaaactgcaccagtctgaactgcacatctcaatcaatatttgcatatacacatctgtgtaactaccacccagatcaagatataatccctttccagttccccataaagatcactcatgaccattcccaggcacctaaaggtaaccatttttctaacctgtattaccatacattgtttgacctgttttgtacttcatataaatggaatcatacaatatgtattcttttgtgtattaacctgtccctattgatgagtatttgatctatttccaacgtttttttattacaaataatgccggggtcatgatacgtggacagatgtatctgtaggacagatttatagaaatgatagaagtgggatctctgtgtcaaagggtaaagacgtatgtaattttgctggatattgccagattccctgcttaactatgtaccattttggattcccacttgtaacatgtaagaaagctggtttctctggatttttgccaatctaataggtttcaagtgtaattttaatttgcatttctttaagtattagtgagattgagagtcttcacatatgagggctatttatcttcctgtgagttagttgttcatgtgttttactcctttttctttgggttcttggtatttttctccttaatttctagcagcaatgtatatgctagggagatgagccttttgttgagataaaaattgagactactttttccaagttaacctttgtctttgacttcacttgtgattttttttcatgctaatgtttgtgtttttaaaaaatgcagtcagatttattaatttcattttatgacttctagattttgaatcttataaaggacttccatattttaaggctccaaataaattcagcagtgtttcttctagtatatttagggtttcatatttttttatttaaataatcaatccatgtagattttatcctggttcatgttgtaaaatatggatttaattttatctttttccaaatgactttccagttgctccaacactatttatttaaaaataatctcttgttactgctttctcaatgaaacacatttaatttgcaaattatttcgataatttcattctgaggtcatggtagaaggtgggttcataagttcagaacaaagttgagctttggcaggaatttactagtcagaaaagacatgttattttaggtatctttgatccccactttgaatcatgtgatttttaaaggcattttcagtttctattttaaattatctgagtatctttcacattgcagtccatagccaaacaagagcatagagatgctttgtttttgagaaatttctagtgtcttaaagtaaaaggcattttggagaagttatcctcattaaaatgattttattctttattttatatgttctgtatatttaaactttttattttgtgatacttagagattcatatgcagtggtaagaagtattacggagatcctgtacaaccctcacacagcttacccaatggtaacacatcttgcataactacatgtatttctgaaaggcagaattgaatagtgattagagaacactagagtaccttgttttaatacctgctcactgctatactacattgtgtaaattaatgtatccttctgtttaaattttctcatatgaattaaaatgagaataataatgtaaataatttttaaatttttaattgtataaaaaaccacaatttaccattataagaatttttaagtgtacatttcagtagtgttaagtatacttatattgttgtgtaatagctctccaaaacattttcatcttgcaaaactgaaactatactcattaaacaagtccccatactcccctcccccaagtccctgcaaccatcattctattttctgtttctacaaatttgactactttaaatacctcatgtaaatggaatcatacagtgtttgtctctgtgactgccttattttgcttaatataatgtcctcaagattcattcgtgttgtagcatgtgataggatttctttcatttttaactgtgaatatttcattatatataaaaaacacattttgggctggatgtggtggctcacgcctgtaatcccagcactttgggaggctgaggcaggcggatcacttgaggccgagagttcaagaccagcctagccaacatggcgaaaccttgtctctactaaaaatacaaaaacttgccaggtgtggtggcacatgcctgtaatcccagctactcgggaggctgaggctggaggatcacctgaatctgggaggcggaggttgcagtgagctgagattgcactattgcactccagcctgggtaacaagagtgaaactccgtctcaaaaaaaaaaaaaacaaacaaaacaaaacaaaaaaaaaccctaaagcacattttgtttatttactcatatgtcaatgatcatttgggttgtgtctatctcttggctattgtgaataatgctgcaatgaccataggtgtgcaaatatctcttcaagatcctgctctcaattattttggatatatacccacaagtgggattgctgaatcatatggtaactctatctttttgaagaattcaaagctctatttttaattttcatttttattagagttatacatacacataaagattcaagtagttattcaggtttgatgacgaaaaacatttgtccttcgctccctttattccatttctcccgcctcagtggtaactactttccaactcttttagatgattctcttggtatttaccttcatatttaaaaataagactcttgtgttgtcatttcattattaatacactttaggtataatacattccactacgaaaaatgaggatttagctctctcttctctctatacccctacatttgctatagtcagacacactctttctatacccccttcaatacagttatagcatagatttggttgagttcacattaagcgtgtaaagtatgtgatttgtgtattagtcatgattccagtaggaaaaacataatgcattcaagttaggcatttggagaaaactttaataactatttacaaaaatgtgagtatggcacaggaaaacctttagaaatagtgccttgccctgggcaggcataggggtttggggtacaacaacatctaggttcaaagaaatatggggagggagcagtcatagcaatgtgtagagagagaggtgtgtggagagggtgacttgataggagctgtgtatttctgtcaatactactgaaagcaaaattaggaaataaatatccttatctcattttcttcccccattctaatttcctacaggtgctccttaatgatggattgattgaatccatttggaagccagagagcaagaaagctgttttgttgttgctgttgttgttgttgagacaggatctcactctgtcacccaggctggagtgtcatggtgtgatcacagagctcactgcagcctcaacttcccaggtccaagcagtcctcctgcctcagcctccagagtagctgggattacaggcacacaccacctcactgggctaattttatttattaattattattattattattttgtaatttttagtagcaggccaggtgcggtcacttatgcctgtgatcccagcactttgggaggccgaggcgggcggatcatgagatcaggagatggacaccatcctggccaacatggtgaaaccccgtctctactaaaaatacaaaaaataattagctgggcgtggtgatgcgtggctataatcccagctactcgggaggctgaggcaggagaatcacttgaaccagggagtcggaggttgcagtgagccaaaatcgtgcctctgcactccagcctgaaaaaaaaaattttttttttagtagtgactagttgcccaggctggtcttgaactccagggctcgagtgatcttctggcctcagcttcctgattagctgaactacaggcatgtactaccatgcctggctaagatttaaaaatttttaagagacaaggtcttgctacattgcccaggctggtctcaaattcttgggcacaagcagtcttcttacctcagcctccctattggctgtgattacaggcatgagccactatgccagacttacccagtttttgaggggtagggatgtaaactccatttctttgtaggaagcaatgttgaagaatttgtttgaaaaccagcacaggctcttaatcagtgctccttcttttagctgctttcccttgccaccatcctaccccaccacaagggaggtacctactgccatgagctcctgagctttttttccaagacttcattgctattttttctcttctgttctttcatttggcttgaaacttaaaaaaaaattcctatcatgtttgtggggtttctagagacaataaattagaccatatttatctagaagttctaaagttgccctaacttttcacaatggagctaccatatacctcctcaactgttcatcacaactcaatacatttaacacctgatatgattatctaggtgtctggaaacaatgccatattatttctacctatagatgccactgttggtttcaagcatttctgagattcagaatcaagtactagaagagatccaaaatttgaattgtgtgaaagaaaacagtgccacctttattgagaggaaactcagttttgaaaagaagaaacctgtgcagattctggtgagtttggcagcattcatgacaatgataactttcacctctttgccttatccaagttgtagtatcatattattttccagatcacttatctcattctaatatcctataatttacatatgtgtagaatttcttgtacatttctatcctatataccataagctccataagatcatggattttttttctactttgtacatggcgtatccccaaagtgcctaaaatgactaaaatggtgcttgtcacaaggtaggaggcactcaataaatatttgttgaataagattttataaagataaatcatatagtccagacatttccttttctacataaggcataccaggccccagagataagtgggtttctcaaagtctcttagggcccgagctgagggggggagtataagcgtcttgattcttgtctaatttgctgatgatatttcccagataaagacatgtacatgtacaatttacttagctgaatacttaatatgcaacgggttgtctgcagaatggcaaagagtttaaaatggttgtgcaacatccaagagggattagaacctctgccttcttattcttgttttttcttctctacaacactgccctcctgtgcttactagaaacatttttccctgaataactcagctgggtactttacgataatagcctgctctatgcctgcaccttgaaataatcctctaaaaatatatgactcctacgttttaaaaatctccagggaaaaaatatttaccaactccatgaggattttattatgtatctgtctaaaccaaaacttctccttatttctcccagccagaaatgccacatcaaactgacattcatcgctccaaacttctatccacatatagtgcagaggaactctatcaagctaagcgcaagtgcaatgctacacaagaatatgacatcaatcttctggaaggagacttggtggctgtgatagaacagaaagatccactggggagtacaagcaggtggcttgtggacacaggaagtaagtttttccccagaactaccactcttctttaaactgagatttttctgagggcacatgtttgggaagagtatacccatgaacttggttcttctttctttttatttcctatccagatgtgaaaggatatgtttattcctccttcctaaaaccctacaatccagcaaaaatgcagaaagtggatgctgagaacaggttctgtgacgatgattttgagaacatcagcctcttcgtgtcttcacggccagctagtgacagtgtcacaggcacctcagaaagcagcattggtgatagcagctcatctcttagtggcacatgtggaaagtttgaaacaaatggtactgatgttgacagttttcaagaagtagacgaacaggtaaaaatttgatgtaaaaatatgtggttgttcaaatcatgaaagagtatctctctactgtactctataatactgtaacacttggtggaaaagtgccagctttgacatcaaggagacctggctctattagcacagtggatctttttgtaaggagtttaattccctgagcctgtttccttaaatgaagcaaagaattagagataaagtgtgtatgtaaagtagccagcacaaagtagacacacaataaatgggagctattactattactaccctgctgttacatacttacagcaaagtatctttttataccccctccatcaaagaaaagtagttcaatactgaacagattgctgccatcaatagcacatgggaaattgcccatgattcctctaagagcataatcttcattgagctatctagtaattggccagttttaatctcatgtataataccacacactatatatggaaactttttctttttttcttttttttttgagatggagtctcactctgtcgcccaggctggagtgcagtggcgcaatctcggctcactgcaacctccgcctcccaggttcaagcaattctcctgtctcagcctcccaagtagctgggactacaggtacacgtcaccacgcctggctaatttttgtatttttagtagagtttagtagggtttcaccatattggtcagactggtctatactgaaacttgtaagagctatatttccctcactgcactaatgcaaaagctactggtacaatctttttgcaaaatggtaagttaattatagtgcaggacttgtttttgctatatcagaaaggttcagtatacttaatggttcattccccagtggtgaccatctaattcctttatttatttaccttgctttttctttagtgttctattaataatttatttaaatttatttttatagaggttatgtatatgtatatgtgtagatagatagatagatagatagatagatagatagatagatagatgatagatagatagatagagaagttaaaatagtagaaaagcatacgtaacttaaaagtaagctgggcttggtggctcatgcctgtaatcccagcattttgtgaggctgaggtgggaggattgcttgggctgagtttgaggacagcctgggtaacatagcaagacctcatctctactaaaaatcaaaaaaattagccaagagtggttgcccacatctgtagtcccagctactggagaggctggggtgggagaattgcacaagccggggcggttgaggctgcagtgagccgtgatcatgccactgcactccagcctgggcaacagagggagatcctgtctttagaaataataataataataataaaagtaatggtttttagtcccttctccccttgtcctgtgcttcagagacaatgcttgggtatatcctttgtatattctgtgcatatacaaacacatttataccagtgggaaacatagcatgtatggtatatagggtttttttccatgtaacaatatatcttagacacaattaaacctaaatagctatcttattccttaaaaagctctacacagtatttaattttatgtatataatttatgtaactatcagcctaataatagatacatagaacgttttgggcttttaaaaaatttcaaacaatatttcaaggaaggggcttgtccatctatttttgtgcatttgtatgagtatataagtgtaaaacaaattcctaaaatattagagggccaaaggtatgtacatttaacgtctttatagacattgccatactgaccttcaaaagtatggttctattcagtttctttcattaacagttattgattgctgtccaattcatgacttcttttttttttggtttggtgttttttttcaaaagcagcttatcaatatcttatattcatgtcatataattaatccatttttaagtgtacaatcatgacttttagtatatattacaaagttgtacaagtttagtatatttacaaagttgtgcaaccatcactttaatccaattttaaaacatttctttcactccaaaaaaccctttgcacccatttgtagtccctcctctttcccacccctaaccccagggaaccactaacctactttctgtctccatacatttgccttttctgtatcttttgtataaacaaaattgtacaatatgtggtgttttacagctgctttttttcacttagcaaaatttattgagagtctttcatgttgtagtatgtatatgtactttgttgctttttatcgcctactaatattccattctgtgggtatattttgttaatccactcaccagttgatggtcatttgggtaacttctagtttggggctattgtgaattatgctgctatgaatattcgtgtgcaagtctttgttgtggattttatttctcttgagtagatacccagaagtgtaatttcttattggttttataagtgtatgtttaaatttttaagaaactgccaaactgtaatccaaagtgggcgcaccattttagattcctaccagcaaagtgtgaggtttatgggttgcagtttcttcacatccttgtcaacactagttattatttgtctttttaattatagccatcttgtgggtatgaggtggtatctctctggggttttaatttgcatttccctaatgattaatgctattgaacattttttcatgggctcatttgccattcttttatttcctttggtgaatgtctattcaaatatttgcctatttaaaaaaaactgggtcattttccttcttattttcccattgtaagagttctttataaacctgagtgcaagtttttttttaatcagatatataatttgcaaatattttcccctggttataactgactcttaacttgtctggacattactatttgttcttattacccttctgtcttgatgtttcaaaacactatttctctattacttgttcactctgttgtttattcagtttctaaaaaacatattataatgctaactaatgaatttttatcagtgaaatctatgtacctgattaaatgtcctgtcagactttgccttgtcccaataacctagatggacagaaatctgagggccaaatttatcagcacactctaaagctggcttgatgttgagttcttgttcttacttggctctacagggactttggactgagcacctcacacagactttctgcctggtgtttgtagtatgagactgcatttagttcctactagctggtacttcaaagcaattttctccaagcaatcctatcaatatatataatgtgaattacatccattagagatttccattaccaagagaggaaaaaaatgagatagtatttcaaaacaaaaaatatattaatggcatatcttcataaattgttatttgctttctttttcctctgcatttggcaccaattcaaagtaggcatagcatcaggaatataaatataagcacatataagcattattactaataaaactggattgaagatgcatcttggatcggtagcacatgggatccctgatactttccctcagagtagaaatcatctaactcaaactgaaggtgaaccctgtgcagggaaaaagtctgtcccaataaacttactgcaagatgaggaagaggatgcacctgttggaaacttcactacaagggagaagagaaggccgcatggaaatatctcccttaatgtcttaactctagccaatagatgcacatgggccagtggtttccagactccccctgtaatgcataatgcataatattgaaaacagagagaaaggagtatattatgtgcctaatccttgccccagggccgatgtttctattctgttggctttgagaaattgtggggagaagaaagtgattaacctctgtatttgtgatgtgatagtataagtcaatacattatagaggtccctgtaatgtgatcaaaagtggaagaaaattatatcttctttaccaacagtgagaatacagtacatattgtaatatttcacatttgcggtatcctacaaagcaattttctgtgtggctatttagactttcgttcttgattttattttattatcaggaacatcagctgaaacttgtactggcttaattggatgccactttttgttatcatttatttccctctcccttcctactgtggtagcactttttttatttcttccagaattgctatagcatgtttccaaggggtgttgtaggatgtagtctggatttattgatgggtctagtgggccctgacaaaaaggacaggtggcctctacctcatactcagggggtatctttgggtctctaaagatcattcacatataggcaatttcaaacttagattctagtggctctgtgatttttatactagagctgaatttttaacctggacgcgaagacctgaagtggtctatgaatgagttttgggaggatttaatgagtctcctcaaatacattggaaatattgtgcttatttgcatatgtacacatctatggtaaaagaagtctacctttttaaacagacttttaaaagaaaattttatctaaaatgttagaaatcactgctgtagagatttaacttgcttatccattctctacctcaagtaagaagagagactgctacaaaaaagttcccccaaattatattctggagcctttgttgaataatggggatgagctagtggatattcacaacctggcagtactgatttataccaaggtccttaatttttaagttcttcattttgttttttgctatatcgaagaatataacaaaagcattcacgtaaatatgccttcccattctaatgtattctctccttttgtccatcaaatagtaatggcatgctctgcattagtgttccatgctgcataacaaattaccacaaatttggtggcttaaaacaatacaaacatatttctcaggggctgttgtcaggagtccaagcacggtttagctggatgccctgcttaagatctcatgtagctgcaatctagctgtttgctggttgtattgcttctgaaactgagggttctcttcccagctcatggtcattggcagaattaaatttcttgttctggtcggactaaggactcctttttcttgttggcaattagccagagaccactttcaacaacctgaggctgctctcaaatccttgccatgtggctgtctctataggcagtttacaacatggctgtttgcttcttcaaagtcagtaggtgagcatctctctggcttcaaatctctcccttcagaggaggcctgaatgcacttcaaaagtctcatatgagtaggtcaggcccatccaggataatccctcttttgactaactccgagtcaatttcctagggactttaataagcacctctgcagaatctctttacctttgctatagagtgtagcctaatcacaggagtaatagcacatctattaagaagttccagtcacagtcaaggggaggagattatatagaacatgtacaatagggggtgggattcttggggtccatcctagaattctgccttccagagtgtctaagatgccttgtttggcaagcagaatcttgtccttggcacttctcaaaaaggactaggtttaataacggctaaaacccagttttggggggcagttcagtgtctgagaatcagtgttgttttctttttccacataagtaatattgaaaatataatttttgacttctaaaaaaagtagtcgttttgctaccaatcccacgttcatagtctggcccttcatctttacattttccagctacctatgatgatgatgctatatacctactgtgtcattgtttagaaagtgcttaaaaaagtcagcttattaacatgaagagattttcaaaaatagtatgaggtaaaaaacagcttgcaaagttatgtatactataagtccatttttattaccacttcaggtaggtaggtagaaaacaaaaatggaaggaaggaaagaaggaagaaaggaagagaggaagatgggaggaaggaaaagaagatactaatagcagttgggtgggttttgttttgttttgttttgttttgcttaactttacttaaaatttttttcttcatcgaaattgctcgtgtaattaaaacatataattgttaagtgaagaacatgaaagcttgctcctgaagggtaagagagaataatgagcatttttcatgcaatacaactaccttggtttccagagatacatataatgtaccataaatgctgattctgtaccttttagttttagaacagaagattaacatatattatgacttttgttgctgttaattggagaattgggataaaaataaaatgatattcagtgaagtcaggtaatgtggctcacggaggaaggaaaaatcaaatgcacaaatatagaataagggaatgccaaactgggaatgttaccacagggaaagatctagtggttataagcagtgggtaataaattaggtatgagtcaataatacagtgttataaaaaaagtaagtgtggtagaaaactgagttgtattcacagaatactgcacctaaaatgagtcagagctttatagagtagaaagaagcaatcaataaaatacattttaaaaagtgccaaggaaaaacagaagaagattaggtgattatggctcaaattaacaacattgtaattaatgtgcctggaccaaaacatattagcatttaagattagaaagttacagactgaaacaattaaaatgttgaagataatgagaaatctttcagttcttaaatgcatgacaggttaaaaatttataacttgtagtctaacattaaggagactaaaaatactaaaaaggagacttaaaaaagagactgaaaatagactgctgtctctttaaaagcagcttacttccattttgagtatataatatatgcccccatttaacataaattatataaaaactaaaaagtgctcatcctaaacaaattttgggtcatgattatctaaagcattgaaagtatataattttgtactttaaatttacaatttcatgagaatatattttaatatttagaatataaactataatttcataccaaacagatctagatggaagagtttatatttcgcttgagagaattgtgctaaagtaaaaaactaccactatttagaaatgttctattagtaggcaatctaacctgctaaaaaaatctatagttgcataggtaaagcattacctattatttataaaaattataaaagatgattaccaaccactaatgcaggctcttacagatgtttcagatgtattatagtacgttacattcccgaatacttttgcaaaccaaatcttccattctgttcctgtggatttattcaatgttttcactttctacacagcaaaacaacaccatctacaatatactagaaactccagtccctctccgcaagaatacactctgtacatacttgctagaacaagagtttggtctctaaagcattatgagaaatggaccaagcacaggatttgaagttagaagatattggtcatagcagcaccaattagctctataattaaaaatatgtttcttctgtaagacataactcataaggttgttgaggacaaagcacatttaacatataactgccatgcgctctgtaaaaggtgtttattattgctaccactccattgctaaagaatttatagtacttttaattttcttctttacttaaaaaaattatgtaataatttgaccatgttcatcaatctcttgtatgtatcttttatgatacaagatgatgtcttgtatgatatccatgcctttcaataaatatttgaatattcctactaattttcaggtcaaatcaataaatatttgaattcctactttgtaccataatgtggtcaatggagaaaagtttaaatgtgtgtcttagtgcatttgggctgctgtaacaaaacaccataaactggttggcttataaacaacagaaatttatttctcacagttgtggaggctggaagtccaagatcaaggcaccagtttatgtggtgtttgctgaggggcaactttctggttcatagatggcaccttctcattgggccctcacatggtggaaggggtgaagagtctcttttgggcttcttttaaagagaaaccaatcccattcaggaagttgaaggctaatcacctccccaaggccttacctcttaatagcattaccttgtggattaggctttcaacacataaactttgaggggaaacaaacattcagtccatagcaatgtggttctttccttggggagcagctcatattagttgataaatcaatatcccaatcaattgaatcaaagtttcaccaaaagttaaataacagtttaatatttaaataacaacttcagctacagctatagtctcctttccacactacgcattctctttctctgcttaatgaagtaatgaagtcatcttatttctcatagtttcccttacctattgaatctcaagtttgagagttaatctgcttgtcttttcctatatgttgttttcatgtattcatctccgtaccttcaaatatgacatattcatgccttttgtcagctttgtcatttatgaaagataacttatttcaaaattcagctcaccattagctgatgtatcatctgtgtgtagagttgttgctgttttggtgtgttttgttttgttcactggcattttcttttcctagctgagttgtaagttgtccaataaaataataaccagcacttagtaggtacttgaaaaattttcattaaataaatgaatgggaataaatattgcttaaataaatgaatgggaataaactaagccagttgcttaattttatgccataactaaacatttttattatcaatcttatgattttgttggaagaataaagacttattttggggcttcttacgcacttaataattataaattgttcttttgaggtcagagaaaaattcttttgactgaaatattgtattattctaggccataaaataatttttaaattataaatttaatacattgtcattataaaggtttgggaaataaagaagggaacaaggaagtaaaaatgaaaatcagctataattgtaccattcaaagaaacaataatattagacttatatcgtacatctaattttatgttctttttaaggtttactattttatcataagtgtttcccatgttattagtctcagaaagcatcgtttttgttgttgttttgtgttttttctttttttttttggagacagagtctcactccgtcgcccaggctggagtgcagtggcgcgatctcggctcactgcaaccaccgcctcccgggttcaagctattctcctgcctcagcctcctgagtagctgggattacaggcacacgccaccacgcccagctaatttttgtattttttagtagagacggggtttcaccacgttggtcatgctggtcttgtactactgacctcgtgatccacccacctcggcctcccaaagtgctgggattacaggcgtgagccaccgcgcccggcctgcaccgtttttaatgactacaaatctccttagtatgagggtctggaatttaactatttttctcttgctaaacttatagtgttattcctactactctcccacttttcgccattcttatgggtaatccagtaacattgttatgcaaaaatttctgccgatgtttctgtagaagagattcttcaagctattttgattcacaaggaattaacattttaacattattaaaaatcttttaatagaaactgccaagttgccttcaagcatggacaatttatattcctcctaacagaataataggaatacctatttcactccattctcacctgggttatattttagcaaaatacatccaatagaaggagttggacaatgtgactttggcaaaacaaaaaaactttagcattgcttctaaaagcttggaaacttttatgatgtttctcttaatattcaggttccaattccaataatgtcttttgtttctttgtctagattttctatgcagttcatgcttttcaagcacggagtgaccatgaactcagccttcaggaataccagagagttcatatactcaggttttgtgacctaagtggcaataaagagtggtggttagctgaagctcaagggcagaaaggatacgtgccagctaactaccttggaaagatgacttatgcttaagaaaataagccttcaacttttattttccagcaagttgttgattgactacctcataaaactgacattacaaaactttggaccagaaagcaagaaacctctgaactacagaaactgatactgtactgggttttcaggaatactgtacttcctaacaggattattgcatgaatgtattataaaggatacatgttgaaagaaatactaagccaacagaaatagcaaagcaaatgacccaagcttcaactatcaactatttaaaagtgaagatcttttgaaggagtaattatattcttttatcatcaagaaaggttggatccaaaggtttttcaatttacttttttttttactgtatgatgtattttgccttaaatgtttttgtttttcatattgctctcttgcaaatgcatacatgtttatatacatacatataaaccatatatattatgtagctttatacacgtatgtggataatatgaattatacacctatatgtataaatcagagtatacaccaaatatacataagaagaatataccaccaactagaagtctttgataatatattttgttaatgtttcgtttatatgttttgaactaaaactgaataacttgatattaacatgtaacattactgaatgcacactatatgccagacattgttctaagtgctttatatgtagtaacttgtttaatattcaaaacattatgaagaaaccatggcccaaaaaggtgaagtaatttaatccaaatcacattgctattaagtggtgggcctggacttaaacctaggtagtgtaaaccaaaaataaaattctaaggcttccaaccatctaaatagacttccccttcagccagggcttttttctttcttttcttgttgtttttttttttttttaaagagacaataaaaggaggtttttttattcaaaggtataactggataagtagatttgtttacaatcattcttgtgaaatacttttttaaaaaaatacgatcaacttctttgcaaatagtagacacatacctcaacaatgatgacctaatttttgatccataatgtaagattaggtagaaataggcaagctcacactgctaaattaactatcaaatactcagtcaaaactccatttgtggcccccacttcttgatctatttctgttccacttcgtcttctaccatcttgccgactttcctgagcaactgctttgtcgactctctctacctgaccaattgccagatcgacaacctgactggcctgaccagccactcctctgtctggaattaaaagatgtttccatcataatattctttaatttcaggtaatttagctggcactgagagtatccagccggaatcatgccactttgcctgtaacctttgactcaattggaggaatatcaaagcaaacacccatatttcctttcaggaggcacactctggtaatctgagacactgcattactattcagctttctaagttctttccaagcacagctgacatcctgtatttcctctaggctttccagagtcatggtcacaaaccccttatcagagttgattaaagatcatggttcaaagcttgatacaccagaaatgtgggctaaagctgcagccaatgcatctatcgcccctttctcttctatcagtatctgagctgatggttggaaaaaaatcaacagcagcataagaaatggaagccagagaccttatggcatccatgcttttaaatttaactaaatccattgtagaaggaacacctacacatttaaaagtaatttgtgttttttgttccacatgtcttagttgacctttctcttggttgataaaaacatatacaaacccctgtctgtccagctttacccacgcatccagagagatggatataggactcaatatcctgaggaggagaactttgaatcaccaggtcaactacaggaatgtccaaaccacgaggagccacattggttgccaccaaaactttataattacctctctgaagccttttagtgtaatttctctttgtgactgtgcaatgtccccatgtaaacacagtgcattctgttttgtgcggattcatggccatgtcagttacattcttcttcgtctcacagaaaataatagccctcccttcagatccactgtagacttgaaggacatctcattttcatctgtgttttataaaggaggaaattgaggacctcacatggagggactggaatttaaaaccaggtcttctgactttaaggcctttcttttagtgttttcccttttcttttccttaagtcactaaaatctgtagttatataatcttacataaagcatatgcaaaatagaaaaatgatagtcaccacatatctactaatgggattaaaatgtacaatcctaaaagcttacttgttagcacacttgcttatctgtccattcattcattgaaccagtaagtatttattgagagttagtgggaatacaatgctgtgcaagacaaacaagatccctccattcataccacttaaattctagtggggaaaacatctgcacataacaaactaaataaaatgatcataaaataataaatgctatttatataaaactggctactttcattactgctcagttaaagggtcttgtagctcattttatgacatgaaaaaaatcaaggtctaaaagctccttgagacaatttaaactctaataccaaatatacctctataaaataccaaactgagctaaatacggtatatgtgtacttatacatatgtacataacctaaatatacgtgtgcacacattatctatacaaagagccatactcagtgaaagataaattacctcctaaactaaagtcccctctgaggtacaacagaaattaaaataattgcttctcttctcaactctatgtagcacgtattttccatgatgggataaatgttttcatttcaagtgccaatgtgtgaactgtaataaacattactgctttc

SEQ ID NO: 553 - DNA, 79061 bp, Homo sapiens
agtcacagccaggtaaccctggagtgaagcggtttagttagaagggagcagataaactcgtcactctagtagctttaaccctcaccctgaggcaccttagcaatcagccattgcctgcaagcctccaaagcttgtctttgcctaatatggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggactgaatacaaccagaaattacaaggtaaccaaaaagaaatcaattgtcccagttactgcactcccagctccatttctgctacgtttccaattgcaaagaaaacacacaaggcagaggggaaaattgaataccacctctccttcccacaaaataagaagatgaaagtaaatgtgacctataaattatagggaaaaaaatttattacgtgattcaatgttaaagagtcaattccgaattactcttaatattgctgtgtttttcttttttttttcctggtgagggtaatcatttttcttctaacttcctcttttcttctcccttctctacccaacttaagaagtgggaaacactggaaagcaaatgagttagaaacctacaaaagattgtttatctcaatgggtagatatgtgatattacaccatgagatatatctaggtaatggtactgaactatgattgtggttatcttaaataggggcatgaaactataatcgtgtctgtgacaaagaaggaatgttatagtcagagagacggtataaaaagatttgctgaaattcacttaggtgattatttcctttgagtaaattgaataatactcaaatatggtaagaaatgtttagcatgcttattttgaatgacatttgaggaaataacttcagtttattttgtgatggtacaaagataatttggcacagttatgatagcacatcatttgtttcagggccttaatctatatcctgtcctatctatcctttctttctctcctgtttcctgaaggtcatttgttctagtaaaatttcattttgatgttgatattgggcagcattttaagtcttttcttcggtacttgttatgtggtcctccagaacttgcctctcctgcttttagcacaaggtgtgtctgaactctcatcatcccactgtgagctgtcgttttggatttaaaaactgtgatgaggtcagaaagaccgataggacatgcttatatttaacaaatctctttccacaaatatgagcttagatttagttatgcaaattaattaagttaaataagttaaattaaatgcatttaaattaaatctaaaaattattactataagttaatgtgtaaaaataaaaaaaaaattaccagtagttcagcactaaagcacagcatcaatcttatcctcaaatactttttttttaaaatgagggagagcattgtttaatctttgaaattaatttttctccaagcaatagatacattggaaagaatggatgtcttaaaatttcaacttttattttagattcagggggtatatatgtgtgtttgttacttgcgtattttgtgtgatgctgcgatttggggtacaaatgatctcatcacctgggtactgagcatagtacccagtaggtggtttttcagcccttgcctctgtccgtttctcgccactccagtagtctccagtatctattgttgccacctttatgtccatgtatgtctaatgtttagctctcactcataagtgagaacatgcagtatttggtttgctgttccagcattaatttgcttaggataatggcctccggttgtatccatgttgctgtaaaggacatgattttgttctttcttctggctgtgtagtattccatgatgaatatgtaccatgagaatttaaaatcatacacatttagtttctaaacctggttcttcaacttactaccaattagaacttgagcaaattacttgaaatatctgagcctcaattttcctgtctgtgaaagtgggactaatgatacttgccacatagtgttgttgggagattgaaattagataattacaaaacatctagtatactggctgataaattttaggaataatgggtaccataatgataaaacagaacttgcccaatattaatcgaagtttgtataccttatttctctttttcaattcttttttgtcctttgataaagagaccacatctagaaattcaggaaaagcccattgctttatccctaatgacatgttttttctgtctgagtttcactaattcagcatctatcagagtctccattagcaaaataaaaacagaaaataatttttgctattcacaaatttttgcttactaaattttcctaaaaaaataagtctatgaccacacaagagagcagacatgggttggttactttgcagaagacctcagacttcttacgcacttcatttgatttgtggctttcctgtgctctgttggattctttgaaggtggaaggcaaaactcagcagttaatacatgcttctagtctgtgcttgagaaaaatcaccaagaagtatagaggagcacataagccataaagataggctggcctcctgagaagtaacatcttaaaaacgtaacccttaaaagaatccaagtctgattatcgaacgcctaatagagcttttagcatggttcgactagaacagggaaggcgacaagggaaggcattttctcattaatgttcaaagcaatcagttctgtgcgtttgttctctggcctgtacgatacccattattatgcagatgagtcctaaatcaccttaagaagctctttattattcaaatgccgagagattttcctctccctttcttggaactggtggtccctgggaggcactgaataaacacctggactggttagagccctcagatagatggcctaaagctcttgtgaggtcaaagagtgctttcaaatactggaatttctggcaacaccacattcctcaaattatttagctggttatttaattagttatttaattggttgtccttcaatgctatattacctgagtaaaattcactgctctaactctctggggaagcaagttctctgggttccgtaaaatgtaagatttttctttggtgctcttgagcttgtcttttaactcatgatacctagtctatctgttcaattcaatttctcacatcactttagtagcatgaaacttaagttgtaataacaattttaaaaatggtacactggctgaattaaaacgatagaacatggctctaaccaggacatcctaaaacctttgcagaagattgtgatcacatcaacatagtcattcctactaagcctggagttgtataataatagaaaggccacccttaggctcccttactccttgaacagattaattcagttgactagcatttattgaatatgttataccttgttctttgaaattaatttttctcaaggcccttgatacattggaaagaatacaaattgtaaaatcatacacatttggtaaattgacatttattgaatgttttagatgctgtgtcttgagggttacaatgaacagcaaaaacagaatatgtgccaggaattacaactacaaaatcatcaagaaaacatgtctgacctttactccaaagaggctcaaagtctggttgggaaagataagacaggtaaacaaataaatacaataaagtggcatgatagaagtggaggtaggatcagtgggtccacaaaaggaggaaacggtctattcaggactgcatgaaggaggttgtcagaaaatggtgtctctaagaaatggtaagggtagggatgagggaaggtacaggtaagagaatggcattttaacctcttcactgtatttagctctgtctgaaatggtttttgtttccttgtttatcacctgttattgactgttgttcccctcccttttctctccctccccgctcatacaccatgaaagaaaccctatctgtcttgttaactgttgcatctcagcagcccagaatacagtaaacactcagtaactgttaaatagagtgaatgacttgaatgatcaggcccaagcaggaaactggtgtgaagaaagacaccatggcctgaaataagagccattgtatttatctaaatatgtgaggacacatgtttctatcagaaagatgattcttcagttaaatgaacatcagagattaaaatgtacagaatttatataataagtaattcttagtggaagcctgtttcattcccaactcgacctttcagagcacacaacaaccatatttcaaaaattcctcttctattagtgacaagagccatcttaacttccactagctcaattcctcatttccattctactgggagccatagaaattacctaaatacaagaaatttagtggttgagttgtaaaaactcagaaagggtttcataaatacttatatacatgatctctacatttgaaatatgcctaatttaaatagttatacagaactgtgtctgtgcatatgcagatatatatgtgtatatatatgtgtgtatatatatatatctccagtatgtagatatagatatacatgtatgtacttgtatgtgttcgtgtgtgtacttgagacacttttttgcaatgattagactttttattgaaagttactataaaatttgaagaacaaaaagaacaaaagtttactaacattcaggagtcttttctgaaaaccatatatgaattatatcactgacattataggtttcctctcagtatgggtactatggactgaatgtttgtattcctctaaaattcctatgtgaaacctaatccccaatgtgacagtattaggaggtggggtctttgggaggtaattaggtattgagggtgaagctttggtgaatgggattagtgacccttaaaaaaaaaaaaaaaaggcaagagagagcttgcttctctctgctctcagccatgtcaggatacaagaaggtggccatgtgcaaaccagggagtgggctctcagcaggaataagatcttccgcattaggaataagatcaacttgattctggattttctagcctgcagaactgtgaaaaataaatttttggtaaacttaagccacctaatctctaatatatttgttatagcagcccaaaccaaccaagacgggtcgattacctttatcctctatggccacactaaacttctggttaattttctggccagtgcatatttttgtttatccaacaccaggtgaaaaggtgagaatacatgggtaaaatgctattacccattaccactgccggtaacacaaggcaaaaattacgtctccatttcttagtgtgtctgtggtaccttctatttttgcaaaggctattgtatcattctaattaagaaaggttatctttatgagacccaaagttgtcttaatatggtgcgaaagatgaaccaccctactgtatgaactttatacaaaataacagattgtgccatgtggggacaagtggctcaaataataaattagacttggtaagactatgagggcatttaatttaaaatgttttttaagaatatagacagtctgtcagggagcagaaattaacactggaagacttggtgagttttgttcaaggccaaatgaagaatggagtaaaacaaattgtccagcttcctgtgcatgtttctatcccagtgctacaaaccctttttgttcgtgtctgttctttgattagtgagtagctccttcccctttatctgccttcatacactctacagtgaaatgggaagtatttgaatcagtaatgtgacaccagtacaaacaggtgtgtgtcatagtttgaagggcaaatctttctaaaaggcaagacgctttaaaaactcagtaacttttgtcttactgcatatatagaaaccagtgtaaaacacggtattttactttcctatttttttcagtagagacatcttgcagtttttagaaggaccatttgtgtcaaataatgtgtgagtcacagaaattgagactgtttgagctattctactactaccatattgtgatgggcaaatttattcctatgtttgaccgatatgactttaggtataactttcttaaaagtagcaaacacaatttctagttgtgctttttttttttgtttataaaaattatgggtttatcaaaatgagacatcaagaggaagaaggaatgaaagaaaggaaggagagagagaaggggaggggagagacagacagaaaccaagcaagcagcaagaatgaatagaaatataccttaaaatagtaataaagttggagaaatgatgggagagagaaaagcacccaagccacattcatctttgtttctgttgacacaggaaaagaaaaaaaaaaacctctgtttacagaattactttttcttgatgccataatcatattagcatcagtacctttatgaatattgatttcctgataaaagtagaattattgcaagagttgctaaatttataagcagtatcgttcttagaaccagtcaagactcaaagttatggcttatttgggagtcctaccttcacttctagactgtttctgagactgtggaattttctgttcaacaggcctcagtactggctccaacatttgcttggaccgcttcttatcccatgctctcaagggcagactgtggttgctggtgtgcatgctcttaggcctaaggcacaattgatgatgggggtgtttctggagcttgatcatgctggagtgttcagatcatgtctaccaggttcctctgggtgggaaagctggtagagagaagagtagggattcaagcctcaagattaggtaggagtgcgtgtgtcccatggtcccctgccaaattttggcataaaactctgagggatatgagaaatctaaattagaagttggcctttcagattgttataaaatatatttatcaagacagaaggaaatatcacattttatttaatagtttgccagcttcatttataacttttaaatatgtagatctggtatgctggcctccatctgtatccttgctccaggtcccacaaaggaggcagctatgtgtggtttttgactgtaatctatttcaggatataacccttcttctatactaggttgtgaaagtaagagggaaggggagggaaggaagagattgagtattagtgttatgttatctgctaggagctatgctagccagatgctgtcacacacactgttactgaatcccaacttctcttctgttcagttctgattttatcattgagaaaaataggtggtaggccttgggtttgagatgtcacatgcttgaaatatttgcaaaatggaatgaatttaactagttgactcagtaggtattttatacatatgatttactaagaagtcaaagccatttgatggttgcagcacatgttttgtaatgtgatgacatttctctgctaccataataaagcttaacttgctgtttttcactttggaatatattttctttcttttgacttatagtggcatgtccctgccagactgtcactgtttaataaatactttttttgtttagttgtcggggaacaaaattacaaaggtaggttaagcaaaactgtcttatagtaatagcttaatgatctccatttcctgcttcattgcgtatcttgacactgaaactcatctttctttaattttatgcctgttgtcatttatttgcatctcaataaaacttaatatatatcagaataactgagagtcctattctacagcaatgagaggagggaatacatttgcaaatgaaaagaatggaattatgtgtgggaaacaagcaactttttatctggataggtgatatttcagtagaattgtatgaagtcagcttaaattgtgagtcataacttaaatgcagcaggaacacagagtgctatgatttaagactttgtccaaggttttctgaacaatgtttttcttgattaatgaatcagagaataaatgaatagtctaagatacctgcactgaagccctcgatagaggatgcaatcttagactgacatacaattcttacttaaagaagaaaacttaaaggtcatgtcatctagctactactctaagtattgtgagtcattatagcacttcacagaaactgtttttcctgaatgcttcttaatgttaggtctccagtgtcactacaaaaagccatcacagatttctccttctgtgtttgttgtgaaatggttgatgaagacattgtttacctctctcagattttattcaatggaaagctgactctccttaagaataaaaacacatcccctcccagataaaaacaagcaatttactatatttagctgctaggagcttagggtcaaatttgtttttgttccctggcctttatattaactattttgtctgtctaaaagtttctttcccatagaggcagggtgtggtggctcatgcctgtaatcccagcactttgggtggccaaggtgggtctatcgcttgagcccaggagtttgagaccagtctgtgcaacatggtgagaccctgtctctactaagaaaacaaaacaaaacaaaacaaaaaattagctggttggtggtgcatgcctgtaatcccagctacttgggaggctgaggcacaagaatcactcaaacctgggaggcagaagttacagtaagctgagatcatgccactgcactccagcctggagtctcaaaaatagagtagaataatagaatagaatagaatagaatggaatagaatagaatagaatagaatggaatagaatagaatagaatagaatagaatagaatagaatagaatagaatagaatagaatagaatagaatagaatagaatagaatagaatagaaaagtttctttccccagatctctgcaagagcagatttttatcactgaagtctctgttcgtcttttttgggagtccctccctgaccatccgacctaaagtgatgtaggtaagggaatacctttcctctaccctcttaaattctgtgactaggacctgtgaattgtatagacaaaagacatactaacaaaagaaaaagcatacacattttacttgaggttaacatttttatgtgtcgtaggaggctttgtaggaagaaagaagtaaaaacctcaaagaagcagttagacctaggggtttacataacattttaacaaaggtcataaattgtggagatatgacaaagccaaagtaaaagagtttagggttggggaaagaaattgtggaaaagtgactaggaaatacatgggagaagctaatggaagataagggttatttttgtaagatttgtttgtgtagattcatctctgtgtcaactccctgtctctgatgatgagaatattcccttcttggtgatacagggagggcacttttctcatggtaaatttacactctgcttttaagtaaaaaaggaaaaggcagagagcccttcctgcatctgctattgagcatctccagctcaaaataatcagtatcccaaagtggcatatttagggatggtgtgttctgatccccctcagtggctttcataccatctattactctatgaaattatactacttcattctatttttggcttttgctgtcatttgaatataattctccttggggaaaaagacttagcatttaagcaatgcctggtatacagttattctgctcaatgactatttattgaatgactttaaaatatccagtgaataattacaactatattgatccttatgacatacttgcttttacaattctgtcattttcacttacccactatgtaatggtagttaactttcagttaatttctttacattctttttctgtaaagaaagattataaataaataaatttaattaaagaagagactagaaagagtttcctggccaagaaaaataggatctctttttaaatgaatttattcaacaaatatttgctaggtattcgtatgtgccaggtatgactaggtcctaagaatgttttttaaaatatcagaagcacacccagcccactgagtgagacaggttgtgaacaaattattgcagtaatgtaacaagggcctgaagtatactgcaaattgggtttccgacttgcaaattctgaaatagagattcgggtggaggggaattattaggcaacattctgtgaccaccacctggggaagaaaagggaaggacataagcctgggcacagggagaggccgagctgtgatgtggtctcattggaagctttagccaactctgagggaagttctgaagacagatgattttttggagttgtctccagtgttgtgaaggacctgggcccttgtatcacactttacgtttggggatgtggctatcttgggaaaaggcatggcctgagaggtgctttcatctgagataattcctaaagagggcatatctgctggttgcactcccggcagctgaaataataatttatcccttcctttaaggggaacgggtgctaacatggcatccaccacatattaagtggttattattattagagacacaaataaagcaatataggagctatgataagaaagagcttaattgcacctctgaaatgccaaaagaaaatacactgaaatctgaatcttgaaatccaattaggacttttaggggcagaagccattccaggcagagggattatgctggtcctcatacatggaacaaggtaataatactaatttttgtatttggggatttctaaatggaagagcaggtacaaacaccaactgaacatctgtagtaggcacttaggtgcagtacgtcatttcatgctcttagcaactttgcaaataagttattgccatatatttatagatgataaaacagaggttaagagaggtataagcattctcccagtggtcacatagctattaatagcaactggtgaagtcagagttttcctgaggtttgcttggctccaaagtcagggctttttcaaccatcatgcagttttcctgttctaaccttagtttttagtagtagtacctgttttatggtttgctcttaagaaatcaactgattttaataaacttttgaacaatactcacaagcatcaagagaactgtaagttctgccaatacattcatcggcaatcttgaagtgaacagtgaccaacaagtatttttcagtagctgtgttattttatgcctctcaacaaaatgttctatgtgcttggaaattagaaagatatgtacttgcattgaataaggtccatacttcacagaaacactagaatattctgctctaaaaatacaaaactgattatctgaattatctagtctttgaaaactccttgtcatcactaactacagagtacttacctggattagggtactcagtgaaaaactgggtcagaatgtcaaactacatggctcctttgcttaacactcctcattgcttttcatttttctatagctagcagcagtacccaaagaggggaatatataaaccccaggagattttacagacaatctattgtgcaaagaaaaaaataggtttgtttttcagtattgctctttgaaaatatttattgttgtgcatgcttcataatatgtatgatacattaatatgatacgtatattagaggtgtatacacagaacagtttaactgacacaataaaaacatttgcagtaaaattctgacacgctactacatggatgatcatcaaagatattgtgctaactaaaataagctagtcacaaaaggacaaacgctatatgattctacttatatgagagtagtcaaattcatagggacaaaaagtagaatggtggtttccaggggctgggggaaggaggaaatggggaattattgtttaatgggtagagtttcaatttgggaagatgaaaaagttgtaatgattgcataataatgtgaatgtatttaatgatactgaactgtttacttaaaaatagttaacattgtaaattttatgtcctgaatattttaccacaataaaaaatgataaaaaagtttggcggcccttggtttacaatattaaaatggaatgtaaggcttttcccaatttgactctatctcatctctggcctggaggacagtgttacttttgtcaatgaaaagagtcaaactctgtgaaatatttgaagatatttattctgagccaaatatgagtggccaatggcctgtgacacagccctctggagatcccgagaacatctgcccaaggtggtcagccagcaacttggttttatacattttaagcttgggtcaggaaaggtgggacactcatcttctgctaaagactttaaataaaaacattttctgaagtacccatttatttaactcctcattgctctgtctgtgctatgctgatcactgtcggagcctgtaaattcaaaccaataccacttcagtatttttcaagacaggtaagctttgtttaattcctttttgaaatccactaatctactttctatgccaattagcagtcagaggaaataaatcacatgcccttccaatgaagataaaatattcccagccccagtatttgagctttcaaattcagagtctcagagggtctgttcctccacattttcacttaatacctcactggctcccctccaaaccctgtctgacatgcaattattttcaacctatttcacagaagtctgctccattcatctttctgtgggtcagatttccattgaaactgattttaaacgataaaagattttactgtgtgaaacgtatgttggtagggctcgacgcaatgctaagccaagatttttttgggtttattggggcagatatgaaattggcagcatggagagggatgaaagaacatttataatcatatctgggggtttcgtaatgatctgtctggaataaaactgtatattgaattatgggtgggtgtttgcactatacgggtagaaagggaatcggactgatagaggcagggagggagtgttggtcagaagttctgaactcaatttctggctttgttacttaaggtagaagacttactctctctagaaattagcttcctttttttatataatgagatagagctgagcagaacttatcaccttatctcctctacctgctcttttcctgttgttccctatttctttaaatggcaccatgacccagttaacaagtcagaaatctgagagtcagctttgacttctcctttaccctctgcattgattactcaccagttcatgctaatttcacctcttgaatttcccttgatctgctctgttctttctatcttcttggcaattagactaagcttaactccctccttctttcccctagtgactggactgtccatgcgaagagccacttcactacccacaggcttcctcctcaccctcccctctcaaatctagttcagtggaggccaaagtgatcttgctaagagaatctaatcatgtccctcatttattaaaaaattcctcattgtcgagatctgtctcctgagaatttctctagacttgtccccttttcacaacctctatcacttgtacttcagctgcactaagttgttttcgcatctttttttgccaccaagcctttaaatatactatttcttttgctcatgacacttttgcatttctcttcaccttgtgctacctgtttcagatttcaactgtgtcacttctccataggactgatgtccaggctgtgctatgcttgcatgggtcacaggttatcataattctatttatactaactacagttttaatttttttatttttaatttttgtgggtacataataggtgcatatatttatgggttacatgagatattctgatacaggcatgcaatgcatagtaattccatcaggaaaaatagagtatcaatcacctcaagcatttatcctttgtgttacaaataacccagttatactctcttagatattttgaaatgtacaattaaattatttttttattatagtcaccctattgtgttagcaaatactgggacttacttattatttctaactatgtttttgtacccgttaatcatccccctttcctccactacatcctccagactacccttcccagcctctggcagccatcttttttttttttttttaagagacggagttttgctcttgttgcccaggctggagtgcaatggcacgatcttggctcaccgcaacctccacctcccaggttcaagcgattctcctgcctcagcctcccgagtagctgggattacaggcatgcaccaccacgcccagctaattttgtatttttagtagagacaagatttctccatgttggtcaggctggtcttgaactcctgatcttaggtgatcctcctgccttggcctctgaaagtgctgagattacacacctcgcctgccatccttttactatctatcttcatgagttcagttgttttaatttttagcacccacagataagtgagaacatgcaaagtttgtctttctgtgcctgacttttttcacttaacataatggcctccagttccatccatgttgttgcaaatgatgggatattattctttttatggctgaatagtaagtactccatttacaccagtttttaaatactgaccaatattttaaaatgcaaagtgatttgtttgcagaatctttctggaataattcttaatcttttaaatttgtctcattcaactcctaatataacagcagtgctttggcaacttgactttataaaattatgtcaaaacattaaagcagttttcacagaaacatacacatggtattttaccctcatatttcattaattatgtaagtttcgttaaagtaatataattacaaagaagtacaactgacataatgaagtcagctgttgaacacaattaagtcttgaaaaatatgccccttgattgttaagtggagaagtacatagacatcagtttgtgtatttaagggagataatggaaaatgttgatttatctcatgacttcaataccctgtctttacttctagattatacatatcttgatggtaagagctgttgtttattcatttaatatacacaacacaaagcacaatatcaactcaatatccaatatgtaatttaaaaaattaatattaaattagatataaggtttttttttcttttattattatactttaagttttagggtacatgtgcacattgtgcaagttagttacatacgtatacatgtgccacgctggtgcgctgcacccactaactcgtcatctagcattaggtatatttcccagtgctatccctccccccctccccccaccccacaacagtccccagagtgtgatgttccccttcctgtgtccatgtgatctcattgttcaattctcacctatgagtgagaatatgcggtgtttggttttttgttcttgcgatagtttactgagaatgatgatttccaatttcatccatgtccctacaaaggacacgaactcatcattttttatggctgcatagtattccatggtgtatatgtgccacattttcttaatccagtccatcacatgaacagacacttctcaaaagaagacatttatgcagccaaaaaacatatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggtctataaatcatgctgctataaagatataaagttttttaactccaaagactatggaatttgtaaaattgttaacttaccttcaaattctaatattctttgatttgtatgtaattataaacatatttgtgttgtgatgaaattatatattagttaatggccagattcttgtgttgtattatctttgtgttctccacagtcaaatgactgtgaaagttgctcaataagtaagtatcaaatggtgtatgtgtgcctgcctggttggttgttgggagtatgagaatgttccaacattcttgaagtatgtctttgttagcagcatgagaacaaacgaatacatactgcattttgtttataaaagtgcatattcctgaaaattatttttagggtgagggcaagtgctgttaagtaaggcattaaacaaaaccttaagcttggtatatgaaattattcactacaactattctttactaagagatcagtaagatttcaatacaattaagaaaatctaaattcaggattatttattggtagctattgaaaaacaatatcagaggggaaccttaatctaaataaacaatgacttagaattttacaagtaataataagctgtgtactttagcaggacacagctgtttaatcatctccttgcccattaaacttgtttgagaagcacattctcagtgactgctcagaaacttatttgcattggtgatttagctttggggtaaatgattcagatttttaaaattcagatgttattatattatgctaaacaacatgccagggctatatccctagctcatttgaatttagcctgaataatagcagtgcacattaggcctggtgttgaaccgactttgtagcagtctttgctgtttttgctttttccagccaaggagggcaatttcctgatagatggtcaatctcccctcttgcccttggaacatttccaaggaaaagaaaaagagggaaagcaggtgtagccattcacaaccagatacagaataatggcaagtaaatcatggtcgtaaaaacaatgactgacattttttgagaggtttctggtatgtcagacattgaattaagcaattttcatgctttatctcaattctcacaacctcctagcagtgagcagtggttaacatgcaggttcaggagccagactggcttaggtttgaatcctggccctccactttcagtggtgtgaccttgggcaaactgcttaacctctgtgtgtgtcagcttctgcatgcgtaaaaggaagggaatatatatacatcttattgtgtttttgtgaagattgaagagaaaatgcaaaacaaactcagtatttgcactaaaaaatgttagcttttattatcatttaatattactattattctttttctctttctacagtgaatcaatttagtgaatccaaatgactttgtccaggtcacagaggaagtgggtgtcattgccagaactgaactctatgcctccctgtccagcaaaattccactacatagaacatgatgtaccatgatcacgacagttccagtcagggagtgaagggagagagcccaggcttcggagctaagcacataaagtttgaatccagctcttctgcatattctatgaatcactgaatatatttacatacattcactgtattcagtttcatctctaaaattagcataatatcccatttttagagttgtgagaaagataataaataatgcatattttaaaaactggtaaataaaaagttcttgaaagtggttgctcttattataggcttatcacaatacattataatcaaatataattgcagtaatagtgtataatgctttaatatcaaaaataatttgggggaacatacacgtttataaacaaaatgcagtatgtattagtctgttctcatgctgctgataaagacatacctgagactgggtaatttataaaggaaagagatttaattgactcagagttccacagggctggggaggcctcaggaaactcacaatcatggcagaagaggaagcaaacacatccttctcatggcaacatgagaaggggaactatgagtgaagagtggggaaaaggcccttgtaaaactgtcaaatcttgtgagaattcactgtccaaaaacagcagcctaggggtaaccatccttgtaaccatccttatgattcaattacctcccaccaggtccctcccatgacacgtagggattatgggatctacaattcaagatgagatttgggtggggacacagccaatccatatcatggtatatatacacaatggagcatcatcagccttaaaaggaaaggaaattctgataacatgatataacatcaatgaaccttgaggaaacatgatacaacacagatgaaccttgattacattccgctaactgaaataagccagacacaaaaggacaaatactgtatgacgctacttatatgaagtacatactagtcatattcatagagacaaaaagcagaatgatggttgccaggggctggagggaggaagaaatgcataagtattgtttaataggtataaaatttgcttagaaagatgaaaacattctggagacgtttggtggtaatggttgtccaacaatgtgaatgcatttaatgccgctgaactgcacacttaaaaatagttaccattatacattttatgtcatgtatattttactacaatgaaaaagttggagaaaaaagaatatatccatctacgggaggaaaaatttgttattaaaattattgaaataagaattgcagtcctaaaattaactcatacctcatcctttttttttctttttctttttttttttttttttttgagacggagtctcactctgtcacccaggctggagtgcaatggcgcaatcttggctcactgcaagctccacctcccaggttctcgccattctcctgcctcagcctccggagtagctgggattacaggcgcccaccaccatgcccagctaattttttgtatttttagtaaagacgggtttcactgtgttggccaggctggtctcaaactcctgacctcaggtgatccgcccgcctcagcctcctaaagtgctgggattacaggcgtgagccaccgcgccctgcctgctcatgcctcttcaggaagatttttgatattttgcgttgaattcctctaagaagtcatttcagtctttatatttcacagtagtgagaaggagtgcatgactgttcttacccacacatatgttccttttcgaattggcagatgagtattcatcaatgtagattctaacaatactgtcagaggagaaataatattgttgtgacaccaagagaacatttttattgtacacattaccttggaataacatttttgccaggaaatttgatgcagcatacatatggtgcctgatagaaagaagccaggcgaaagtacattagtcctgtgtgttgtacatgatatatagtcaaacagcctgtgagatagaaggatatcattaactatgaaggtcattccatcatcagtataatgtttggaacaaagatatattcagttatgctgtttactctatttatacttcaactctgcatctttataaacctacctttctatgtgatttttaaaactcacagaagacttttttttaagaagagaagatctgttttgtttaaattgccttgcactccaaataaaaactattatgaattttaaaacatgacttcttctgacattgaaactcttcttttttttccaatgactatataactgttaaaattttggaaaaatattttagtatgcccaggaagccttgctatgtctattctatttgcatttgtttcatagtctcattaggttcattttccccctaatttttcatttgtggtaaaatgcacataacaacatttaccatcttagccactttaaagtgtacagttccgtggcattaaatacattcataatgttctgtaaacatcaccaccacctccagctctcttttcatcttgtaaaaatgaaactctgtaactattaaacaataactctctcttccccccaatcctcagcccttggcaaccatctccactttccgtttctatgatttcgactattctaagtacctcatacaagtgggatcatatgtatttgccctttgtgcctggcttattttacttgccataatgtcctcaaggttcatccaggttataacatatgtcataattccctttctttttaaagcttgaataatattccattttctgaatattacacattttgttcatctatttatccattaatggatacttgggttgcttccatgctttagctattgagaataatgcaatcctaccaacaatactcaagaattccaattccaatttctccacatccttgccaacacctctggcttatattttaaaatatattagccatccttatgggtgcaaagtggtatctcactgtagttatgatttgcttttccctcatgattagtgatgctgagcatcttttcatatgctgatgggacctttgtatattttctttggagaaaaatctattcaagtgcctttgctcattttttattcaggttgtttattttgttgttgttattgttgagttttggagctctttctacattctgggtgttaatcttttatcagatatacaaatattttctcctatgctgtaaactgcttttttattttgttgatagtgtcttctgatgcacaaactttaaaattttcataagtccaacttttctgtttcttcagaaaagaagaaaaaagcctgagcctttgtcatatccaagaaattactgccaaattcaatatcatgaaatttttgccctatgttttcctttacaagttttatatttttagatttctgatccattctgagttaaattttgtatgtggtgttagataagggtctaacttcattcttttgcatgcaaatatccaattttcccggcaccatttgttgtaaagattgtcttttccccataaaatagtcttggcacccttgtaaaatatcatttgaccatatatgcaaggatttatttctggttctttattctgtttcattagtctgtatttatgccagtaccacaatatgttgatttcctgtaactttgtagtaagttttgaaatcacgaagcatgagttcctccagctttattcttctttttcaagattattttggcctattgttgtcccttgagatgccatgtaagttttaggatgggtttttttttttatttctacaaaaaaaaattggaattttgataaagattgcatagaatctgtaaatcactttgggtagtattgacggcttaacaatatcaagtctttccgtccatgaacatatcttctcatgtatttatatctttaatttctttaataatattttgtagttttcattgtacaaatctttctcctctttggttaggttaagtcataagtatttcattgtttttgatgctactgtgaatggaaacactttcttaatattttttcagattgttcattgctactgtatagaagaaatgcaactgatttttgtgtgttgactttatattctgctactttactgaatttattagttccaacagtttttggggtgaacatttagttttccacacatgagatcatataattttagaacagagagaattttacttcttttttttccactttggatgcctttatctctttttcttgcctaattgctccagctagaattttcagtactatgttgaaaagaagtggcaaagaccgggtgcggtggctcacacctgtaatcccagcactttgggaggccaaggtgggtggatcccggggtcaggagttcaagaccagcctgaccaacatagtgaaaccccatttctactaaagatacaaaaaaaaatttagccaggcatggttgtaggcacctgtaatcccagctacttggaggctgaggcaggaaaatcgcttgaccccaggtggcagaggttgtagtgagccgagatggtgccattgcactcccgcctgggtgacagggcaagactccatctcaaaaaaaaaaaaaaaaaagaagtggcaagagcaggcatccttgtcttgtttctgatcttagaagagaagccttcagtctttcaccattaagtatgatgtttgctgttaattttttatatatggcttttattatgttaaggcggtttctttctatcccttgtttgttggattaaaaaaattttttatttctatagcttttggggtacaagtcttttttggttacatagattgattatatagtagtgaattctgacattttagtgcacctatcacctgaataacgtatgttgtatccaacatgtagttttgtatcccatatagaataatggtgtccagctccatccaggttgctgcaaaagacattatttcattcttttttatggctatattccatagcacatatatatatgcacacacatatatatagcatatatatatatgtacacacatacacacacatatatacacacacacacacacacacacaccatattttctgtatccactcactggtcagtgggcacttaggttggcttcatatctttgcaattgtgaattgtgctgcaataaacatacaagtacatgtgtctttttcatataatgacttctttcctttgggtagatatccattagtgggatggctggatcgaatggtagatctagttctttaaggaatctccatactatttttcatagaggttgtactcatttacattcccaccagcagagtagaagcattctcctttcattacatctacatcaacatctatcattttttgactttttgataatggccattcttactggagtaagatggtatcccattgtggctttaatttgcatttccctaacaattactgatgttgagcattttttcatgtttgtgggtcatttgtatatcttcttttgagaaacgtctatttatgtcctttgcccacttcttgatgaggttatttgttttttccttaatttgtttgagttccttgtagattctggatattagtcctttttcagagacatagtttaaaagtattttctccactcttgattgtctgtttattctgatgattatttctttggctgtgcagaagctttttagtttaatcaggtctcatttatttatttttgctttttttccatttgcttttagggttttagtcataaatactttgcctaggccaacgtccagaagagttttttcaaagttatcttctagaatttttatgctttcagccctagacttaagtctttgatccatcttgagtttatttttgtataaggtgagagatagggatccagtttcattcttctacatgtggatatctagttttcccagcaccatttattaaatagagtttccttttcccaatttatgtttttgtatgctttgttgaagatcaactgtttataagcatttgactttatttctgggttctctattctgttcccttagtctatctgcctccttttgaaagtaccatgttgttttggtaactacagccttgtagtataacttaaagtccagtaatgtgatgtctccagatttgttctttttgtttaggatcgctttagttatttgggggcttttttggttccatatgaattttaggattgtttttgctaattctgtgaaaaatgattttggtattttgatgggaattgcattgaatctgtacattgctttgggcagtatgatcattttcacagtattgattattccaatccattagcatggaatgtgtttctgtttgtttgtgtcatctatgctttatttcagcagtgttttgtagttctctttgtagagaattttcacctccttggttaagtatattcttagttattcaattttcttttcttcttttttttttttttttgcagccattgtaaaagggattgagttctttatttgattctcagcttgctcattgttggtatatagcaagcagcactgctgatttgtgtacattgattttgtaacctgagactttactgaatttgtttatcaaatctaagagtcttttgaaggaaaatttagggtttcctaagtatagagtcatgtcaccagtgagcagtgaagtttgactttctcttttccaaagtggatccccttattttcttctcttacctgtttgctctggctaggacttccagtactatgttgaataggaatggtaaaagtgggcatccttgtctttttccagttcacaggaggaattctttcaacttttcttcctcagtgtgatgttggggtttgttgaaggtttttatcataaagggatgctgaattttattgagtgcttttttctgcatctattgagaagatcctatgatttgtgtttttaattctgcttatgtgatgtatcgcacatattgactcgtatatgtttaaccatctcggcaacctgggtatgaaacacacttgaccatggtgtattacctttttgatttgctgttagattcagctagctagtattttattgagaattttgcatctatgttcaaaagaaatattggtttgtagctttctttttttttactttctttctttaattttttttattattattatactttaagttttagggtacatgtgcacaatgtgcaggttagttacatatgtatacatgtgccgtgctggtgtgctgcacccattaactcatcatttagcattaggtatatctcctaatgctatccctcccccctccccccaccccacaacagtccccagagggtgatgttccccttcctgtgtccatgtgttctcattgttcaattcccacctatgagtgagaatacgcggtgtttggttttttgttcttgcgatagtctttttttattatatcctttcctgatttttgtatcagagtgatgctggcttcatagaataatttaggtaggattccctcttcctctatcttttgtaatggtttcagtaggattgatgccaatttttctttgaatgtctgatagaattcagctgtgaatccatctggtcctgggtttttgttgttgttgttgttgttgttggcaaatttctagttaacttctcccatctcgctgcttatcggtctaatcagggttcctatttcttcctgacttaatctaagagggttgtatgtttccaggaatgtatccatttcctataggttttctagtttgtgtgcctagaaatgttcacagtactctcaaatgatcattttttatttctgtggtgtcagttgtaatgtctcaagtttcatttctaattgagcatatttgaatcttctctcttttcttggttaatcttgctaatggcctatcaattttgtttatcttttcaaagaaccagctttttgtttcattgatcttttgtatttttttgttttaatttcttttggttctgctctgatctttgttattcctcttcttctgctagctttggattgagtttgttcttttttctctagttccttaaggtgtaacattagattgtcaatttgtgatcttttagactttttaatgtggtcgtttagcactataaactttccttttagtgttccttttgctgtatcccagggctttgataacttgtgtcattatgatcattaatttcaaagaatacttaaatttctatcttgatttcatcagtaacctcaaaatcattcaggagcagatcgtttaatttccatgtgtttgtatagctatgggggttccttgtggagttaatttctagttttattccactgtggtctgaaagatagttgatattattttgacttctcaaaatttattgagacttgttttgtggcctattgtatggtctgtcttggaggatgttccatgtgctgatgagaagaatgtatattctgcagttcttgagtagaatgttctataatatctgttaggtccatttgttatagaatataagttaagtctgttgtttctttgttgactttctgtcttgatgatctgtgtagtactgtcagtggagtattgaattttcccactattattgtgttgctgtcttaggtctagtagtaattgttttatgaagatgggagctcccgtgtaaggtacatatgaatttaggattatgatatcttcctgtcgaaattatccttttatcattataaaatgacctttttgtcttttactgttgttgctttaaggtctgtgtgatctaagaataaccattcctgttcgctttggtttccatttgcatagaatatctttttccacttttttaccatgaatttatatgaatctttacattttaggtaagtctctggaagacagttgatatttggtttgtgatttttttaatccattatgccaatctgtatattttaagtggagcatttagccacttacatgtaacattgagatgtgaggtatagtttcatttatcatgtcattgttacctagatactttcagtttttctcattatgttactgttttataagccctgtggattttatgctgtcaagaagttctattttggtgcatatcaagcctggctgttcttggtgtataggaatgctagtggggtttttttggtatgttgattttgtatcctgaaactttgctgaatttgttcatcaactgaaggagtaccaggactatggggtttcctagatatggaattatgtcatctgcaaacaggaatactttcactatttggatcccatttatttctttctgttgcctgattgttctggccaggatttccaatactatgatgagttagagtggtgagagcgggcattcttgtcttgtgccagtttttaaggggaatgctttcagcttttgcccatttagtatgttgttggctgtgggtttgtcatagatggctcttattattttaagatatgttccttcaatacctagttcattgacagtttttaacatgaagggatattgaaccgtatcaaaagccttttctgcatctgttcagatgatcatgtggtttttgtctttagttctgcttatgagatgaatcacatttactgatttgcatatgttgaaccatccttgcatcccagggatgaagcctacttgattgtggtgaattagctttttgatgtgctgctggatttgatttgccagtattttgctgaggatttttgcattgatgttcaccaaggatattggcctgaagttttctttatttgttgtgtctctgccagtctttggtatcaggatgattctggcctcatagcaggagttggggaggagtgcctcctcctcaattttttggaatagcttcggtaggaataatatcagcttttattcgtacatgtgtttgaatttggctgtgaatccctctggtactgagcttcttttggttggtaggctatttactacttactcagttttggagctcattattggtctgttcagaaattgaatttcttcctggttcagttttgggagggtgtatatgtccaggaatttatccatttcatctagattttctagtttgtgtgcattgtgtgttcagaatagtctctgatgattgtatttctgtgaggtcagtggtattacctcttttgccattgccaattgtgttcatttggatcttttttcttctttattagtctagctagcagtctatcttattaattttttcaaaaaaactagatcttggattcattgatcttttgaatggttttcatgtctcgatcttctattcagctctgattttgattagtttgtgtcttctgctagcttggaggttggtttgctcttccttctttagctcttttatttgtgatgttaagttgtaaaattgagatctttctaacttttcgatgtgggcatttagtgctatatatttccctcttaacactgccttagctgtgtcccagagattctggtatgttgcgtctttgttttcataggtttcaacaaacttcttgatttctcccttaatttcattatttacccaaaagtcattcatgaacaagttgtttcatttccatgtaattgtgtggttctgggcaattttcttggtcattaattctaattttattgtactatggtctgagagagtggttggcaaaatttcaaggatttttgtacatgtactgagcataattatatgtctgattttgtggttgatttcagagtatgtgccgtgtggcaatgagaagaatgtatattctggtttttttgtttgtgtctttgtttgtttgtttttttgagacagagtcttgctctgttgcctaggctggagtgcagtgacactatttcagttcactacaacctccaccttcctggttcaagcaattctccaccactaagcccggctagtttttgtatttttagtagaggcggggtttcaccatgttggccaggctggtctcaaactcctgacctcaaatgatccaccaacctcggcatcccaaactgctgggattacaggcatgagccaccaagccgggactattctgtttgttttttggtggagagttctgtagaggtctagagggcataatagagactgtaaggaagaagcattatttgaagtactccttgtctgtttaactcaccccacctgcaggagtagttggaggccaagaacaagtcccggtgccccgtagccccatacaggattcccagctttctctgccttgagcccagcatctgtggcttccttctgtcccctctcaatgccttttctttgaagatttactaggagtgcaccagtcttcccagtgttttggtcacttggtgggagatgtttctcctgcttgcatgtagttggccatcttggaatgaactcaggaatagcatctttcaaaaattctgaaaagctcccagctttgagcacttcaaataatgttcttccttacattctctattataccctctagacctcctagtaaacattagttgaaccttcttattcaatcctcaacatctcctaacctctctcacatattttacatgtctattgcattctataaaattttcttggcttgttcattaatctctttaactttgtataatttactatttagttcattatacaactcaactatttattcaacttagccatttattgattaaacaaaataattaaattttaattattatgagcttttattttaagattctgtattatcttttaaaatccacttgatcatttttatattctcttgtttcttgcttataatttcaaaccattacttgttttttaaacctattaagtaccctttttatatctctaataatttcagtaacttaagactttgtggatataattatgctatcaattttattttctgcatctgactcatggtatcgtgtttccgtgtgtgttttaggatttcttaaaatctcgtattcctatggccgggtgtggtggctcacgcttgtaatcccagcactttgggaggccgaggtgggtggatcacgaggtcaggagctcgagaccagcctggccaacccagtgaaaccccgtctctactaaaaatacaaaaaattggctgggtgtggtggcgggcgcctgtaatcccagctactcaggaggctgaggcaggagaatcacttgaaccaaggaggtggaggttacagtgagccaaaatcatgccactgcactccagcctgggcgacagagctagactccgtctcaaaaaaaaaaaaaaaaatctcgtattccttgcaatgtagctgcaaggaacagttgaagcctgacttgagtttctattcaatttcattaagctttgttcttaatttcctttattctattttcttttggcttattgtatttttttttttttacttatttagttaagagtcaaatcattttcactcttgcttcttttcttgtatatgaatttaagcctataaattttctgtaagcagtgctttacctacattccacatgttttaatttgtaatatttttcttatccttataacagatatcttctattcactttagtcatttcttctgtgacccatcagttattttgtaggttttggttctctattaattccaaaacaaatgagtcctaacattttatttttgttatttatttctacattaatttcatggtagttgtggttctcaatttactaattctttgaaatgttataacttaatttataatgtatttcttcaagtgtccttaaaaatactatgtaatctctaattattggagtaaatattttctgtcctaacagtctatcagttactgacagttatgtttaaaatatcactattaagactgatttgtcaaattctaccttcaactctttcactttttgcttcacatgttttgaaatcatgttatttagtacatacagaattagaattttcatatcttcctaatgaatgggacactttatcactatatagtgcccacttttatttttgccttaaagtctattttatctgtgtaaaatagctatatctcacccttcctttaattagtatttgctcagtatatatttttgtactttcatcttcttgtgtgcttatgttctctactataaatggcatatagttgttgttttttgaatacagtttgataatatggtcacttgagttatgattacacatagatttgaatcgactgccttatatttgtttttctctttcggttttctcctttcttcatttgaactgctttctctcctctactggttttgaaattttacatgctattttattttaatggttggccttgaaattttaacatatatccttaatttaaaaacatctaaagttcattaatgtctttagcttttctgcaatatcacaaaaatgtttaaatgtttaaaatacttagaagtctccacaatctctcccaagctgtcctgtccaccaaatctcttatcctctccccagcgtcctcctacctggccacacattgctctgcttcctgttccttaaataggccatgcacacgctcaccttaaggttttccactgaccagttcatctgctaaaaaccacctctcccagatatctgcatgactctctcacctttcaactctatttcaggcctttcctgccatcttatttaaaattgcacacgttttaagctcttcctagcagctttcatagcattatttttctctatatcacttatcaccttttagtatactaaataacttgtttaaattatttatgttcttcttccccaactagaagtaaagttccataaggaaaggaattttttttttattgctgtatccccagagcctaagatgattttgggctcatagtaagcccttactatttatttgttaagcattcaataatttcagatctcaaatccatatgagagccagttagtgtccttgaattgttaagggatgctatttttttttctattgatcaccaccaaggctgagacaaatcattttattgatgtctctttctttggagcattatttttacttagtgtgtttccttttctgatcctttatctggatatgtttcctgagtatgttcccttttcccactcttgatttaaaaattgcccaataaataaatatttttatctatttatggttcagttcatgaaaaacaaataggagaatagatactgtgcagacaacagcagtgtctgacacaattatgctgttgttacaaaaaagatccccactatatactgttatagttgcaaaagcaagttgcagaagaatatgtatatgagcttgttactgttaaaaaataaaacaaaaaactgaacttctgtaaatatgtgtatttgtatgtgcatggagatattttgagaagcctatacactacactagaatacaaccaataatacagtaaaaataatattacaattaataaatagggattgcatctaataataataaaacattttcaagatatccagtataatgccaggcactgttacaagtgttttacagacattaactaatttaatcttcgaaatcactttataaggctttactaacgttatccttaacttacagatgagaaaattgatacaggaagagctaagtaacttgtctgaggtaatagatctaataaatggtagtggtggagtttgaacccaggcagtctggctcccaaggctatgcacttaaacctctactatatctacatctctctctctatctgtatctatgtctatctatctatagctatagctatttctatgtctatctatatataacttagatagatattacaattacatattattttataatttacaaagaaagaaagaaagaaattacctctccttaaatccaccccaaaatggcagtagtagtagcaaaagcaagaagaaaggaaaaacaggataggataaattctaagcaaaacgtggctatcagtgaagattgtcttcagtcctcccccaacacccctttgcctttgggtgctgttgcacttctctaagagatcgaggttctccccacgcatatacccaagccagataaactgctcaggattctaaaccccagctttgttctgactttcctccgaaagcagcatccctattttttttcctcttcctcttccaactgaactagctgtccacccactttagagtcatgcatttttcttgacaagttggtaaccacaaaataatgggataattgtttgctctagatggtggaagagtttgagactgtagagaaagtaaccctatttttcccattcccacagaaatagttaacatttgtattgttttaaagatctcaaggagcttccacatggagctgctcatttaattcagtcttcatgatcacactgtgatggttttcatgcatagtttacaggtaaggaaaccaaggctctgtgaggataactattagttattagtctactgtgttctcacagctgagtggcagagctgatctcaagtcagattatccttttcccaaactgcaacaacctctttttatataaacttccttggccaggaatctccacatatattattaatgaattttgtggctagaatagtaaaaattcacatcaccactggaaaaataaagcttgagtgtgaaagaaatacagagtgaagtcaattacatggtactgctttaatatacagctgcatatttctgttatagcaatctgaatatccttttaaccttagtttcactttggctttgacattgtattttattatatgcaaactattgggaaacatttattcttaaaacaatttttccttctttcctaaatagcccctccgttgctttttttttttttttttttttttgagatggagtctccttctgtcacccaggctgaagtgcaatggcactatctcggctcactgcaatctccgcctggtgggttcaagtgattctcctgccttagcctcccaagtagctgggattacaggcatgtgccaccacacccggctaatgttgtatttttagtagagatggcgtttctccatgttggtcaggccggtatgaaactcctaacctcaggtgatccacccacctcggcctcccaaagtgttgggattacaggcatgagccactgcgccaggccccctcggttgcttcatccagaaataaaagacgggctatagctgactgctgatttgggcgatatgtgttggcaatattgttgagttccaaatacttttatatataaaagctaagtataactaaaagataaaatgtttaaatgcagagaaagatcttacaaaaacaaaatgtgtccacaatgcattgcagagtttgttggtttaagaaatgcaaacatagaaagtgtttagaaacctgaccataaaatgatgcaagtgaagtttttgttcctacaataaacttgagtcaaaagagcaaacaaagatatctcataaggttgctcaactgtaaattctctgagagatttttacacctgagggagaagttgagtattttcactgacactttatttcacccaccttgcccccacaaatttgttctcaacaagttgttgagcagtattggaaaacctaagcattttttaattgacaaaatctgatgtagtacattttaaagtgcagcaactgaaacgtctgtgaagcaggttaagttaacattgtgattgagtcctggaatttagaactaaaaggaacccaaatgcatgttttagggatattcctttgtcgacgatcaggaaaaacttccttctccttgctaggatcccaaataattcatagattaattttataaggcatagaaggtttagaacctggaaaagcaatgtcagagcagtttttcatcagcatcatttttattttcaaggaaacattaagtgataattgggcagtgtccatactggtttgtcagctctcttacgcatgagatttcctcctgtgctctatttcacatactccaggagtaaaggacgtccctcacacctctctgccctcagtctcccccacccccacccaatcatttcactatgtataatacatcaaaatattatgttgtacatcttgaatatacacatttttaaaaagaaagggccacaatgcagcctcctcactgcagctcctctcataaggtgtcctgtcttcctctttcatatccaaaataattcattgtaatgacacgtgattgtaacttgctttttcaaatctggggcactgagaggcaggctgcttctactttccaatgcaaatattacaaattaggctggtgcagtggctcacacttgtaatcccagtgcttcgggaagctcaggtgggaggattgcttgagcccaggagtttgaggctgcagtgagctgcaattgcaccactgcattccagcctggttgacaaagtgagaacctgtttctgaaaacaaaaaacaaaaaaacaaattagcaagcacccccaaattctcataatatagatcaggattggagggctacaggatatctcatgcattcattctctctccttgaatagattatctgttcttatatagctcatgtggattatgatttatgattatgattattattttgagacagagtctcattctctcgcccaggctggagtgcagtggcacgatctcggctcactgcaagctccacctcccgggttcatgacattctcctgcctcagccttcaaagtagctgggactacaggagtccgccaccacgcccggctcttttgttgtatttttagtagagatggggtttcaccgtgttagccaggatgatctcgatctcctgaccttgtgatctgcctgcctcggcctcccaaagtgctaggattacaggtgtgagccactgctcccggcctcatgtggattatttccttagcactaaatagcccaaatctcataaaaccatgtggttttggatgctatttgtcaaaacttcctgctttcctgatgaaggagggattggtaggcgataaatggttccaaacatactcacctgtgggtctggattgtccaaagatcaacctagtatagcttccaaactgatgctggaattactctccacagatgtttgaatattgagtctctgccttaaatgctgaagttagtggaccagagagagagctcattactttttaaagtgtctgttcacattcctggggcagtctcttgacatcacaccattaactcttctgctatattgtttctccagttgtcttagctttgttcccggagtcagccaagaaaacactgtttattttcactttcatacattgtgacctgtacatttattttttactgtacagactctttataggcccttttgtaaagtcccacattctcagggaatgtgtcaacattgaagatgtctcatataccagttactagaatcatgttaactttaaatgaaatataattacttctgcaactgcagagactaagatgaaaattaagcttcaagcttgaagcaaatccatttacacacactcttacatacacagactcacacactgccctgatgtttatcgccactttgatttcatggtctgtggtctggtttgtggcttccaaaattttacattgctctggggagctcgtccttgaagatacttagctttcttacttgaatacttcatataaacttttgctatgtgtgaggcttcccatttatctcattatctccccagtactgtgactttttaaattaaaactttctgttcgacagttcaagaattttgaaataacaagatatgcttggtataaaagatgaaccatgaaaaatttcagttgaaatttatttaatccaccacttcttcactcctcatggattctgatagtgaattgaaaagaaaaactccaatcatgcaattgttttccatttcattgagatttggatattacccactgagaatgagaggtaattgtttttaatagcagtgacaaaattcattttcatttactaattaaaggcatttcatttactaattaaaattcttcccttgatttaaaagcaaatgtgaacggaagttgtgaactgttttttttatacatttgatctccaggctgaataccggctttataggctaagctacaacaatgggatattttaaagaagccacgataattgagtatcatttaactcacttgttagaggaagttcgctcccacttttcttcttgcttatagttttgtaggggaatgtccatatatcacttcctaagaaaacatcatgaggataccttcagcctttttccttgttaacaaagtccttcgaaggcgttgtttgtaatgaaggaaaaagaaacctcagcagaatgcctcacctgtatatgttttcatttaacagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaaggtaaatatatatttgagatttttttttctctcccatatcataaataggatcactagcaccatgaaattgaagcactcaggtgtatcaatgggatgatgtgcctttctccccaaaacagcactgttctcagctctggggttacagtttagtacaaaacaaagtcctgcccttgtggagttcactttctagtgcagaaaaggaggagtcagacaatacacaataaataaataagcaaacaaaattaagatatgttatatggtgtgaagtatggctgaggaaactaaagcagggaaaaggaatgaaataaggggacaaggccgggtgctgtggctcatgcctgtaacccagcactttgggaggctgaggtgggaggatcacctgaggttcggatttcaagaccagcctggccaacatggtgaaacctcatctctacaaaattacaaaatacaaaaaattagctgggcatggtggcacacgcctgtaatcccagctacttgggaagctgaggcaagagaattgcttgaacccgggagacagaggttgcaatgagccaaatcgcgccattgcactgcagcctgggcaacagagtgagactctgtctcaaaaaaaaaaagagagaaagaaagaaaaagaaagaaagaaggaaggaaggaaggaaggaaggaaggaaggaaggaaggaaggaaggaaggaaagaaagaaaaaaaagaaagaaagaaagagagagagagagagatggggacaaacgagtggtcattctatttcaaatagagtggcaaatgaagacttttccagtggaggacattgagcagagaactgaaggaggtaacagaatggtccaggcaaagtggaatacaagggcaaagactccaaggagtgataactcatcattagggttgtaaatacacaaatcaaacaatatagaaaaacagaagctagaaagtgaaaatgatcagaaattccacggtcaaagaaaattaccattaacacaatcagacatatcccctcagacatctatttgaacacttacatatacatatacaagcacatatatttttacataaatgtgatcaaaactacaaataatatcttgtaacatacttgtttcatccataaatctgttacatgtatctttttatgagtactaatatttttcaatatctgtctactattacagtggttgagatgttttggatgtttgtttccttatatccttagaataaattcctagaaattaattgttaggtcaaagggtatgcatatttaagattttgaataaaatggacaactgccaaacagaaagtcaatatgattttaatattcattcctattaataatgattcagagagcattttctctgcatcctctttaatgctgagacttgttgatttcataaatgttcttttgattccttctgataaatatcttctcatatattcattggccttttctgttattcatatccatgttttttgctgttttaaaaaatgatggtttaatatttttcttattattttataagaactttctgtgtattagagttattctttttccatcccacatgttgcaaataatttttctggtaagtcttttggtttctaaccttgtttaagatgtatgtttattttgtttttgccatgtttagtcaaatatatccaactttattgattctgagacatattttaatattacccatgattataaaagcattgctagcctgtcatgcccccaactatttacaacattcaggagcagattttatatttcttaacacagtactcttctcagatttttttgttttgttttgttttgtgacagagtctcgctctgtcacccaggctggagtgcagtggcgctgtctctgctcactgcaagctccgcctcccgggttcatgccattctcctgcctcagcctcccgagtagctgggactacaggtgactgccaccacacccggctaatttttctgtatatttagtagagacggggtttcacagtgttagccagggtggtctccatctcctgaccttgtgatccacccgacttggcctcccaaagtgctgggattacaggcgtgagccaccatgcccggcctcagaaatattttttaaaaaaccatctggcctacatattagggaaaaccagtataggtcaaggcacttctgacacaaaaattgttttttggtctaagacaatgtataaagaggagtagcaaagaaggcatggaagccttttcttacacaggaagtcatcttcagtttgcctcatgacttttatttaatgcttactatatgtcagatcttgctccaggcacttcattagcattctcatttaatcccccacagttcccacgccagaattaccagacactttctgaaaacctggaaatttcttattcatgatgtaagagtagaagtaatattgatggtcgtgataaaaatttgctctttagtgtcattgctacgtatataaatgttttctgctgtgttttctttattttattaacatataaaccagatgtatttgatataactgctattctggcagatatcaatggttactaacatgttcatttacatacttattcaaatgttgattttaaatgcacatagcatcagactctgtcactacctttccttatggtacagtcctccctgtcaactcttattctttgaaaaatttggaacctagcccactgtgtctatgtattctcactctctcgctctcctccttaattctgacatcttttttaggtaatttcaatattcatgcaaataacccatgcaacattcgggcctctcagttctttcactttttcatatccaacaatctttcctcaatcccattcagccactcacgccagggtcataacctagaacttgccattaccaacaacttcatcccctcaaaatcagaatttcaagcttactattctctgatgcccaagcctactcccactggtacgatttctgacaaccttctgatggcaccgagacctccaaactatggacattactaccatttctctcttcatcgggcccaaagatgctttaatttctatgggtccttcattataatcgctccttgcacacgacctcaattcctttttctctctttctttccatttacttccctgcaacaacttactcgagtgaagttcaatttttcgtctacttcacacctttacctgtgcagcagaattaatctcttataaaattcatgaccactttctactggggcccccagtaatgtttctgaggagattctctcacattcttttcctcacatgtcaaacacccctttttcttctctcagcttatgcccttttccatcatttcataaagaaactagaaacaataagatgtgcacactcccaacaccaaatctaccaacttactgcatctctacctatataagttggcttcctcctattaccggaagcaatggttcccgcttctaatgaaggatgacctctctctgctagtgcagtggattctatcccctcagactgaaaggttttactccagtctgtgtcctttctctctcctgaataattagtttaccctccttatggaatcattcatagcactattatctactatcttaaaaaccaaaatcaaacacaaacaaaccaaaaaaattgttttcctcgatcctaaaggaatcatctatattcattgtctattttaaaattaaatataaaatatttactaggtataagaacatttgtgactaaaacatgtttcaaaataagcacaatttatcaaaaatctgtccctgcgattggctaatgatcaatataaaaaacagtaaaaaacacgcccagttgcagtggctcacacctgtaatcccagcactttggaaagatcagcacaaccaggaggattgcttgaggccaggagttcgagaccagcctgggcagcatagggagacctcatccctatttaaaaaaaaacagccaagtgtagtggcttgcttctgtagtccaggctactcaggaggctgaggtgggaggatcacttgagcccaggaggttgaggctgcagtgagccatgatcacgccactgtactgcagcctgagagacagagcaagaccctgtctccagaagaaacaaataaacagacagacaaaaacatcaaatatacaagaaaagtctttctttgaattcttagtccacatttgtatcaaatggactaagtttaccttatatgaaaatgttgccaatttaaataatctgctacattggtgagtcaaactagccccgctaaaatgaatgtcattgatagctgtattcttatatattttctccaattcttttttgtgcttttactttttgttatttttctttacttgtttttggcttcctatgaaactcttataagcagttctcagaattggtgtcttagaccatgccaggtaaaacttttccattatggtaacatttatggtcgtttatttggcacatttggcttttgctctcaatactgtgaattacaattctcaaaattctaactcacattttctaggttgttttatttgaattgtttataggttgttgatttttcacactttgaccttgttatttagctatctttcaatgctgtctgctctctgccttcctcattgtggactttaatttcattctattagttctctccactaaggtaatagcaattctcttaaggttctcagaattctcatgtcagatctgcctttttcccacttctcaaaacttttaacctttgattaagtaaataaatgttcgggtactcatatgactcttatcagcgtttatatgagtgctgaggtagttagttgacaccaccagttcattcagttcactaccttttcaatgttcgttagttctttcctgttctcacttcccttctggacatttaactaccagtgtctttgagcacaaaccacctgtcatcactgtcaaaatgtgtagattaacacatacagttttcagataactatagcaataatctgtaaaccaagcttagctaaacctggggcaacataaatattttacaactacaggttaagctaggagagaatttgggtatcatcggattcatcatcttttctctatacaaaatcaaactcagaccactcccagtaaaaacaaaacaaaacaagtcattttatttaagtgaaaattggatgaaggaagttgaaaactgaggaaagtaccagaagttcctggcttaactgagtcaccttgtatgagtgaatcagtgtacaaatgagtgattagatctagcccttgactgacaactgttctgtgacaatcgtgctgtaaactttaatcttaacttcaaggcttttctatgtcagacctttaccgaactgataatacatcaaactcagcagttacacatcttctttaatagcagcactgtgagaggttttgcaaagaaggcaaacgttatccacatcagttagtgttgaaacatttagtgggaaaacaggttctagttatttattatccaaacagggcagtgagagatactctatgtttttggctataagtcaaagtaaatcaaactagagtagactaatctaacaatggaaagggcaaaaagtgattgaaaggaatagctggaggaatttgagtactgtacttatttttatttttctttgttttttaattattttcagttgctaaaattcacatagtgcaaatctaccaaagatctcaagggggctatagaattcctcagctactcggtttcctcccctagaggcaaactccattaccagcatctttttacccatccaatgatatttcaagtgtatgtgtttgaatgcacacttggtagattttatttctataacaagaaagttatgtgtatttattttgaatttactcatatttggtttaatcatgtgccttatgctcaaaaatttgtgttttctaaaaaatggtttaaaatatatataattttgtattgacaggaattcagttggaattttctgttaaaattttgatatactatatggcaacattatataaataattttcactagaaaaaatatatagaggaaaataatcacctgtagtcttgccacttagaaataagcacaataattattttggcttattgtttatacaaacatactgaaatattttctggaataggaattataccatacacagttgtccctcagtatctacggggcactggctccaggatccaccaagaataccaaaatacatggaagcttaagtgtctgacgtaaaatgcaatggttacatttacacataacctacacacatcctactgtatactttaaatcatctctagattatttatggtacctaatacaatgtaaatgccatctaaattgttgttatactatattgtttagggaataatgataagaaagagagtctgttcaatacagatgcattttaaaaaatattcttgatccacagaggactgattccatagacatggaactcaaggattcagagggttgactgtatgccattatggaatattttcccctgatgacaactatatatttacacattttattttcagccacaaataacaaatatgaaattgaaaatttaaaaaaacttattaaaataagggaccataaatttgatgttcatgctctctctcaattcagagtccttgaatgtaaaatggtgcctattaccagtgttatcagtcatacctaggttagcagtgggctgtttcaatgtcaggatggtggggagtatattgagcaatggttctgtgtgacatcctacaaaatctctccctcagggtccaaagtgggtgaggaaagccctgggatagggaaacacaaaagagagggagttagggagggaaaattcttagctggccgctttttcaaaggagcaagggagggaaggcactccagggctcaggcattcagcttcctgcttgtgccccccaccccaaaccaagttgctgtagcgtcagccatcataccaaccctgtcagagaaggctgcgtgtgaggagggctcaccaactccctgagaacacagtatagatccaagtatccctgaaaggagacagggaggaggggaatatagatgtactataataataaaaatactgttcaaagaccataatacaatgaaaatttatatataataaagagatagccaaagtcccattgacttcctatgcattttaagctatatttactgctaaagtattcagtgaaacttgtatatccctttgctgtgtttttcatggctcttccttcaccagagtgagcccattgccgtcctatacaacaggaactgcagcttcagcacgtcatgggaatcttcctgagttccatatcctgccctctcttccgatgtttttagctggttgggcatccctggtgaccgtcatgacacctcaaagctaggttctacctctatatccagcccctggctgccttgctgtggaacagcactcccagaaattatacagtgcatagcggctctgcagcagccctgatgcactgcttactcggctctaaattttagtgtcactgcctagatgcactctctgagatgaccctcagttctatctgaatactctcaccacccttctctcccagcccagctcctcagacccccaacttgtccataacaggaattcagacaatgaaatgtaatgaaattttgctactttcattgagcagaggacagaattactgttacagtagctcactgaaatacaagataaaaggaccaaggcaaaaatattttatctagtaattatcaaaatatagccagttttcctagatagataggtggatagatagataaatgaagcttctcaaagttatttgctaaaattttgcccacataacaaatagaagaaaccagatgtaagcaaatatctttgggaatgaattttcgatggtcacagaggactcttgtcaaaattgttttctccagctgtcaccttcactaaaagacatttactgtttccaggaagaatggtctttcatttttgcttaataggcaaccatggaattctctctctctttctttttaaatcacccagctacccttcccatctctgttcacttccagaattttctgattgtagtctgggcctgaaaacacatttcatcttggctcactgaccacaactttcttaaagttggctactctctaaaactctgtctcttccatgaaattgccctgaactcagtggagttaaggtattgatttctcacagacatgtcttatttatgcaaacaattgccttatgccatttataatatgttctaccccacaacatcaaaatccaatgcacacattctattgttttgcaggatgttagccttgggggaaacttggtaaagggtacatggatctctctgtttcaattttttttacaactgcatgtgaatctacagttaattcaaaataagaactttaattaaaaacataatgcccttattttctctatcttcctccctttctctctttaaattatccttttaaatacacatgtaaaattttacatgtaaggataaaatttttcctctgatcctttaccttgtttactctcccaaactttccaattttttttttaatatattgtgttttcagaggggtagagactacgtttaagaataagggtacacattcggttgtttggaagaaattttatgatgtataaaacaacctcctatgtatcttggctgtttctcacgctatgcttgaaacaccagaaatccatgtaaactgtaaaacaaactgatgaaaaagccaagtccctttctccacttccatctcctattcgatccagccccacccactgtagagtaaggcagttcctgaggtcaaactcctcagtcacaagacctcacagactttagtgagtacagatatccaaaccaggctgataattccaaagtaaaagatgccctaaaagccagagaaaaacagggattttgttcactacattaaataaaaatctgagaaaaccagagcaattcctgccaagtataattaagatgctgggagaaatgactcaaaagaaatatacctgcctttctcattctactttgtattggcctttctgaactaaggtgctgacttgaaaatgttatactcttgctggaagtctgctttaactatcaatacaaatattcttcaatcctttacaaataccgattttcatgaagaataagatacattacaacaaaaaatcctgtaatctgtatgaccaggttagaactccattttttttttaatcaaagacttgattttcacactttctgtggaatcctagcatttattatatagtctgggccattgtttctccataataaggccagatacctgaggtctcataaagtcagaaaaaaaaaactcaataaaatttttcttgattttatgtaagtgtgttaataagggcagttcctatgtgttggaggttaaaaatgtgaaatgttaaatttaaaaataaaagtcacagtgttgccagccacaatgtgactgtgttaatacataatatctaactggcctctttctcaagtactgacactgagtcatcacacttcacttactttcccattttcccctggagggacgtttctgttttgtcaacctggaaaacacatagtttgctgtcatattggattcagatttagttgggtatgaaagtgatacatcaatattctagtatgtgaattttctttttatgggaaggaaatctcttatctttgcttgttcagaaagtctcaactcaaaaaaatgaggcattcatttttatccttgtactgtagttttatgatagaaactgtcctccttgttgttacatttataagcacctcctaagctcctttttaggacagcttcagtgctctctaatttttataatctatagtccagatcgatcagaatctgctggaccaagtgaggataaaaatgaatgcatttcccaattcagtgcaggatttgggatgcccagaattgaaaaacatagatgtgttaagcggatctgttttaatatccagaaaagtcatccctcagcctgggcaagatgatcttgtgctcattactttacttcccagaatggagatgatgcataaaccacaattttaatttgcttttttttgtgcatgtgtagaataagcgacaaaatttcagcggctgtgattattataatattgccataaacctctctaatgaaatgccagcaatgttgagacagctttattcaggcataggtcaaaatagccatgcatatcagtacagggcgataaatcctggactccaaacaataacactgggccagaaaggaagcagatattaaggaaacaattattttattaatatgcacttatgtaaggcactttagacacaggcaaggtagatgattacatgagttaattaactaattaattttaggtcatttagagtatgtaaggacatatgaaacacatttttgtgtcatcaaaaaactaagaatcccttgtgagaggcctcttatagctatgagaagataacttgtaatgcaaagtgataattgataagtgtagacaataagtgcaattggagttcagagaagggacagatcacttccagacagattaactgagctatatttcatgaagaatgtgatattttagttgaatatgcaaattaaaagattaaatgtttgtcaagtgcctattgcatgcagtgcctgctcctgagctctgcgtgggtatcaagaaaatttatgtcacagtcttgccctagtaaagtctataatgtggccaagaaaatgactcataaacatataaaacacaaataacaatcaaagatctatttcaaggcaacgctagaagtgatcatgacagaaggcagtcatgattagttgtgctcattagttatgcaaacaattaattgctttagacattagcaaaaggaggcactcacttccctgacctgttggcagcatttgacaaaaacagtgccttctgtcttccaggactctacacactctttgttctccccctaccactctggctgctgcttttcagtctcctatgctggttaatcctcatctataaacactaaagtaattgagggctccgcctgtggtcctcttctctcttttgtccacattagctctgttgcaaatctgatgtagttcatggctttaaatcccatctacatgctggtgattggcaaatttttatctccagcctagacattttccctgaagtcctcctttgtttctccaattccccactcaaatctctacttaattgtctacaagccatctccaatttaacatgttcaaaactgagttcctaatttcctctttaaaactttctcccttgtattctatctcatctcagaaaatggcagctctaccttccagttgctcaggcaaaaatccctggagtcatccttaactttttctttctcttaattcccatatcagatcgatcagcaaattctttagttctgccttcaaaatttatccagaattagaccatgtctcatctcctttcttacttccactctggttcaagaacctatcaataacctcctggatttttacaactgtcttgtgacccatctttcttcctctaccctgtttcaaccaagcagccagagtgatccttttaaaatatcagtcaaattatgtcactcttctactcaaaaccctccaatgacttcccctctcactctgattaaaacctaatatactcatgatgacctacaaggtcctacaggggctggccctcattctcactgatgtcatctatttttaccttctgacctcttcactctttcttgaacaaaccaggagcactgctgtttcaagctctttgttcttgctgttttctttgccttgaatgctcttccccaaaataacttcatagcttgctacttcatgtccgtcaagactttactcagtaaatccttccttcaccacctcaatctatcttagactggattcctcagaagcagagcctgataaaaggattttagatggtattgatttgggagatgataccctgaaatagcagtaagggaacagggaaatgagacagagaaagaagacaatatagggtacattaatgagtgggttaactctgtggccaaatagggctcatttcccactgggagcttggggaggctgtacagaacacattgtcctatgggaggagtatttaccctcctcaattcctgttagacattggctaagggatgctcctgggggtgttaattcctggcacttctaaccttgcctgtgtgtaggcagagcaggcatcagcggtcagagaaagcctttaggtagaaaatcagagatgcttacaccagaaggcccttcacatgtccaagaatattcagaatcaaggagatataagtaaggcattgccagtgctgcagcctccccaaaattccgtatcttccttttgctgtttttgttttatccctataacatttaaccctatatttaatacaatatattttccttacttatcttgtttacttttttcctttatgaatcatgaattttgtctcatttgttcactgctatatccccagcacctaatacagtgctttatacatgagcagcaataaatacttatggattgaaaaagaaatgagtggatgaacaacttcaggatgggtaagtgatccaggaagtcttagagaagggatgggatttgcactgagtaaacattggttaggtggaggcagggtcaggagagcagcccagcagtggagaaccacaggagcaagagtaggtgagctaacatagggtaagtttaaaaatgagttaattccttttgatagtagcagatggtccttataaaaataaaaataactggagtaagacgagataggtcttgtccaggcaaactgtcagactgaggaatttgagatcttttctgtaggcaactgggaagaaacaaatgttttaaaacagaggaatttaaactgtgttttaaacccaattaaacacgttttaggaagactaatctgaagttattagtaagctgatttggggaaataggaaataaaaatgagtgtagaagctttttcagaggcagaaactggggcctgatagagttttacaaagtgactaagaaaaggctaattgaatgttggagatagtgtggttaagctatcaagatcagggttagggatgacagaggggagagcctgcattgaccctaaggtctagagtctggaatttagtggtacagctaatagatgatgcacccaaagaccagtccccactccagggctcacgcttgtttccatcatcctgggcatacccagcaaaatccaaactcggctgagttttgagaatcttctggaactcaggtgacctaacattgatttgggcaccttggatttttgacaaaggtagttgttcaaaaaaaagagacaagtgagaaatttttagcaatttaaaaatgttcccagaactggctctgcttcctaaaatcagcactcactcctgctcccttccttatccttattgtctgtggttcttgggattcatactgcagcttaatgctgtggggagcatcagtctacctagtagtgcaaagatcccgccctgtctccagataaggactctggcagtcccatcattttacagatcaatgaacatctgaagcacttgtctagtttgggaactgcctttagcagctagcagtttggtcaaaattcattccacagttttcctaaaaacaacaataatagctacaatatattgagtacttattaggagccaagcattattctaaacaacttgtttatattagttaatataatcctcccagcaacttatgaagcaggtttaagtgttcctagttgactaatgaggaaaccaaggaacaaagaggttaagtaacttatccaaagtcacacagctggaatgtggctcctccttgacacctgctcaccagccagctcctgaccctcgggaggatgggtgaggagaggtaagggagggggaaggtgtacttgaactggtaccatcatagactagctttacattctttggattttctagatataataatgtggcactcttacaggtactttcctggcctttttcaggctattcccatgatggtggtgttggggagattctctcttgaaagccactagatccaattgcatctgtcccagttggtgatttgcaactctttcctgagccccgaggcatccagagtgtaccttcatattctgccattcagccttgcaggcagagtcatagatatgtttatactagcttccacacctcacagtgtctgcagctggtccataggaagcattcaagcatccctgacccccaagaactgtgggagtacagattcatcccaacatagccatcactttcctactgccacagctcctttaggtttctcaggtatgagctcaacagaggtgactttgaaacagttcactgaactttcctttgcaagttctgcatatggcaaaccatctcccgctcactttggtatctgatagctaagaaattgatgcctcaactgaaattcaggcaggaggtgtttgttttttaacctttttggtatgtttactatcttcatgggattccatggagacatcctggggaagaaaacatgatatggactagcatagtatgggccatgaaatcaaacagctcctggagtgccatgcggcaggaggcaaagcagaaaagaggtgcaaaggcaaggccacgaagagccccatgccagaagaactgacttcatgtgtgtggggaagggaaaccattggaaatttaaacagtaatgcttaacttagatgtcatgatcaagtgacattccccaagggaaaaaatgtgggaattacagtggtcaagtgattaaatcctggaaacaccagaatttacaacacagatggacttcatggatatttgttctatgttgtaccagtttcgtccgtaattcctgtgttactactcaagtctactgtcacacatctgcccaccacatctttttgagccttctgtttcagccttcttttttcctttcatttatcatctctaggaaatttttcttttcctttcttttgcaaaagcatttcctcatttttcaaattattttcagtgagttctagtttttattgtattattgaagattagaactttgtaattgtgtcattaagtctggaaaaaaatgggtgttaatgctaagtcatccctgatatcagtaatttctttcagatattgggcctaaaggatatggatgcttgttgaaaaagttatgagtattgctataagctctcagtttgagtatgtacaggaagaagaaataaacacacatgtacacacattcacacacaccctcacacagtgagtactcaagtgatcaaagcaaaaaatgtttaccccattcatcatgcccagccacaagcctttaaatataattttttggctgacatggatacattaaaaaattataaatttttcctataatctcactgattgttccaaaaagtttccaaattactttctctatatttcaacaatataaatcatagtgtttagtctatgctttctaaacaatttctgaaaagattacaaaatatactagccctccagctcaaaagacctattttttagcaggactgtttgtctttggaacatttcatataaaattcaaagtaggaaaaggaaggcaagaccaccccaaacctctgctgagtaacttcttttctgcctgtccctgtgtcaaggcagagaagagaaacaaaggcagagacctttagtcaactatttaccttttactcaaggataccaatataataactttgcttttctattactagtcaaaacaaattttctgttggacttttttttaattttaattttgattttaagttccagggctgttggacttcttaactcagggacttctcgagtttgaacccagcctctttctctggctttgactgttgcctctgtccttcctcacacacatgctgagatttctgttccagaactcccactcccctttctgcaaagggactaacatctctgtggctaatgtaggtctgtccacattagtatcttctggcctggaatgttttctggcagttatcaggtaacttaagcatttatctgcaagattagttaaaagacttgctgtatagctgtgatattgattcaactcatagtttgactcaattagccagtttcaaatccagtttcacagcaggaaatttcacacatacaaatcagcacttttgagaagcctgatgaaataatggctagtttaccctgaaacgctttgtaatctagaagccaactgtctcagtaaatgccatagtaatgagttaattatcctagcccagtggttgctggggctttctgccaacatcctttttttccacttgctgcaatttctatctcacaagcagtcctcttctcaacttccttactaaaaaataaaacaaaacctactttatcctctcagaatgtccccagtgagtctccacttctcaaatgtttggtaacccatggcagctttcttccacttccaccttactgcagtctcaatatcattgggttttgatggcttcagcattaataatggatcaatctaatttagaggatgcatccaggcctcaccaaaatgttgtgtgtggaactgtcctacagaaggagtagagggcaccaaggttctattagaccaaatcagatgatggccaaggagaatttgccctatattaattctaatgtaattactacataagttcagagcccagaattggggccctatttgaacctggatttactgcaaaactacaccaaatccaaacactgaagacttttctagaaacaatttccagaggatgatttggttggtggcaatcaccgtgacccttgaaagcagtgctgtttattttctcccttcttctacaattgttgtattaaatatatatgtcatgcacatatatatggaatttttaagttgtgtgattttgaccatcaaattaagagcccaaaaatatagttccaaattgaggtcagaacagcaatatccaattgacaattttaaatccattggttgtcagaagaaaaaagcaatgtttatttgttaatactttttaaaatcctttaaaaaattaataactttagctcagtgataatcatgagtgtgaataagactttagctaagagctgattataataatgaaaagcgtgatctatctagatttcaaaaatttatgaatggttaagtacattacagtatttccacaaaatgttaaaaatggtgcaattgaggaaaattactgacatgaacagatgttcatgttatgttgttaaggcaaaaaaaatttaaactatttgaagtatataattttttgtatggatgtacacacagacacacagagaaaaataatctagaaaaacatatctgaaaacattattagtggctatttctgtgtggtagaattacaggtgactgtattttctttcttttactttcttttgtctactcatccttaattttctacagtgacatgaactacttttataataatagcctaatttattttttcaaacaatgtttgttcctagacttctttacagtgttacttttagagatgttagtggttgggggtctgcaggacacctaagaaagtttggtttttcctccctgtgatggggttcaggccgattcatccagtgctcattaaacagaagcctataaacaggcatgtcgcaggtgtaaactagaggaagattggcttctgtcagcaaattagccagttataccaatggccaaactaagcaccccagtgtgcctttgcagataaaattaaggataaaattataaaatatccatgtaattgttttgaacaactagattggtaattttttccctttaaaccacttttgatctttgcatgcttattattcagagcctagtgaattgattacaaagaatattcatttttgactcctacaagagtaaatagatcatgtgcattgtacagattcaattcagttcaaatttttaaacttttactgagtaactctgcacatccccagaaccgtgttagacacagtagagtactcataaaggcaattcttagaggaattcacagttttgtcatagagacagataaattagtaaatatttctgataaatagaatagaatgggcttccatataagcagggagtaatacaaagcaagagtcatggaagtgagggagaaagagaggttaattctaactaaggaacaggaaatgtttcctagagaaagtaacattttggctacaattaaaagtgtattaatcttctttgggtcatagataacagaaatcaagttcaaactagcttaaataaaaaagacagtttgtcggcttatggaataaggatttcttgtttaggcaaggctggatccaagagttaacaagactttgccaccaggcttagctttcctctttgtgactttttcacagacaagttctccacaaagatgactgccaaagatagaaacttacatactatttttgtccagttaggcttctatttaaaaaaaaatgccataaactgggtaacgtaggcaacagaaacttatttctcacagttctggaagctgggaagtcccagatcaagatgccagcagattcagtgtctgatgagggcccgctttctagacagccatcttttagctgtaacctttttaatttgttgagtaacctccatactattttccataatggctgtactaatttacattcctaccaacagtgtgcaagagttcactattctccacatcctcaccaatacttgttttccttcatctttttaacagtagtcattctaacaagtatgtggtcatatctcatttgattttaatttgcatttgtctgatgatagtgatattgagcattaaatacctattgaccacttttatgtcttcttttgagaaatgtctatttagatcctttgcccatttttgtaatttaatttatttttatttacttatttttaatttttataaatatataaaacttgtacatatatgcagggtacatgtaatattttgatacaaatatacaatgtgcaatgatcaaatcttagtaattgggatattcatcccctcaaacatttatcatttctttttaaaatttattttcaaggatggtttcagaacatttataattttgtttgtgttgggacattccaaatcttttcttctagctattttgaaacataacaataaattattgttaactatagtcaccctgtatcttctttctttttttttaacttttattttaagttcatgggtacatgtgcaggatgtgcaggtttgttatgtaggtaaacgtgtgtcatgggggtttgttgtacacattatttcatctctcaggtattaagcctagtatccattagttttgcccatgttttaatgggattatttgttttcttactgagtagagctccttatatattttgcatattaacaccccttatcagatgtgtggtttgcaaatgtattctcttgtttcacaagttgtctctcaactctgattattgttttctttgctgtgcagaagcttttaagtttgatggaataccatttgtctatttttggttttgtttcctgtgatttggggtcatatccaaaacataattgcacagaccaatgtcatggagcttttcgcctgtgttttcttctggtaactttacaatttcaggtcttacgtttaagtcttcattttgagttgatttagtgtgaggtaagggtctagtttcatttttctgcatgtggatagccagtttttctagaaccatgcattgaaaagactgtcctttcccattgtgtgttcttgacatctttgctgaaaatcaatcaactgtaaaagtgtggatttatttctgggctctctattctgttgcattggtgtatgtatctgttattatgctggtaccatgctgttttgattgctatagctttgtagtagattttgaagtcactgaaaactacttaacattgataaaagaatttgaagaagacatggataaatggaaagatatctggtgttaatggattggaagaattaatactgttaaaatatccattctacctaaagcaatctatagactaaatgcaattcctattaaaatttcaatgacgtgtttcatagaaatagaaagacaaccttaaaatttatatgcaaccacacaagaccctgaagcgccaaagcaaccttgagcaaaatgaacaacgctggaggcatcacattacctgattttaaaacctagtaattatttaaatgtaatgggaactggctatttgaagtatatcttgcgataagtacttttgtaaagcaataaattaaattgccagttgaaacactggcctttaatctagaaccagaaataccatttgacccagcaatccaattactgggtgtatacccaaaggaatattaatcattctactataaagacacatgcacacgtatgtttactgcagcactgtttacaatagcaaagacatagaatcaacccaaatgcccatccatgatagaccggataaagaaaatgtggtacatatacaccacggaatactatgcagccataaaaaggaattggatcatgtcctttgcagagacatagataaagctggaagctatcatcctctgcaaactaacaaagaaacagaaaaccaaatacggcatgttctcactcgtaagtgggagctgaacaatgagaactcatggacacagagaggggaacaacacacactagggctgattagggggtgggttgggagaggagggaacttagaggatgggttaataggtgcagcaaaccaccatggcacatgtatacctatgtgacaaacctgcatgttatgcacatgtatcccatttttttcagaagaaaattttaaaaaagaaacattagcctttaatttttatgttttgtaagtctgaattattatatattgacttgacttagaatagtgtgtactcagactgtctttttttaaaaaaatgaattttaatccatttaaaatgtaattcaacttaagcttttagaacattacctgtttccagtgaatgattaataaatataaatacatgcttccttgaatttatatcagtaatcataaaatcatctatcagttttaaaagtctacgtgtaccagacatttgtttgttccttggcatagcaatgattggatatgaattcattttatgattcacagaatccccatgggctcatagtgatatgggcgtttgaaatcaggccaattgatgttttaatcctttctgtccttcaggaagaagtggaattaaaatctatgtttttgttatttagtatttgtggcactaagctaagattacagataaaatgtagaattagatccttgccaaatggattcataatctaaattaaacagatatacaggaaactgacctcgggaaataaattgtaggagtgacaaattggtgaaaaactcaggaacaaaccaaaaaatctaaacagagatagtaaagtactctattattaatatttcctggtaaagaacgaaggcatagaacaaaaaggccaatttctgaatccagttctcccctgaacttcttgcataagtttgagcatggctcctttcttcaccctgcattattttctgtatcttcaagatggttcatcctttacaaagaagttggagtcatgtatgaaataataaacatgaaacacttcaagtttctcagaataaagtttccagagcaaaatgaaataataacagggatacactgtatgatttactgctgatagtttatcttataaagcaagtaaattaggggctgaaattttatatattagaaggatttatttcaaaaatgattttaagaaatatacaatcagtaaatttgaactaaaccaatttataaaactttgattcatacacaacttttggaaaacatcttgcattattcagagttattatacctttgtggatttaattaatacccaacacataaggcaattctttaggataagtaatgtgctaaatcagtggtactcagagatatattacatttgagccattgataataatgaagtattattaaatgacaacttcatgttaactacttaataataaattattaaataataacaaaaatccatgtaactgttatatgccttttaaatattttctgtgatattaaatatactttctaatatagaaattgaaaatcttgaacctctctagattacaagcaaaaaaccacatgtgccatctcctattaaagtgaatgatcagttaaggaatattttgtgacactggattaaagaccttaagaactaatagtggttacaatgtaataattagtatggaattatagacaatttcagaatacataaaactagttttttaaaagttgtctaatcctatattgaaataaaccactgcatataatcatatgaatttgattacaaatgaggctgtgggttatcttgaggacaggatgaatgatgggaaagtgaaaaatttcccaagatggttgaaagacttgtatacagcaagaccatattgcataaaaaataactgacatagtcaccacattttgaaaaggtgccatgtgaagtcatgcttccacattcaatgacagaatatccttaccaaaataatattggtatccaatatggagaacagtggatgggacaatgtcaaaaaggaatgggatcaaaagatgagcaggttgctttcttccttaccccttgaatagaccccacacacacctgaagaaactgagtctgaaataatggaaaaaagctgtagttgttggcctttgtctgcagaattcctccatgtctcccttttatatcccttgttcccaattcccctaatttctcggcacattttctttaattggattctctgtctctttcatttccctaactttgctgagctggttttaagccagcaactctgattttcacttgtgctactcctccatgaattgattattgatgaattaattatccacctatgacctcattcacagtaagtcatgagtaaaaggcacctactcctgttccctgatgtagcccagtagagcctgcaccaatacggctgtggcctgaccagtcactatatgattatgaaaggagatccaacttaaactaaagggaattattttgaacaagattcatcaaaatcagagcacatatctcaccatattcagacagctgaggatagttgtccatccctctactaaccaatcactacctataacacagtctggattctttcgtaattcttggtacatagaagcttctcagaaattatttgatgaaaggatggataaatgaataaataaattattataaacacttgctataagatctaagaataattacactggttgttaagggtgtgcatgaaataacaaaatataatgaatccttaattagtagaatatatttaatgatttccatttacatttatatcaagaaaaaaaaaggaaaaagcaacccagcacatctacttatcatcacttttcaaacatctgtggtttaaaaaacagctttgaaaatcgttacttgcctcgggtaaggtctgacttctgctgtataagcagtaaactattctaaatccttacacactagtacatatcctcatagagggcagttaataccaattaggcccaaatcttcccattctggttcttataggaatatatagatgtatgtttgatacaaaacatattcaaaatttttttaaaaagacagaagtaacagatgcatcatcccaatttcttggaaaaaaaaactgcactctagaattcctaaataagaatgttaacagaaatggttaatggagacagcatgcgctggcatttaaaatgcttactgtttaggaggagaaaacatcctaaatacagtgcttctccatcagctcaatgttttttgtttcttcagactgataggctggatgtggatagcttgtttagcaacattgagtccgtgcatcagatatcagccaagctgctgtcattgttggaagaggccacaacagacgtggaaccggccatgcaagtaattggtatgtttattctcttctcgagttctacaatacaacaggaaataattttttaataacctccctttgctttggttttttgttcctgactcaccatgcttcccaggagatatataaatgctaaacccatctttgggctcattgtgattatgcagactctgtgtttattttcaaatgggtttatatccatttgctgaagtccctcagtagcacaaaacataccatttgctttttaatttccaatctttcaatctctttgctttccagatgttctgtaattttttttaatggctaacacttacttgatccttaaagaattaattatttaaatattctaatagctttactgatttctcattacaatgttttttagatcttatgcccatcaatcaatttttttagattataaacttcttacctgaggaatgtaaaactattaaaggaatgtaagttattaaaaatttacacaagttctactttttttcatgctctctttttttctgtattatttaccttccaaatatgtttttactgtcaatcagatatatttattttcttactatggtaggattctcaaaaataacaacagaaaatataatttgaaaagtattgagccaaatttttatgctctccatttcttgggaatttccaagggaatatgtgctatgaattccttaaaggcagtttgcacttcgagacatcatacagtgtcatgtaggctaagagttttttaaaattatcgtttctctatttcacacttaatatacaataactcctcattacaaaagtactaaaacaattcaggagcacgtagagtaacggtaaaatttcctttcatatatccctccaatgccactgccttccccacaagtaaccgcttgtttgatgtagatctttactttgagatacacacacaaagactacacacaaacactttatgtctttactgattatgtctttgttaccttttatttgttagagttataaaaatgtcatggaactggtcttgtttaatatttatagagaaccaaagtttaatgaggaaagctgatcaaagacatgaaatatagtgaaagaaatgactgggtaataaggccagcccactcagaaagatttcttccacagataggtttaaattcaattgttctttgtgatgaaatgtccccaacaaattgtaaaaatatttcctaaaagaagaactctactcattaccacactaactcattagtgtgaattcattggctattcatttattaattcaatcaatgaatagttatgaagtagcagcatattcacaagatttggtactgtaccacattgcttggtatcaaaaggtgaaagggctcatttctctctttcaaaaacattcaatcaaacagcttcttgaattgaaggtgtgggtataatacaccatcaaagcagtttctacactactgcaaaccttggaggataaagaaaacatttctagatggaaactccaaggattcttgaagatgttatttgggcttaaagtatagattctatttcaacaatagggtccatgttgaggagaagattccaaatggaaatgacagcatgaaaaacaagtgtgaaacaaatgccaaatgccaagtgtgtttaggaaatgaagagtgatcaagctggagtgaaggacagatgtaagcaagaaatgagaaatgaacctgaaagtgcagagtagggactggcagcatttggaaatgaagtttggaatttactgtacaagtaataaagagccattaaaagatttctggcaagggtgtgatgagacacaaaagtttctggagagagaaagatatggtaggtctgaacagcatgcagaggaggaactgagtcctagactagtaaataggttgttataagtaatataggcatgtggtaataagcattgagactaagggagatacagtgaaaatttttaaaaatggggtcatttcaagagaaatgtagaagaaagcataaacaagttgttgattcatgtgctgaagtcaaaaacaattccagatttaaggtgaccatgtattgtggtttgtctagagcatactgattttagtgtattacgtaagcattcagtccactttagcatttgtcatggacttttcctttttaaaaattattattattattagttgcatcagaagaggttttataagacctttacatcatacttcaacttctgacacaatctcttttagtagagtgtaatgtgcagttaacggttctcactgtaacacatggtaaactctgaaacatagtccatctctcgtatgccaaccttttctagtctcaaggaaagttctatctttctttgaattgccacatgcagggaagtggctgattaaatgatgctgtttggatatgaacagctagaaactgctaactcctttctgtcctggtggttgtggatgtgttggatgctgcagaccccgccatctactgggtgtagcagctagttgtgtcatgacccatgctgggtggcccatgtcatgacctatgagaggcatgaagccatcgggatgccagtcagtggggttaatgggacacgtttttacagaatagatgtaaataaaatatgtatggaaaatagggcctgagaaatcatgctacagagtgtctagaggctcttgctatggtaatttggttacctattgcatgttatagattgacaactcttttacaaattttttggttatgtttcattctgaaataaaccttttcagaagcaagaatttaatatattcatgtttgtattagtcagttttcacactgctataaagaactacctgagactgggtaatttatgaagaaaagaggtttaattgactcacagttcttcaggcttaacaggaagcaagcctgggaggcctcaggaaacttacaatcatggcagaagacaaaggggaagcaaagaccttctccacactgtggcaggagagagagagcacgccaagggggaagtgcgatgcactttcaaacaaccagatctcatgagaactcactcactatcacaagaacagcaaggggaaagtccacccccatgattcaatcacctcccaccaggcccctcccccatcacctggggattacaattcaagatgagacttggcaggggggacacagagccaaaccatatcaatgttttagaaaaattttgattttctttatctcaagaaagttgctgagcctataacacacaaaataccatccatcaaagggtcctcaatgctatcattgaccatagacaatcagaagatggaaatatgctgaagcagcggcaacatctatgtcaaagtttagtcattatttttaaaagactgtgctctaagcaagtgattaaatgcatgcagctgcttaaggtgtgtttacatttcactgcatgcagcatggcttctcatttaggtcagacaacagttttcctagattaattacattcattttttaattctgagtttccttaggcctatgagaaatataaaacaatggttactaatgagttgacaccgttagcaaaagagtactgcaaacagttaaatgatgacagttttatatcaatgtgagcagatgaatcgaataatagtttcaatagcagttaaaattttaaaaattcaattcacagaaccaaagaaaagcttttagaagtttatcatgtcaatggtgaattgtctgaccttattataaatgctgtcactttaacttaaaaattaaacattgtgactgcaaatgataacataaatacaaatattagtggagcacagcatcatagtaaaacaatgattttattaaaataaaaatctatagagcagacgtgtagttgaaaatgattggtgtatatatgatgaagttgtggaatttattaattgaagtaaaaactgtagtgaaaatttgcatttatttttatatacacaaaattagagtgaataacactacctgaagaataaatttgatattgaattaaaaataatcttatgtatgaaactatacactctctttcctgctggtcattaatcagtctttggaaatgtttgattctttgaagcaccactttacaaatcaaccagagtgtcctaacatggcattggactatttttgtaaacaaggcctctgaaattgaattgcattttgttaaaaatcagttggaagtctttagttaaggtattcatcaaatggagaaaataacttcaatttttaatctttacaaataacaattattaaaaacaaaattgcaaataggaagacattgaaatgtatccctatgaaaacaaggagtaagtttaaaaaaaataagcaatgagagctcatgtataaaatatttaattttgaaagtccataatcatgctttggaaaatctgacttatgaagagaagcctttgatggagctcctctttagtaggataaagtaatattctgtaccagatttcacaatctacatttgggaaaatattccaaaattacaaatagaaacaacttacttggtgagttttattttgaaaaaaagagagagagaatgaaagaaaacaattcaaatggaagcaaaaagataatgcctataaaaatatttcagctcaaatatttacttgttttaatatgtatagtaatgagagtaaagcttctatttaccataatttcctctgagctcaatagatatttccttgcttataaagtattttctcagttttaaatattatggtttacaaatttcagtagtaaaataaatatgctgatattgaattataacccacagaaatatcaatgagttcttgctgatataaataaatgtggagaaaggacagctgtccattacagattttaattaataaatagagaaagaagaacggctgggcatggtggctcacacctgtaatcccagcactttgggaggctgatgtgggcggatcacgagaccagcctgaccaacatggtgaaaccctactctactaaaaatgcaaaaattagccgggcgtggtggcacgcacctgtagtcccagctactcaggaggctgaggcaggagaatcgcttgaacccaggaggtagaagttccagtgagctgagatcgtgccactgcactccagcctgggtgacagagcgagactccatctcaaaaaaaagaaaaaagaagaaaatagaaaatcaaattcacattacataaacaccacagtcaactattgcagacaaaatctactggttgatgctatgtttagtgggtgaaagttagaggagaaatatacttttcatagtctcaaaactttctccccaagtaattattaacctcaaagggaaaggtggtaactttacattgagaaacctagcagaggccagccacctttatctagagatctagagttaattttccttctctgacaatcgtattttgatatgtaagatgttaatattggtgaagctgggtaaagagtatttgaaaactatttgcactattttttcaacttttctgtaaatcaaaaattagttcaaaatgaaaaattgaaaactatgatttacagagaaaactcaattgaagatgttcatactttcagattcactaatcatagaattccaactttgaggaaaattacagaaaattttatttaaaaaattaagacaatggggccatatttgaaaaagaatcagttggagtctcattttaatatccttatcctttgtatctgggctggccttgcgacttgctttgatcaatgaaatgaggcaaaatgatgttctacaacagcattatcacttctgccttctgcttgtgaggggagaggcccaaactgcccagccattcaaagcaacacagccaaggcctcaggcttgagagtaaggtccttgtcagctggccagctggcccccagccagtccaccaactgacgggaaacatagaagtaaaccccatcaatgccagttaaatgctgcccaattgttgacccatacaattgtgagcaaacgaacagttattgtcttaagcttttaagttttggagtgattcttttttttcctgtggtaattgctaactaatacagattaacaggtgagagactaacttatttcaactcaaatggtgagggaaaacttgatttggaagtggtttttgagcttgcacttgaaagatttagaaaagtggagattgggtgcaaaaggctttctaaatgagaaatagggtaaaggcctcaaagcaagagtacaggaaattctgaaaaaggatagcagcagccctatgtgactggagcatagtgccgagaaggcctctctgagccaaacgttgtagacagaccaaaatgagttcactggcaatttccattactaaaccttttaccaaagcactttcattccataagataaactgattgttggtgagatgtttccaaaattatgttatcacaaatgaaaagcacaggtgtcccatttctttgtccttagatggcacaaataagagtttgtgattcacagctgtagtgccaaagggagaattttcctgatacctagataaactatgaagaaaattttactcaataataacactggagtttggataaggtttaagtttaaacacaggggcatatgcttgcagatctgagagctctgaggaagttgtctgtactgtcatgccaagatacaaagtggattttaaaatcttgacttaagcacagtgtctagataggaaatgggttttcaatctttatagatgggagtatgaaatgtggctcttgtttccacttagatggcagtgtagagtttaagaacacatgggttttaatatcaggttgacttgggttacatctcgttttgtcctgttgctagatgtgcgatcttaggcaagttacaaaacctaattgaacttcagtttcttatctggaaactggaggcaatagtacctatcccatatggtttttatgaagatttgacaaaattatgtgtacagaatgatagcccagtgcctatccctaattaatatccaatagatgatgttataaattattatcccaagaatattagatttactcatctatttaaaatgcctgattttttctgtatgtaacaagtgaataaaatgtgactttttcttagaggtcctgatcatgtttttcaaacaagtcagatttgctggatgtgtgtgatttctagatgcttccaatatctatgcatcttaatgattcatggatctaatatggtgacatatttttttctgtgaagggagatttaacatatcaagtgtcattttcacatttggtagagtgaacagcaatggcagtaattagtctccaaagatggccctcaatggaccatgcctcctagttcacattgttatatgagtctagtgtcatattgactctggactggccctctgattcactattacaatgtggtgaaaatgacactgtatcagtaattgggcccaagccttagaaaagcctgacaatttctactttcataattttggaagcctgccatttaaaaagttgagataccttactggaagtatcatggagagagacagcagatgagactatgtagagtgagaaagtggcacagctatcccagaatcccagcagaggccagcctcccagctgttcctgccaaggcactagatttgtgaaattagtcatctcggacattaaaacccagataagtccttggatgactcagcctgagtggatgtcaagtgtagcaaaagaaccacagagttgagcccagtcaatctacaaaattgtgacagaaaataaaaatggctgttgtttcaagatactaagctttgggatggtttgttacatagcaataaataacccaatagcaatagtcctcttatatgtgtttgcatattataatgtttcaaagtattaaaacaagactgtcatgaacatgcttgagtctactttactggcttacctcatgcatagtgcgctgagaatcagactgaaagaagcttttgataaaggaattgtaatttcttgtatgcattttcctgagggtgactctctccttggagagaaataatttagagctttctgttctttgaaggtgtagtaggtgatgcactgttgttctatagcagtgctttgttttcctaaagcaatgtttcttgtaggtccctgaagtagaaatctgtgcctttagcagtgagtttgtgagaagagtactagttgctgacaattcatatcataatgctgtgtgggagatactacattggagctcacttaaatgaatttttcaggattattattgtgtgtaagtgtgtgcatgttttactcaggacacaaataggcttgacctggttaattttggccaactgggactggttgggagggtcctagacctgcatacttgaatgtatgaggtcagtgcggaggtttgggggacacccagatgcaacagttggaagatcagaatgcaaatgttagaagtaataggaaagctgtccgctttggagaaaatgacaatggggaaatggtattttcaggatcaaggatacaccaatcctcacaagaaagaaaaaatcagcaggaagcaggtaccaggctgtaacatgggggttggacttccagtctcctgagcggggtgaatatgggtcccagtgctgctaggacttatttcttacaataaaaataaaataaaggtggcttagtaaaaagtcttacagttctgatttctgaggaggatggtaagttctaggatgctatgctgatggagcctgccagtggaagtcagtggcttagctgtgccaggaggagtattggagagttgaggtcagatttgaatggacctgcgaaaagtcacatattgcgcaggatacacatagaaatacatttctaaatcccaggaaggaatgtaagagtctgtgagttcctgaacactttcccagcctccaggaagctaaaatgagaagtacatagaaagagtaacaaaccttgaagttgcccaatagcctggaaagagcatggcctttgaagtgaaacagatccaagtcttaatcctggctgtcatcactagtttgatggctgtgagcaagtcacttgagccagtgaggattcagtttgccttcctgtaataaaaagctggccaacagggtttgaccaaaaaggggtttatttttctcacgtcacaagaaatccgtaactcacaagtccaggactagtgcaactgcttgctgctccttcaacctcttcccttcacaatgctcagcatgtggcttttgatatcatcccttagatggctactccatttccaggcatcacttcctaaagacaatgaagcaaaatcacctcttcagaaggcttttgtcattttgggggaatataaccattttcccagtgacttctacatatatctcattctattttgcacacatgttatttcatttcacatacatacacacacaaacacacctttgcacacacacttggccatctaaataccagagatttggggaaaggtcaatatttttaactgggtgtgttaccagtccaaattctatgcctttggaagaaggaagaacagataagtaaatagcaatggattccacatgcatttgttcatcttttcaatggggacaacaagactcccatggcaggaaaatatcaaacactgggcataacccctccagaatgtacgctccatgagggaaggaattcttgtctgttttatgactgttgtgtcaccagcacccagaacagtgtctttaataactatttgctgaatggatgaaattagagataatagtaagcgtgcagtgcattggctggcacacagagggtccaggaggtgattgttgttactgtcgtcactgagtctgtctgtggtcagtgtcattgtcaaatgtcactttcaaaagtcaatgtcattgccagagattgctaagtaatatagagcaactagctacagcagaggcaagctttctcaagagaggtatttactaacgtgagttaaatggaaaatcatggattggtctaagacagggttttcctcagtgttgtcaaccttacattaaaaaaaagttatgtaccttttcctgatccagccagcaaaactttcactttctcagagaaccaatgttgccttaagatgtcagttgttaaagaatcctgacctggagttaaagtatctagaagtcaacaaggttcaggaagacatcgtgagctatcatcaaaatatgcagctgtatttttaaatgttagaactggactaatatttcaagagcatctattccattactgagacaaaaacagtaagagctgatttgcccaatttatattagtaactctggacactctcagaagggactctagctcttccaaatataggccagagctttttcctctccaaacattgaccctctccacagcccactagcaccccccagtttgtcctgctcagctgctagccacctcccatggccagatgtactgagtggatgccaccttagcttcagaacagccccttctttgagagccccaccacaattatgacattgtcttccctggcactggacacagagatgatcacgacaggttcccatcctccactctgctcttttcctttctctgtttctctctttagggtccagctcccttcattggtccctcttcttcatctctcattccctcctaaacccaaccctctaaaaatgctattactgcatcaccagggacctcagaattgtcaaatccaatggacacatattttttctgaacttatcttacgctagtgcttctgaaaaaaaatttttaccagaatattcccaatatcaagagagaaatatcataagcctcaggaagtgtggagttatgatctgaagctagagccacaggcgtgaaataatttggaagtcttattttgtcgtaagaattcatgtcagttttccagtctactcttctaggaaaccagagtttttttcttcaaatttcttaataaaatggatactcaagggatacacttgttttaatcccatggctgcatgtcccacctgctgcctgtatttggtttgaatattataaccctagccagggtctcttgggtatccacagcagcagttttatcccctaggctaggtggaagctaaatgagactgaaggcaagggagtgtggcttctttaagcagcatatactctttcagtttctttcttctcacttcctctccttgttttatgctcccttggagaacagaatgaggctaggaaagaaagggagaaagtattcagatgatctggcatttgggctggcgaatctactgccttgtttagtcatggcagctgggctcccatccaaggaggataagaagaccgcggggagcaacccttgaacttggggtgaaagctgccaggaaagctctttcactggagatggcataccatggagctttcgctcagctgtgtgtgtcactcagggaaatgacagtcagaggcctgtattgttgcacccagatctcagaccttctttccagagagtgggccatctctaccctctgttcatcacacccccttctctgtattctaaatactctgccttgaccacaagttttatttagaaccacagataacttccttttgggatatatctcaggccataatttatacatgagattttaactaaaattatttttgtaaacattatcttagttggtttttagaattgaacttactgcatagtttttcttgttaatacaagcaacatccaactttatatcctccataactaacagttcatgtcatattttcatataatttttaaatgaaatgtaaaaatgggtagtatagagggggccttaactcatcaggatttctcccaaaatattttcctgtcaaagagaaaacagaacaaaacacagtgagtagattagaattaagttcagctgggagaaacagaaacaaaaacaaaacattactagcataataagacagatgttgatttctctatgtgtaaaagtctgaaggggatgtgttctagagctgtacggcagctctgctccacaaggtgctctgggatgcaacctccttccagctcacagctccactcaccaagaggtggctgttatcttcatggacaaggtaaaggtattaatagtatccaaatcctaggtagcagatggagacaaggatgaagacagtgtaaaggctgagccagctgcctcttcaggaaaattcctggacattgtcatgggacactttcatttatatcccactgtgggctttaattacatggccataccaattggatgggagggtgggaaatgtcattttgatttggggcagccaaaacttccatttctttagaagcagattatgaccatggggagacagctagcaagctctgtcacccaccccaccaacttagtcaatcttggcagtatttctcattattttgttcttgtccttcctcatgctgatccttctttgtggctatgccttctcaggcttctctgcagtctctttttcttctataccatcctcaatgttagtgtttgccaccatctggtcctcaggcactcttttcttctcactctgtgaacactctcgcatggccacataaattcatgtcttatactacccaatttttacaaacctacatctttgtccaagatattattttcttaaatcctagattaatatatccaatttcctaaagggcttcactgcttgaatatacaataagcaactcaaactcaatacatctgaaattaaactcgtcatctttctcattaaactctgttatgccatcagtgtctacacccacatggtcacttaaaccacaattctgggatatgcctggaatcatctctcacacatgttcaatgtccatttttttcctttcctctgcatcctccttgcttttgctttgctttagttatagctaacatctattgagcatttgcatgtgccagcccctgatgcaaatatattacatattttaactcatttaatctgcaaacaaccctactattattatctgcattttacagatgaggaaattaaggaacagataagtaactttcccaactgtcacacatcgagtaaatggtaaaaccagaatttgaacccaggaagtcgactccagtgcactctctcttaactgcaataactttctgttttagcccctcattgtttatttaccttattattatagaagactttcagtttgtttatcttcttcaatctcaccaactcctccccgaaattccatctttcatacgaataactaccagaatagcttttctaaaacacaatctggtcagttacctaaaaatccatcggtgcttcaccatcactttcaggtgaaagtttcacctccttaatgttgcacaaggcccttcatgatctggccccagcacacctctacagtcccttctggaacttcctcacagacatggtcccatccagccacactagatcattccaagtttctgaacagatcttactctccacacctatctccttgctttttgcactcactcagaggtcctatgtcaaaagtacactgttatgagtgttgctcaaagctccccaagggctgaataggtaaccctctgtactttatttacttttcacatagtatggtaaacggaagttcagtcttctctctctcccttggtgtcctgtataatttccttgaaggaagagttggttctttgtatctacagtacctaccaaagtgtttggtgcatgatgatcatcgagtaattttcaaaaagggatgaactaaggaacacaactgcttcttcccttttatggcattttcctaaacaaaacccgggacaaggagatcccttgaaaatcactgactttacccttgtttacttacctgcaggagaaattcatcttggagcaggatcacaatactataaaggccacctggtttggtgtggcacatgttggggctgcacgtgagagtatggaaatagaaagagtagcatatgtttattcacatcagtaaagggaacaaattgaaacataggagtcatggtatccagacataatatcaatattttgggaagttatttttaatgaagataactaaggggacttaaaagggtgcattttttttctcctttgcatggcgattgctttttggggatgccaatgcagaaattcttgggttgtagaatttttaaaaagaagagcacactagttttatttattttacaggattctggtgcctttgtgacaggcaaccacaagtgaaattaccttcaatggtcttggcttagtccctcctctgctcctaatcatcccctcaaacccacatacattagacagagcggttgtccttcaccactaaagaaatgcagccgagagttatgttaccgtggaaacagaatcactttttgctgcaagacacactgcttcatctgcactattatgaagcagaatacattggtagggctgggaggggaataaaatattctgcctgccagtgttgtacttggcctttgggggaataaatgactttcaattagagtacttaaatatcttttaactttaataattattattagagcctcaacagaattttacttggaaaagagtaaaaaaaaaaaagattcttctgttaaagtaagagctataaattctttcaaactacaccactcctgttaaagaaaatgcaagagaatttacaattaatgggttcattgtgtataaagataagtgttttagctcttctttgttttttgactttctaatttgatcaccttgtggatttgtgagattgtccttacctctttccttttttggtctctgcttttagcttctttgtagtaagcacacttatttacagcttcatcttgtgttgggctgtgtgtatgcaggtccactgttgttgacttgctgctgagcgtccagctaagtctgtgatctaagcctgtcaccagtcccacttctgggccctcccagccaaagccactagttcccatttgctacctggttctgctactgggaggctcccttccctaaattcagtcacggttctattttgttttctttcctctacttgatagctcttactgtttgtgttgttatcagtgttgaagaacaaatccatatgacctacactagttgaaggatgaactctataggatatcagaaacaaaacaagaatcctgtgtccttcagctccaaagatgctcacagttattgagttttcttataggcccccagaaagcactactaaaacaaacaaacaaaaatcttaaaacacacacacacatgcacacaaacacacacacactcacatgtgtgcacattatctcacattacctcagagtctaactataagcatataatcacaggaaaatcccacatcatgaaaaggaaaaatattttattggctgtaaataaattagaaaagaatgtgatactttaaaagtgttagtgttttaattctagaggtagcaaagcaaccttaagagacaaatgacaattcttgagcaactagtcagtggcgggcactttttatatctatcaccccatttcattctcaaatgaatctcaatggctactattatttttattttgcaaataaaatgaaggcactaagactcaaataatttattttaaaaaaaatcattctccgattgtataattcatccatgtaaccaaaaacgactagtaccctaaaagctactaaaattttaaaaagtcattctcaaattccccacacaaaccctaaattgtttctgatttcaagtttagtgttctttccaagtgcatcacctcatacagtgctcagcaaagctctgaattgggtggctggggaggggtatgtgctaaaatccagggaaaaaataagaatacagcctctaattctgcctttccacctctagacaggacttcgggaaaatcatttatttgtttcaaattcagatttattcatcctgaattaatatggataaataaccttttatctcttcatgcaagtaggaagttaatgtgtgaaaaacatgttgaaaatactaagggcacttttatttctgtggaaagaatgacttactcctgttaactataataggtccagattaataggtccagatcactgtcaatctattcagccatcccaattaattcagccaccaaatcattattagtctcaaatctgcaatgttttgagagctgaccctgtcacatattgcttggatatctgccaaataatttctatagtgttgggttgagtagtggatgcataatacttatctttaagtaatgaagtgtggatcaaatcaaactatcgtccaatatctaatttagtcaccagttatagaccctatttcatcataataccaaaaaggattcattaaatgcctggatacaattagtctaagttgctttacgaagatacagtcataacctttgttcatggtattaaactgatttttaaaataatgatctattttattatcacatagaaggaaatattttatttctctaaactccattgcttgcctttcagagagcctcaggaaatattagtggagtaaatattgaaaaatacttacccagcacttgaaatttcaccttctgtgtctcttataaattaacaaaaaattgcttcattttgagtatttcatatgtatttactatactatgaactttacaaataccacctcttttactttttacaatgactctctaaaattgaatctattggtgtcatcaggtttaaagagtaaaaataacttgctcaagtcaaagtgccagtctgtagcacagcctgactcaaatccgtgcacaccaactctaaactgcaactcttttttttttttttttgagatagagtcttgctctgtcacccaggctggagtgcagtggtgcaatctcagctcgctgcaacctctgcctcccgggttcaagcgattctcctgcctcagcctcccgagtagctggggctacaggtcgcctgacaccaagctgatttttgtatttttagtagagacggggtttcaccatattggccaggctggtctcaaactcctgacctcgtgatccacccacctcagcctcccaaagtgctgggattataggcgtgagccactgcacctggccacactgcaactcttaaccgcaattctgcacatcaaccttgtgtgtaaagttgcctttgagaaaaccagctttcttttgctgcccatctctgataacttgttcatcctttgttttataaaagaaaaaaaagaaaagacagaaaaagagaaggagcaaagaaggaaagcagggagagaaggaaaaaggaaagaaaaggaaaaaaaaatcactcaatgttttccaccctccctgaataacctggggataaagtagatcccatccaagtttttgacacgagtcgacattgttgaaaataatcatgtgaagtgccagctttgtctgatgatgtcattttgcctttgttttgcatttatcaggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagtaaggccttttcaaatgatgattcccatctcctctcagttgcctagcagggaacattttaaatggatgtagatgaaaggtctcacataaatcctatgttttatgagacttgctgggagctctgctttgcattccctttataaaaagctgacatgccagaagccctgattgactttttttccccctgcgagaatgactaaaaataacatggaagaagatttagagctctgcagcgattgaaaaatgcaatatcaaaatataaaatgtggaagaaaagcctcttcttaaagctattgtaacttgcctggccccacgtagttcaaggattatgtgagataacacgtggccccatgaccactggagcacatgggttaatggagttaggggaatggcctacaactctgcatggccgtcttctttccccaaactcactgtggggagatgggtgaagacaagtcaggccttgttaaagttagtttcagaacaattactcatgccttcctttctcatccctaaaacattggtgggggagctacacaatgtactttttcttttctagaggaagtatctattcactgtgaaaatctgaaaaatataacaaagtatgtgtaagataaaaaccccttgctatttca

SEQ ID NO: 554 - DNA, 425790 bp, Homo sapiens
gcctaataatcatttatttttcatagaagatgagcacaacaggacaaaataaaaacaggaattgtgtaactggtcatcggaataaaagttttgtgctgctcagggattacacagtgttaaaaatattcaagaatgctgcagacaaaattgtatacgaatcactatgtatccttcctgattcatgacattaaaaaaaaaaagcttaaagaagtgtttgatgtttcaaaggtaatgatttcattacaatctactcataagattaaaccacaaaaactacatttaaatggcattaagggtctgaagtctatcttctggagaattaccaggtattacatcattctgtaatatagtgtgagtctgtggtatttgggtatcagtccattttacttaaaattacaaacatgtttttacactcatgtgcagggagcagttttttttatcatttggccacttagtattttaagtggtcaaagtctacaaagtatgccaaagaatatttcatctgtgaacctcaatatgcatagatttttttcctgatttagaaaagatcaaaggtgctaaaccttagtaaaactgtacatttatccctatgcaattttgtcatttaaattaaatggaaaaaaaactagttccaaagactgaatatgagtcccaatattatttatttgctgcagccccagcacaattttaagggcacattgaaacccctgaaaatagaggtttataatagaaatactgataaacctttaactactagaggaaggcattaacagattccaataaactacagtaacacgtaatgaatgaatatatagatgattctgtctttgttatctttgtcaaatccatgccatcttaaaccctaaccagtataaattatactttttctggctgtttttaaaatttttatctattattttaaaaattattttctctattttaatcaaacacttgaagtttttagaaaaagatacctatgttacattgcagcttcactttatgcaggctcatcattccattaaacaatatttgaagactcgaatcaatcaaatacagtctgtgatgcatgcattgtacctaaatttcctctaaccactctcagaaactgaaacaatgtctttgctcttaaaagagaagagacttcagatgtaatcaagaaaacattgtgtaacttgcctctaagctcttcagagccaattttactatggcaggatattccttcctgataaggtgattaatgaagtttttggtgctcacttttctctcatagtctataagctcagtataccaaaaaaaaaaaaaaattagataaaataaaacaaaacccccaataggtcttgaaaataatataaatattttgtggagtcccagtcacataatactccactcccaaacccagagaaaatgatcaaggtcttgtgagtctttctgagtccttcaaaagggatttgatttccataagccatgaattccatccgtttcagcacagagtatagaagagatgcttagaacaacagaaggaagagacatgcggggaagataattagtggtaaacagagaataaattctctctcagtagtgtgtacttgacgttaatgccgatgataattcatctgatctacagaatattcactttaatagagagatgagagtctgaaatgaccagaggaaaatagatactgaagccaatatagtcttgataccaaaataaaattaaaatgagaaactaacatgataggttcaaggccttttgggagcctgttttctttgccagatttcacattcttacagcttcatggtctttttcttctaacaaattaatcagctgagagaagctgtctttcagtgcatccatgtcatccagtgagcagggctgtagaatccagcgttttccacgtgcaagtggttcaagttcaaaatattttttgatcttaagaggaaaaaataaagataaataggttattaattatatcagaaactttctcatatcaaaattctgagggataaagtaggggaatttcgaggcggaatttatacgaactgtgatgcctacaactttgcaatgtggatgcctgtccgcagctgttgttataatgtgggttatatattgtgacctgggagtgttttctttagaggtgaatgatctgcgtgcaagccaccattccacccatacatttagcagcgtgggaggtctgatgaagtcagagaaaaaattatttgcactatggcaccagtcaagatacattgcagacaccaaaagattcgatttcatcaaaataattagcagagtagctttcactatctcaccttgccaacttattaaatgggtgacgacttacagtaggtactatattgattactcaagactcaattattttgaccatcaagcacataacacaacaaaaatctaatttaaataatcttcttctctttctctctcaaatttctagtatctgcttctgagacatgagagcgtgttttctaggaaagaggatagaaactgcatgtatgtatgtttgtatgcatatacacacttacataaatttacatatatgcgtaaaatcttctacctttttttttctttttcagtcctgaattttctaggatggaaaaagcaagaacttataataggtatgtgctgaaaaacctgttcaattaataaccagtcacaagtcactcttactatattggccagcatactgactaacggcatttagtattaccaattcctggctgtgaataaatagcaaattattatggcttctagaagtattgatgatcttctctcaaaaggtatcataaaacacaaagttcaggaagctcccgactcatacacactgtatcatacaaaagtagaacattatatttattgcccaacaaagttttacataacatcaaatacagttagtagcaacatcaaaagagacattgctcaaagatgttcttggttaacaaatttcgttaaatctcatgtgtcatgaaaaattacagtcttaccttagtcaatacttgacctagaaaaaaaagtatctccactttaaatgccatgctcaaatacggttttattttgccagtaccagtgcagactactgtttgttgacagtagagatatgctatccaaattggtattaatatgtttgtacattttttcatataagccagaagacatatatatctatatataagaaatactaagctattatgctaatttaggaaccagaaatatactaacattttatagtccaagtatgtccaaaaagtctccttatcaatgtctgaaagttcataataaacactaatttaaaaaaaaaacctgtgagaattacaagatcctcattaattctgattctgaagagtaatgaacacctcacttgcagatcagaaaatggatatacaacttcagaacaattttttgcccaaggtgttttataaatcatgttaagaggattctttgttgttgttgtttttctttttttgttttatttatttatttttttatttttatttttttagattagatagggtctcaatctgtcacccaggctggagtgcaatggtaggaacacagctcactgcagccttgacgtcccaggcttgggcgatcctcccaccttagcctcctcagtagctgggaccataggtgcacgccacaacaactggctaatttttaaaaaatcttctgtagaggtggggtctaaccatgttgcctagggtggtcttgaactcctaagctcaggggcttctgccacctcagcctccaaaagtgttgggattacaggcgtgagctaccatgcccagctttaagaggattcttgcttactgaaaacacaaactccattcttttagcttgttttctttatggcactgaaaactattgacatccaagacaatctgaaattcctggtgcaaagaccagtatcagggaccaacccaactccgcagagggaagaactgccagttagctgagtaggggaccattggccaataggggaaaaaagagtagggaggagggactggtagggaatcctggctaagtccacccttagaaggaggtgggggctgctccaaagagctgaaaatcagagatgttggtcttgttgcttctgccacaaagtaaggcttcaggttgtatcactgagctcagaaattgggaccactgtgcttacaatgcaatctagtatttgatcaataatgcttcccatcagatgaagtatgcaacatccaaaatctagtacataaaggaagttgtgtccctgatacatattataaacccaaatccaaaaggacagcattttaagtattgctaatgactgagaagagggctggtcacaagaaattcaatattaaaataataaataataataataataggaaggcatctcattaacaatacttcctctgggtggttaatttaaaaataatacggaattgatcccggtagcatatttacagctaatttgaaaacaatattggattaaaataatcacaaagtatatcagtaatatgtgatattttacaatacctaccagacataaaacagtgaagttcagctacctgttaaaggttggtttctaggcaactgaaaatatagtctatcacacaggcatacatggaagataatacaggtgtctgcaggtagacatgattcagaagttgttcctgctgaatactaaacatgagaaagaagtggaggttacagggacagagtggtcagcagataaaggggcctagtggtgttaagctgacaaatatggctgggtaattcaagattttcagatccatcacctaagtgggtatctaacactgccaatattcactccactggtatccacaggattccacacaactctacatttatggtatcaatttttaaacgagttttgccatttcactagtattcaagtacagtgagtgactgctgctggaacatttattagcttttcattacttggaatttcatgtttctaaaaacaaagaccacagtacagagaggagaagatgaggactttatgttctagttctgactgtttttttttttttttttccgagacagagttttgctcttgttgcccaggctgaagtgcaatggcgcagtctcggctcactgcaacctctgcctcctgggttcaagtgattctcctgtctcagactcccacggagcggagattacagatgcctgccaccaggcccagctaatttttgtatttttagtagagacagaatttcaccacgttggccaggctggtctcgaactctgacctcaggacaatctgcccaccttggcctcccaaagtgctgggattacaggcatgagctgctgggcctggcctaggataacatttttattttgttatcttatatcaatctgaaattcaaattttactttccctatgttattacagtaacaattacagtcacatttgaattgttcaccattgcttttttgtctttgtatatgttgatgtacagttttaaagaatagtgtttaactttgaacaacgtaagtcatatacttaacatctgacgttatttttaaggtttaaaaaaaaaactgcctgtgatgcaatgatctattttttatgatggacatacaattttttaaggccatttacttatcaagatgaacatcttaaaaatgactgaagagaacatgaacctaaatcttttgactacttatccgttgctgaactagcacggttaagtgaaaacttcttgaataaggagatagtgattgtttcacattggcctttggagacggcacttgggagaatgacatcagaatacagctgtctgacaacctgtggtcatttagctattttcaggaaagccacagagagtgggcatttattagtagccatgtgtccaccctagagataggaaaacaaagccaccaccagcagccaacctattttagccctgtcaccagagcctttctccactcatgccactgccggctgattggcatgactgcgttccattattcacacatcgcgtttactgtaaagtcccaatataacagagacgactcggcaccatctcactgctgctaatgtttgtagcagctgttaaacctgtgagacattacatagcactggagacccactcattgggtaggagatgtcctttatgtttccttgagcagtgaaatcacagtatcatcctttcctaggtccaggatctctaacggggcagtgatgctctctgatttccctatcttgccctcacttgagattcaaaattttgattttcagttcttgccaatttggtgtgactaaatttctagaaggcatgtaaacagttttgaacttcaataacaagtctttcctttttaaaaatctgcaaacttcattttatttctaatggtaggctgcttgtttttcctctgtttgttattaaaccagtagtgtgtgcccagagttgaactagttttcctgtaagcattctggggagcaggggaacagaacagtccagaaagggtttacttagtgtttgtgtgtgaaagagagtcatgttctcagctcagatatttataaacagagctttgacccacaagaacgtgttgtgagacatggagagccagggtgtgtgacagttccttactgcgtgggactctgctctgcatcatagaatacgccacccctagttctactgagttagatgccatgggcaacaaccagtcattgctagaaatgaaaacaacctgcaccctcccatgcccaacacattccctgggtggtcctgcccgttgggaactgctgctcttgccatgtgaaatacaggtacctctcaccctgtatggggctattagcttattttttctgcatagtcaccactggggatggcagctggatatctgctttccccattctcccccagatcacccactacacacaatgcctatgttccctctgtgaaaaactagtggattataactgacccttcttaagcctgcgaggtggttgtggtggggtcaggatctatctaaggagctttggaaagttttgccctaaaagttggcttcccataacttcattcactcagccgctctgtcctgaacgagactggagagtgtgagaaggcagctcgggtgccagcactccaggtgccagcagacggggctccactgaagacacgatgctgcaaactgaaaacaaaacaacaacagcagtggtctgagaagagcactgtcctcatcatttgtattataagagtacagggttttcccccatgagctttttagtgaccataaaagaccgtttaatactgcacagtttactaagggctttttcacttatttatagcacttggacttacttccactggaaggcagaaaaacaatggattccaataaagagggatatgattacttagactagttcttaaatcacagaactcaatttgaataaaaagtatctggatagaagactgttaaaataaactttagaaataaaggcacattctccatctctggaaaaggaaacaggtctcatgaaggagtctaggttgacaactttagctccttcaaactgatggggataggtcagctaatgcagatgactgggtgaggatctcaaaccaaatacaaaaggccaggaaaaagaagtgcaactgtgggatgtgacagggagaagggcaagctggaagatgatgcaagagaatctgttaactgtcttgaaccacgtgcagctattactgctttcttgtaagtttaaatacacagtgtccattgcatggcatgtatttttcaaagaactataggaatcatggttttgggatggattcatattggttctgttatttatttattattactgttacttttttttttttttttaaagaaataggccctagctctgtcacccaggctggagtgctgtggcacaatcatagctcacttcagccttgaactcctgggctcaagcaatcctcccacctcagcctcctaagtagctgggactgtaggaatgtgctatcatgcctgcctaatttattttttattttttgtagagacattatctcattattttgttcaggctggtcttgaactcctggcctcaagtgatcctcctgccttggctcccaaaatgctggaattacaggcatgagctactgtgcctggcctatactggttttaaactctctagtaaaagtatggtcttgctccaattaataggatgccaagagagcctgaatggacagcaaaatttcgtaggaccttttccatgattgttacaaaaagagtgggactttccttgtctatgtcctagcacctttctttaatcactagagtagatagacctattgtgtgaacgtgtcacattagcggaaaatatttgcattgaaatttttctcagtgatatggtggggcccgctgacatagggctggcaatagctgattgtgtgcattctccttccaactccaggtacacggatgtcaaattgtacaagtcatgaacgtggccatggtttgagtatttacaccacagaaacctgcgagtacaacaaatcaggactttttttctttttaaagggacacatttaggctgggcacggtggctcacgcctgtaatcccagcactttgggaggcagaggtgggcggatcatgaggtcaggagattgagaccatcctggctaacacggtgaaaccccgtctctactaaaagatacaaaaaaattagcagggcgtggtggtgggcgcctgtagtcccagctcctcgggaggctgaggcaggagaatggcgtgaacccgggaggcggagcttgcagtgagccgagatcgcaccactgcactcgagcctgggcgacagagcgagactccatctcaaaacaaacaaacaaacaaacaaacaaagtcacatttaccatcacactactgagtgtatacatcttgtatatgtatttgcaaaagggccctccagctttgctgccttcattacagaggctcatgaagccagcttaactgggtaaccttcaccaaagtcagagaaagccatgcccacgccatggctccaggacagggtctggagataaagtggcagggcatcattaagattcttcagagtgcattcttggcagcttgttcaaagaaaggttagtctagagagcagcaccagctgttcctcttttcattgcaggattttgaaatccttagaaaggtactaaatatgtcattaaaggcagaaataaatgatacaaataaaaaaccaacttgccacagtccccaaaatattataacacagaatggatattattcactttttactgagtgcttaacaaggacctgaaaatgatgacttgatgttaaccaatatcacaatattactttgggggtgcgtatttatttcaaaaagatggtaagtacaaaagtatagttctcataagatgcttctttcttaaggatactaaagttcagtgcagcctacctgaataattgaaaaccagacaaataattgcaggtaatcacctgtgattgagccttgctcttactataagtcatcttccccaatcagtaacctccgacatgtatagaattttatttgttgtgacaataattgtgtagaaacccagtcttccaatgcacgggagaagttagtatgtcccagaatagccaaataaaatgatcccattagctttggtggtaggacctaggatctgaaaaacagtcttgtttttgcttaatctgattaccaagaagtacagagcaaacatgtctgtttttatttaaattattatttttggtatgccttaggggcttgttttattcttctatccaaaaagcttacttctagataaccactatgagaggcacagttatgtatgggtgcttcttgtcttcagggactaatgaaagacatccagtattcccatatctgtacccttctctactccagttattctatcaggccctctacagcctgagggattcctgcatccaggcctttgctccaactactgcttccaaccctaggtgcctccatccacaggtgggaaggatcagcctataaatactctctcatcttttaagaccaagctgatgtcctcctatcacctcaaggggatcgcttatgatataggagcaacttttgaattatatagaaggggtcttagtagcagaggccattgttggttgcctcctcatcacccaggcaccataaattccctgtaaataaaattttattagaactcagcatgctcatttacttaagtattatctatggctgctttcatgctacagtggcaaagttgagtaattgccacagagatggtatgtcccacacggcctagaatatttactacctagccctttatagaaaataaaaagtcaacccctggcctaaagcattctgtagccttctgctttgtctagcagggaggcccaaggagtgcttgggaggagcctggggcatcaggctttctgtgcctcagtttgacctcaaattgctagacttcctctcccctgctttagttcacactttagtgggacagaggatttgggctttccagcttggctgggctccagttacgacttcggatgctttgaactgtagtcaagcaggcagtagggtcatctctcattaaagaaagccatattttatttcctctctgtgtttagcctgtgtttctttcgtgtatgtagagacttgctaagaccacaagaacaagccagggcacaggaagttttcttaccaactcccttagtactactccccattaggcaagtggtcagtgacctgtcagtttgaggtttttggtgcccttgaggatggcttttggtgcacagcaatactagttattgttactttgcagttttgaaaaggaatatacagtttgttaaatttacaccacctgaagcctagcttttcctgaaatttttgtgttacacttaaaaattttaatattctatctacatatcttttcaattttaacaattacatttatggtgcctttgaatactctttgggtgcatttataaactaagttcatttttaactcattttataattccatttataagtttaatatattcagttttctttttaagcatttcaactgtttaacaatcaaaacatccccaagtggttgagaatcttagaatttttttccatgaattttatgaattaaatgactctcaagttctggtacattctaaatgagaatcacaaagagaatctatcagtttgatctatgtgtaacatatactttaaatgaaagtattaatattgtggggttattttatcattttaattttactttttaatgttttttttgagacagagtcttgctctgtcacccaggctggagtgcaatggcaccatgtcggcttgctgcaacctccacctcccaggttcaagtgattcttgtgcctcagccaaccgagtagctgggcttataggtgtgcactgccacgtcccgctaattttggtatttttggtagagacagtgttttgccatgttggctaggctggtcttaaactcctgacctcaagtgatctgcctgcctcggcctcccaaagtgctgggattacaggtgtgagccaccacgcccagcctatttaatcatttttatactcttaatgttaaatcttccagggtaaaaagacttttcattaaggaaacaatttgccatcccaaatgaaaggggttataattccatgtaacttgaggttcccatctaattgaacttgtgttggtttccctttatttatttatttattttttctttcttttgagacggaatctcactctgtcgcccaggctgtattgccatggcatgatctcggctcactgcaagctccacctcccgggttgttcacgccatcctcctgcctcagcctccagagcagctgggactacaggcgcccgccaccacgcccggctaattttttgtatttttagtagagacggggtttcactgtgttagccaggatgttcttgatctcctgacctcatgatccgcctgccttggccttccaaagttctgggattacaggttgtgagccaccgcgcccagcccaaacttgggttgcttttcaatcaaaatttttggagatactcattgacaagttaagccctttcaaaaaatagttgtgacaactcttagaaaacgtcggtcttcaaagggggttgtttgctcctggattaggaggtagttatcattacctacttcactgtctactcacacagatggatactcccacctaagattctagataatttcttccactgcttggttggactttatgtttctttagcacatgttttactatctttccatcttgctctacagatattccattttcttttactgataatttgtatactataaaattcatcctttgaaagcatacgattcagttgcttttagtatattcatagggttgtgcaacaatcatcaccatctaattccagaacatttctgtcatctagagagaaacacctgaaccattaatagtcatcccccaattatgctttccttcagcctttagcaaccactactctactttgtttcttcatggatttgcctattctgaacatttcatatagatcaaatcatgtaatatgtggtcttttgtgtctagcttctttcacttaacacaatgttttcaatggtcatccacactgtagtatgtatcaatacttcatccctttttacggctgaataatattccactgtgtggatatatcccattttgtttatccatttattggtcgggttctactttttggctattataaataatgctgctttttatgagcagttttgtgtaaacacatgttttcatttcttttgggtatatatctagggatggaattcctgggtcatgtgttaaatctatgttgtcaaatgcttttcctgcatttgacatgatctattaacatgactgtatgatttttatcttatagtatattaatataatgtgttacactgatttttgtatgttgaaacaactttatatcctgagataaactatgcttgattatcatatatataattctcttttatatgttgctggattaatttgttagtacagttgatccttgaacaacatgggggttggggtgctgacggccacacagtcaaaaatccatgtataacttttaagtcccccaaaacttaactactaatagcctactgttcactggaagccttgccaattaacataaattttgtatattatatgcacattacattattacaataagataagctagagaaaataaaatgtcattaataagataataaggaagataaaatatatttactatttattaagtgtaaggggatcattataaacttcttcactgtcttcatgttgagcacgctgaggaggaggaggaagagaggttggtcttgctatctcacaggtggcagaggcagaagaaaatctgcatataagtggacccacacagttcaaacccatgttgttcaagagtcaaatatattggttgagagatttttgcatctatattcacaaggaatattggtctttaacttttttttgtaatgtatttggttttagtatcatagtaatcttggttttgtggcatgagttgggaagtgttccctcctcttctactttttggaatggtttgagaattggtgtaaattctttaaacgtttggtagaattcagcagtgaagcaagggtcctgggcttttctgatgggaagggtaattcaatgtttttacttgttataggtctaattttgatttctattacttcttgagtaaatttcagtagtttgcacccttctaggaatttgtacatttaatgtagtttatctagttatttggcaaacaatttttttaattgtattccttcatagtcctttatatttctttttttttggtttgggttccacccgctgccccccctacccccgacagacctcactctgttgcccaggctggagtatagtgacactatcatggctcactgtagcctcaaccttccaggctcaggtagcctggaaccttccaacctcagcctcctgagtagcgaggaccacaggcgtgtaccaccatgcctggctaatttttgtatttttttgtagagatgggatttcatcatgctgcccaggctggtctcgaactcctgggctcaagcaatcctcctctcttggcctaccaaattgctgggattataggcatgagccactgtacccagcccctttttatttctgcaaggttggtagttgtgtctcttctttcatccctaattttagaaatttaagtttccctcatttttgctttgttagttgattaaatatttgtcaaactggctgtgcgtcttggctcacaccagtaatcccagcactttgggaggctgaggtgggtggatagcctgaggtcagaagtttgagaccagcctggccaacatggtgaaaccccatctctactaaaaatacaaaaaattagccaggcgtggtggtgcacgcctgtaatcccagctactcaggaggctggggcaggagaatcgcttgaacctgggaggcagagattgcagtgagctgggatcatgccactgcagtccagcctgggtaacagagtgagactctatcccaaaaaaaaaaaaaaaaaaaaaaaaaaaaaaaaaaaaaaaatagatttgtcaattttattggtctttcaaaaaaactaacttttggtattattgattttctctattgttttcctaatctctatttcatttatttctagtgtaatctttattatattctttcttctgtctgttttggtttagtttgctcttttttctcctactttcctaaggatgaacaaacatttaattttaatggcattttaagagcattctgttggatctcacccccatatatattattatgtttcaatttctagcttttttgattgattcaagtaaatgaagttctatattcttttccttgttttcttatctagcatggttatacctcttatacatgttaaaaataaaattcagttggattatgtctctctcacattttgtttctgtattcacaagagttaatgacatattccaagttacgacaagaaaaaatgtaaatgatctgtttttcaatcagtgaataggatttctaatcttacaaatcagggacagaagagtcctccttacttttttcctccctacatctatttatccaattctacattgcggagttcacttgtagcaaccacttctagtaccaaattatgagtaactgaatgttaatgtttggtagaattaactcagcaatcccttctagtacgaaattatcagtaactgaagaggcctgtggttgacagaaacagaatgcccaacttaaactggcctaaaaagatgaagaggatttatttgtttataaaactgaaatatcccctgctagtgtgtgcccactggattcagaggttcataaggtaatcaaagctgaggtttggtttctaggtagtctccgcaggatacaaatgctgaaagatagctgatacatgaagaaatagccaagaaaactgcaggtgtgattgaaccacaaacccctgaatcaagctatgccaaaggcctgcaatctgtgaactttttagttataggaaccattatactctgcttataacaggcattataaataattattgtataaattaatgggttaggctatcaagactcaatgcagatgaagcatctccacaagtctctggtgaactccattttcagttacagcataatccagatttggataattattccctatttttttcatgtgtatgagtcctcagttccttgagggcacagaaatgaaaaaaaattgtattatctagtattctcaatataatgtgagacacaaagaggatacttatttgaaaaaaatagatttaaatagctgagctacaatgaaaaagacaacaaaatatgtactatatttcattccatgttaaaatgttagtaaaagaagaaaattgaatattggagagaagttaccagtcttcccaattaatcaagccatggtttcatgaaggaggtgggattttacatgaagagtttcaaaactgtagatataattggttcaaatgattacacatatgcctacgggcagctgcaatgaatcgtgttgcaaacagaaaagtaaacaacctatcctggaaaagagaaccactccagaaatctcaagacccacataggacacttatgttttgagctattcctttaatctgtgtccaaacaaagcatctaattcttatttcagagaatggaaagctctgacatatgcaaaaagagaagcatcagtacacttgtctttgcatgcaggtgcaagcaacagacttctcaataccatacataacatagtcgttaattacagaggcagccaggttcaagagcacatcatgttctcttcctttttctcctctcctcctttccttcctttctgtcaatcatttccactccactctttcaaaagagcattcatttttggtatcaagcacttttagggtattctacttgattttttatcttctgtatttggggtaatattcagttatgattttccttcctttcaagaaagcaaatattgtaagtaggaagaaacctattcaatgaaaacctttctcctggcaatagaataaggttgtttaaggagtcctacctatatgtctgtaagctaacaaagtatgtactagacaggaaagggagttaatgagtgaaagccccaaacacatattagagacaaccaattagcttgtctgaaacacaggcttgtaaagctatcagtatcttataaaatggtctgctacacacgagtaaaatgttgtttaaatggcttgcttaactagatgcattcaccatgaaattgattcttttaagttttttttttaaacttaatacccattaagtgtgcatattgaaatggctaggtgggtgggagggtgggtgcacatcctgatattacaaagtgcaggttgaagatatgagttccatattttatgaggttaaagagcatatgaaaaagaaaaacaactcatgattaccaacaattgtgtctgcctcagtaactgaaatgtttcaacacagttggattattcctcctttgccttgctaaaagcttagactgggatggctagatgtgctctgaggacattccagtgctgagaatttatgcttttgtgttacagaaaacacggttttcccaccatagcctttgattctgcaaaatagcatgagaggaagaagcccctgagcctggtatttttcaaatccaacatttgcctcagagtgaacatcaaatttcatccctctaagaccttacaaaacatttgaggtaacttaacgttagctgacaaatgaacaattcctgattctatttcacattctcaattttcttaaaagtctactctatcttttaaaatgagtttttggccacacctcacattcaactttttctgttatacgaggctgtgtgccacaaatacacgtcaaacgattgctacctgatcagacaaccaggggaacgtgatttgattttgtcaagtctagctattctccctgctaatccaatattggcacccttgtgcactttattaaactactgtcaattggccaactcaagggattctctgactcaacaaaatattagggagaatatatttagtcaatggttaaagaatgttgaaggcacaaatatcttttaaaaacagtttatacacacaaggttatttggcttttgtaatggaatatatgtcccctgtctcaatcttgcagctgtcgggtatgaaaaaacaacagcagtagtaacaaatcaaaatgttaatatatggaacccaaataaacatgtttaatattggccttgtggtactatggcagcactctgtcctaacaacgacaacatttagatgctggagcagattcaaattcttgggccataaacaggagacagacaaatatggcaagccacgcgttactcagtcaccaatggagggtgccaatggccccgtccagatgcagagatattcaagggatgtgcctgtcagcagtttgtcctctggctacagcaagaagccaccatggaaacaccagaaggaaaagaaaaaacaggaaagcatggagaactaggggaaagaggggcagggagctgaggcagaaaaagctgacagccgcctcaatagcacatctgagcaagggcaacaggtaacaaatgggcttgtaaccaggtgccatgtcagtcacgggaagggaatttctttccctgctggcaatacagtcaggagcctaatatcctggcaactgagaaatatgagcttggaaagaggcttgcaggccgtctaaagaaaagctaagtggtaatccgtactgaggaattttagccaaaaaatcccacacaggactagttgagctcagtacaaagcctgtgaaagacatgtctcaagaacattctaatcagacataaagagaacaccagaaataaaggttccaaaagccattgactgggatttaccacagcattgggagtgtggccttgggtcgtaattgtcatccatgactagttgaaaatactagttctaaaccagggaaaggaaaaggcaactgtaccttcccacgggacatttgataatgtttggggattgttttggttgtcataacagggggtggggaagcagagcaggtggttactaccagcatctagtgggtagaggccagggagatgtggctaacatcctccaatgcatagggcagcttcccctctcacctcaacaaaacattatgtagcccaaaaggtcaataatgccaagattgaaaaaccttgctctgaactgatcttctaaggcaaaagtcagagaacaaacccctgttaatgattcaatccacagtttagcagcacaaaccatcagactcactccctggaaccaggagatttagaaagtggactgggagggtagaccaggagctccgtccaggagcatcacaggtcaacagctcctattctctgtgcttctttctggctcaaaatgaatgatcaacagatcttggggggccaagtcagtacaccaaattgggctgaaacaagtgtgccaaggaagtagccacctttcactcagtctacacagtcactgttttgggctctggggatacaaaggtgaacataacaagtcctggccctatggagcttacatggtggccagcgatactgacagatatcaagtaactaagtaaagtcgggtaggaataagtgacatgaaggaaaagaaagtaccacagcaataataacatttgctatataactgatctaaaggagggacagaaggcaatatatgggttaaatataaagcagccatagataaggacaaatctatagttgggttcaaaacaatagcacatagagctatgataaaagctctactgattagtctccacctaatcaccttggatcaaccgactcttcattgtcctggtacaagacaaatgattgatgttgcctacacagtgaatgttcatgaccagtggacacatcaccctgaatgatggtaattacccagtggatgctgacaactggtgagcactcctaggttgcttcacagctctcaagatggcaatcatatttattattaagtagtataagtaaatgtgacaccaacagataaaatatgaacttgagaatttctattcctatgaaaaactaaatggaatgagttcaaagaacttaataaaggtgagtcactaaaaccaaactgctgttggattggatttagataagataactacaaaggattgagagggaaagatgcagattgcttcccaagtatctttaacttatagttccattttaaagaaacagaagctgaaaaatcataggtaatggctgcttaatgaaacaaatataaaacacaactctgattagtggccacatattcagataaaaggccttggcccaacatgaaaagattagtaccattggtatgtttaaattaaaataaattatttatttttagttccttttttttttttttttttgagacagtctcacccaggctggagtgcagtggcacactctcggcttactgcagcctctgcctcccgggttcaagcaattctctgcctcatcctcctgagtagctgggattacaggtgcctgccaccatgcccacctaatttttgtatttttagtagagatggggttttgccatgttggccaggctggtctcgaactcctgacctcagatgatctgaccacctcagcctcccaaagtgctaggattacaggtgtgaaccaccagcgcctggccttttagccagttcttgattaactgttcaactaccagttcagaccaggccagatgagtgggcttttaactacacgttctgctctaaatttccagtcacacttttcatcatgtctgaatcaaaagcattctcagaggggaagtcattaacacccacttcagtctgaagtttagagtgttacataaaagcatgtccactgtcagaatcaatactagtgtctatcacctcaaatccttttttgtgacagtcgagtataaataaataaaattaaaatactcaaacccacgctcatgtgcacacccccacacccctacagtttcctgtagaaatattcatctctatgaaagcatattatggttataactgaaaaccttgttattaaatataatattagttaaaatattaaacataatgttattctgaatgtatttgtaaaatatttcctaaatagaacttattccaattttctagacccagaacagaaacagaattctattataaagtatacccatcaagaaaatgtcctgagcttttcttagcccatgccctgattacaatcttccacactacatttctttagagagcaggtaatcttagtgctttgcagaatagtcctattttaccttgaaattatcatctgtttctttccaaatgaattcttaccaaattcatttttcctttggtaaaatgccaattccagaaaagcgcttaaaaacaaaaatcatataattccaatgcctgacaaatgatagcttgtaccaatgatctatttttaactagaaggtaagtgttaataacaaaacaattctaaatgatacatgtaaatggcatttgcctctatgtgtccacaaacttacttttagttcctgataccctgtcacatttagcataaggacacttatacgtcagagtccttgaaatagggtttgtaaattttaggtgcctagtcacagcatctaatctttcactgaaaaaaaggaaaagatgtggctctagagaaatcagtatttcagaaacaaattcttgcctgtttgactgtagcttctcatctatccatacaacacatgtaacctgcacactttttagcaagtcaattatagttttcataaaacatacggaaatgctgaaatctcctgcagctgctgaaatacttgaattctgacttcttatatgaagtcgtggacaccaaatatgtagtaacctacttacaggttgaactgctttttggcaccatgagaaggggcaatcttctatcaaactgatttgataaatctgtaaatgtgtccggtaggttgcagggcttggatcagtaacaaaaagcattgtactatgggatgggggtttgacaggttccagcatgaccactggccctgtacatcaccaagatatggtttacctcctacaaaacctggggaaagagaaaaaaatggaagcaattaagaggtacaacataatggggggaagttctgcacatgaggtggaggtggaagtgaactgaactaactattctctttcttgttcccctcactttctcacaaagtatgttattaagcaaaggacttattcaaagcactaaaagacataatatattaactaacactcatggaggaattgaaaagagttccctaaatgagcaaatcactctatccttataggcaaggctgaatttgcaatggcttgcataactatcttaatggtttttatgaaatattataaattagacttacagtttagatttaagaaattcatttgtgctgcatcatagatgtttaaaaatattcctatatctgcacaaagcataaaaagctctctggaaaatcatgaaacccttgcacactcaatattcctccccacaccagtccttcccatctgccagctgggtttcattttaagaatttcacactgaatataaagtgctattttgaccatgtggctccagaaatgtgaatttatagttttttcagcttgtatgcaggtgattgacagagaggggattaaccaactggatgcgatgaagctgctgcctcttccttcaggttactttaagtttccatgcaaggatggccatccttgaatggtttcattgaggctagcaagaagtacagcttcctagcaggggacttacttttcatttaactactacatggccaccataccttgaaactattttctccatgttactattcctcccacattccatctattttcccatctgtaaaatgggaatactgaagttagctttcttagacataccttgtggtgatatcctactgatatatgacacatatctatagttactggtcttcgggtttaagagtcaagattttgacaaatgtgtaggtgagcatgtgtgtatttggttttcttgggtgggggcagactagagggaatgggcatggagaagaaggttgaaaggttggcttaagagttcatatatatatatatatatatatatatatatatttttttttttttttttttttttttttgaggcggactcttactctgtcatccaggctggagtgcagtggcgcaatctcagctcactgcaagctccgcctcctgggttcacgccattctcctgcctcagcctcccgagtagctgagactacaggcgccctccaccatgccctgctaatttttgtatttttagtagagacggggtttcaccttgttagccaggattgtcgcgatctcctgacctcgtgatctgcctgcctcagcctcccaaattgctaggattacaggcgtgagccacagcgcccagccgagttccttaatatattcttactctctgtgtgagcaatgcctaataactgaaatatggaagagaccctctacactcagtatttcagatattgctttgggcatctagaaatgtttcagatacgattgctatttaagattgccacataaagcagtcctattttttcaacagttaactatcttgtttcagacttctcatcctcaagcatcatcacaggcacaaaaatgatgtcataactatagacaatagtccccctttacatgcagtttcgctttccgtggtttcattttccttgctaccatataaaaagatattttgaaaaacagaaagagagaccacatttgttttcattacagtatgttgttacaattattttatcattagttactattgttaatctcttactgtgcctaatttataaattaaactttatcataggcatgtatatataggaaaaaaatatagtatctatagcaggccttctgtatccatgggttccacatctgtggattcaaccaactgtggattgaaaatactcaaaaaaaaattgcacacgtactgaacatgtaatgaactttttttcctcatcattattccctaaacaatagagcatgactagttacgcagcatttacattatattaggtattataaggagtcaagaaataatttaaatatataggaggatatgcataggtaatatgcaaatactacaccattttctttcactgactcagattttgttatttcagaaaggtctcagaacaaatgccccatggatactgagggacaactgtaaagggtttggtactatctgtagtttcaggcatccacaggaggccttggaatgtatcctccgtcaataaggggtgatccacttgtattcagattttcaaaatgtttcttttttgcaactttagggtcatgctgttcctgggattccgtacactcactaaatgcacaggaaataatactacaaaccagatgacttccctatttgacaaaagatcaatgaaaggatattcgagcattgacttttgagaagggtgtgtaggatatattcagatttgatactgtgacactggagctagtctcaaaattaatgagcatatacacaaaagttgacatcagatggaagatgacatcatttgaaaaatacatgcttatcatatcccatcaagtttggtcctgttcagaacaggaaaagttccattcataggtggagtcttcagcttctaaattattcgggagagtaataacaatgtttcccctcccttccctcaagacagagcaaacaaacaagtacactatagaaaatcaattataattaggggaaaatttctcctgcttgccagcaaaaataaatatggctccactgaaaaaaatcactaatattatatattgaagttttagacatatgctctgaataattaagaaaattatttgagcacagaaaaaggtatggaagaagccacatcaaactgataacactggataataaccttggggattaaagagggaaaagattattaacttttatatatctttatgtatttctgaataattggacttaaaataataagtgactatagtttttgtattttaaaaaaactaataaaataaaaacaatcaggctgggcacggtggctcacgccagtaatcccagcacttagggaggccgaggtgggcagatcacctgaggtcaggagttcgagaccagcctgaccaacatggagaaaccctgtctctactaaaaatacaaaattagctgggcgtggtggcgcatgcctctaatgccagctactcaagaggctgaggcaggagaatctcttgaacctggtaggcggaggctgtggtgagccaaaatcacgccattgcagtccagcctgggcaacaagagtgaaactccatctcaaaaagaaaaataataataaaataaaacaaaacataaaaacatacacatgaacacatcaaaaagagaatttaaggaaataaaactacactgtatgcagagacacatccaagaaggtaacctggctcacagtagaagctcaacaaacatgagttatatgaatgtgaagcacacaatagctgacaatataaacattctcctcatataatagtatctactcatgtgccgcagataaatatagttgctttttaaccatcatagttaagaaatatggatttttatcttatctaagcactttggggatttaaattttaagtcaataataatttataagagtttgtctgtttctggaaggtgggcaacctttcaggcaggccagaagaccctcaggattcttaactttcacaatgaaaatccaacaactgcccacagggctgcaatgtttatatgtggattttccagaattagtggtaccagctcttcaggcccggacaggaaatgaaatctccaactccctgctctttatcagatctcctgggagaagtaatctttagagaagatcattgaaagggccagatcatccatcttcctctacaggatgtctaatgctatccttgaatgaagttcaagtataccctgctgaaggctaccaaatcactttatggcatttcaatactagggtctcaacattacttaatgccaccgtaagaaaaggccacaagaaattcaaaactacgcttactataacagtgttgtgaattactcattagatcactcaatgtcttctatagaaaacatcttcttagaattatggtcttaaatgacgagttaatgggtgcagcacaccaaaatggcacatgtgtacctatgtgacaaacctgcacgttgtgcacatgtaccctagaacttaaagtataataaaaaaaaattatatatatatatatatatatatatatatatatatatataaagaaaacgtcttcttagaattatgctcgaacagcttttattttccctatggaagacacattctccttgttttccataatgagaaagaatatgtcacagatcatgattcccctgccctttcgtttttcaaaaacccagagcaacaaatatgaaactcaattggaaaagtgattcgaccaattggagtagggttgagcattattatagttgccttctctttgttctgatcttcttgtatttcaatattttattattactattttcatgtgagtcactttaaatactttgtagacagaagcagtggactacatagacaaaataaaaataaagtaatatctccatctggagttgaacaataacattcaattatctctttccttggcataactgcttaacagaatacacgaagcttcattgaaagccaccaatattcgatcattcttactattttgagggcttcttaattttaccatggagtgtggactccagttttatcagaattgtcttggtatgagaagcttcaactgaagttcactcatttaaaacattttaagaatatcacagtaagaagaaattcttcagtaggtcaagtcccttacagcaaaatccaagagactcttcaattgttttactatataaaatgaatgatgcttacaacatcattttttcagaatccttccttctttcctttgtcctttctttccttctctccctcattccttctctccctcattccttcccccatgactgtgatattttcaggtgataggattttaactgtaccgtccagttcttactatcttatagatcagatgttagatgtcatctggcattttttaaattgattgtttctccaaagtacctttaacctttttttcaataggcttttgggggacaggtggtgtttggtcacatgaataagttctctagtggtgacttctgagatttcagtgcacccatcacctgggcagtgtacactgtacccaatgtgtagtcttttatccctcgccacccaccaccctttcccccaagaccccaagtctaatatgtcattcttatacttttgtgttctcatagcttggctcccacatatgagtgagaacatatggtcatctggcatttttaatgccacacgatcaaatccaacaacactctccaaaataatctttcagggtagtgatggtggaatataaaaacagtaaagttaaggtgtctttagccataggattctggccaaactgtgagataaataaaatctgcctttatttctttttcaccttcctttccaagaattccttccagcaatccgaagtctctatataccttaccatgtgtcagactttttttttttaatggaatactttatgaatttgcatgtcatccttccacaggagccacgctaatctctgtatcattccaattttagtatatgtgttgtcaaagtgagcaccacacactcttttaagattaaaaatatatatattaactcactaatcctcacgtcagtccattgaggaaagtactattattattccatttttcgaagctaggacaccgaagcttagacaggttaaagaatatgtccaagctatgggggcaagacacaatagtggtggtctggcccaagagcctgtgtacagtggaaatatgctgcttgttacttagtatgctgcatgctgagctagtactaacaacaaaaaaacggttttcaatgaaaaatcagtgattaataacacgaaatgaaatccaacagtatgtaactttaggtacttataatagggttgggatgagatttgttgcaatgcctcctgaagtcccttaaaactcagtccacatcagcagctactccttgagagtattgcaagtagaacaaagcatttcaaaccacagaatcctttcaatgtttttatatttctccaccataatcttgcagcaccccctcctccaaagggcagcactgaatgcacagacacatgacacattgatatgatcaaggttgattggtggcttcccacatatcatgtgaggtccacaagagactaaagattgctagagtattgtggaaccctcagtgatctgaattcaacttatccattcattcattcaacagatactcaacaggaacctactacatgccagatactcttctagagactaaagatagagcggtgaacaaagctgaataatcccaaacttctagctacttacattctaatgaagaaagactaaataaatgtgataaaccactaaaatagtatgtagcatgttagacaatggcataaagtactaggaagatgaagcaggaagatgcatgggaagtctacagttcaaaacagggtggtcaggccaggcatgctggctcacgcctgtaatcccagcactttcggaggctgacgcaggaaggtcacttgaggccggacttcaagaccagactgggcaacagagtgagaccccatctctacaaaaaatttttttaaaaattagccaggcatggtggcatgcatccggagtctcagctacttgggaggctgaggtgggaggattgcttgagcccaagagggcagggttgcagtgagccaaggctgcaccactgcatttccccatgggcaacagagtgatattctgtgtcaacaaaacaaaacaaagcagggttgtcatctctcaatactcacagatcctatccccttaactgagtttagtcactccttgaactcaccttgccctttccaaatatgaactctttgcccaagacatttctttctcctagaaggccctctgtcctgtttcttgtgagtggtagtttagctagttaactggactgaagccgaaactaccgttgttcaaatcccctttttattacttactaactctttggctttgggtaagtcccttgactgctctaggccatagttttctaatttggaaaatgggtataataataatgacaagaacaataatacctatatcacaaggttcattgtgaggctcaattgaattagaatattaaagtgttcagaatagtacctggcactattctactactactatgacctcaactaaatttctatctgtgcttaagacccaattcaaatgctacttctcaatctctaatcacaatagctgaaggtgaggttttccttctctgagatcctgtagtcccttggttttatcactctaatggtatttaacctgtatcattgcaagtattcacgctatcttgaagtacaattattatatatatgtgaagtacaattattatatgtgtgtgtatatttatttacttataaacagcttcttccctcctgaaatcacagcacctgagggtttagaatgaacataaacttttcttcttcctccttatctccttttcccttctgtgagtgttttaatcagttcattatttatatataccagagagtggacaggacaaggaaagggaagtgaaattagcaagtgcacaggcccacacacacactctcacacacacacacactttatagttctgtattagtttattacatttaaatctcccaatgtttttgatctccttctctgaggaaagcttggtggtatagcagtctatcctccaaagatttacaatctaaatcgtgtagaaagccttaaggaaaaaaaaaatccctctcacttcaacaacttaagccccaaccctacttgaaactatgccttaaagtgcttgctgtctccccaaatataccatgtattaattttcacacttcaagactgctacttatccacctgatgcattctggaacctccttcccttcccctgtcacttcccttctttgttttccttgctctcccttccctgaagaattgactgctccctcaacccaagtaatacataaatattcgtccattcatttcccctctcccctgctagagtgcaaattctttgggatgaagacagacctcaaggctcagagagctttgcccaaagtagaccctctcactcatcttggcgaattccgcatctggagcaaggtctgaagtgaggcagatgctcagagtgttcactgaatggaactgaatgagctgctaatgagaatagacaaaggaatcttttcttcttttctttctctttctttttatcttctttttctttttctttcctttcttttcttttctttctttcctttgatggagtctcgcttcttcgcccaggctggagtgcaatggcgtgatctcagctcactgcaacctccacctctctggttcaagcaattctcctgcctcagcctcccaagtagctggaattacaggcatgtgccagcacgcccagctaatttttgtatttttagtagagacggggcttcaccatgttggccaggctagtctcaaactcctgacctcaagtgatcaacccgccttggcctcccaaagtgctgggattacaggcatgagccactgcatctggtcagtcagccaaagaaatttcagtccctccttccctcccttgtccttgccttctgagcagagatgctgggcacagagctgaccaaaccaaactactagggggaggagatacacaaatacttcctaaaacagtctgggcaggatgatctatagtttttattaattcagtttgttgggggctttatcacacacaaggcactgtgctgtgagagagaaagataaccaagacctgatactgccctcaaagaacccgtaggctactgggtgaaaaagataataattataacaaggtatgtataaaaatggctgtgggaacacagaagagggtgtgagatttacctgtcttgatagttgctaactcatttgaaaattcataatatttataaatgataataaatccatagcaaaagaagctttaaaactatagttctcaagtctagcattgaacagtttggacaatgtctaggttattttattttgtggagaataggctgtttctgaaagctcccacttttatggcccaatcagtaagagatttctattccagctgctacactattcatttattttagttgtaaaaacttgaaaaagcgaaaggaagaaatgtaaaataagcatccctgtcaaatttaccctttttctttagaatgatgttgatccaagacaaacagtctcaaccagggcaacatatattttaaatatcattgcagcaagtaagaaagagaaacgacttgatttaaggttggtttttgatttgtcaggtgactttaagtgattcgcctcttggttcccaatttggcttctattccaagatagaaattctaaaacttgctctttcactcaggttgaagtgcagtggcatggtcatggctcactgcagccttgaccttctgggctcaggagatcctctcatctcagcctcccaagtaactgggactgcaggcacacactattgcacctggctttttaatttatttttatattttgtagagagactgtcttgaactcctgggctcaagcgatccttctctctcagccttccaaagtgctgagattacaggcatgaggcactgcacctgacctgaaattctaaacgtactcacaaaatacccagaacagatttaattcagagaataccttaatctcaatgtggctgtgtccaggtgaagagtcaaaatgtaatattaaaaaaaaaaaaagagaaatagaaaattaggttccacgatagacaccagggcttacttgaggatggagggtgggaggagggagagatttgaagtaccaattgggtatgatatttactacctgggtgacaaaatgatttgtacaccaaaccccagtgacacaatttacctgctgcagggaaaacaacctgcacatgtaaccccctaaacctaaaataaaagttggggggaaagaaagaaagaaaattaggtttcagaacacaaagtattattattattatttggaaagtgcctagtaagacaggggcaggtgacatgttcttttaaggcatcagtactaaggctgcccagcaaatacacagctaatctagaatattctgatagaaagataagggtacagggaatcttgtatgaaacaagaaaaaggccagatgattgatacagcctccaacataatttcccctaaaggctattaacaacacaagaaggcccaaggcattactctgagcaaattaagacctgacaggtcatgtaggaaactctttcaaacatcccaacatttgatgttttatcatttcattttgctctgcatatcaaagagatggttttacctctagcccaaacctccgatattcagtagtcactctattcatatatatatgaaggaaatcactacaaaagaaatacacaaagcttcagcttactctggactcaatattctaggggaagacaacagttttcattttcttttcttgctggagaacaaaagcatcaggtaggaaaatctgtccccttggaaaaggaccagccatttgttctctggaaggcccctgaaagtaagcagataagggaaagtggatatctggacttgcctgagaaaagccttttaggtccaattgtagcaacttatttgagagctgcaactcattaagtgtgtctctgatatcacttcagatatgaaggttagtgaaacataccaatagattgaatcatcaaaaaattctcctaggaatttgaacacagaagatttgatggagaattactccattggctcaagcctggatgggcccctagtggagataagatacagacaccttttagacaagggtttcattcttcagaaatagaagctcaaattgagaatgttccctcaatccctcaacattatcatcacagtgtttattagacatctacatatactccataggcactaaccaaacacataaaatctaaagtctctgccttcacagagcagacaaattaagaaaacaaccccacctcctgctcccattctggggactacacatcagaaaatagatctctttttacaaatgtgaccagtttatttccttaaatccttattgattcaggaaacagtgctcttcaagtctctggcttgagaagagcagttaagattaaccttttctgatactcaagctgcaggacatcttctttgcattgcctctggaaggctttaacattgctctaatccctcatctatcaaactccttcaccagaggggtaaagggggcccttttgctccctatttttatgagtctgccaggaatacactggcaatcaaaactgaagctgcattccttaaaacgcttttggtaaatagacacaaggcagtattgtgcttacacatatttcatattctgagttgtctatcttaaactcaggctcaaagaggctctgaatttcccattcttagaaatcatacgacatatgcaataagaacatatggccatgagataactgaggcttcagtttgtaccacagccaagaacactagatgcccaagtgtataactactaatgaatcaagaaataatgcagagaggttgtcgagagaaggaaaatatagaaaaccaatttagaaaaagcagattttatttatttatttatttatttagacagggtctcactctgttgcccaggctggagcgcagtggtgtgatgatagctcactgcaaatttgacatcctgcgctgaagcaatactcctgccccagcctcctgagtagctgggacaacaaatgtgtactaccatgcctggctaatttttttttatttttagtagagatggggggggatctcactatgttgcccaagctggtcacgtactcctgggcttaagtgatcctccaccttggcctcccaaagtgctgggattacaggtgtaagtcactgctgctagccggaaatcagacattttaaaggtatctgtcaattgcataataatctaaaaatatttacataaatgtgataatgagagatgagagtgatttagatctggggggtcatgcaaaataaagcttctcaaactcagcagaatttcaacaattatccaaggttgacagtcttaaaaatacaaatagagactgcacactaataaatatgaagctcttaaaatctggctttaagataatgccacacagaccattgacagttagcaaatgaaataaaagagtctgagtatctggaagcaaaagagaggagattttgaaatatatcttataatttggtgaagttgacagtaaaaaaaaaagctgcattattttcgaaggtccattaaacttgaaaagtaacaacacaaatctacaatctaattacacaattaaaattagtacaagaagatatacaattattttataacttctggatttctactgggctttttatttcctccactggttttgtctttcattgggaaggaaaatttcaatggtttatcttataaacaccaggtgtgagtgaacattcactgggcaactgtacaggacataatacacccctcataacacctccctatcaaggcttttgttatagatcactgccaatctctgtgaaaacaggaaccatattgcaaagatcagcagtcatacagttttccttaacaaattcaaatactacatcgtaagtctacgaggtgtgtgccaaaggtgttatccaatatactgagtggtaaatagcaaagccctccccatcagattttctcaacttggaaggaattagggaagccattgaaatgaatgcagaatggtttgcagaaccgtaaataatcatggtagaatctacaaatgtaacactagctaccccttgtaaaattatctgtgctcctgccaagggaactcacactccagtggagtgcagagcagtagaaatacatttacctttcttatgaagacaagaaaaaagatcagcctagtgctttctataaacaataatacaagtgagaagaaagtgattgagggagacaaaacaggatgggaaaggaaaaaaaggaaaggtttgagcacgcctgtgtgtgcactcagaataaacagctcggattaaggtgaaagacttgcagcagctgctgccatggtctatttctactgaatggcaacagggagggaacaaggggaggcagatagagctaacctttattgagcacctactattccatgctgggtacctgaaataccatgtgtttggatcagctcactcgtttctcatagcaaccagtgacattggtgtttgagttgttgttttgttccttgtatcagagctgtgcaacttgaactagaaagatcactgtcctgccattttctaatcaagtaatcttgaaccgacgagtcagtaaatgtctttagcttcctaattttttaaaataagggaataacagctgtctttgaagggattgggtatagactgggcacaaatataggtaaagtatttagcacagtgactgcccagagtaggtgctcaaaaattggtagctttatgaataaaatttataactacttaatagaaagctgtaatatgtgaataactttttaaaaaaaatggaagtctcatgctaaagccctgaacaatccttccttcccgtaagtaccttcataacttttgggggtctattttacccaaattattattttatttttggtagagtagcccaattttagaaacttttcccccatatatgtagggttggagggtaattgaagacatgatgatagggtcccacactatgtttttcatttgtggtttcaacttggtgtatatcttgcttggttgcctttcataatatatgttcttgtcattttgttaaaaaatggctcttcaacacaaagtgagtgcttttatgggttcaggataatttgcacagtcactgagcaactgccaaatggtgagcatcactgtagctgctgcctggtgcttctggaatttttttttaaaaagtatctgccagcaggtgcagtggttcatgactgcaatcccagcactttgggatggctgtggagggaggatcacttgagcccaggagtttgagacaagcctgggcaacatagtgagactctgtctctattaaaaaataataaataaataaataaataaataaataaataaataaaaggagctgcctacttatgacatgccaggcactgtggtaagtgccttagatagctagtgcatagcaatatctgtgtcctcctcttcttccagggcaaaaggctacactacaattcacagcctttgccagggttggctgtagccaggtgactgagtcttgggagtcggggcacaactgatgtgcacaacctccaggcctggctcaaactaaacttttgtgatgtcccctttttgtgcgcacagtccttctctcccttttcataagtggttgaataaagtggccccaaggacctagaggagagcagaacaagatagaggacatcagggtccttgaataactacaaggagcagagtgcccccactgaccatattgcactgtgaggtgacctacagtggcaagacatcgagaatgtaagctttatagcaactgtattactctaatacagaaacatttcatcacttaattctcattacggctctgtcaggtaatgtattatcacctgcatttaactcatataggaacagaggctcagagaggtaagtcacttgttcaagagcaagcagctaacaggtgaagaaactgacattctgcccttggtcagtgaaactttaggacccatgttcttacctatgggtatactgtcccccctatagctattgtaagtatgtaagtacaaaaacctatgtgttagacatttccccttttaaccttgaacttatgttccagtaatagaaacattttattttcccattaattatgtggagaatagtaaaaattaacatgaactaatttttgcagatgatttcactcagggagtgacagaataatgcgtataaaacactaaaagcacaaggcaggtggatcacttgaggtcaggagttcaagaccagcctggccaacatggcaaaacctgtctctactaaaaatacaaaacttagctgggtgtggtggagtgcgccagtagtcccagctacttgggaggctgaggtgggaggattacttgaacccaggaggcggatgttgcagtgagccgagattgtgccactgcactccagcctgggtgacagagagagaccctgtctcaaaacaaaacaaaacaaaaaatcattaaaagcagactgctctgactaaagcaaggctggggttaccaggaatgagcagtttgacaatcactatgtgccatcatattgattctcaacactgagctattcagatttctttcccttttaaaacaaaaaatgtctaattcagttctagaattcagttttgcagacataccagagctatgcactgaaagttaatgtacaccttgaaagcaatatgtaccttagtgacaaggtatatccatcaatatctgctcatcaaactacttcctgttttacttaacttgtagtgtagcaccatgtgttttgtcagttaattactgaccctcagctggcagccacttggtaatgaaaagactgtcttctggtatgccttagtttgtgtttctggtatggccatctcagcttccattctctcctttaagtctgaagtctacattcagttccgtttagttcaattaacattcactgttcccttgcctgtgtttagtaacgaggatacaaacaagattcaggcctggtctctgccctaggaccaggagaagaatccaatagttcaccgtaaaaggatcactgtaccagttcatttagtctttgaatgtcttcttattttttaaatgacaatgactgtatcagctttgaggcatcattcttgaatgtcccctaactttctgtgtagataatgtttagtacaagaggaacatttaagatattaaagatggagtatgtcatggacactaaccaaccagaatgaacgttggtggcagtgctgtagtgcagttctagaggctctctaccaagccaggaattactgctttggttgtgaaattgtggagcagcccaagaggtcccagcggggaggaaacaggtggcattcaaatggataggccagtacgtcaatattttaacaagtggtacatctgtagtgatgtattgatggaatattgcttgacttgtgaacaacagctccataggaaaaggacagccacttttccatctgtgctgacaactgagctgtgtagatcctgaaccagaaacacaagagaaaaacaatctgaaaactgtctattcccctggggactttcactttcctttatgagcatttcaagtagagcagcactccataaatgctgctgactgactgacatttattgaataaccagtgtatacagagcatgttctgagaaacttatacagaaaacagaagtgacctatacacgctttcatttattttgatgattaatttttaaaaagtggcctttctgaggcaagtctataatctacaccctaaagaagtcttctcaagtgacagggaacttcaaactcagggcaagcaagttttggagaatgactgcctcttcacgattcgggctctggtcttcaatggctgccattggtaagggtgagtcaggatggaactcctgaaactcaaaacaaacaaacaatcacctcccacaccagaaacaaagtccttttgcctctccaacttgaaacacaagtttgtatttgtggtctgatttttgctaagatcataaaactttacatctgcataaaatatgacgcagttgcttcagaagggcaggctgttccctgtccccaccccactgcctccttgtcggtgaagggctacttggtaaaatgatctttgagttctagagatgaattatacatcctgtataattgctggatgttgtcagatgcacaaatataataggttgtcaaatgcacaaagctttctcaaataagcatgatttacctaaaggcatctcctttactagtaacctaaactgattcttttcaacctaaatgaaattctttcggttctggtatattcttgagcatgtcaaaataaaaatctcataatatttaaaaaacttatcaagttttattttttaaacaatacatttttaaaaacctgattatattagccaggcgtggtggcgggcgcccgtagtcccagctactcgggaggctgaggcaggagaatggcatgaacccaggaggcggagtttgcagtgagccgaggttgcgccactgcactccagcctgggcaacagagcaagactccgtctcaaaaaaataaaataaaataaaataaaaaacctgactatttttcagaccaagtaaacactgtaaagttaaaagacttataacgacttgtaattcaagcttaagatctgatttgaaaaaccgctgaaggaaaattttcaattagaaagcagaacattgaagataaatgagacatgactataagttctcttcctggcgttagactatgactttcaggaaaaggaggtaataaaagtgtccggagaaaggtatttgtctgacattgtgtcagatttccgaaggcccatgagcaccttgagaagtaacagctgggaggagcagactgagagctttagcagcttttggaaagttgccattacgtctccttagctttcttaaaaagcattcatttggtgttgtcttttacttttattagcttaaaaaattttagcagattgtcacacaagccacattatgggagatattcccaattttgttgattacttttcaagcctttcttagtgttactttaattattctaaacagcactttaaaactgtttagataaattgaaaataagattcattccaaagaactgatacagaaaagatcttctctgagtcagaatttttgagccagaaggggacttacaaatcatctatttcaaccctctcatttcacagctaaggagactgagaatgactaaagccaaagttggctaggagggttgagggcatgaacctagacgcctaacatttagtccaattctctttctactcagtgccagttccacactgtttttcatttttcattctcacttaaaggctgctcaccgtaactccccatgcccctcctcccaactctggacagcaaccaaactgtctttggcctaacaagggtgcacagggactttggttctctcccaaggaggaggtatatacattcatttggctctcttctttttaatagctcctggtctttctttcaattcttatcaaatacaatgtaatttgggagccccaaatacctcaatcaatatttataaatttacagagaagggaaggaattacattcaaattagaaaactgttaagttagacatattagacacaagaaagaattcaactccttcaaaaggtgcttataagcgtcttttagcattttcacagaagtctccttctactgcctttaataaaatctgtttcctcccaagcttcaattttcaacattaaaaaaaaaattcttcatttgtcctatattgcagacacttcaacttttttcttgaatttttatttgtttcttgtgctacttcctaacttgggccatttaaaaacctacagtttcataattctatttttataatttttttttttttgagaaggtgtctcactctgtcaccgacgctggagtgcagtggtgcaatcatggctcactgcagcctcaatgtccaagctcaagtgatcctcccaccttagcctccctcgtagctgggaccacagctgcatgccaccatgcctggctaattttttttactatttgtagagacagggttttgctatgttgctcaagctggtcttgaactcctggactcaactgatcctcttgccttggtgtcccaaagtgctgggattataggcgtgaaccactgtgcctggcctttcatacattaagtgaggtttggggcagggcacagtggctcatgcctgtaatctcagtgctttgggaggccaaggcaggaggatcgtttgaggtcaggagttcgagacctgcctgggtaatatagcaagacactcatctgtattatatatatgttatttttttaactgggcatggtggcatgtgcctgtagttctagctactctggaggctaaggcatgaagattgctgaagcctaggaattcgaggttgcagtgagcaccgatcacaccactgcactccagtctgggtgacagagcaagaccttgtctttaaaaaaaaccaaaataataacaaaaaaaactttgtttttaagcagtgaaacctgtttttcaaatcgtatcttacaaagaacttaaatatgtatcgtaaacataggagggattctctgactgaaacaagggttggggtctaccaattatatattgttatgaacctctatgtccttagtcttttttctttcttttttttttttttttttttttactaactatacactgaaataaagacattttaaaaacacctaaagaagatacatcatcgcaatccaagtatcttattgtatcaggcaaacagaaaccactccagttattccaagctaaggaatgtaatacagaaaactggctacacaggtgacagaagtactaagagtctcaaccaagatactaaagccattcagagattgcaggaagccactaatgcccacagggctgcagagatgcgggcaggaggtgtctttactagatcatagaagtcagggccatctggtgagaactgggaccatggcaggggctgcccagtggaatctgggaccatggaagaaagggctgtctagtgggaagatgaagccatggagaacatgcagccacggcgggaaaaaagtccccccaccccagccacttcatccaaagcacagacaggtaagaatatctctcatttctcccatacttgtccttcttcccctcaaaattctgtctgtccctccctgaccagagcaaatcagaagcataagggtcagggagcctgggcaatgcagttgacaggagaagggaaaggaattgacatgatagcaaattgacagtgagtggcttcctcttcttcagattgttctacgccaatcaaaaaaaccattcagctgaaactgatatccaatcttacagaaatccttctgccacccagcttcacgagaatgattctctctctgccatccatgctcttctttccctctactttggctcactagaagatactattctgtatggacctatgaaataggtttccaaaggaagttgttcaatgagccaggaaaaccccccacaaaattcagcagaaaaagaatacaacatgcctcaaggtaaagacctcacatgttgaactatttggttaaaccttcagtcaccaagacctttttttttaaaaaaaaaaaataaagtccaaaagcctctctagccccaatatcttcctccgttttaattttatttttattgtggtaaaatatatataacataaaattgaccatttcaactattttttaggagtaaaattcagtggcattaagtacactcacattgttgtgcaaccatttccaccctccatttaatcgttaattttctaacttgcagtgagggcgtgaataggaactcaacacagcaaagatggacagaattcctcaaatttctaaatccttctcttttggtaacttcatcagcttcatgtttctgaagaatggagccttgacattacctatattgcatgtctgtccatctcactcctgcccagctctgtgccttgccaagtcacaaatgaagatggacagacagacagagacacacacacagacacacgtgcaccacccttatgttttcatccttcagctaaaagctctcattcgtaagtggttatacatttggctctgttatttcctgcttaagcacctgccctgggtcccaattcacctcctctacaatcacctcttgaagcctttggaataaagtttccctaggtccgcatcaaatttccttccctaatttttggcactgtccatatcaactcagtgcagccctgcaagtactgatcacacacgtactatgtatgtgtctaggaccatgttctgctttctgaaaaatggtatggacaaggagcttagggtcttggtagctgtgtttgggacatcaaaaataacataaaaaattgaggatgaaggatcaagtatagtgaggtgaaaactgagcatcactgaatcaaaaatgtatgatttgaaagagggctgcagcaactcaaggcagcctgtagggaagtggtctctggactcccggcaggctgggttcaaagtctgactttgccctttactaactctgtgaccgtggatgtttcccttaaccaccccgggcttcatcttcctcatctgtaagatgttgctaataataacatgtatctttaaggctattgtgtggactaggtgagaggtaaggaatttatttagctcagtgcctggcaggtaggaggcactgcataaatgtcagtgaatattattgatctccacactcattctcagcacagagccagactgacggtaactaacgttactggagtcttcatggaggagacaggatttgagatggacttttgattagagttaagattcggatagctgactttgaatgccagaaaaggttcctggagaagggtatgatttatggttgcttaggtagtttagatattaaatgagggcagtattttaggattagcacttggattaatgttttcttttaactgcaaagtaaatgtaggcattttggtagaaaatcagtgtcaccgtcctagccatgatctttctaaaaggatccttcagctcctcagatctttctttttacttccaattctccaaccttgctatgaagtgtggataaaggattaaaattcagcagatcacttcaggttaaagaaaggaagaggctttgccaaataccctttataagtgcgaggcataaattgaggctccattctgaggacttttacaaacaaatagagccaggtacccaaattctacaaattatattgatatccattcataatcattccccctcccctaatatccattcatattaatcctcccgccctcaagtatatggacatatttatgggataaacttgaaaaaaatttaacaaggacattgttattccaggaagtggctgtcgggtgattggttcaagaatattatacaatgctcagcagagctcccacagagcttctgtgctgtcttttctctcacttccaggtgtttataccacataaaactcactgcgttaaccaatgccgagtccacgctcagaatgaaatgatttcctactgtgaaaatggtgtcatccaaacacccacaatagcttggatgtctgctttaagactaatgaatttgccagtttgtatagggcccacgtatttatactttagcaaaagcactataatcttgtttctgaaattttgttcttttcttctaaaacagaaatacagagaactcaagaaagataatccttaaagtttttatgaagttagagggaaacgattccattagtctcacttatcaaggccatctaactctttgtttagataagcattccagatagaaaataagttccaaaaaaaaaaaaaaaatacataaaagcacgcagattggttagatagaagcgaaaagggacagagggaggaaattagggtaaatattatttttccctcaatgggagtattttaaagctaaatgccctgccctaaaaagtcaagagttatgtaaagtattggtggttgtagtcatttgagaaaagtacaacccgaatatgcatttctcttatgggtcaaacagaagtcacgataattgtgtgtcctttacactaccccaagattgttatttaaagatgagcatagtgaaaactataatactatcatttgtccactacccatgtatgctagcaaataattatacatatttttaccaatgaactgaatcagaaattggtaacaattttaaaagtagcttttctgctattgtgcaacatcaatgcccttctattacaattagttccaaaaagataattctcttatctgacagcattataaaagcaaagtatttcatgcatggcagtgttgaggagcttggtcatgggggacagggtgaaaggtccaatggactaccataaatgtgtggttcacaccatcagaggcggatgcacctgctaatctggcttctcagtcaaagtcccccctacaaggcaatggtgtggcagaatgcaaatgggaaataaaggtacaggacagctgggactcttctattgcagaaaaggaaagcaagccgaggaagagagtttagtgtgggcacacttgctgctaacctgaagtgctctctttacttatgctctgttcttaggaggggctgatcatttattataggttctttttatattaaacactaatgagaagccaaataatttatagggagtttcatattaaggctcaatgatattaaatacctggagagcctcacataaacaaagatggattaccagcaatgctcaaagtaaaatttttatacaataataaaaaataaaatattttcataataaatctaaaaatcacatacccacacaagttgcttcttcccatccaatatatactgcaattggctaccagggaggggaagtgaagagacagacacactttttattattttatctcttaaatgttacctaaagacctccatcttaaccaagcagcctatggcttctcctcctgttactaaaaacctgccaacatttcttggtcacctgagagggtatcatcagggcagcttgaatttggtatcaccaaacagtctttgagaaggaaagggtcacttgaaagagagaaaatttcccatccatggataaaccttcctgcatataatgtaactttcaataagcctgataaatactctgtaaaaatagacatcacttctcctaggtgtaagagatatatttgttagaaaggaggcagaggtattgtcttgggattagagatcatttcaaagcgaagtcattacagaacacactctaggttgctcaacactccaggggaatattttcggtggtcgattcacgcacatgctgactacagaggacattcctatgaacaggaaactaaggaggaaaccacagttttctctacattatccatcatcagacctctggacactgttaattcaagtggtttccctatagaaaagatgcaggtcggtagagggaattaagctgtatatataccaatttaatttcatgaaatcagtttgaaatagaagtagtttagctaactggaaagactgtcttacagattctttgaggaattctgggcagtagattcactttccatgattttatttattttttatctctaaaggattcctaagaatacatgataatgttcctaacaattgagtcaagggaaaggtcaaattaatgccttcatcaatcataaatggtgattataaataaactcagaattaaatccttatcaacataaatgtttaaagtcagctttatttggcctacaatgaggaagaaagagtaatgacagctatatactattcacgtatgctattagcaaacagcatatatattattatgaaaaaacgcagggaaaaaaatctcaatttcatctttcctccaaccagggtcgctgctcctagcccaacaggccacacactccatcacacagggggctattcacaccaattattgtctaaatgatgttcttaccacttagaaaagatgtacgtaggacacaatcagtttgttactgtttaaagcaaattactgtcattttattttgctgaaagatttaaggaaaaattaagtaatttaatcccatcaaggtagatggtgtgcctgatgcagtcccttacaaattgttagaaagcttgcttttctttgttattatcatatttaagctttaagaatagtctcagcattaggcaggcatgaccaaattggatcttcctcctaaaggaagccacagaagtcaacacctttaccagatccaatcctacctctctcatctttggcacctttactttcttccactatttaccataggaataatataaaaaattatgtaccttttcctacatagtacattgctactttctcaacagcataaatacccaactaaaaccaaacacaatgagaataagtaggggtcagacatttcatttcttcttactttagcccacaagcctctctctgtcttaactccagtaagtaggttttgtttgtgtttgcttttttcaataactgtcttttaagtaagcctgtaggctagaggtttgggcttgggacttatatatcatctatattccctgcccatccggcacagtaattatttaattcaaaaaatacttgtggataggccaggcctaccctaaatcagttactggccttacgcggcaactcacatttatgattattttacataatgcacggtttctagaaattagttcacactttgctgggtctgaaaatttagtattgtaaactggcatttgtattaacttgataaactaagaagggacagcctcagtgcccacacattgctacattacagaaaaatcataggcatgagtgttttcaaacaaatgtaaaccttataaggaagggaacttccgcttattaagaaagaatcaggataaaggatgcagaaaacatatgcttttggggaaggtgagagaaggcagtagaaaactaaacttaaaaagttttgggtacaaattcccccaagggagtgtaaaccaaacggaaccgagcaacgcccaccagcccctagccctgccaacagctcccccttcataggagagccttgccaatggctttttacctctggcacaaagaccagttacaaaatggacctactattcccaatctcaggctttctaaatgacaaataagcaaggaagaaaaaaaccttctaagcggatcaccatctgggttgaggaatgaatttacgccaatgaagtggtactatgaaattataaacattctggaagactccgtgccttgatcaagagtactgggtgaaagccaaatttggaaacagaaagcaggataaagccaatgtttgtggtctttatcattccgtgctatattggttataggtaacactggacacagtgtcagtgtgaagttaatgaagcctctgagatctgagcaagtggctggcaatagcaaagcaggccaagggaatagagatttgcaaatagaggttaaatgtgagatcctcaaagacgaaggagctcaaggaattacaggggaaaatgtagaagcgctggggcaaaggacaattaaagccccaataatctcctttctcgtaatccccgtcatctctcaaatgtctccaaatttactgggtgcaatagggcttaattgaaagtaatcatataagcatgaaaatgtaaggccatagttatcacagagtcaacactttagtttataacaataataaaatgaaaagcttttatttagaataggacaaagcatctctgctgttctcttttgacattatttcttgggacaaaccttagagcctccccacaaaacaacaaccctacccaactgtgcttcatgctctccaagaatcttccaaggtctgggcaagggggtataggtagaattactctctaagagaagagattaatcaaatctagaaggaaaaaagacataggatatagggagggtgtagtttgaatagcattctttcacagatctcaaccaccagtagaaaggttttctattatcagtaaagatggagaaaaaggccgggcgcggtggctcacgcctgtaatcccagcactctgggaggtcgaggtgggcgatcacgaggtcaggagatcgagaccattctggctaacacggtgaaaccccatctctactaaaaatacaaaaaattagcctggcgtggtggtgggcacctgtagtcccagctactcaggaggctgaggcaggagaatggcgtgaacctgggagacagagcttgcagtgagccaagattgtgccactgcactccagtctgggcgacagagcgagactgtctcaaaaaaaaaaaaaaaaaaaaaaagatgcagaaaaagcagtcagatacatcagaatgaacacttaaaaagcttatcttcaatattcattaggtttaaggatctctcttaatgagaatctatgctttcttctaagttgcttagttcagttttagatgatgacggctgatgttacatattttcacaatgacacctgcaggttatttgcaaaatctggcttaaatagcaatgaccaagggctgaattcagattttcaagattcccaaggttatgtaaatgaccgctgtgtgggcagaatcccttaagctctaactcaaaatcagtcactattggtaaaataatttttcttttactctaacaattttcataaaaaggataccattagatttcacctggggttctgttgaaatattgacattattatagctattttaaaaagactttctgatagatgtttatagaaatgtttcctatgctcagtacatgcatatagctggtctataaaatatttcctctggagtgttaacccttcataaaatctttaattattcgttacaacagaatataatgagataaactgcttttatatccctgctgtacttggaggtagacatatccacagactctgtaaagataaatgcagaattcccggatgctgggaaagctgccatttagctcaaggcttccttactgtcatttcatgagaaatcttaagtatgtaaccacataccaacttaaaagcatgatttttattgtttaactgaaattctagggaggacagcatataaattgagaaaaaaaaaaatagaaacctggctacgcagagctcttaaataaacttgacagctgcccaaagacaggagatttaaataaatgtacattaaactcttaccactaggcacatacatcttttccctatagtatgtagggagaccagttgcaatagaagaaggccttgaaggatgttattacccattctccatctattaatagaataatgcggtagtcaaaagactttcaaaagataaaagcatcattctctctaaagtttttggactcctgcccaaatcacagtcatattttcatatttgtcagctcaaagagactcttttataatagcaaataaaaattaagtgttcacactgggcttcaaagcaaaattctttcagtgatgatgcataaagcacagtatacatctttctttaggaaggttgactgcctcaaattcaatattcaagctggtaacatcacagagttaaagcatactgggacaatggctgctatgatctgattttaaaaaattaggctaattatgcagaaaagcattctcacatgggtgaatccagagccctttcccagaggtgacattttttagaaatgtccttaataaagacagacatggaactgaagagtcaacagggataaaaagaggagggaggatcacaataaagactcctttggcacttgctgggtacagagtagtctcagagtaaataatgaaatcaataaatgaatgtaaaaaaatctatcaaataatacaagccaattgggtgctacttgtttcatggaaaacatactcatagcctaacactttttcttggattactttcccacttagtgaaggagctctttctttacacccaccctcatccaggagcagtagctgccaacaagcagatacatgtttgtgcaggatggaagtagtgataagttgttgacttgaataacaaaaaagaaaataaacagaatactattcagctactagctgactaaagcatataatagcaagcctgtcctctttagaggtgtctagcacacatcattctgtttcagtacagttggtggacttttacttctccctacagagaggcaactggaaatatccaaaacttcagtgcctgggatagtacccagcagacagtaagctctcaaagagttactgagaagaatcctttgaaatgtacttcaaggttttctggattcctgggtaaacctgggagtgtggagcgggaggaatttattcacatctgatttgcatgttgacagccatatttccccaaagtaaacaacaacaaccacagatccatataatctctgaggtttgtttttttgtttgtttggtttttttgtttgagactcagtctcagtctctgttgcccaggctggagtacagtggtgcgatctcggcaacctctgcctcctgagttcaagtgattctcctgcctcagcctgctgagtagctgagattacagatgtgcatcaccacacccagctaatttttgtaattttagtagagatggggtttcaccatgttggccacactggtctcgaactcccaacctcaggtgatccacctgcctcagcctcccaaagtgctgggattacaggcgtggccatcgtgcccggcctctgaggtttatttgtaatctcagagaagaaaaaggaaaaaaaagaaaatgaaatcatttatgaaagacttagttttcagagagaggtacatatattgacataatgaaactatatctatcttcatgttaggcctcttttcctagacataatgatgataaataagcagcagaggccaaagctaccatttgtttcacactttcacatttcgtactttatgttttttgtgcatttatcctcaccaactttatgatgtagctgtgattttgcccgcctcacagtttagcaatccttagagacagtttaaacaatttgctcaaggtcacatggctagaaagtggtaaaactgagtttttaaacccagatgtctgagtctaaaacctatgtgcatatctatgacactattgtctagcttggataatcagaatcttggggtaattgcaggggttggactaacttgagtttcaatcctggctttgccacttgctattggtatgctattgagcaaacttttgcatcattatctgaaaaacaaacaaacaaaacttccaagattattgtgggaattagaaacaatgtgtttaaagtatctgatagctgctcttgccattgttgttactgtcattatcattaaaaggaatgtagaattttgaaattcttttgagactatccagttttctcatttttttgcatgcattttatctgcatataacctgaggacaagagccagttaagcagtgagagttcctctgctggggttcgctagagggaaaagttgagaccagaattctggtttcttgcccagtgcgatttccaccaccctctgctacctatcatttgctttactttaaaaagactaaactaatcccaaatgctgctaatcaaatccaaaccaaataaggatagaaactgttcctcctttgcagggaaccataaaacaggaatgcagaaaacacatgcttttggaaaaaatcaacagaaaaaactcaatactctttgggtacaaattcccccaagggaacacagacctgacagaactgaaaaaaacacccactggtagcaagccttgccaagagttctccgtccccggaggctcggtgtcaatggctttcacctctggcatagtgaccaattacaaaatgggccttccattcctaaccacagatatcctaaatgacaaattaagtgtctgagagataaaaggttatcagggaataagtacaaaatacacatgtgcacgcctgcgcatacacacacacacacacacacacagcctgatgtggagttttaaaaagtctcatttggttttcatcacatttacactagtttttctttgtctagcataactcttatgtcagtagtttaaacaacatttaatatttgagaaaaaagccctatgtggacgtgccaaataagtacagtcacgtgtagcataacaacatttcagtcaaggatgggctgcatatatgataatgggcctttagaattataatactatagtttttactacggcttttctatgtttagatacacaaatacttcctattgtgctacagttgcctacagtattcagtacatgttgtacaggtttgtagcctaggaaaaacaggctttaccatacagcctaggagtgtagcaggcaggctctaccacctgggtatgtgtaagtacactctgtgatggtcacacaatggtgaaatcacctaactgtatcaaaataatactaacaccaaccatgatgtgccaaatctatgtgatcaggggtacactatgaaatggcaaaaaaaaaaaaggggtggagtggggtggggtgaagtgggtatgaaacactttaaggaacttcccaggccaaacagtgcacagccagtttaaccataatatcatcaccactctggggtaaacaatttccatggccattcatgtcaacgtcatatctgtgtttatattcattctcatgagggtagaaataacagcgttcattatgagagatacatcatactaaaatgctcaattagttttctcttgatccagaggcttgttaaaatcaacaccctcaactgatatggggttcaacatttagaagaacctacaaacatgcaaaatgttttattttgcttttacttgtatggctcttctagtcttttgttggggagggtggttaaaaaaggagtttatccatatttctccttggttaacattctgctaaaaaaaaaaaaatcaaaattttaaactggcttataatgcctgtgacaccaagaatacttagtgagcaattaaactacagcactatatgtctactttagggaacttccctaccacatgtctggataaatatttttactttcttgtacaaggaattaacgaatcaaatcacatttctaaaatagtctgcactcattgtcttaccaataaccttttcagtattttgcatacatcaatcttttgtccaagatcttccaactgtctcctttaccaggttgacacccaaaatgcaattctggccgggtgctgtggctcacgcctgtaatcccagcacttgggagaccaagacaggcagatcacttgagaccaggagttcgagaccagcctggccaacatggcaaaaccctgtctctactaaaaatataaaaattggccgggtgtggtgccatgtgcctctaggcacatgttacttgcaagttccagttacttgggaggctgaggtaggagaatcgcttgaacctgggaggtagaggttgcagtgagccgagatcatgccactgcactccagcctgggtgacagagagagactctgtctcaaaaataaataaataaataaaatgcaattcttatcggtgtttacagtatgcatcacttggcagtctggccatattagcgtcagtttacgacacaaatttgttagcatcataaaattacgctaaaatcctttaagctattatagatttcctctcagttactgtgaaatcaacaaacaatccatcacttcctcttagattctcacccaaaagatatcttggttgcatttcttctagaacatacttccctcaactacccaaattaaacatatttcaagcatcattaattgattagatttacaaagagctctgaatgagttcaaaggcactctggatgagtgaaaaggcaattgttcattttcttcaagtaccttcacctttcctttcactcgggaacgaatgttttctaataatttttcttatgaaagtgttacctatcttctgtctcttcccctagtcttatatttcatgctaatgcatgcatttcagtttccattttactgacattactgtttgttataatgttattaaaattcttctcttcacaaatttttggactgacgaaaatattcagtcattacatttccgttttgcaaatagcaagttagatgctgggccgggcgcgatggctcacgcctataaccccagcaccttctgaggccgaggtgggtggatcatgaggtcaggagatcaacaccatgctggccaacatgatgaaaccctgtctctactaaaaataaaaaaattagctaggcgtggtggggcgcgcctgtagtcccacctactctggaggttgaggcaggagaattgcttgaacccgggaggtggtggttgcagtgagccgagatcccgctactgcactccagcctggagataaagcgagactccgtctcaaaaaaaaataaaataaaataaagaaagaaagaaaaagaaagttagctgctacatcactcactattccaatgttccttacatttgaaatctgtagattaataatcataaaagaataaaattaaacactgattcaaacaaatatgaacagacgtttgtaacttaggtgttatccagaaaaaacaacaacaacaacaacaacaacaacaaacaactttgatttttgcttgaaaataaagtcctgaacttttttttttttttttttgagacggagcctcgctctgtcgcccaggctggagtgcagaggcgcgatctcggctcactgcaagctccgcctccctggttcacgccattctcctgcctcagcctcccgagtagctgggactacaggtgcctgccacggctaatttttctggtatttttagtagagacggggtttcaccgtgttagccaggatggtcttgatctcctgaccccgtcatccgcccaccttggcctcccaaagtgctgggattacaggcgtgaaccaccgcgcccggcagtcctgaagttttaaaactagaccaaccagtgctatgatactgcttaattcccataggcatgtagcaaatttgtattttcttcatttgctgaaagaaaaaagaaaaacaccataaccttttgtctctacctttgagcaatttaataaaattaaactttgaaagagattaagagtagtaatcaaagttccaaatatagctaagaaaaagctaactactctggtggaagttacgtatatttgaagcatttttcctcaatataacatggaattaataggaattcactcattatgcatgttctagtataaccttaaatgcccacaggttattcctaattttctggagaaataaaagtcacatggcatttttctatgcttaaacagagaacaattatggattttttaagaagggagagaaggaaacatgcatacttcacttatgcccataacttctagagcttttatgtttcatatgaaaaacagaaaatacatttctaatgtgtcatcaattcttttgaacttctaataatttgaatgtacattttatagcaaatagcttaatgatcacatcatgcagctgacttaattctcaaaatgtctttgtagttttattattctgtaaaagcaaactgtttcaccaaaaattgtactaggtcaagcttttacaagaaaaatatttattatattgtccattaaagcttaccaattaattaccaagtttagtcaatggggttcctttgaactgcctgtgagatgagtattttattacttattattataataatgagtagatttgaaagatttttaccttacaaaatatcaatggtttatttcacaatgttatttgttaaaccaaagcattagtcattctcttcttctacttttctccttcttcccctttccctttacttctgtataagcttttttaatatttaagatatgaagaaatccaacattatacatcattaaaccatggccaaattcacaataaaatgtgcctgcaatcctttaaaaaaaggattatgtatacagaactacgtggaaaacttgctgttctcagaaaagaacagaatgaaacagataataaataaatttctatatccaaggtagatctttctttttacaggaggtcgggtaagttcatacagaaaaactctacagaatgggcctgtcgttaaaaataaacgaagcaaggattattgggtttagatcattttcttaagaatcaaaaaagtttttctagggctttggctaagtacatgaagataaatgatgcccaattctggttttgccaaataacacaagtcttttcagaaactacaaattccagtggctctggcagaatgaatatcaacctaggtcagttctccataaccagaacccacaaatttgccagtccacttcacatctcaactattagataatagcaggcaagatgcatgttcctggtgggcacagttgtttatgtggtgattcttctttgagttgttggtgttttctcgctttcttccctcccttcctccctttcctcccctcccctccacctaatagagggcccacctctctacagggtgctcacctctaactgtctccagcagtagaaaaggaagtcagaaagctaagcaaggcctgggtcaggagagctatttattttcatgatgagaaaccaccgcagggctctgggaagggaagtggcacagtctgatttatctatttaaaaaatccatgtaaagagtatggggcgggcaggggcaagaatggaagcagagatgccaggtaggaagcaattacaagaatccagagaggaatggttgcaggttgcttggactagggtggtaatactgtaggttcaggatatattttgaagataaaggcaactggtcttgctcatgtgggcactgagagaaactggggccagggaactaggtaaattgtggggtgggtggggaagagagggaaggatgctactttgactgagatggaaaacaatgggggagaagttgggtttgagttgtgtgggggcttcaggaatcttttgaccttaaatgtaagatggcatcagacataccagtggcactagaagctgtggaagcacaggaataatctagaaatcggttgagagctttggctagagatttaaatgtaggactcatcagtttataggcatcattggtgtatttaaaaccatggaccaaggaccaggcgcggtggctcatgcctgtaatcccagcattttgggaggccgaggcaggtggatcatgaggtcaagagatcgagaccatcccggccaacatggtgaaaccccgtctctactaaaaatacaaaaattagctgggcatggtggcatgcgcctgtaatcccagctactcaggaggctgagtcaggagaatcgcttgaacccaggaggtggaggttgcagtgagccgagatcgcgccactgcactccagcctgggtgacagagcgagactccatctcaaacaaaacaaaacaaaacaaaacaaccatgggaaaggtgagatgacctaggatatgagtgtaggtggagaagagattaaaaacaaaatgaggcccgcattccactatttagaagtcaggacatgtgagggtgtgataagcagccaccagtgatgaaagtgcttcaggaaggagggatggatccgctgtggattgcgtagtagttgagtcatgagagaactgattggcatgacttcaagagggaaaatgggaggggaggaaatggaggcaacaaagagacaataaatgttctctctaggagcttcacgataagtgtgtgcttgcagagccaagaaagaaacttgctggaggagggctggtcagtggggagtgggcgggggtgttggggaagataagaagggatttttaaaagattttaacgggctatgtatataattttaacactctgtatcctgattgtaataattcactagagagaagaacaaagtgatgatgccagaaagaaaatgtaacttcagtaggtgaaaggaaaaaggatatggtaagaaagtgtgtgtaaaaggttagtagattttttgttttgatgatttttattttctcagggaaacagggagtgaggtcatccactgagaaggtggaagggatactgaaggtttgagagaggaggagaaactatgaatgagtccttcccagagaagtgaccagctaagattactagaaaatttggggccccttgagccttatggtcatcaatttaataagccagtcaggagtagtattgctggtttttccttctgtcatgttcagtttttctgatgcaggtatggagtaagtgagttgaaaagacaggaattgtcaaagacagtgcttaaagatgaggtttcacaggtggtacagctacttataatggccaagtctggttgagaatggcctgagtgggtggctgagatagagtgaaagaaagattgttggaaggaaagtgctcaaggaactaagagaaccaaagctggataaattttctacctgagagctggagtttccaagaatgacagacagccatgggaagaagaggtgtcaaaccagcgctcaaaagcttctatgaatgatggtcagaatcaacaggaagctgtacaaaatgtgtccagaacagtagtaggtagaatagtgcaatggcttaaaattaaaaggaaatggaatttttaattgcaagataaatggtctggaagtggcagtaaggaacaagaaagacactcatctcaactctggaccccatgttacatgggcatgggagataaaaatcacagcaagtgaaggatagaaaatgaattaagatccttctagggatcttacagggccttagaactacatggtaaacaccaccatgtctggcacagagccaaaaacacaacagggtttgaacaaatacttgggttttaactaaaaggagtttaaaagtatcatcaattctgtagacaaacagcctagatatggggctttagaaaaagtccacaagggagtggttaaacagcttgagcaagagacttggaatatatgagaaaagggatgaaataaagaaatgacctggccgggcacagttgttcgcacctgtaatcccagcactttgggaggccgaggcaggaggatcgtttgagcccaggagtttgagaccatcctgggcaacacggtgaaacttcatctctacaaaaaatacaaaaaatttgctgagtgtggtggcatgcgggaggctgaggtgggaggatcacctgagtctgggaggttgaggctgcagaaagctgtgatcatgccactgcactccagcctgggtggcagagtgagaccctgcctcaaaaaacaaacaaacaaacaaaaaacaaacaacaaacctgatcacctactgagtagctcccgactgcactctcagctattttctatcctactaccttatccttttccttgatttctttgctaattatttgtctgcttttctagaattgctaattttctgattcactacaaatgtatcagcttaattactatttcttttgctcgtcactatatacctaaggcctagcaaagtgtctggcacatataatgtcctcaaagaataccaaataaacaaaatagagaaaagcatggttagaagtagcccaattaagttacactatgcagagacaggccaatataggttcaatacttctaaggatcccatctttgggatggaattgacatttagaaagaaggcagtgaaaaacaaatactgattcctgggcaacagatcagggaggctgcattcttgtaggcagagggctaaacagcacttgactaaggagtaagcttggagtggctgagagagatgtgagtcagcttcctcgtctctactcaaccatcttcaaagtcctgcctcatgtgaccttattcctacgatgatccattctgtccacagtggcctttcatgttctgtacttcctgatctaacagacaatcgctatttccactgtactcctagcttctacatcactattacgttgcaactgtgaacacggacatgtttgtcgtttactgggtatgtttactgagtagtttagacgtacattgacatcagacagtttatcttttagattataaacttgtagaagcaggggtttgtagtctccataatgtaatctttggttcgttaactcagtttgtttaggtcaagggtgaaggtttaacctccaaacgagttatttagttttgctttgctccactttctcaaactacctccaactcaggcattctcagcacactgagaagtgttaaaccaagacagaataagagaaaaaattcacatttgaatgaaaattccaaactttacaattgcaaacaccatacattaaaaagaacagcagtgaaattccaaagcacctgaaaaatgagttgcaaaaacaaaaaggtttatataatctaaaattcccgactgcagaaatatgtaaatatatatttaaacttgaaatatatggccattgctattaaatgtaaagtcaagtaaatttatgttaaagtaaaatgtagtgttctcattccactaaccataaacatagaagtttagagctgggaaggaccttgcaggccaggccccttattttgtagacgaagtaactaaagcctagaagggttgctgaggtacccagcatcagacagcagcacaagtcagcagcactgaagtggagacaccacaggctttggagacagatccatctgcatttgaccctgatattccaccctttagctgtgtggcattgggaaccctcactctttcaaatttcagtttcctcatgtatgaatgagggatcatatcactatggtttattgagcaggcctgtaaagattaaaagtcttaaacctgaagtgcctagcacagaacttttgggctaaaatgacataataggctgcgcaccatcgctcacacctataattctagcactttgggaggccaaggcaggtggatcacctgaagtcaagagtttgagaccagcctggccaacatggcgaagccccatctgtactaaaaatacaaaacccaggcgtagtggcatgcaagtgtaatcccagctccccgggaggctgaggcaggagaactgcttgtacttggaaggcggaggttgcagtgagctgagatcacaccactgcactccagtctgggcgacagagcaagactcggtctcaagaggaaaaaaaaaaaaaaaaaaaaaaaaagacataataaagccagattatagaatctttcccctaatggaataaacttaaaatcgctgttaaaagaaaaaaaagtcaaaaatgttaccagagaccaaccaagttaaagagaacatcataccatattctgtataagcggtgcccatgaatagaagattcctaggtaaaaagggattgcattggaggtgggaaagttaggtggccaaaatcctgaaaactatcattaacagcccccaatttggggaaaatggatctaagctagcattttggcagcccagggaggagatggaaaaatccatccatagtaaaaagctcttcctgccatcacaggaatctcctcagacacagaaaagcaaatcagaactcaccattttggctttttatgcctgggaggaaaggagaagaaaagggaaatgagtcataatcaagcaaagctaattaattacagccaaactctattataaagctgtatgtaggagtctaacaaattcaatcatgtatgtgggatctcattgttgtagagctaataaaacaaggacaagggctgggatgaagggaaggagatagccaattgccagttgtgttaaatcttagttggtgctaacatgaggttcgctagtctgtatcagagtttactgtatcttaaacagtaaacaaaggtctagccaaagagaaaaataaataagggtgtgtgtgtgtgtgtgtgtgtgtgtgtgtgtgtgtgtgtgtgtgtgtgtgtgttgagggctgggagagaaggagaattaaaggcagaaaattcccaggtgaggttcccttccctgtctgtggattaataatgccatggtaaaagcatacaggtttctcctttctccattagctggaaagagataaaaacacttgctgggggaaagataggatgtggcaagggaaggagacacctgaggctgacattcttagccaaaactaatcaaacaaatggcttgcaagcacctccttgaattggaggaataatccaaagccccgtatctcactcctccagagatatatctgtgaatatgtagagcaaaccctgatgcagggcatttaatacaattactgaggaagagcaaagatcctaccaacaactgggattgtaggatcccagcacgcagcccagctcaactaactctacctcatctccagcatgtgggtcttcaggtcgactcctcaaactgaatgcagctctgggactagaccccgaggtctaattagagacggttaaaaagcaagacaaggacaattcaccaacattagagaatgaagaaaagatcctgagtgagttgttcatattcaacttaagttttacaaagagaaaagactatgacaactaagcaggactcccagagcaaagaaaaaaatgaaagaaagggggagggctgggaaggaagcaagaatctagtttagaagaaaacagccctctccaccttcctccaaaaatctccgtgagtgcattacactacaagattaaagaaaatagaaattaaatgagacaccagtggaaaaaaatgagataaaaagggaggttgcagaaggaaacaataaattaaacaataacactgtagaactaataaacaaattagaaagaaaagaaatagaataggcacaggtaaaaaatagtgacatagcaaaaacccttggaaacttgagataatgacagtgaatacgtaagatgatgatatacaaattaaggcaatttgggaacagaggacagataatgacaaacaaatgtaagtgtccaaaataaagttggaactactgtagtaggttccttaacaaatattagtaaactttaccccacctaactcctatcatcatgtatgtaaaaacagtgttttatggttcttttggtcttctatatgactacctacagaagcaaacaataaaaatgaactgataggtcttgtaaaatttgccctgatgtctattttgaagtgttataaattcggtatttgcgtaacagtggttctcctggagaaaatcattagaaatttgatcctacaccctattcttattcactgaacagaaaagagaaatctggaagcaatctggtaatataaaactattagtttatgctgttggagcctttatctaacaaatttccaaaacaactacagtcgttaaaatagtgaaattattatttccaagtggacatatatttttattaaaagaacaattaagacagtttatttgatatattttaacacttttcattaaccaggggtcatacacttgctaaaatacttttctggaagcacaggtaatattcagaacaagagtcacaattgtgcccactcagcattccttcacattgatcagaactcacttcactgagaagtactgcactaaaggatttaatgagacatgctactgaaacataaatgtacatagcccggagctgaaggattttataataacaaactcatacacacacagaaccgcaaatcattaccttcactgccattctgaagagagctggcactttagtcgtaaagtttttccttaagtttagaagtgtccctgattgcaaataatattcaacaaaaaatttataatcttaaaaaagatactgctaaataaaataaaagctacatactgcctgccacatggaaggtgcttgataaacatcagttagataaataagcctcaagactcacaagacaatacaatgatttaattcccattggatatggtattgtggaggactctaaatttctgagtcagcacccttcatttcatgttgtttatagactagctttgtaaccagtattctactcaatagctagagtattcacaaatacactaaaataatgaagaataagccactgtgtaattaaatatgaataatgaagacagcacttataacagtttgacttctatttcaagtgaaaaacaggaagttgcctaaaaagttgctgtgtttaaaaatgggtctttttatggatttataatacaatcaagggaccaacttttgcagtttgttctcaaatattaggagatgtagtttcttcatcatttgaaatgatgacatggaagacagcatgcataagatcaaacaccttttactcaaaatacagaattaatgggcttgctcatattccaaggatgtgtcttcttaaacactggtttgtttcatagttctaagttttttggagggcctgacttaatccaaaaatactgtggcatgcctacaagagttaacctcttatattttgaagtagaacaaaaagggaacatatattctgacaggagattctatcataatcgctcagaacactgaactttttcaacttgatgaaaggtttctccaagttagaaatactataagtaactctttccaaaagactgctcgtatgtgaagagtgaaaaaacaaactaaacaaaagcaaaaacttaggactaaagactaacaaatgcatatgaagaaggaaagtgcctttgctcaaggtcattgtgctaacagaatgacttgcttagttcacgtgcagatatttgttggcaaatgttaagcgatgcagaaaaaaaggcactacataaatgtgaaaaacaaataagtaaaaccataaacatgaatgttgtaatttgatgattatgtgcaagatcaatcaagtagtgaaagtatgtagtattcaagtgtttaaagtggcggcctgggcatggtggctcatgcctgtaatcccagcactctgagaggctgaggtgagagaaatgcttgaggccaggagttcaggaccagccagggcaacacagtaaaacctcgtttctacaaaaattaaaaaaaaaaaaacgactatgctcaaggtagtgaggaaccacttctactaagccagatggaaattgctaagaacagaaagacgacgatgtcatgacggctggttaactatgggagcagctggggtttgaatttctgttaacagtaggagaaaataaggactggagacagagggggaatctgagaaattctctattttggtggctaagctaacacaatctactcacagctttttttcatttgattaccatttgaaacagattacttctccatttgagggtaatcgtgaagcaagatttcaactcatgctctatcactacccattccaggccacaaattaaaatagcctattactacttttatacacacaataaagagatcttccatcccaatcttctccatgcttttttttttctcagcaaagttcatgtaaaccagtaggtcatagtaaatcctaaaatgtattcccacagtgagatacttggaacattttccttctggattttattaaacataatgttctaagcattatgagtgctctaaggtatttcttgaataataacccaaactgcagagtgaaagtaagtggcaattaaaatcccgagacagacgggaacactgagactaagaaataacagcatctgttcctgacgatggctggactgctgatctagcttggggtcagcaaacttggcctgagggccaaatccagcccactccctgttttcatatggcctgcaagagccaagaatggttttcacagttttaaatggttgggggaaaaaaatcaaaacaatattagcatattaagaacataaaaattagatgaaatacaaatttcaatgtccataaagtttcactgaaacacagcaagattcatttgtttatatattgtctattgcagctgggtatgggagagctgagtagcagggactttgagtatggcctacaaagcctatatttacaatctgaccctttagagaaaaggtttgcagaccatgagcttgatcagaacttcaaataccatctgtggtgaaggagctggtttgttttgagtatttgttttctaacccatcatagatctgagctaagcttttgtagaatacaaaaatcatatactttggatgttgcagagatgtcagattgctataaatttcctaaatgtttactctcaatttctgtatttatcttcttgcatactcaaacagatattttgtggactggcaccagtctgcaggtggttctgtgtaggtattctttgtgttctttagatcacacaaattttctaaaagcactgatctagagaacacaagaataccttcacataactttttggaaaaccttacttactccttccctatatactccttccctatatattttcgatatgatgaccactaaaaatatcagtaaataaatatattgctttgtaaatatattaactagataaaattatagtttttccatgaatctttttcaagcattatgctttatgctttaaaattataaccagtttcttccttaccagctaccacattatatatttttactgttctcttagactttacataaaagaattttttttttttttttttttttttttacattttgtgctttggggaataactcaaattccataaacaaaactattagtacaaatgttttctggacaatctgtgctgtgattttggaaattgtgtgtgaaagaggagagtagctgggcgtggtggctcgcgcctgtaatcccagcactttgggaggccgaggagggtggatcatgaggtcagttcaagaccagcctggccaagatggtgaaaccctgtctctactaaaaataaaaaaaatagccaggcatggtggtgggtgcctgtaatcccagctactcgggaggctaaggcagagaattgcttgaacccgggaggcagaggttggagtgagttgagatcacgccactgcacttcagcctgggcaacagagtgagactctgtctcaaaaataaaaacaaacaaacaaaaaagaagagagtgaaagaatttgagtccttgcacagacaataactgttttttatgtttaaactttttagtttcttatgttaaactttttatgtttaaactttcaaaaggttgaataaatttcatcttatgcttgcattataatagcaaagttccttgatatgtcaaaggccacaaaagtaatttttagcttaggtacaaaacgtgccttgggcctgttttatatgatactccttggttttagcactacattaaaaaaaatgaatgtgaaaaaaatcatttccatgaaagttttttaattggctcaaagttagtagcaatttactttcaaatttcaatctttatctctctagggaaatacttaattctactgcaatttttatttaagaaatgaaataatttctaaacatttttaaactttaagaaagatgaaactctgttattgtgccaatgactttttattattaggtgtcagatgataaaacattcaaataagaaacagcactgggatttcacagtgtcaggagaaaggaaagtctataaaaagaaactcaaggtgtgtttaagtatgtgaaaagagcagataatccctaaacctgttttatttgaaggcaaataggaagatgcttgctttatttgttgttacagaagaatgttgttgctagcaaaggataaaatctcaaagcagagggagagggaatataaaatggctgtagattaaacttctgcaaatgttcactttactacgcagctccactgtcataaaacagtcaaaatagtaagatatactcattcagaacaatgacacaatgtttataaatatttatatgtatgctgaactagaccattactaaaagctgcagctggggtatagaaagaaaactaggatttgattggaggccttattttgcaaattactaggctccatgatcttgtggaacttacttaacctttctgagtctcagtttcttatccataaaataaatgagattctacctacctctgaagaattgaggaggataatatacgtgtcttgtataaagcactatgcaaatgtgaggggttattgttatttagtagggagctcagagaatcttaatatgtattatatttaaattttctataaataagtgaactttttatacagcaaagtagattgagttgtttgtatatgccctttcctaatatcactatttcttgaagcagagaatatattgaggtaaatcctcattagaaaatttattacgcaaaatttaaccaactgtagttgtgatcagtgctactgatggtcagtgtgctatgggtgtgaagcaggaagaccttttcatatgaagagggtggagggcaaaggtggtagggatgggtagaggcaggggcaggtgcagtgggaaatacattttgtaatgccgacgcctgaaggaagaggaggtgtcagccaaaggaatgtgagaacaaacattttctatatttaatgagacaatcataattaatacggatatatcaaaagttctctgatccatcataatatctatttgttgattcaaaagtgacaagcaataattattatgtaggagccttacgctttaatgaattatctatgatcacttaaaaacactaggttttccatttcagactaagtagtgagatggtaatagatttttgttaaccttatacagatgtacattaaacatatggtataagaatagcattctattttcaaaacctgagattattgattttcagatctttagttgaatatgtatcggtacaaagacttctctgttccatacaagctatttctcatcttctacttaaaaaaaaaaaaaaaaaaatcaccaaagacaggggagctttcttgcattcctctaagtggtagaattatcctaatgtttgggaaatcagtcctggcatcctttagtctggataaaacatttgaagaagcatggtatgacatacaggcaaggaagacccagctacttcagtaaggttgctgtatatatcctctccatccatcatctgcaaataccttcctctgtcttgggatccaagccctctgccaaggtgtagaacttgtatactgatttctcattatttggaggtgattaagctaatcagttaatacaacaaaaggagaaaaataaggtaattactttctaagaatatttccatgttccatagcccaattcctcactggatcacctgtccactccttgaacatcatgtccctgcgtttcccacttcccagccatttcatgtctgccacagaacagtttcctttcacaccaaatgcttgataacctgaaaagtgagtagaaactcatattcaactttaagaactcatgtaaacaggttaggttattgagaatccacacagtgttaggcctctagatcaaatattttacataaatagactcatttaatactcaaaacggtcagtaaaattaggcatcattatccaaagtttgcttccaacatactgctaactaggaccacactgcctctttgcataggaaagaacatattccttttaaaaacactgttcttaaagtggaaactattttatggaaagagcatcgatctaatttctgacctccactccagtgtttccacattgcaccagctcttcggtaacatatgtgccatactccaacatcactttctggaatctgcctaagaaatagttctttgggtgaaagtctctatacttcttccagcactgaaatgcacatctcctgctttagattaacttaataacaatgtcttagttaacttgaagttcatctaacaaacatttatcgagcacatttcatgtgccatactagatggagaccttaaagaacctgcccctccacctaaggactgtaagacaaaggaagatagcagcacagctggaagactctacacccttccattcaatcctgataccccaatacttttcttccttcaacaacaattaggttactttagaaaaggataaaattttcgatctaatcacttttctgccaagctaatacagtcagatttaccatttcttctttacagagatttataaatatataaatattttgcaaagcataccttgtgagcttacggcagcattttactaggattacaactgaaattaaagctccaaaactggaatagattttacagtttaagaaagaatttttcgataaataaaacacacttctaaaacttacaatttaaagtagggcaggaaagtgatgttagcaaaaatggcagagtaggcacctccaagtgccccatctcccaaggaaacattcaaaattcaagaaaaagctttgagaattgacattgttagaactctggaaaacagacaaaggtttacagcaactaagcaatgccgaatcaagagtaaggcaatttaaaaatggtagaaaagcacagtaacagttgcatatgttctggcccaaacctgtttcctggctcagcagcagtcttaaaggcaacagtctggatttccagtgtgggaccctggcgcctggttctgaaggctgcacagtgtaccttatttacaaagaattgtttttgtcatttctaacttatctagaggctacctgaagaactttgtttcacctaactcaaaacacattcgaggtggaaaccctgcagctgcctaggacaaaagattaaagttgaggcatacgagtcccaaaaatatggaaaagaaaagctggagagagttgttgttgttgttgtcgttgttttgagaaaacagggcattcaaaagtgtctatatatactagagaatttacaaagtcatgcacatacccacagcatgatatacattcaaaaaaagaccctgagagattttcttccccccaccccacttcctctctcttgcttgtggctcctggcattcaagaaaatctctttcagaacactatctgaatggaagctaaaggaataaagctatcagagaccacatatgataaagaatacatccctcgttttaatagtttagaaatgtcactaaactaacagctgcagcttacagcaaacaacaacaacaaaaccctgaagaaaagaaagactgatttccagggttaccatattacaaaagtcaaaatgtccaattttaaacaaaaaatatataaggcatgcaaagaaagaggaagtatggtccattcacaaaagaccatacttcctctttctttgcatgccttatatatttttcacaaaagaaattaatagaaatttcacaaaagaaattaatagaaatttccctgaggaccaaaggcactaaacttacagataaagactttaagtcagttgtcttacatatgcccacagtactaaaggaaaccatagatgcactaaaggacatcaggagaatgatacatgaacaaatagagaatatcaataaagagacagaaattataaaaaggaaccaaatagaaaatctggagctgacatatgaacaaatagagaccatcaataaagagatagaaattacagaaaggaaccaaacagaaaatctggagctgaaaactacaatgactcaaataaaaagctcactagagggttttaatagcagatgtgggcaagcagaaaaaataaccagtgaacatgaagataggtccactgcaattatccaatctgaggagcagaaagaaaaaaggatgaagaaaaatgatcagagcctaaaagaccagctggacaccataacagtataccaacttacacataatgggaagcccagaagagaagagaaagaaaaaaaatgatttgaagaaataatggctaaaaactccccaaatgtaaaaaaaagacacaaatctatacagtcaagaagctcggtgaactccaacaagaatcaatgcaaagagatctgcaccaaaacatctaataatcaaattattgaaagccaaggaattttgaaacaaggtatttttaaagcaacaagatgagagaaggaatttaccacatagaagtgagcttcaataagactaagagaagatttatcattggacactatggggaccaaaaaggagtgggacaacatttttaaagtgctgaaagaataaaaaatgttgaccaagaatttcatatatgaccaagacatccttaaaaaataaagcagaaattacaacattcccagaaaaaccagcaccgagaaggtttgcttttagtagacctcccttaccagaaggctaaagagagttctttaggttgaaacaaaaggacactagatagtaagtcaaagctataacaaagacataaagaatgccgttaaaagtaaccaaatggagccaggcatggtgatttatgcctataatcccagcactttgggtgaattgcttgagcccaggagtttgagaccagctcaggtaacatggcaaaagcttgtctctacaaaaaaatacaaaaattagctgggtatggtggtatatgcccatagtcccagctactcaggaggctgaggtgagagaatcaactgagcccggaaggtcaaggctgcaatgagccatgattgtaccattgcattccagcctgggcaacagagtgagaccttgtctcaaaaacagaaaaatagtaatcaaacaggtaaatataaaagctagtatatattttaaatttgtaactcctctttttactttctacatgatttaaaagacaaatgtggccaggcatggtggctcacacctgtaatcccagcactttgggaggccaaggcgggtggatcacctgaggtcaggggttcaagaccagcctggccaacatggtgaaaacccatctctacaaaaaatacaaaaattaaccaggcacggtggtggctgcctgtaatcccagctactaaggaggctgagacaggagaatcgcttgagcctgggaggaggaggttgcagtgagtgaagattgtgccactgactctgtctcaaaaaaaagaaaaaaaaaaaagacaaatgcaaaaaacatttaaataattttaaacatatgttaatgggcacaaaatatataaatgtaatttatgagaacaacataaagaggaggagaacaaagccgtacagaagcagagtttttatatgctgttacgttggtatcaagtaaaagtagactgttagaaatttaggacattaattgtaatccccatagtaagcactaggaaaatgtctttaaaaaatcacaaaaggaaaagagaatcaaaacaatacattccactaaaacatcaactaaacacaaaagaaggcagtactggagggaatgacaaaaatgtgtaagacatacagaaaacaaatagcaaaaaggttaagattcttgttggtagttacttgaagtataaatggatcaaactcttcaatataaaggcagagattggcacaatggagtaaaaaacatcaggatccaaccatatactgtttataagaaactcactttagatccaaagacaaacattggttaaagtgcacagatgaaaaaagatattgtatgcacatagtgaccaaaaaacagttggtgtgactaaaataatatcagctaaaatggtcaaaaagtttttacaagacaaaaaaagatattatgtattgataaaagggtcaattcatcagaagatataacaattataaacacatatgcaccaaatatcagatctccaaagtatatgaagccaacatttacaaaattgaaggaagaaatagaaaattcgacaataataattggggacatcaatacctcactttcaataatagaaagaatatctagatgaaaaatcagtgaggaaataagaggatttgaacaccattataaaccaattagacctaacagacatacatagaacactccagccagtaacagaatacaccttcttctcaagtgcatgtggcacattctctaagacagatcatatattagaccacaaaacaagtctcaataaatttaaagtatggtaaaaattattacaattttaagttttaaaaaaattttgtttcattttcaaataaatgtgctggctaataaatgtatgatattaataaaagatgcactgttaagccaaatgactgccaagataatacctatgcaaatttatgggaggagaaatgagcaaaaatcccccaagggcgctttttatctatgtgctaggcaatagagacacaatagagaataaaataaacataaaatccttgccttcacagaggtcatattttggtgggggagatgatcaatatatctatattaagaaacgaagagcctagtttcaggttctaataaattttatgtagaagatatgctaaggtaactgtgggagagagtaacctggaggattgcttttgctaggataaaaggggtaacgatactctgcctcttttcctctggcactggctatagaggtgcagttctctcttgggacctatggacttattattcctactactttctgcactgatttgcacctcttcctgtttttgatcatttgtcaccttctcagtgaggccttccatgctcgtgatcatccaacgttgcattcctcctccctcctcactccctgccccactggcaactctccttcctttcttcttgcattgtaactcccacacttagcactatcataggatacattttactttgctatcttgtttactttttttttccctttactatactgaaagttccaagacaggagcatggcttgtcctgatcactgctgcatctgttgtgcctggagcagtgtctgacatatagtagatgcttggtaaatatttgtcgaaagaattaatgagtggagatgtcaagcagacagacagatatataagtctatagttcaaacgaaagtgcttgacgggaagatataagtttgaaagtcaaaggagattaaaatgggtattgttttcttcaacataaagatgtagaaattggttcatataggcaaatgagtatgtacaatgatatatcatcttctcattatctcacaagctgaagcaatctagctggtagaagagataaacatttcctggtgcatattctaaagggatattaacatttggacatttaaaaacaagaacactaaaacacataatgaaataatctatccttaacagtgattttcttattgtgacccttgatgacagctcaggtcactacaaaagtaaatgtgcttcagtgaaagaatcttacggcccaaaccaatgaggctagggcacaaagatttcctgagctctaacttaatctaaggatagaatttagaatacctaatgatgtagagacagcttgtcctcctttctattctgttgtgacaggagcattcagttcaaggttgatctctcttgtggttattttgtattgctgagtaaagagacgtcaagatgttttgtaaaataggtgcccaagttgcaagactgaaatttcatcatataaatatcaatatgtctgacttgttttcttgccagataagtagccacttcacctctttgtggaggtgagggttaagtgattcttccaaagtcacagctagtggcagagatggggcttgacctcaggtctccgaactcccagctcagagtattccactttcaatcctctgtgccttttatactcacatattaaaagataacaggtcacatttctggaacactgtgggtgggatcctgaggctgtctttatttgtaaccttctctaaagcacctatcactgcaggaaacagaagaggcttgtttttgtcagggtttcttgtatcttgtccttgtaccacatggtccaaatgttagggctctaggcatctgcccttccctttagtttctctatctacatccagttgtggactggggaataccaaagataaataggaaataggataactgcttctatatgaaacaaggttatggttaggcttgaaattttttaaatcgctgtttagattaggaaaaacattaataagtagagtcatagactttagaaataattatatatacaaggatcaagcatgtgatcttaaaaacaacaaaaaattatttccttggggggccaaggtgggtggatcacccgaggtcaggagttcgagatcatcctggccaacatggtgaaaccccatctctactaaaaatacaaaaattagccaggtatggtggcacacgcctgtagtcccagctactcgggaggctgaggcaggagaattgcttgagcctgggaggtggaggttgcagtgagccaaggtagtactatcgcactccagtctgggtgacagagagactctgtctcaaaaaaaaaaaaaaaaaaaaaaaaatcattcccattgattgattttatattttaaaatttactagttgtttgtgatgcaaaaaccacttttaaaagaaagaagctgtacctaatcccatcatccaaatggttgaagtgaacattaaattttaaaaagggggagaaatacacacataggtttagaaaattccaacagtagagaaaggcatgaaacataaattaattattcttacttgtatgtattatatttctgtgtttccttccagaacaaaatatcttttatgttataggagtctgtgttggcatgtattaatttaatgtatgtctataatatacacaaaacaacccatattgttcagacttctatagcttgccttttttgactattttatcctgaaggtctttcgatagcagcacatattttttcagggagcatatggagttctatactacagatgtaatgtaattaattcaaccagttccctactgataggcatttaggttattcccagtttgttactattattagcaacactttaatgaacatctttgtacatacagcttggtgtactttcacaagtatattcttaggggaaactactgatggtaagagtataggataaaagggaatgtgcatttacaatgttgacaggtattaccaaattgttccctaacatccttggacaatttgtactctagctaacagttggagaccataatatccataatacttttaatcaacaggtacataaaataaaaagtatgatgtaaatataaattatacttgtgtattctatcccatgtactccatctctggggctaccatgatttatacaagtaattaccattaagtataatataacatatctggaactttatgttaccaaacaacattaattcactgagaaaacaattcatagtcattgctatagaatcttccataataatgatcctgggagttggaagccagctccaattatcaataattggaaccatacaagagtgtgttgtgtgtgtcactttttgaacagtaagtttcatttcgaaatctatctgaatcagcttgtaaaacctcaaaaccaaaacatttgttcatcatctctatgcaaggattgatcagaaatatatagtaaatgtatactctattttcctcaaaagtaatgagaaataattcatagtagtgttctagttaaatgatgtgaacagatttcatcatttaactttggttcatttaaactggatcaaaggcctaaaggatatatgaaaattttgaattttaaattatgaagacaattgtcctatggatattagaagaaaggaaacagaaggcagtggttagaaaagagttatcaaaataaggtttttttatttttatttttttttaagtgagggctgtaaaactaatctcagcttctttctttacaagttatgtgacttcagagaaaatacttaactctccaggctttaaatgaggtaatgaaaacatttagtccagtacctggcacctcgatagtaccacatgaatgtgaactgctattaatctacagcctctattaccccattattaacagtaggtctgaaaaaatagaaaagaatgtctcctaggatatagacaaaaaggtaataaaggatgggaagaatttgagagtagatgtttactacctaattagcacatttatcccctttctcaagtgaacaatgaacgtgttatctccaaagaagcagatcacagtgcaagactgtcagatttccacattatgattttggttttccaaaacttttgcagactttggcatggtaaaaatacatcttgaaagccttattctggaactgaagaatttaagttagtctgctttgggtgaaaaacagtgtttcccagtaggagccagcacagaaactcatagggtcttctgacatgaaaggcaagtttcagctttatttcttcacccaattttatgaatttcataaaaaataaattcatacaaaatgaaaattcaagaatataaaattgactctaaaatataactgatggctgggcgcagtggctcacgcctgtaattccaacactttgggaggccaagacgggtgcatcacctgaggtcaggagttcaagaccagcctggccaacatggtgaaaccctgtctctactaaaaatacaaaaattagctgggcatggtggtggacacctgtaatcccagcttctcgggaggctgaggcaggaaaatcccttgaacctgggaggtggaggttgcaatgagccaaaattgtgccattgcattccagcctgggagacaagagtgaaactccatcacacacacacacacacacacacacacacacacacacacacacatacacagagtaacttgaatattttacattctttgataattgattgccacgagaattctggaaatagttaattcttctcagcaataaatttgccttatttttaaatgctctcgattcaaagattcccttgatttgaccttgtaatttctctttttatctgaagattgcagaagagagatggtaactacatgggccacctattcccacagctgaggccaactgtgcagaatactgaagcctttttccccaaggagcctggttgtggccacagagtgcttctcagcaagtgctacctgttcctccctcatcttggacaggaggtggcactcatttgtcatcccttttacagaatattcactttacaggaaggtcccactaaaatcagttagtatagtatcccactgtaaagtcatttcactttctattttccttttgtttaaaaaaattagtatcttctcccttgagaaagatgcctgaaggtatttctatactggttctattttattttattttatttatttatttttttgagacggagtctagctctgtcccccatgctggagtgcagtggcgtgatctcggctcactgcatgctccgcctcccgggttcacgccattctcctgcctcagcctccctagtagctgggactacaggcgcccaccaccatgcctggctaattttgttttgtatttagtagagacggggcttcaccgtgttagccaggatggtcttgatctcctgacctcgtgatccgcccaccttggcctcccaaagtgctgggattacaggcgtgagccaccgcacctggcctctatactggttttaaacacttagttacttaaaccaaaattcataggctccctgagatagtagggattttcgtattcttctaatcttacttcttcctaatgtagaaatactttctataacatccttgatgattagacactgaattccagagctaacactctagcaatgtagaactggctgaggagtaccttgttacaagtaaaagagcagtggatgaaatgttgggatagctggggttatactcccaccccactcctgaaggtaagcgacttattccattgtgcaccttggttttctttcctctaaaacatagttgttatttattgattgctaagatgccttagaggcctgccaatttgcaaaacatttcataagaaaatctttgccaggaagtcctaattgttagaaatctgcctcctttaacttctgcccaggccctctaatcttgactctagagagattcaaacaagtagattttcacacaattgaaagctaggtatcacatctgccagaagcattctttcttccggaccttgcagagtccttagaatatatttcttgtttgtatattattaatatctcctttagtgtttaatcaaatgatatagtggttaataggacaaaatttattcatggtattttggtggaagaagataagtggaaggctgaagctctgcaactcatagtgtaagcattttaaagactattttagtaaaagattaaataaagaatattattttagcaatcttctgaaactgattgacaacagttgacatttaattaattactatttttatgagccaaggttttgctctttgtaagatttcaaaatcctgaggtgggggggacttgtgttgaaatgcagtgaaagccttagagaccacagaagagagttgggcttttgggccttgaattaaatgggccatggactgtgtgtgcattttgggattctatttctgtttttctttttttttttttctgtgtggggggtttcttgtatccttgctcactgttggtctgtctgctattactcatgctgctgccagtggacttgactatatcagtgcatctttcttcttccaaagttcctgcttctgatctactgtgggtttggcaagcacacaaccaaacattttagaaacttgtctgagattggagtaaatggactgagataccatttttcatctacccagttggataaaaatgtaaaagaattattactattactattgtgggagtggggaacatcgacaaactcttgctctgcagtgtattaaaaggtattaacactttggatagctgtgatattgtgaaatatatatttggttttcatccccatttcctgacatacaatttctaaaatccttggaatctccaaaaggctgtctttttggtatactaatgttgactgctaactttaggatggggctggtcaccagaaagacatatgcaggattagaggagtggaacttgcagccccatcctccaacctcagggaaggggaaaaggactgaagatcaagttgatcaccagtggcaatggtttaaacaatcattcctccgtaatgaagcctccataaaaacccaagagaacagggttcggagagcttctggatggctcaacatgtggaggttcccagaaggttgtaccccagggaggacactgagactccacgccccttccctcatacctcaccctatgcatctcttcatccgtatcctttgtaatgtccttcataataaagcggtaaatgtaagtaagtgtttccctgagttctgtgtgctgctccagcaagttaacagaaccaaaagtgggagttgtgggaaccccaacttgagctggtcattcagaaattcttgagacctggacttgcaactggtgtgctgttgggacaatcatggggactgaaccccagcatgtgggatctcacactatctccaggtagatagtggtgggattgaattggaggccactgcagaattaattgctcacttggtggtggaaagcaacccacacacatttggtcaaagaagtcttattccgtgttgacgactgttactgtggtggtgtaagagaagagagaaaaggtggtttgagagtttttcccaaacaatagctatttgacaatctattttaaaagccctaaaacaatgcatccccgcaaatatgtgagacaaattccacatgcagaaatctgtcctcagaaactagatgtacaagtacagaaagatgtatgaataaggctttgattataataatgaaatgttggaaagatcctatacatctacctttagggcactagttcaataagctgtgttgcagccatataataatgtcatgaaaaaatgatactgcaggtgtataattaccaacaaagaagtaggtacacactaaactggaatataagtcagttcatatattataatcccctttaaaaaatagacatacatattggaatggaaaaatctgcaataatatagacaaatgttagttaagagtcagtgttcagtatattataatttcaggtttttttagtttaaaatttttgtttatttgtattttctaacttttccaaaacattaatgctttaatttaaagctggcttagacttccgtgtacacacaatgaattcatcacaagttatctcttctctcttcaaaatttcactagaatgacaataaaagcatgtaaaagtattgaatgataagatcaagccaaatgggagaaggcaaaagcagatgagagatttcagcaatgaagatggagagaaaagtggttagtttgaggatatgaaggctatagtgaacttgataaaatttagaaactggatatgggaggagacaaagggatcacaaagaaaataagaattggtgttggtgctgctattcactgcctctgagaaaataagaagagtaggtagaaaaacaataggtaaaaatggatccagttttgtacatttaacctaagacttgtgaggtgtccagtagggtgctggatacacagagctgccttcaggagacagatctaggaatcatctgcatgtgagtgaggctgaaactaggggaggacatgtggtcatgttgagagatttgcccagcgatcagaagccaggggatggaatgctggggaacatcagcatgtaagaagcagtggaggaagagtgatccacagaggaggcccacgataagtaactagacaattgaatgtggggccaaagaagctatgaaggagggaaatagagaagtgaggaccaaatgtagtaccaaagaagtagtcctgtaaaaagcagttattgttcagtgattgtgatgggtgtagggtgagaagccagattccaggtctagaggagtaaggaaaaaatgggaggttagacacagacagtgttttcaagaagcctggctgtcactagagaaatgagagatgtgagtggcaacttgggggcattaagctgacattagacttctggtttcgtctctttaatataagagagagttagtatgctgaagtaaaattatatgcaccatgatgtaaactgatactctacaaaactggttgtctaaataaattatacagctttcagatgatcgatcactttcaacaagatagcaaaacctggcatatctaattttttgctcttaatttttcttctattttataattatctaagacctaacataaaagcacagatttaaaatgccaagctaattttaaacattcgtgggaggatgaggccaaaaaacccaaacaaaccctaaaatacagaaacatcttcactgagactgggttcatgaagacatcttaaaactgagcagcataatttcatagccaaatcaaataagcattcactttcttgataaattagatgtaatttcaactatcataagaaagtagccagaaagtaatatttactgtaagctgctgtgtcctactcaattagcagcatcctagtgatctgaaggactgcagtcttcggacgggcttaccacttgatatagagcattcattcattcattcattcattttgtatttttagtagagacggggtttgaccatgtcggccaggctggtctcgaactattgaccttgtgatccacccgcctcagcctcccaaagtgctgggattacaggcgtgagccaccgctcccggcccgatatagggcatttaaacacattttttgttacctgggcacatcttatatcttttaaaatacgcaggctgggcacggtgactcacgcctgtaatcctcgcactctgaggtgggtggatcacctgaggtcgggagttcgagaccagcctggacaacatggtgaaaccccgtctctactaaaaaatacaaaaaattagccaggcatggtggcaggtgcctgtaatctcagctactcaggaggctgaggcaggagaattgtttgagaattgctaggtggaggttgcagtgagccgagatcgcgccactacactccaacctgggtgacagagcgagattccatctcaaaaaacaaacaaacaaacaacaacaagaagaaaaggcacatacatgctagtgtctttagtaactatatatttacataataggcatgctttgtccaccatagcatattttttaaaaactgaaatacttgcaaaagtactattaggtattcaacaatttgaattccctagttaggaagatggggccaaatagtatcatactttttttctttttggtaactattcatggcagaacttcaactactttcctcttaatgtggtgttctgtgcagttagtttttctttttgtgtctatcttagaaagatggattctcaaaaattaaaaacatgtgacaacagtgacttcagcacattttgccaggagcaaaatgcagagtgaacaaagagaaagattaaataatttagaaacacgttctggtgaatgagagagaattatcaaacagataaaagcaggtctgttcctattttcagtcatcttttcgatgcttaatatttttaaaaaatctatttctgctttatgatctcaacaaaacccactacaaagcatgcaatgggatagtgatctctgaattttgtgagttgacaattttcctcaagtgcctagaatattctggaataagaaggttacaaaaactttctttgtttcaataataaaaatgtaagtggctaaaactctttattggtaaaaaaaagaaaaaaaaatcccatgtttgagaagttgtgacaggaacgtgagctgggacacttaaaataccataaattaagataaactttgcatttactgcatgagcatatgtaaatgaaaatgtggtttaactctcttggcatactgtaaaggtgattgcatgctggataaaagggagaaccttggaagaagtaagtccaaagtgtgatgcatgtacaagtatgcatctagtttaatatctcacaggcttcatagatgaagtttgagaggaaactccccccaaatgatatcaaatgtggctgcaaaaaaatttgaaattaatttccattttttacttgaaaaaagataaaagatagccaatgaaaacagaaaataaaaactatgaaacataatttgatgagtttggtgcataatagctattgaatggtttcaataattattttttgaatggtgtactggtcttccggttgtgccaactccaggagggtacaaaaaagtccataaaatatcactcagcttctaccatacatttgaaaccaaaatcatgttttctttgaataaagcttaaacaaagttccaggtatttcaatagcttacttctcttccattctctcatcctaaacactatagcagagagtgagaatgagtgagaaagagagagagagagggagagagagagagcgagagagaactccgtttttatttgttgatatttggtcctcaaaactctggaatccattcttaatgacacagttgcttggttttaccttcttgccctgaactactcatcaaatgttattaacagttacagagacaactcaacgcaacagatgattttgtgtagataggctggaggacaagttgactcattgggccctgaaagttttccatcccaccttgggcagtttactgtacagcttgccaaactttaaagttattataactagtttcacacagatgccagacaaaacagacaagggattaattggaatgatcacaaatgcattccttctgaataaatgaaaacacactggctagtgccaagagacatttaaaatagaaaacctgaaactaatcaatcagatcaagtttagctctttttgatgttatagttgggagacatttcactttataaataatagaaaaatacctagggaggaaaaaagagagagaaaagtttgatagcattaagaaggaatttttgcactatcaaagagaagtgcctaaggagtcagtatcttctgtggctggcatttaaaaaaaaattataaatgttaaaagtaataaatgataagagttataagtcttcaagaaaaaagtgaagactcaaactattggctcgatttttaaattataacattgaacaaatcaaagttaaagtataaaagcccagaacaatactgggagatgagggctgtggtcagatgttagacagactatccaaacagctggaaaagatgttgattctccttgggaaatttgtaatgtatttgactcatgttttcatggagctgtggattgtcctagggggtttgaaagagagaaaacttgccaagaactttatctggaaaatgatagtattttaccagttttccaattagacaacaaaagcatttaaagaataataacaaaaatactcagaagtgaccaatgctatctctgtagcactaacgttcaggttatatgactagaaattattgagtacattatcctcattcatttacacacagctatttcttaaaaaggcatccacacacaaacaccacatgaagtgattaaaaaaaaaagaagagcctttcattacttgagttggatgatatgttaaatttcatatttggtgcacacacatcctaaacaacatgctcaataacaagtctccttatgcatgccttggcatacctacagctagtatctgatgctgagaggccagaaagggaagatttggtaactgaattcttgctgatgtgatgcaattttttagctctaaacagcccttgcatatgctttgctgaatttcttaaaggtttttaattgtttgcttctcaacaattgcaatgttcattttcccaaataagcctaaaagatggattaggaatcatctattatgcatactgaaatatttatggatgaaatagcatggtatttgggattggcttaaaaataatccagtgtggaataggaagtatgtgtgaatatagatttaaaaagattatccgtaagtttttgactgttgaactggtaatggatatatggggttcattatactattctctcaacttttgtaaaggcttagaatttcctaataaatttggaaagagttaaaagaaaaaagtggaaattaaacaaaaaaaacccctcttggatcataaatgtaaataattaggcaaagcaaacgttcttcatacttttaaatttcccagatgattaatcacctgcccgcattgatagtcatttttcctccctaaaaaaatacaattcccttattttggatcatattttcaataccacaattattttcattattttagtttgttccccagtagcacagtatattatagtagaagatatgctggactttgactcagaaaacttggtttttaaaattcaagtagtgctatttgttaaccttattaccttgaacaagtcatttaatctttccgggtcttagtacagatatctcctatgcttgctttacaaagcaaatattaggttgcaccaggtaacatttgtttctttttttgtacgtcaaaaacagttgaattgtgtcagtttcacatgtgtccaaactaatataaaacattataattatgactttcttctagagactttagagccagaaatcactgtcttattattatacaggtttaccgagatcaccggtcaaggcattttctgtggaacataaaatatgaacctgtttaaacagttaaatcacaaatgagaattagtctcaccctccaatatcggtattgtactgagatttcaacgtcaaggagtatataggaataaaatctatctgatggtctgtctcttgccttctgttacgtactggaagtgatttcaagtttaatactagcagagtttccttattttcatgtttgcaatgacctaaagatacttgaagataaatttctaaaaatattaattactttttactctatcatatccagcttgtttgtgcaactgtgatgttacttggagcaactgctatagaaaaagcatgagtgcactaaataaatattatttactagtgatgacaatggcagtgatggctaaggaactgcaatttataaagcacagccgagtatgagaaatcgaagcataaaggtccaagaaataaacagagaatggaaatttacagcagatataaacttgatttaaagttttttaacgtcaaaaaaataccagccttggcaaaatagtgaagccctgtctctacaaataaatataaaaaattaggccgggcatggtggctcacgcctgtaatcccagcactttgggaagccgaggcaggtggatcacctgaggtcagaagttcgagaccagcctggtgaacatggtaaaaccccatctctactaaatatacaaaaattagccaggcatggtggcgggcgcctgtaattccacctactcggaaggctgaggcaggagaatcacttgaacccgggaggcagaggttgcagtgagccaagatcgagccattgcgctccagcctgggcaacaagagtgaaacttcatctcaaaaaaaaaaaaaaaaaaaagtagtcaggtgttgtgccatgtacctatagtctttgctacttgggaggctgaggtgggaggatcacttgagcctcagcaggctgtggtaagccatgattgcgccactgtactccagcctgcatggtagagaaagaccctgtcttaaaaaaacaaaacaaaacaaacaaacaaacaaaaatacacagacttaactgaggttaaatgatgttttagtttctgtgagcgggcaattttaaaaggtataagctgaaatgatacagtcatttatcatatgcataaataatgctattttcaacgatttttcccttttgtatatgtgggcatataataaagtctttaaaattttatgttgactttgagtaaggccctgtcattaaaaaaaaacagaaaaaaagaagacaagagactaataacagagttttgggtttgtggtctgtctgggaaactgattccacataaataacattgcatacaagctagactctgttttcccacagaaacaaatcccatgttaacttttcaactgatttttaaattgggtacagcctaccctttagcaagctactgtcatgtacccacctcttggcaagttgccttagacctggatcacacttaccaggttgatctggctggagaagaaagtgagcacaggcagtgcctgggcagctaagtggttgtaagtgcctgggagtgtcaattaagtctcctttacttgtgacttaatctgaaaaatgtcatttttatgaggttactaggtgatttgttttcctcctcaataatctgcccttaaatgtaatctataaaacacgccctgcccctttaaggaatttctgccatatattggtagacattaattattttaaaagcaaacagaagtttctctgcgctcactgttttctgcttggaaaccatgtatctgtgagcagagatcaaaagcatagatattggaaataatggcagaattctaaaggtcactatattaggtactttcagcctatcttcttgtctaacatcatttgtgtatttcaatcacttgacaaatatttaataaacatgacattgttctaatagttaacaaaataaagaacaaaaactatgtccttatagatcttaaatgtccaatttattaatggattaatgacaacctctgctttgctgcacacagaatttgaggcaactctaattctagaattaattaaaatctggttgaatcttgagagagcccttgataatcataggtgatgtatccaagacctaggagagaaaactgatcttctggcttctttactgaacttctccattctactttctgtctgtgaggtggtaatcagttataagaaggtgagcggcaacagtataaaaagtcttctggttatgtgtacctcagggagatgtaaacaaaggtgctgtgaaggaggcatgaggggaaccctggtatatgagcaggactgacagcagtggttgtgtgggcctgattaccaggaaaccaacatcctctactccagcctgaaaatctaaccttttttttccttactcctacaacctcagtctttcctccttcccattctaagtatttccatctttttctctaaactttctcccatatcaatttgtaagagaaaaacaagaaataggtgggcagaaatgatgtctgagggatcccccagcagcttccaattagctatgtcactaagaacacctccagtcacagcaagctgggacttgatttggtgactgtccattgctggaaatatctcagtttcattaatctaagcactgtattcaaagagagcttgcctacaaagcacttgcaaagggtcctccctgttacactactcctctaagaagttctcaaggatcttggcctttacgggcaccctaaatccttggttagtgtttcacatggacatgatgtagggcagtaagcagcagcatgcaaaggactgtgaaatgttcagatctaattctgttccctctcttggcaatacttgctggctttatttgacattggaaagatactaggagcatctaggcccatggggcgtggcaatgccaagggtcctattgagaaagaatctgaaactgaagaaattaaaagaaaaaagtgtcatatgattcttctggggaaggaccaaagccagttgagacacaaccatccacaaggcttgcaggtgggtgagtgagtagaacatgttgacctgacctgactaaggctgctgataggtctaggaacatcagtacagctgcttggccagggtccctggctctgcctacgtcatctgggtgtgtagctataataacaaaaatggcaaaaaggatattaagtggccatacctttctatcaaggaaagctacccgctgtcacagactcatgatacctttaggattgaagattcgcacatcctggatttagcctgtgtgccatcaatgttctgtttattggaaggaaagaaattgatttcctgtttccttagttcattcatctattaataaacattttttaggcaccctccaggtcccagatactatgctatgcaggcagcaaaaacacaaataagacataatccctgcactgagggtctactggggtagtgtagcaggggtgataggcaaccacacgagtaccaaaatagctgagtaagtggcatgtcaaaaatgcactagggctgagtctagagtagaaaggaagtacatgcaggtaggaggaataatatttgcacatgctccaagaacagggtagtgacaccacccatttaggaaactacaacatttcactgggatgtcacatgagccagagtggctggaaataagtgatgaggggcttctatgcatagagcgtcttctatgctgtgccaaagaacttgaacttttatactaatggatatggggagccacttaactttaagcaggggactgagatgagtagatttccagcacagaaaaaaataacttgggcaaatgtggaggggcaaggctggcaagcagccccaaaccgtagtctagaagattgccccaagtgactactcgatggaggcatcattcactgatatgggacaaacaggaagagaaatgcatttgagagaagatgagctcaatttttggcatgtcgagcttgaggtcgtggtgctggtggttcagaaatgtccgtttctagaaggaaagttctatacatagatcaagggaggcaggtgtagggagctggcagtatgtgagtatcgcttagtcctgaagaagacgggcagccccttcaaaggatggtatttttgaacagtaacgaacttcatggatttttctgttggagcatttatacccagtagtgatttgtctctggactacagttgtatttcatttgttcttgtttttataacaaacataaattaattaccaagagactaacaaaatagttttgttaacttttatctccaaattataatgtgaaaactaggaaattcaaggcataggttagaaaaatatcccactaggcaaggtgcggtggctcacgcctgtaatcccagcactttgggaggccgaggcgggcggatcacaaggtcaggagatcaagaccatcctgataacatggtgaaaccccatctctactaaaaatacaaaaaattagccgggcgtggtggcgggcgcctgtagtcccagctactcggaggctgaggcaggagaatggcgtgaacccgggaggcggagcttgcgtgagccgagatcgcgccactgcactccagcctgagcaacagagtgagactccgcctcaaaaaaaaaaaaaaaaaaaaaattcccactaatagtgttttgttttgttttaatgtagcacagtagtcttttacatagtaatttttcccacttgaggaactaaaaggctgtcagtaataacttcacttcttagatgattcctgtttaatctgtaagtgttcccatcaaatctgtgtcatgaatacctggtctgagtttttatggaatatagatcaatattacttcagaatttaagtccatgcaattttgccagaacaaactaaggcaagtgattgaccctgctgatagaagatatcatattttgaaagataccagcacaaaatgtaagtatttcaaaccaagctctttgatgatgaaattagagcagaaaagtcttatcaagtctctggaaacaaggtctgagaacaatgaattcaagtcaggagaatctggtgctctctatgcagtgcttccactggtaccctgtatgaccttgggcaagtcccccggtcctctgcccccccgccccaacaacttttcctcctttctatcactgtggagttttataaagtattttatgttctttagatgaaagatacaaagtgcaccacttaaatggaaggtctgaggcttttcgcctataataggaggaaagactcattagcacaaaaccatctaagagacaaaaactttatttagtggttttagtctccagctaacacctaaatccaaaaaggtctaggtcatgtgttcccaaacatttcaatgtaaagaaagggggaaaaaaaggaacctagggaagaatcgaatcctacaagtggtatattgcttagtatctgtagcctgagaaaatatacaatgctttaagtcactgccagttcaggaatgtttatgggtaaatttgtatttttaataatcacatggtattcacatatattttcatctatatttgaaatagtggtatctgtatgtatgggacataactcctcagtcacaggcaaccacttggtttgcaatgagaataagagactcctgacatcaaatcttaatgcccaccctaatgttctaaagactgaatgttgaaatctctccttagcttccccgaaacttgttttactatctactcccggagtcatccatttgtcacagcaactaaaagaaatatcacagggcaagcatgatggctcaacacctatagtcctagaactttgggaggccaagatgggagaatcacttgaggccaggagttcgagaccagcctgagcaacacagggagaccctgtctctacaaaaaaaaaaaaaagaaaagaaaagaaagaaataaaagaagcatcacagcaggcaagaggtatgctaaagtccagtattctgagaaacgttcatataagaatatatatatacacacacatatatattttatagaaagtaacaaagtacctcaagatccaacttttgtaaaaggccacttaaatagtggaaggagaagcacaaccaattgaggttaagtttctatacttttcacaaagggaatgagaaaagtgtatttatacaatatattgaaaatctcctttgtaaatacaatgttgtataaaatataaagcattatcatacagtaagtggttcaaatttgtaagggtagaatattaacttccagaaccacacagacatggctacattaagagactttgtgtctttatcaagggagtcagtattctcattttactctgtgggtcaggttactcctgagcgctacctgttctgagtctatgctttcagaacagcacatctagaagtgagtgaacctgctctgtcaacaggggaagcaaacacagattattatacgttacaatacctaccatctattgatcacttcttaggtacctggtctttatatatatatttcattaaaattcatgggctgtggcatggtggctcacgcctataatcccagcactttgagaggccaaggtgagtggattgcttgagctcaggagtttgagactagcctgggcaacatagtgagacctcatctctacaaaaaaaataaacaaaaaaattagctgggtatggtggtatgtgcctgtagtcccagctacttggagaggctgaactgggaggatcactagagcccaggaggtctaggcttcagtgtgccacgatcataccattgcactccagcctgggcaacagaataagaccttgtctcaaaacaaaaccaaaacctaaacaacaacaacaacaaaaatctcatactatagcaacctcttttaatccctatttttagcagaggtgccagaagcagtcatagggctggagacaattctggctggcctgattctaaagccccactccttcactataccaacatgtcctcccattaagtgactgacacataaaactgggggaattttccccagcaagagatgccaaaataatttgtttagcatctgcttggcaactctgcctcagtcacagttgaaagtctttaaagtcttttgtgtgtgtgtgtgtgtgtgtgtgtgtgtgtgtgtgtgtgtgtgtgtgtatgtttcgtagagatggggtttcaccatgttggccaaactggtctcaaactcttggcctcaagtaatccacctgacttggcctcccaaagtgctgggattacaggcgtgagccactgaacctggcctaaagtcttgactctagtttctttcttcaactactattttgaacatacagtttatttattcctttgagtgctattgatttcattggctaataaacctatgattcctaaattatactttttgctttccttatgtatcttctccaacacctattttgcaaaaataccaaagcaactcaaagacatacttcattatctctatcttccattttcccatttcttagtactagtttgaaaagcaatctgcagtcattcttttaagtagcatcaaagcagtgccagcattgtgctaaacacttaatttgcattaccttttttgattctttatgattaaggtattaaattggtgttaggtctccatttcatagatgaggaaagagttcacacacagccaacaagtggcaaacataaaatttacacagaggtctgatggatgcttaagccctgactttaggccccaattttaagcgctaaactatacctacccagaatacaaacacagttttttcttgtcagaagacactaatcgttaaattacaggaggtggatggagacatgtgagaaattatcagaatttagttctctatacctgcttaactccatttgttcactttaatttacttttaatcccacagagctaagaactgaggactgtgagttattcaaaaaaccctcagatttaagaggaaagcagtaacaaggggctaagattacagcattgaatcttatttcctcagatgaagatagttcatctcaaatgtttaaggaaaagaaaactccaaatcagagcacctcactaatacacccaaaggcttctctcaaactgccctgtagcgaggcatggtggttcattcttgcagtcccagctacttgggaggctgaggccgtagggtcacctgagcccaggagttcaaggctgcagtgagctataatcctgctactgcactccagcctgggtgacagagtgagacccagtttcaaaaaaacaaagcaacacaataaaaaaactgccctgccccctttgccagagggaattactgaaggaacccgactgcacaggggagtggtctagattcaaacaaacttcagttacttcagaacgaaccccggtttagtcacagtggcagaggagaatcttatatttcaagaaactgaagatataataactagatccagaaaaaaaaatcctacagaatttcctaatcattattatttatttttaaacagggtagtgaaaaatgataaaataaatattagtaaacatcaattaaagaatatgtgagaatggtattaattattgccttaggacagtcatcctttggttttattaaattttatcccagtgcaatgctggatatagggtaagccagaaggcaccctgagggtcagtcatcgaataagagtgagaaagagtggaaactctagtgcctgagtctttctgggagcacacaggattcagagaacacagtctgcaagcaactgatactctgtgagcagtggtgcatatatttcagtacaattctcataaaaataatcacttataaggattcctaatttaaaaactcgaaaaacattaatttgtggtatctgcaagaactcttgaaagaaatcatgcggggcgcagtagctcactcctataatcccaggactttgggaggctgaggcaggcggatcacctgaagttgggagtttgagaccagcctgaccaacatggagaaaccccatctctattaaaaatacaaaaaaaatcagccaggcatggtggtgcatgcccataatcccagttactcaggaggctgaggtaggagaattgctttgaatccagcaggcagaggttttggtgagctgatatcaggccattgcactccagactgggcaacaagagtgaaactctgtctcaaaaaaaaagaaaagaaaaaagaaataatggaagattttcaaagctaggcaaagagcttacacttttcgtataggcaagaggaagctacctgaggcttatgagtagggcaggtttcaagagcggaatcttggaaccaagagagaacactaaggaggaggtaaggagaacctggatgactctgaaagcctcagaaatggaatgaaagctagttcaagactgaacactcccaggtttttcccactgcttgataaccccgggcttttaaacattcttttttttttttcttttctttttttatactttaagttctgggatacatacatgtgcagaaggtgcaggtttgttacataggtatacatgtgtcatggtggtttgctgcacccatcaacctgtcatctacattaggtatttctcctaatgctacacctcccctacccccccaccccctgacaggcaccagtatgtgatgttccccttcctgtgtccgtgtgttctcactgttcaactcccacctatgagtgagaacatgaggtgtttggttttttgttcctgtgttagtttgctgagaatgatggtttccagcttcatccatgtccctgcaaaggacatggattcatccttttttatggctgcatagtattccatggtgtctatgtgccatgttttctttatccagtctatcattgatgggcatttgggttggttccaagtctttgctattgtgaacaatgccacggtaaatatacatgtgcatgtgtctttattgtagaatgatttataatcctttgggtatatatccagtaatgggattgctgggtcaaatggtatttctggttctagatccttgaggaatcgccacactgtcttccacaatggttgaactaatttacactcccaccaacagtgtaaaggcattcctatttctccacatcctctccggcacctgttgtttcctgactttttaatgatcaccattctaactggtgtgagatggtatctcgttgtggttttgatttgcatttctttaatgaccagtgatgatgactttttcatatgtttgttggctgcataaatgtcttcttttgagaagtgtctgatcatatcctttgtccagtttttgatgcagttgtttatttttttcttgtaaactgcacccagcggttttttcttatgtaaactgccagtcatggaatcagttgattcctagtcttttttagtatggcgtatagtattatgtagataataaacagcggtcagtttttgttaagatagagactgtataatcatttggtaattcagtgttgtttatccaatttctagatttttactgaaaaacttgtaaacctgctttgagttatcagggtgctttgctgtacataagtatattttaaaaataaattttctttaaaaaaatcatcaattgacttaatcctcttgcatcttaaaggaaaacagcattcaatgttggatctgctctccaaatttatgttacccatttataagaaacttctgaaattttcagtttggggactctggtctccaaagcatgtgggggaaggctgcttaaatcacactatctcagcaatgtcactttcagccttccattctctaaaaacaatgccagagaaggtgcactctggttcactcctgtttccctataactgttgcattttgacaatttgcattttattttggaccatagctactgtaattgtaaattggtctactttctttaatctgggagtagcagcaaatcatttttaatagcccttaattcccccttttaatgagatatctgcattcgactgactcaaccatgtactgccgtaggctagggtggatgaatcacagaaaatagacggaagaaacccattaggtaatctcacgcagtcctctgccagactccggatgattcccaacaataaaacttctaggaccagttcagcatacttttaatgctcctccaaggatggaactgctaaccctcccaccacaggccatccagtcatttggacagcccgcactcccgcagtcgtctccccaagcttccatttatgctctctttatcctcactgcatcccatttcactacagagctcaaggtccacccgggctatgtgcacaaacttttcttctggtctgtttgcaagcactcacatacttagagagtgaccgccctggatattaagggaaaattgaactatatataaaataacttcttatacttcttaacccttgccataaaaattagaaaaggactcatatcatggactcattctcaaagcctgctgtcttttatatgctctccagttctttgtttggtctaattcttttcttgctgcattcctctgaactctctccagctgttccacatctggagttgagctgctcatagctgaacacactattcttggtgtggtcttatttgatgcagataaaccctggctctcagtttcccttcatctctcttatcctgcttgcttttccctttcttttgctttttcctttgctttcaatctataagctctgtttttgacattatgttctggagagttactcaattcagttccacgggcttgagaataatggtaatgaaaaaaacctcttttgaggccccaacgcctatttagttgatagagtgatgccttttaggatttccatttcccactgctctacaattaacatcatcatcaacaataaccacctccatcttttttcaaggtcaatgtattacctggtaataactattatttaccataataatttcatttccagccaaatacattattttacttaccatctatttattttccccttgtgttaatttatatttttttctttgctaaggttagattattctgccttcaatttactgagaaaacccttatttatacattcagcccaacttccccacttatttcttcattttcaaagtgattcctgcaatctttgtaggattcagaactgaaaaggactgaacctgtagctaggccacttcctttgaccttcaattatggctgtttatcctgccaatttaccctcacatatgtaaaatccagcttcatttatagcaggacctaattaagggggtcactttttaaatattgaactttctacttatctatgtaaaaagctcactatctaaattattgtcaagaatggaacaactacatagccagattctagcccatgtgtttacatagagggtgagtacatgcaaatgttgtactcacaataccaagggtgctcccaattctacataatcaaccttttccaccactcccctcctccaagaacagcaggtctttcttcccacatcctcactccctctgctcacactctcacactcctccccctatctcctattaggttgggctcagatttttttaaaaaactgtggtaaaatacacaacataaaatttaccatcttaaccatttttaagtgtacagttcagcgctattaaatacattcataatgttgtgcaaccatcaccaccatccatcgccattactcttttcatcttttaaaactgaaactcttatgcataaaacagtaattcctcatttatttctctccccaaaccctggcaaccaccattatcctttctgtctctgtgattttgactactctgcattcttgatttaagagaatcacaaggtatttctcttttaatgactgccttatttcatttagcgtaatgtcctcagaattcatccatgttgtggcatatgtcagaattcccttcctttttaaggcttaataacattccattgcatgtgtatatatagtacatttgcttatctattcatccgctgatggatacttgggttgcctctacgttttagctacagtgaataatgctgctacaaacatgggtatacaacagatcattcttttttatggtattttcaaatacacacaaaagtagagcaaccgacaaaattaacccccgtatactcaactttaacatccccaaatccaaaggtccccagatttgactttctcgttttcagacactcaaaagacagccttcactgcctgatgtctctctgtaggaatttttcggtggggcttggggatgacacccagtgtcactagtctttgaatctgatcaccactaattccctgtaaccacagagctaagagaacacatgtccacatccaattagtcagtgttttatttttcctctcctctcatttacaattctgccagaagttctaaataaaagaatagagtacctatctaccttctttcggccctgactctcaaacatatagtttaccctgaatgttatgtttctgcctatgttctgtcattctttcaagtgatcatgacttcaactttcaaatggtttcaggcaagattttagaacaaacaatatactgctagagagaaaataaaaaccagcaaaaataaaccaaaaaggcaattgataattattttgggagaaataatttatttttcaattttgaccatcttttgttattttgcttttcatcagcacttctaacagagctaagagttcagatcagatgcctctaattttaatgtgagctaaaatctgtgttaaaatgtagactgccagcctccactccagacatcggattacactggtctagggtacagcctaggaatctgcattttatcaaacactccagagggttccaatgcaggtggtctctgactatgctttggcaaacactgaagaatcagatgaggaacacggaattgctataataattctgaagagaaagtaattttttaacttggggtaatgggacagcttcacagagacagagtttcaactttgtagttttcgttcattcagtcactgaaaagaaattattaggcatctgctatgtatcacattctgtactggagctacaatagtgaagaagcctgacagagtcctttgctaatgaggctgagagtctacaagagcaggatttcgggagcaaacagaggaaccgtcataaacaaagaggggatgggattaaggaatatccagtacaatgttgggcaatgtggagaacacaaaagaaatatatatacatttaaatctaagactagaaggggtagggtggtacaaaagaagttagtacagctggaatggccaagtcttcaatgacagagactgaggatggaaactgggcagtggagatggctgaagggaagtcagcagttatcccaagggcagtagaaagccctccatggtgtctaggcaggaacatgatataatttcaagatatggctcaagaggcccaagttatgttttgaaaaggtcatctttttcctagaaggtacattaacaatgaagtatactagagattttgtgtaaatgtagaaatgaatattgaactgcttccagaactatgtagccaggctgacaaacttttaattaagtccatctggccgggggtggggtggggaggggtgtcttgtattcattttctcttcatctagatctagcctcgtccttccacataatttgcagaaaaggctcacacatgcatgcgcacaggcccaatccttttaagcttttaattgggcttccatccacaaacccctttcactttttttttttttttgagaaccaactcacacattctgaattattttgagtatcttatcatctttaaagagagtgagaaagagagattacagattttgtggttaatgattctttaaagaagaagggaagctcaagtcaagtttctttccatttagaatagagctttgggtcctttcagaaattaacttctctgaggctggactcgatggttcacacctgtaatcccagcagtttgggaggccaaggtgggaggatcacttgagcctaggagctcaagaacagcctaggcaacacagggagaccccatctctacaaaaataaaaattaaaattaaaaaataatttggggccaggtgcggtggctcatgcctgtaatcccagcactttggaaggccgaggtgggcggatcacgaggtcaggagatggagaccatcctggctaatgcggtgaaaccccgtctctactaaaaatacaaaaacattagccgggcatggtggcgtgcgcctgtagtcccagctaatcccgaggctgaggcaggagaatggcatgaacccgggaggcggagcttgcagtgagcagagatcgggccactgcactccagcctgggcgacagagtgagactccaactccaacaacaacaacaaaataataataatgataataataataataataatttggatgtgttggtgcatacctgtggtcctaggtactcaggtggctgagatgggtggatcactgaggcccaggaggtctagctaggctgcagtgaaccatgattgtgccactgcactccagcctgggcaaccaagtgagagcctgtctcaaaaagaaaaaaagaaaaaaagaaaaaaaaaaaaagcttttctgagataagatcttttcaactttatagttgaaaaaaactacatggacaatagcccccacttaagttattggaagaatcaggtgagttgagttacaagttgctttattatagttcttgacgcataacagctgctcattaaatgttagcttctaaagggttaagaatacacatcattaggaacaggataaaaaagaatgagttgacatttaatatttatagggtattgaatcaagtattgaatcaagatctttaatttattactgaatacattttgcgtgcctaaaatgaccaggatactctccaaaagacaattttacagcatactgtttatctgaattttaatggtagactgtagcaagaacatgaagtaggtcagttgaagaagataagcctgtaaggatataaaggatgagagaaaacctcaatacaagtccagaggtgctgccgatagatgagttccctagaattctaagtactaccaagcataatggttagtgtatcaactttggggaggagtggtgaatttctgaaaagctgcaatcagctgagataaatatgcaacatctattgagcatatttcaaggttattcagaggcatcaagaactgaacaccaggtgaccttgggcaagttatgtgtctctgagttttggtttccttatctgcaaggctgatgggctagataacctctaaatggttcttgcagatataacaggatttggggaggagaatggataattgaaagagtccagactatgcagtcagtcagacttgggctggaattctgcttctaccacccaccaggcaaagtacttaacatccttgggtcccattttctcctctgtaaaatggagaaaataaaatatacattgtatagctattgaaggataaaaaataacatttctaaattatctggcatttattaataatagacaactaaattaagggaacactcaatgttattctatgatcgtgtgttaaatgcacctatggccaaatttaaagtctagttatcactttaaagtctagttatccggtaactgactaaacggtgattcttcaaatttcaaaaacattcctcgctttacaaaaaagattcatctcaggctcctcttaaaatgtgagtcaataatcaccctgagcatgagatagacttctaggatatttagatatatctacccactgttgaatatgaagtgtgatatcttcattctcaacaaacccttaccagggaggggtgtgtgtgtgtgtgtgtgtgtgtatgggtgtgtgtatccccttgtttgtaaagctcaatgctaagtgaggtttataaagttctgcgaggtttgattctctgctcttgagaaactgacgataacttttctctgtaggaagacaggtacacaatgccaaagaaccaaaagccttattttgaaaagaaaaatgagagcgactccttccacagaatagtgtgaattaattagtgtttataaagaattttgatatgcttatgcaaaaggcactttgaatgtaaacagttttaagggcactttgttgtgtaagactagattaagaacagggcagtaattagcacgttgggaggcatgaaaaagttttaaagaaagcacaaggctgggcactgtggctcacacctgtaattccagcgctttgggaggctgaggcgagaggatcacttgagtctgggagttcaaaaccagcctgggaaatgcagtgaaacccattgaaaaatttaaaaatttgctgggcatggtggcacacgcctgtggtcccagctacttgagaggctgaggcagcaggatcgctcaagcccaggtcgtctatagtgagctaggatcactatagtgagccaggctgcactccagcctgggcagcagggccaggccctgtctctaaaaaaaaaatagttaaaaaaaaacacatcatattgctacaaagacaatatgtaaaacccactgcaattgttacataaaagaatgctcctagagtagattttgtgcagatgataagccaggtaaaatctggaaatacaatttcttctttttagttcagggaaagccaggttcctcagtataagtaaatcttaaataagtttttaaaaataccaaatcaatttaaagtgctaacagccttaccaggatgtaaattcttaaacaattagcttcattcccaacaggatcaaacacaagcacacagccaagacagtttagctcctaagcttggtgcgttcaaagagaatcttgacttgagctgagtgtgatctccagatgcaatacaacccttctacacacagatccatgggaaagcattttctggaaacagatgcaccttgtttaaaaccaaagttgtgtttctgaagaaagctgggtacaaatagaatttttaaaaattgaatcatattttaaatgccctggggatgctcatatcacagggaaccctcttatgaatgattctgcaagagaagaattattttatgaattgaaaaagcacctctaatttatttgctgcactgattttttgaattttgttttcaaaattcaaaaaaattttgaaattatgtgctaattatgtgcttgccttttgtggcttattccgaatatcttaacaaagaaacactatttttttttctctttgaatgtttgattttgaaatatttgcttttaatatagtcttttcatatagtctaattcctctcactccctacccccaccccatgggtataattccatttttgaagtggaagccaatgagataactgaattgaatgtactggaacttattttatggtcaaattttaggaacgcatctgttatacttggtagggaatatagattctattagatctaaacagaatgaaagggagccggggcatggtgtctctatttgctgttgaacagctgatataaaaggaattgaagcaggccatgtacggtggctcacgcctgtaatcccagcactttgggaggccgaggcaggcagatcacctgaggtaaggagttcgagaccagcctgaccaatatgatgaaactccatctctactaaaaatacaaaaattagccaggtgtggttgcatgcgcctgtaatcccagctactcaggaggctaagataggagaatcgcttgaacctgggaggcggaggttgcagtgagctgagattgcgccattgcactctagcctgggcaataagctcgaaactccatctcaaaaaaaaaaaaaaaaaaagggggggcggggggcaattgaagcaatgagtgtaaacaccttggctctgtagctgaccctatcaggtggggaagaacagagcaagatcagaagtatgcttctattcacaaaatcttctatagacatgtttgattcaactccaagacaccaagttaactttcagcagaggttcccaaattttcttgattcatgaatctcccacgtagtgggagagtgattaatctcccactatggtggtgtctttaggccaaaagaaatacctaacagttaacttattaagtacctacgttcaaacaactactaaggagctgtcctaataacttggtagcagtttgaaaaaaataatacttataaattgaaagaaaaaaggtatatttttatttcattcttaaccacaactactcactaaagtatgcgtacacctttcgggtatgcacaacttctcaaatcttggaatcatattggatagagttgccttcatttcccataccaaattgttgccatgcagtacttgctttgtatcaagttaacctccaaaaacccaaccttagaaagatatgacatcgtcaaaaggaatgtagcgccatctaatgttgaagctgtgaactacctcaatctagtaatgcactgggtacttgacagataccaaacattgctgtgttttcctctaaaatttaaaacatcccctatgagttgactgtggtacccttgggtgccctggtatacagtttgggaactacaagtttaaataaagacaagtagactttccattttcctgaatgactgaacaatgtcataacacttcaatacctgctcagtatacatataacacacacagaggaaatctatacttgcttctacacacatcttatacctagttaaaagcactgtcattccaggttaggttacaattttaaaggcaatacttttatggcagtacctacccaaatgcatttttaaactgtattccattaaatttcacctttgctttcacaattttgtatctggcatgtgattccatttaggttatactaggaaaaaacatttttattttctcaaataactaacgttttgtgttgtaataaaacctaatgtctagtaccaacaatgtcatggactctaccatgttagatgcccatccatctcaaatgtgtaagatatcacatatttaggcacaatggctgtacagtattggtacattgcatgaaaaggtcacaggccagccacagtggctcacgcctgtaatctcagcactttgggaggccgaggtgggtcgggagtttgagaccagccagaccaacatggagaaaccctgtctctactaaaaatataaaattagctgggcgtagtggcgcatgcctgtaatcccagctactcaggaggctgaggcagaagaatcgcttgaacccgggaggtggaagttgctgtgagccaagatggcgccattgcactctggcccgggcaacaagagtaaaactccttctcaaaaaaaaaaagaagttaaaaaatgtggccatttctttgtggaaaaaaagatattaaaagcactaatttaggatgatgttaagtagaaatgtgtcatttcacctgatacacattttcgtctaggaaacacagtgcagattgttaatgatagaataatcccactcctagtcgttagccttggaaccaaactgttaactctcttctttcctttgagcatagcctatttatttctatttgctgttgaggataaaccactgattgagtcatagaatgcagttttgggctgggcatggtagctcgtgcctgtaatcctagcctttgtgaggctgaggcaggaagatcccttgggcccagggttcaagaccagcctgggcaacataggagaccctgtctctaaaaaataaagaaggaatgatgaagataatgatgatgatgacagttttgcaatcatctcacaatttccttttctatctttgaaatcaaactctgtccttacattgcctatttcaactttctgcaccttttaccttgcctatttcagctttctgcatgtttacctcatattgcttttgccctggggttctcctccctccttagagttttatctgtctgtgcactttctttcctctctctgctactttgcaaaagcctcccacacaattctaggtaatagcaatttaacaacatgccctcaggtggaataatcagccatcatgattagttagagtcaggtcctggctgaatctgggattagggatgggtgtctcctcaggaccaaggcagtctagtctcagaagaatagaattaaagggaaaattccagtttcattaagtgtggcattttttaatcagcaagtcacagaaccttattaccaacatgtattaaaatgaactccattttaatggcagtgtgtccattgtcaagatatttgtggttcactatggcaagtaagttcatgcgtcctaacccaatccagtgggggtaaatgaatgagctgaaagagactggaataaccacgttgataaggatatcacaatgtaattactgaaaagatgccactttgggacccttgctcttttctttaacagattggtattttgttacttttaaacattccgtcatatagtattccacctgaagaatattttagctcatataatgacatttaagaaaaatatagcaaaaaacctagaagccttctccagtgccaaactcatttagaaagtttagcttctgactaatgcaatgatgcaatgtaatactaccaaattctttcatcatatttaggagtaagtgattacttgtggaaactgtaatgtttcctaacaaaccgagtgtttcagggacagaccacccaaatgtattattatataaagatgtcagttacataattacatgagaaaacaacacattttacttttttgttttttaacaacaattatcctctctggggaagagaggctgaattagctgcttagcaaagtggctcctaggggctccaattaacttagacacatttaaactggatccttgataatgtacatttaacatgaggaaaatgaaattgtattttcttcctcccaatccctaactcctgccatgtctgaactgactttgctgagaccaccaacagtgaagatgcatttaaaaactgcaactcacatctaaatgtaggccatataccagctgccttgttttaaaattttttttaaattattttgaaagtcctatgccattaatattaatattagagccatttaaatgaaaacacacaaacctcaaatcaacacttatttttctttctttttatatggacaggggtctcactatgttgctgaggctggtctcaaactcctgtcttcaagcaatcctcccacctcagtctcccaaagtactggaattacaggcataagccaccgtacctggtctaaacatctacttttcttaatgggtgccaagacattctttaaaagtaactgggaggctgggcgcggtggctcatgcctgtaatcccagcactttgggaggccgaggcaggcagatcacgaggtcaggaattcaagaccagcctggccaagatggtgaaaccccatctctactaaaaatacaaaaattagctgggcatggtggtgggtgactgtaatcccagctactcaggaggctgaggcagagaattgcttgaacccgggaagtggaggttgctccgagccgagattgtgccactgcacacctgggagacagagcgagactccgtcacaaaaaaaaaaaaaaaaaaaaaaaagcaattggggatttttttaaatgatgtgagtgtgcagttgcatttaattcaaataatattttataaacatttgtctacattaggggtgtgcaataaatgattttaaaaatgactatactgcttatgtataaaacagaaatatgttttaaatatttgatgcctcactactcataattctcagtattttggcagacacttattgagtgtccaatgtcagaaaacagttacactactaaggtccaaataagcaaaatagctatagattactcatcttcaagagtagtttatcatagtttatcagtaagaaaatttggcaaaggaagagtacattttcattaaaatgctcagtgtttcaatgaggatgctcctggcatttaagatatgataattctcccttttcgggggttggccttgtcctggcattcctggcccctgcccacaaaatgctagcagtgaccccagttatagtgataatcagaatattcccatacgttccccaaagtcccctaggcaaaaaagtactttctccagttggaaaccactgacccaaagagtctctagcttaaaacagaaacaaaaacagaataagggtgaaatgtgctaaagcttcattatgtggttttaaaaagcaggggtggttgagtgttccttaataactgtatataactttacttccttgtctttcagtttatttgtaaaaggtttgtctcctgggggttcatacattatcaataattctcattggcttcttcagaggaggatgttcaggcagatgttcaggagaatgttcagctagatgggtgagcaaaaaacccagttttcttaaacttttagttaaactcagctctgccgcctagctggggacaatggcaagggaaatcagattgcagactagtgtctcctgggactaatctgacatttatgaggggagcctctggttgacgaaatgcgagtaccagaacagagctgatgcatgtgtgatcatactcaacattagaacaccccttcaggctgggtgcagtggctcacacctgtaatcccaacactttgggagactgaggcgggtagatcatctgaggtctggagttcaagaccagctttgccagcatggcaaaactccgtctccactaaaaatacaaaaattagctgggcacggtggtgcacatctgtaatcccagctacttgggaggctgaagcacgagaattgcttgaacccgggaggcggaggttgcagtgcgctgagatcgcaccactgcactccagcctgggtgacagagtgagactgtctcataaaaaaaaaaaaaaaaaaaaaaagagaacaccccttcagcttgtgacaagcagctaacatctaggtctatatgacaaatgtttttcttttgctacctaaaaataggtttctgaggctggttaggtgaaagtcccctaggtaggaatggtattgtctctagttagagactactgatccaaagagaccctagataaaaagagaataatggtaggctaacaccttacacctgtaccttacgcctgaaggcagaagggagcaggagcactgggatggacacaggctcaacatatctaaaattataatcttcctatttttacagatgggaagaaagagttcagagatgtgggatgacttgcagacattctgtgcagtttaataaaccttccttctcctgtatcgtacagcaagatctctttccaacattactacctcaatagggtgaagaatacatttctcatctaccatttgacaaatttatgctgaaatgcaattcgtttgctgaaccttggaaaacaactcaacaaagttctgtcctttacattataaatccagttcacaaaaacctttcaaacttttttctccaaataatctgtcttcttctttatgtcctgagctcagaagagttccctaatctgagctcctcaactctgggctcgtcgttcttcatttcttgatatgtgcccactgctaagagttgtctttgtttatcactctagccacagcattcaaaatctccaagcagtagacagtctctctgctgccctatcaatctcttttcctgactatttcttaaaaaccaaattaagggtaccttttatttcctgatgaatagcaggccttcccacaccacttcttgtttcactctccctaaatcctcatcacctgataattttcaataatgatccaaatggcaacagactacatcatctcagcaccatagcatgagagaatgaaagggaccttggaggtcatttgattaactggataaaaagtgttctctaagaaacttttcagattcttcagtgggcatccaggagcaggatgaaggaggtgaatggggaagggggcagcaagcagaatttatggtcctcacctccaatttagccagaacaattccactttaatctgtttctctaattatgctaagtacaattttattttaaaaagaaaataaaaagagggacgctttggaaatctccacttaaaaaaaagaaatgtaaaaccactaatctatttcccaccatgctgagtcctttaaaaagagcctgatgtaaactttgcaaaaatttgtgattagcaaagggtctttaaaatgcctagtctcttagtaatcataatccctcaccttaaacactggcctgcaccaccaagaaaagagaaaatgtgatttactgatggatgtgctgggagaggaagaaagagactcatgtttgactgctgattttcccattagctagctgctaagccacttaacctcctcatgcctcagtttccttgcctgcagaatgagagctgggctctactcaggcattttctagctccaaaattctgggttctatgaaccagatttttgtgagggggactgagccctatttctctcgcttttcccatctcttgaataatgtatcgttcttttccaaaggagaagtgtccagggacatcaggaaaaaaaaaaaaaaaaaagcttttatccaatctaacaccaggactaatggaatgtttacagacagactggctggcctcagccctttagtttctccccttttatctttctaatcctcctttcaatgtgtcacccctcacatctctttccttccttcttagctccgctcaaatttagcatacctttaagtggctactgtatacaaggcactgcggttcagcacttgggttatataaagatgaataaggcacagccctgcacagaaagggacttctgtaaggaggacaactctggcagaaacataaagggaaggttagagatgcaaaagaataaaagtggaatatttacataagagatgagggcatgaaaagtctttgagaactaactgggaggtgggagagaagccgttcaatattaattcagtgaatcaatcagcttgttacttactgagctgtgttccaggcactgtactacatgcagcagttacaaaatgaaaaggcctggtccctgcttatggtctaaaaaggagagacagacatgggaattgggtttggtgccaatgagaaccagggcaacaccaaccaaaagagggatgtcccaaatagcagacatgagtgggaggagacagaataagtaaactcccactggaataaggaatttatttaacatgacgatgctgaagggatgtgggggctaatggggcattggtgcattcacattaagcacactcagagtaacatttggatctggagtcagaagacagagacatcaacactgagatgctgtcaagagtggggccaggaagtggaagaaatctcctaggtagaaagaacagagaataaagagaaggctgtaggaccaacattcggtaagtgtctatactcaaggaatagagaggaaaagaaaactgagtgaagaagacagtgaaaggaaatgtaggaaaacaagtaggcatgtgcaatgctaaaataagctcaggaagaagggaacttcaaacaaaaagaaatgttcaaaaataagtggaaggccgggcgtggtggctcatgcctgtaatcccagcactttgggaggccgaggcaggtggatcacctgaggtcggcagttcaagaccagcctggccaacatggtgaaatcccgttcctgctaaaaatacaaaaaattagccaggtatggtggtgcgggcctgtaatcccagccacttgggaggctgaggcacggagaatcacttgaacccgggaggtggagggtgcagtgagccaagatcgtgccactgcactccaacttgtgcaacaagagtgaaacttcatttcaaaaaaataaaaataaaaataaataaataaatacataaaggctgggtgcggtggctcacacctgtaatcccagcactttgggaggccaaggtgggcggatcacctgaagttgggagttcgagaccagcccgaccaacatggagaaaaccccatctctacatgggcgtggtggcacatgcctgtaatctcagctactcaggaggctgaggcaggagaatctcctgaaccgggaggtggaggttgcagtgagccaagatcacgccattgcactccagcctgggcaataaaagtgaaactctgtctcaaaaataaaataaaataaaaataaaaataaggaaaaaaataagggaaaaaaaggaagcagagaagggtggggtatagtagacagaaaaaatgtcataaaatttagcagctagttaataaaaggcttttgagacagcagtttcactcatatctatattgagtccatgagggtcttccttagaaaaaattagcaaaaaagaaaagctacactgcagactgatgtattatggattcaaagaacactcttttcttttcctctagtttttttaagtttggaggaggctccagcaaggcttttaggccaaggaaaagaaatgaatctgctacagattctctcccctgactattgtccaacaaaaaacaaaaacaccaactctatgttagaagttttcaatcttttgaaaacctttcttctggtcactagctgcatgtgagggtggtaatctacataaataaatggacatcacgtctgcctgcaataacgcctggatagactctcaccacaactagggtacatctggaataatcagtgaaattatactgagtgaggcaaacagctacccttcagaagggttgaaactgaggaaaaaggagagaatgatgtaacaactgatgtagaaagatgtgtcataaatattaagccaccttgggtaccaaaaccctggatggcaaatcctgcactaaagtttaacaaatgacccagcctgtctctgcggtacatatagtatcactatatttctccaagtctgatacttcctctgagtttttcataccctagtctctgtcttcccttataagaaataatccctgtccctaattcctaaccaaaaaaagggaaataaataaaacatatacctaacaaaacatatccattttgatctgtacaaacttgttcaaatttctctatataaacccttccttgaaaaaaggtttagtgctgacatattagatttcacaggaatcacccctgtacccagggctggcctcatgagtgtgtgagccactgtgcagtcgcctaagaccccactttcaaaaggggcccaggctcagaagggctctgggcttagtttagtactctgctgttactatcttgaaattcttaataattttatctctgaatttgtgttttgtaagtgaagtcggatgagcagaggataaaactttatattttagtacttttaatggtactttttgcccgactttgaacaatggaatttttgttttgcactatgccctgcaaattatgtagccagccctgcctgcaaccctctcccccagaaatgggttgtgtgtgcttaggtactagactcagtaatccaccctcccttttattcatttccttgcattatgtaccttaatacattatacacacctttgaggggagagccactatcttttccatctctttatcacaagctccccatatcctagtgcctaacagagtgctaaggatgcagaaggtacttgataaatatttgtaaagtcaataccccactctagttagacaattctcaactactccatgatgaccaccactgaaccttttcaaaacttcaaaatctatctggtttccagaacattataaagtatcaatctccttattctatggaaagctacaaaaataatgacctctccttttaggcttgtaaagaaacaacatttcatactaatacaacaatgataagtgtattaggtttgtttttaagggctttattttcttttaactttttgttaaatctgagcatcaaagcattttttgaaagtttactgttccagcatcttagatccctaaagatggcaactcaactaacttttcctaagggttgaatgctgcttcatgcaatgcttaatttgagtcaacaatggctgaaggaacatccttaaatgcttatctcaagaggagcaaatgtagctactggcctctggcaatccaaaggaaaataactgaggtcaagttctgtcttaaattctcagtaccattacaccttgtactattgctagattctcgtgttggcccattttaggctctttataatgatatgatttatatctcatgactcaaattcattacagatggaccatacccaagataaatgccacaaggcacaaacaactcttcatctactccacagcttccaatggttggagtcactggacgctaaaaaatcacttatatgaaaaatatggattgaattggttacgtatcttacaagacttcaggttcaacagttttctttttcccattttggcaagcatagatagagaactcagaaatgtgtccttggctactaagaggggaggcagatccaggacacacatggaataaagcaaagccaatttaataatggtgccctttatccaaagatgaatgaaagacatcagtcgtcctctaaacattaatggagggacacaaaaccaaaaggcaatggttgagaggcaaaggaagtgacctagagagggtattgagtagtcaaaatagtggagaattgagaagaggaacttgggtttggggaggtgtcataagggtaataagagtgtcaattgcaactttttcattagcttaaaagaagaagttgttgatgtttaacattagttgtaataatctaagagggaccaaatgtacactgtgttgagatattttaggcagagtaatcaagacagagagagcatactttattcacactgtgactaaacctagcgcactgccaaaaaataggatttggaacaaattttggaataaaaactactcatctgttttgcaaaaagaaatcagaagcacatcagcataatcagtaattttaaacttgcctattaagtcaggacactgatcgctaacagatgcatatatttgcaaatttcttcaacaaagttgacaagttctgtatcacaggtctcttcttgctgccctgtaatatatgtttctgaatttctaactatgctctcattgctaatgattctgtgtatctctgtcatttcagagatacccagagtggtttctattgaccagtcaaattctgcattgtgagaaagcccaaaagtaggcctttaaccaggtcttgatagttaataattttctgaactcaatgcaaattgagcaaaaacgattggccattagtagtagtcaatggaaaaagcccctgctttagtctggagactaaatgtgtaaacactctgggctgtacctgaagcactgtggtgaagggcatgggcttcaaaatatattctgaatgagcaaatgggctcccagggtaacttagaatgtagtttatgaactagctcattttggaagttacaaatacaatgtaccacagtgggggaaatgtggtattcacagctgaagacttatctaacagtgacagtgagaatggaataatggaataatgacacataagtatgaatgaagctgtatctctttgcttcaaatttggccaacaaccacacgtgagctgggaacaacatggctacataccacaatcccctacatcctcaaactggtgacatttatcagccagccatttctcacaaatgtggatttttatagataggagttatgaaaagtacatgcacattgaagatccacaattctgctgaaggtctttcatgagaattttgaaaatttccttcaaaatcaaactgttttccctcaaacaaagcctgagctatgaaaacaggtttaagttgccaaagaattcacctgtgattgtttgtagtctaacatctaaaggactggaatggaatgtcagaatgtcagtcagaaaatattttctttctatctatctatctatctatctatctatctatctatctatctatctatctatctctactttggcctggaattaaacttgagaaatttagaaacatcattcttgtgcccctccttttaaaaacgaaaaacaaacaccaaaaaatacagctaatgggcatatttcattagaaacaaaagaaacataaaaaactgttagaaacaaaagtaagcgtatcagtcagtaactttaaacacaagaagcacacagacttcccaaactaaacatgaagagtattaaaaggaatctttaacaatggcacacaagtgtgaataaaaatctctccatcttttctgatagtctctcactaactccaccttaaaatctcacaaaagccttacttttgcacttccataggaaactttccttcagtaaccaatttccttgccatcgctttgccacttaggtgacaggaagaactttgcttaatactggacaacattcccagcactttacgtataataatttcaaattcacacacacacaaaccagtaaggtagttaaatattctcggccgggtgtggtggctcacgcctgtaatctcagcactttgggaggctgaggcaggcagatcacgaggtcaagagatcgagaccatcctggccaacatggtgaaaccccgtctctattaaaaatacaaaaattagctgggcatggtggcgcgtgcctgtagtcccagctactcaggaggctgaggcaggagaatcgcttgaacccgggaggtggaggttgcagtgagctgagatcaccgtaccaccgcactccagcctggtgacagagcaagactgtgtctcaaaaaaaaaaaaaaaaaattctcaccatgctatagatgaggaagctgtagaacagtgacagtgaggttgaataacttgcccagtggcttcggtggcagatctcaagtccacactgttatccacttatgtattgattgccgcctctctatcacagagccatttgcacttactggtaaattattttagagtttggtagtgctatatttacaggacattagataaatactgctggatggttacaaatttgtaggggtacgagcatctgcgattacatgtgattttgtgtgtgtgtgcctgtgtgtgtgtgtgtgtgtaagaggggttatagctgaagtttatttcaatgagttcacatacagaagaaaagaaatgtacattttgttgagggcctacaatgtgctagtcagcatattatgttttctgctaacttaatcatcaaaacaatcctgcaaaacaagtgttctctttctagtttttaaattctaatgtgtgttttctttttcttttttcttttgaataatagttattattattttaaatagggaggagttctcactatgttgtccaggctgctctcgcactcctgagctgaagtgatcctcccgtttcagcctcccaaagtactaggattacaggcatgagccaccacgcccagcccgtgtttgttttttaaacagatatgggaactgaggcttcgtgaggctaagcaaactattaaattaatgtcacataggtagtagatggcagaagacaagacacccccactccaaacataccttctggtgtcctatactatttgcccttctgttctcttctttagttcccaaagacccagagagctcaattgttcacaggatccagtctgtcccccaggtgactgtatttataatggtagagcatataatatttgtctcatattttaacacttttaagaatgctttattggaccgggtgcagtggctcatgtctgtaatcccagcactttgggaggccaaggcgggtggatcacctgaggtcaggagatcaggagttcaagactaccctggccaacgtggtgaaactccgtctctactaaaaatacaaaaatagccgggcgcggtagctcacgcctgtaatcccagcactttcggaggccgaggcgggcggatcacgaggtcaggagatcgagaccatcctggctaacaaggtgcaaccccatctctactaaaaatacagaaattagccgggcgtggtggccggcgcctgtagtcccagctactcgggaggctgaggcaggagaatggtgtgaacccaggaggcggagcgtgcagtgagccgagattgcaccactgcactctagcctgggtgacagagcgagactccatctcaaaaaaaaaaaaccaaaaaaacccaaaaatagccaggtgtggtggcacatgcctgtaatcccagctactcaggaggctgtagctgggaggaggcacaagaattgcttgaacccaggaggtggaggttgcattgagctgagatcctgtcattgcactctaacctgggcaacaagagtgaaattacatctccaaaaaaaaaaaaaaaaaaaaaaaagaatgctttattgactgtttttgtttacatctcccaagtactggcaaacccctttaaatttagaggctactgaatccagaagcctggttccatccatggtcttagtgtaaacactgtcttcataattgtggccacagttgtttctgggctataactgaggtgacatttcctagatataccccagaaatcatttcttagttctgctttccagagtgtctgaaaagccacaccagaaaaattaaatacaagtatttcaaacagtttgaccataagtaactgtaagaaatattttgatattgagaccgagtacacatggatatatgtgtgtaaatacatatgcacaacaaaaaagattttttttttttacaaaacagtgtgttctcttataacaattgatttttttttttaacatgaaatccacaaaagtctgtatatgactccctaatcatgctgcaaccaacagtttgaaaaacagggatggagaacatactgttccaattttaattaatattttgcacagaatggaattaaaaaagtcttgttcagacaaaataaataacatttattgatttcctttcatttatttgttctaaatgtacttaaaatgaggctgtcattgttatccatgaggtggggaatggataggttcccttttcactacatgcacccttctataccttttgaattttgtaccagcttgagtgcattgtccatgtgaaggttaggtaaaacaggcggggtgcggtggctcacgtctgcaatgtcagcactttgggaggccgaggtgggtggatcacctgaggtcgggagttcgagaccagcctgaccaacatggagaaaccctgtctctactaaaaaaatacaaaattagccggggtggtggtgcatgcctgtaatcccagctactcgggaggctgaggcaggagaattgcttgaacccaggagacggaggttgcaaaactccgtttcaaaaaaataaagttaggtgaaacaaaatttttactcttctgaaagtcaaatttttaattggggctggttctgccttgcttgatttcattttgttcttagtgttttaagactgatttctggaaaacagtttttgaaagaagagtagcaaaacttcaggtctgtggctttctaaagcataattctccattttctaaaagtattgatccgccttgggctctttgtcagttttatgcacttttgtaatactctttgcgttttcaagatggatagccaatggtgttttgataaacttggtcaatttctttactaccctaaaatgcaagtaactggccttctagctttaaatatattcatcttattcaaatagtatttcaacagattttctccctatagcatcttcagtttttgtcccctctaaaatggcatatgatcctggccttaaataaaatatttttatctttaaattttaaaagaaagagtggccaggcgcggtggctcatgcctgtaatcctagcacttcaggaggcccaggtgggtggactacatgagctcaggagttcgagaccagcctgggcaaggtggtaaaaccccgtctctactaaaataaaaaaacttggccagttttgcaatgaaaagagaaacctgaaggtagcataggagcacaatattgacatgttaacaaactgatcattgctgcctctttccttatagaccttctttttgagaaatgcacacttgagccaaaagaagatacataagcctgagtcctctatcacttacattctttcaaatcaaaagcagctcccaatgttgggggtcttgtctgccttcaccatttgaaagaggaagtgtagattatatgaaaacatcatcagtctcaggaaagagagggttaaattctgcatgagactcagaccttcaatacatctcagtgagtcatgcaaaaatgcacagaccggctcctgctttagttctgctgtctctaaaagcagctatatttgattgtcctgaagctgatgtagcattatgtgtcagaggagctaaataacttctataactcagaaacagactttttgtttttaatgtagagaaacttgtttaaatgccaagagtcctctgggcatatatatgaaattttaaaacactacatgtaagagtgaggagagatgagtaaccacctaagacagaaatagtgagaaaaggtatctagggaaaagaaggtgtgtcttaataaatatcaggcagactgtgaaatgtgtacatgaactgcattttagactctatctctttaagtgttaatgcattgcgactactaaatgcattattaaaatggtgccgattgctcaaacctttgtacccaaagcactggattatgttatccaaaattttaaaaatacaaacaaacacttttcataacaaaagttctctcagacttttgacctctctctttctggcattacacgaagctagaacttgcaggggttggagaatgtggcctctgatcactaaccagggttttctctttacactggcttgtttacttatttcttcaccaaagccagggaacgtccctttagctactgcagcatttctaacagatgcgacaaatcacaggggtgtattttgactgctactctgtcatgtgaacaagagaaacactgaaatcttttcccagtccctgtgcttcatccttgttttcccaaaatgtttgtaaactgctccagagaattcttcttttaatatttgagtcttctttcctctggtagattaaaatgttaatacttacgttaataagataaaatgtcattaactggaaatcattttgcatctctgttatctattctggcattgtcatttcagtattgtggctgattggaggtccaagaaactattttaatgtaagattacagaactagacactagaaattatttctatgttcattattttaaggttttgaaaatgagctgatcattttcattagaatatcctggcagtagtattcatgtttcattataaataaaatgtccattagaatttgtgaaatataaaacaaaaggtgcttcatattatatatgtaaatgcaaaggtgccttaattcccactgatctttgacagcctaaatgaaagatctccctgcatttctgtgtatttgccatcattgttaaattgccacaaagttgctttcgactttttaatcatttgggagaaggcagcagtactggcaggaacttcaagtaacttagcaaagtgtgttgccctccttttcctccacccaacaacctaaaattaccagctttccataaaaattgtaaactttctaacattcatttcattcactcaaatatagatttgtaaggtttttttaaagcatattattccagcatcactgatttgtttagttatgaaacaccccacattccatagaaagtaatacttaggctttgtattacatttgctaggtaggtaactgtttcaggtcaaaaaacattgccctgaactctctggctgctgcagacattcctgcttacaacactatggactgcgaatattgtgcacaaactcttttgtcttcagcccaagagatggaattcagcaaacatgcagttgactttttctataagaacaataattgctgcactactaaatcttgcaacttctatattaagacaaacttgatgaaaaatgggtcaaaatttgaggctcaatatcagcctcatttggcaacagagccaatcctcagtaatctgtggaaatggcaggcagggagagtagggaacatctccaaaacccattttagcaatattccaacagttccagttatcagagctcttaacaaagagcagaatttaaggttcttcctcaattctcaggccaccctggaggtgaggtgagagaaagggaggaaagggcaggctcctgactctctttactgaggaaaaaaacaaaaacaaaaagacagaaaggaggagattaagaccaacacataaggccacaaagaaagggagaatgatgactgttttgaagcgatttgcattcttttagcagacctgagtaaaaggaaagccctcccgaaaaacacaaaaacactgccccactcacttcatttcttcctgaagggcaggctcaacaggactaaaaatctgctccttgaacaggagatttgctaaacaatccatgcatagtagtaacattcaccttacatttaataattactttataagtgtcaaagcaatgacaatgaagtaaaacaagtagattgatttttcaataaatgagctacaaatttaagacttccaaaacactggtctaaaaaaattgtcaagataggcaatattccaattgatactgtcactgctaaacattagtatttccactggaattatctagagagttagttaacaagacattcaagacaaacagtctcaatgcctagtagatatcacctcatctttgaccatatctggaagggaaccaacatgattcaaaatattcaccagacttggctctgaataaccgccagctaaataaaaaataataataacctgcaatacaaagcccaagactgtccaacaccaaggacatctaaagatgacaatggtttctgaagaaattatcgcattattttattgatcccaacaatgactccatcaaatcagtaaaataaaaaaaattttaaaaaaatcaggccgggggcggtggctcacgcttgtaatcccagcactttgggaggctgaggcgcgcggatcacgaggtcaggagatggagaacacggtgaaaccccgtctctactgaaaatacaaaaaattagcggggcttggtggtgggcgcctgtagtcccagctactcggagaggatgaggccggagaatggcgtgaacccgggaggcggagcttgcagtgagctgagatcgcgccactgcactccagcccgggcgacagagcaaggctccgtctcaaaaaaaaaaaaaaaaaatcagctctcacaaagactgtggaagaagtccttagtgaagtgataaaaggccaaattataagacagatgcctagcctgtgccgggagtggaaaaagccctccgtgagcagatttcacgattcaaggttaagtctctagagtgaaaataagtgtagtttcacagaagttggcatataaggaattcaacctttagaaatatatactgtgaatatccagagttctatacattatggctttgtagattataaaactgtaaaatttaagtgtttcaccaaacttccaccattattacctcaaaaagttgtattacacagaacttcaactttctatatgacccgtttcagtaatgtgtgcatttcttaaaatgagcacatttctcctgtaatcagaagaggttggttttttgttgttgttgttgttttgttttttgtttgtttttaaataaataacagaaaaaggtgtcagtatttggaaatactattcttcatgggtagaaacttgatagtgattatataggtggttagggtgaaaaatagcatgagttccatttttaacttctttcccagaacatttaacctaaaacaacctaagacaccgaagttaaaaggcttgctaagtcagaaaattcaggaagggaagcttgaatgcaggcagtctaaccaaaggcagtggaggaaatgctggaaaactacggtcttaaaagagcataagggccgggtgttgtggctcacacctgtaatcccagcactttgggaaaccgaggcgggcggatctcgaggtcaagagatcaagaccatcctggccaacatggtgaaatcccgactctactaaaaatacaaaaattagctgcgtgtggtggcacgcacctgtagtcccagctactggggaggctgtggcaagagaatttcttgaaaccaggaggccaaggttgcagtgagctgagatcgcgccactgcaccctagcctggcaacagagcaagactctgtctcaaaaaaaaaagagcataaatgtttaatagacaaaccaaatattgtaaatttaaggtagcatttctagcgatacctaacaaattaccatcactttgtataaaaataacagattttaaatacactgtttatatgtgttcttaaaatggcatgcaaacattataaaatccttttatagccttgtaatatttcagatcaaataatagctctgaaagagatgagagaagatactgtccatccctttagataagcaaatattgtagtcttccagaaataaagattctataactggctgatagtcctcttcatggttttgattgttttatgggttccatgcttgtatgcatcccatgaagtctctcagttccctagctcttatttggtcactctcctttgtatcactaaagacaacaatttagttttgtcttgaatgattgaggacttgcattattactcactggctgcatttaacccaggctatgcaagttgaaaaacaaacaacaaaaaataatatttcttttctttttttttttttttgagacgaggttttgctcttgttgcccaggttggagtgcaacagtgagatctcagctcaccacaacctccacctcccagcttcaagcaattctcctgcctcagcctcccaagtacctgggattacaggcatgtaccaccacacccagctaattttgtatttttagtagagatggggtttctccatgttggtcaggctggtctccaactcccaacctcaggtgatccacccgcctcggcctaccaaagtgctgggattataggtgtgagccaccacgctggactctttttttttttttagatggagtctcgctctgtcgccaaggccggagtgcagtagtgcaatctcggctcactcacaagcaattctcctgcctcagcctcctgaatagctgggactacaggcatgcaccaccacacccggctaattttcgaatttttagtagagacggagtttcaccatgttggccagggtggtcttgaactcctgacctcaggtgatccacccacctcagcctcccaaagtgctgggattacaggtgtgagccaccacgcccggacttctttctttttcctactttcttttattcaattttaagacatctctattagttttgaaaactgagtatagaaagctaatttcattttacaagttaaaaatatgcaagccaatgaatttaagttggtaagttttatctcatataggttaagcatccctagtcagaaaatctgaaaaatctgaaaccacctttgcaaagattatgacagtgagagaagtctagcatgactgattccatcttgcttctaacctcacaggctggctgtcctcactcattcccaggcacaggccaagctaaccattggagagatttagtttaaattttaactttgaaacaatgatgatgctagttgctccctaaaattgacactttccttgttcagggactgaaactgcctctgtaagattaattttgaaaagccacaagattagaattatgggaagggcctgaattctggtaagatgcaggcatagcttaccttcctataaggcaccagaggtcacaagatttgtgacttccccacttgctactataaataacatcactattgtagaacttaagattggtcctttgagatatttcttcatcctgcatcctggcaactgactgactccatctagacctgtgactcatgactcaaccagttctgtggccccacccacaggctgactcagcacacaagggctgttctccacacccctatgatttcacttgtaatcaatcagcagcacccattcccttacccccccacccaacaaactacccttgaaaagctctaacctctgaacctctgaggagacagacttgagtaataactcccatccttccactaggctgccttgcaataattgaactctttctctaatgcaataatgctgtctcagtgaattggcttcatctgcacagtgggtaagaagaacccattaggtgattacaaaatctgaaatatttcaaaatctgaaactttttgagtgctgacatgacactcaaagatcatgcttaaagttaatggttattggagcattttggatttcaaattctcagattagagatgtttaacaaacaaatgaaggatcatagggaacttcaccccaaaacactactccctggtataatgagtattttgaattaaaggctcttggagaacaacagacactggaagagattttttcccactctacctaaagatccaagggaatcacaaggagaacaactgtttttcttctcctccctgttatcttgtacctattgcagaaaagaagaccaagaatgtaaggacacctgagcagacccaaagagaactatttacaagttaatctctgttcttcatccattaattctcccaagtaatcatttattgcccttcatcagaattcctcttgtcccccatcccataacctgttttgccaggacccaagtccccattctttttttttttttgagctagagtcttgctctgtcgcctaggctggagtgaagtggcatgatctcagctcactgcaatctccatctcctgggttcaagctattctcctgtctcagcctcccaagtagctgggattacaggcacacgtcaccatacctggctagatttttttttgtaattttaatagagacggggtttcgccatgttggtcagtctggtctcaaactcctgacctcaggtgatccacccgcctcggcctcccattcttttttaacctcaagatcgtatataagcttctgagctcctgaacccctttagggtgtatgtaatcactctgtggttctgccctgtgtgcaagttaatatatttgtgtgccttttctcttcatctgcctttttgaattgatttatcagtgaaccttccaagggtgaagggaaggttttccctttgcccctatataagtgaaatacaaatattcctaaacccaggccaggcgcggtggctcacacctataatcccagcactttgggaggtcaaggcaggtagatcacctgaagtcaggagttcgagaccagcctgcccaacatggcaaaaccccgtctctactaaaaatacaaaaaactagccaggcatggtggtgggcacctgtaatagctactcaggaggctgaggcaggagagattgcttgaacctaggaggcagaagttgcggtgagccaagatcgcaccactgcactccagcctaggtaacaatagcgaaactccatctcaaaaaaaaaaaaacaaaaacaaaaacaaacaaacaaacaaacaaaaaaacacaaatgttcccaaacctgaaaaaaatccaaaatgtgaaacactgctagtcccaagcattttggataagggatgctcaacctgtatcaggtattcagtttaactatctccttaacatccatacataagttactcttttattaagctgaacatcaggcaggcttttacattataaatcttcataaaatgattacggatattagactcacagaactttagagttgggacactttttaataatgttaccttaatcattccactattgacatggcaaacattttagatggtcacaacacatttggttgtcccttaattatgtcaataatctttcttttattaaagaattatgtatattagaaaacatagcttgaggtgtgtatgggtgtgttgctggtgctcaggacacaccatcccaaaatatgactgtgagagaccagaatgtgcaaccccaaaatacacccctttggcatcttttgagcttgttctgaaaacctatacttttataaaggaaagttctatctctaaaagaagtctacattagtaaagtaactgtatcaggaagaaggctgctctattaccagagagactttatctgcataataatacaacttttattcaccatacagctccattcctcaccctcctgtaacttgtgtcaccaccacccagaaggcccaagcccttttcctttctgtagctgaggatgttctataaacttcaatcatctgacctttcccttgtctcatgttttgtggaactcctttgcggctaccggtaattaaagtggtttttctcctgttaatctgtcttctgtcagttcatgtcttaggcttggttgttgaacattcagagggtagagagaaagttctctctcccttatagtgtataatatataatttgcttcctttgaattttttccaagtgtttgtcgttccctgtcaagtaatcttcacgaaatccctgtgaaagagatggtaagtagacagtgaaaaaggggcagtcattgatgctcctggccatggaacgagtgcaggacaggttcctcttgcaggccagtttcatgggtgtgtcacctgtgcagtcacaatccacaggactcataagggcccacacttgctttaacactctgctgtcactaccatgaaattctttatttttaaacaagaagccccacattttcatgttgctttaggaccacaagttatgtagcctttctgctcctttgtctttaacaccggctccccaccccatgacaattaatgaacctctagaagagttgcaaacacagtaaaattgtttttcctcaggcctccacttattgctgtgtgctgagaagctcatcacagcatgctacagacctcgctcaaatgcaaccttattttcttacctcagtacagtctatgttaacctcctcatgctacattttacatataggacattccctctgacttttctgaggagtcaaatgccttataataccttctaaaatatcttctcaaaatatattctaccatcttatgcatatactgtcatctatttccctccctcttatttaaaacaaatttttgagaacggagagatcgatttcatggttggaaagaccaactctgtaaatgatgataagccaaagaaaagcaaagacaacagcaaagaaagtgaatttgccaacatgttaatcgtggtgcgtcctctacttttctctcaagttctggcattggatttgctccgcctttgtcgcctctgccctgtgttgcatccagctctctgttgaaactgaaacatcataacaacaatgaggataatagtgtgtatggaatcttcatcagtatatttgaccttagaatccacccgtgagcacaagagagagcttaggcttgacatatttccctaaaatggtgtgtctgttcactcacatgcaaacatgtgcaccctggccagtcatttttattaccttcaaatgaactgtcatgaagtggagtgaggtctgaatgtgctttggtgttttcagcttggtatgtctctgccaggctctcctggttctaaggcattgacacagagctgtctcacctccagtcccaaatacagctccacagaattatcaggggccctgcagccacgattctctaggctattatgataacttcactactagctgcattgttaccagctcaggttgacattcccacaccacccagaaggagcatgttctgtcagagtttctgggggaatcagtgcctttgtggaagaaaaaaaaaaaaaaaaacccaaaccaaaccaaagcaacaacaacaacaacaacaaaaacccacaacaaaccctcccaaagggaaggctagaaaaatgagccagaggcagtaaccagggtcttttgaaaactagtttttaaaaggcctccttttccttcccattccatctgttctctaacccttccattaacccccagagcctcttgttcttgctcccttccccagaacttaagcaatagacaaaagacactctcacttccttacacgtcaagaaaatcggaatggacttcagtatggctaaggcaaatctgaagaggaaaattaataaaccaccacattactagatagataccataaacaatcaggatttgaagaataattctaaaaataagaaaaaggggtaaacatttttttttaaatgagcagcatttagaagtaccgaaatacccatataatcactaggcttgttgcctagtgaagaagcacattccacatgttcatcatagtttttaaaaaatatctggattcaaatccaactgtaccgccaagtttacctgtattttggtttacataagcacaaaaactctaatgcttcacaaaaccattagctcaaatgcacatttttttttctgtgaatttcactttaaaggtttagtggattgatttataatttgttgccttttgtctttttcaacagtatgtcattaagtctttaatttggtgtttcctgtagtctgcagtaggatatatgctattttaaatccaaggattgcagacatagatggtgggtaaaaatctgtgaaccataagtaaattcttataaggaacatacaaaaaagattgttcttcagtcagacttaagccattacttttttctaaagaagaaaaggcacaagttaagaaaaaggcaccgtcaaagaccttctgcccaaatgtgcatctccatgaagtttcctgctgagtgcatatgaatgcaccgtgatctgggaaaaggatccaaataggatttcaaacatccaaaaattttaactcaaacatttaggtatttcaccatgctgctattcattcattcactgattttttttgtcttagtttaaagagatgctaaacaaaaggaggcaagctctacatgtatttacattccaaaactaagctcccctcaccatcccccaagtctgtcatcccttcacagctaaacaaaccgtaaagtctagccttaacttggggaagagaagtaacaaacatgtaagaaagtttctcccttttcttcaacaaaacagaactaaacacccggagtgaataatctattatagttcccaatgttgttgtttttttctataatctgcacaatttaagataatgcatgtaggctaaattaaggaacaagatcagattctttacgaatttggtactattgagttctttattgttaaacagttttttgtcaatgaaatgcattggcatcttaactactaaatttaatgaaaaaatatgtatgttaatttatttataaaattgatgaatttattatcataaagtataagactttctgaaacaccctgaaaaagataaacaggttttttttttttctttttatgttcctaacccagttgagacgtacctaagtttgtcatctaacagtgaaggtttttccaagtgattttatttatgcccttatccacatatgtcaaaggtaagtaaacgacgtattgtttaagtaggtttccatttgctttgagataaggctaaagcaattaattctctggtagtttttatttttaagagggtctacattattatttcggaagctttatcttaacaaatgatctgagaatcttcatatctacttaaagtagtgttcggtaaaactacagagggctatacctagaaatctattatttgttggaaggatttcttaaaagccttcaattaatatcatattgaacgacagttaagtatgttggggccatgaagtcactgaattatctcaatctctgaatgtatttacaaattttcaaatttcaactttagatcttctgcatatgcataattccagaaatgtaataaactacatcctaaatttgaaaaggaaatgtgaatattatgacattctaatgctcatgccaatgtagccttatacaaacatacacttgattctgtaaaaaatctggaacaaaaagtaatatttataattgggttgttataaattgaagaatcaagtaggaatgtaagcaccatctatttccattttttaaaaaaccagacctatactttcactgcttttcacaaaatatctacaaaagcattaaactctttcatctacagcacactttgcaattattctcttcttctcacatctgaaaagcaaattagcagttctcaaatgtgacgctacaacaccagacaaaattgtaagctctgagctttgttaaaactagtatgaaaaaactaaatatatctgtagatctaaaagaaatataaccaaaaaagtaaacatatgaagtattaaagttacttataattggaaatatctgaaatattaaaatgagattttaaaaatcagtggtgaccctccccctctcacactgtcaatggagactgtgtacgttccaggaacctggactggcactgggggaatgatgtgtcctttcccctccttacaggagcagtgtcagcggaggcctactagttaggactttcaccaccaccttgcagtaccaaggccacccccctgcagtgtcagtagagactgtactcagagcagtaagaatccccacctctcccagagtgggggtatcatgggaaggctggtaaggagcctgaactcctgcccctgccaagcaataatgaggtatgcctacccaccagatgccaacaaagacttagtgggtaacccagacatccaaccccattgaacaagtaaagaggtagagcagtatcagacgacatctactagacagaaggtctcaaaaagatccatccaaaatttcatgaaataatagccaaagtgtctaaaatttgatgaaaaatgacttgtcataccaagaaccagaagcacctcaacttgaataagaaaagacagtcagcagggcttcgtggctcactcctgtaatcccagcactttgggaggctcaggtggccgggaggtcaggagttcaagaccagcctggccaacatggtgaaacctggtctctaataaaaattaaaagaaaaaaaaattagctggctgtggtggctggcacctgtagtcccagctactcaagaggctgaggcaggagaatcgcttgaatccaggaggcagaggttgcagtgagccgagatagcaccattgcactccagcctgggtgacagagtgaaactccgtctcaaaaaaaagaaaagacagtcaagagacactaacaccaagacacagatatcagaattttctgacaaggatttaaaatcagccatcataaaaatggtttagggccaggcacagtggctcacgcctgtaatcccagcactttggaaggccgaggtgggcagataacctaaggtctggagttcgagaccagcctgaccaacatggagaaaccctgtctctactaaaaatacaaaattagctgggtgtggtggcacatgcctgtaatcccaggtacttgggaggctgaggcaggagaaccgcttgaacccgggaggcggagattgcagtgagctgagatcatgccattgcactccagcctgggcaacaagagtgaaactccatttcaaaaaacataaacaaaaacaaaaaagctttaatgagcaataataaagaagcataaaacaaaagaaaaaatataaaacatcagtaagtagaagatgtaaaggatcaaatataaactttagaactaaacaatacaataactgaacaatacaaaagctcagtgatggactcaataatagaagagcgaaaacaaaagaatcagcgtacctgaatttctttaacagaacaacagaaattactcaatctgaacaacaaagagaaaaagtctaaaaacaatgaacagagcctcaggaacctgtgggaccataatcgaagatttcctttgtgtcactgaagtttcagagggaaaaaagaaagagggtgtggctgaaaacttcttctaagaaacaatggctgaaaatatcccaaatttggcaaaaagacataatgattgaagaagtttacagattgaagtttagagaacctcaaacatttgaaaaacccatggaaatccatgccaagatacaacataatgaaatttctgaaaaataaagacaaagaaaaagcttcaaagcagcagggcagaaagggacacctcacctaaagaagaataaaaattaaaatgacagcagattcctccccagaaaccacggaagccagaaggaaatgatgcaacattttcaagtgctgaaagaaaagatctgtcaagacagaatctgattctcagtgaaaatatccttcagaaatgaaggggcaattgagacatactcagacgaagggaaactcagagaatttgtcactggcagacctaccctaaagaaatggctacagaaagttatcaaaatggaagagaaatgataaaaagaagaaatactggaacactgggaataaggaaaattgaaaagagcaaaaatacgcgtaagtattattggggctcaggaaacaatgtcccaaagtatggtgctttggcatgctgagtgctttgaatcaaggtttctctgaccttctcctcaccctcctccagtcccctgctgcccctgtctctcatctcttgcccctctttccctcccaaagtgcaggaaggtgctttctctgaagttcccttatctgactaagggaagttcctccagaagaaatgcaattgctttgagcccccctctctataatcttatcaaacagagaagattagctcacaggaaaggagactaaaggtcaaaaccacctattctgaagattgctagctgagagactttatccgtataacaagacagcctctgctcatcacacatttttctcccctcaaacctctataacctgttaccacctcccaccagaaatcccagccccttatttctttctgtagctcaaaatgctatttaagcttccaccatcaggcccttttttgagtctcatattgtgtggggctcccgtctatatgcatgtaataaacgtgtgtgccttttctcctgttaatctgtatattgtcaactttattccagagactcaaattattgaaccttcaaaggatggagggaaagttcccttcacccctatgcccttctcctcttgagagatatcatgtttgatggtggaagaaaaaattacaacactgtctgatgtggttctcaatgttctcaaagaggagatataaagaagaataagtagaaatcgttgaactgaaaaatgtaataatgaaattaaaaactcaatggataggctcgacagcaggatggagaagtcaggtcagtgaacctgcagactgaaaaacaggaattacccaatctgaacaaccgaaagaaactagactgaaaaaataaaaaatatttaagacaattatattataaatgaggagggtaaagggatgtagagagagataataatttttacattggacttgaattagtaaaatgttgacacaaataggctgttaaagattatggatgtacagtgtaatacctaaaacgacactaaaaatctaaacagacacatttaaaaatattacagatatatggaaatgcaattataaacaaagttcaaataaccctcaggaaggcaggaaaaacaaaacagtgaaaggtaaagagacggttaagtcgaaaaagcaaaaaatgaaatggcagacttaagctctagactttcgaagatgggaaatacaggattgactctaaaggggtacgactttatcttgatcatggtggtgattacccaaatctacacatgtgaaaaaaaaaaaagacatggaactatatgtacacattataccgttggggctcagaaactgatacaccaaaatatggcgctttgatgtgcttaactgaagaagaagccttaggcctctctgaccttcctcctcccttccttctctcaatcctctgcgcctcccaaagcaaaagatgaagttattctctgaagttcccttatctgctgagagtctggacttgccaaagaagaaaacaatcacctctggtcccttccctgagttttcattaactgaactcatatcacaggaagaaagactgaagtctgtcaacacacctgagcaggtttttgtcacgaaccatcgtgtctgctctgctggcccaacagactttgtcctaggccggtgtatgttcttcaagcccactgaattcccctaaaaatcatttactactctcctaaaatcatccctacttccccatcaccctttcccctgagaagaagggtatataaccatcagcaccccactatgtggtggattaatcactctgggattcttccctgtgtgtgttaataaatttgtatgccttttctcctattaatctgccttttgtcagttgattttcagtgaaccttcagaaggcaaagagggaggcttgcccttggcccctacgatacaagtttcctggcttggttgttgtactatatggttttataaaatgcaaccatggagaaaactcggtgacgagtacacaggatctttctcagctatctttgtaacttcctgtgactctataattattccaaaataaaaatcaatggcagttatgtaacatgaagctacatgcaggtaatggtacttttgcagatttgtgaagaaaaccaaattcgtgagtaacatgtactgcgatgttagatttatccatactttttaatactttgtattgtataaaaacttagtaaaaagacacaattttaaaattaatatctgatacaattttacttgttattttagggtcggtatggtactaactcaattcatataattattatgtctccaggaataagatgtataatgaggattcctaagcaagcctatgagttactttgcaaatattcaagaagaatgtatttatgttcatcataacacataaccctatttcctcatatctaaacaacatatggttactcatatttaaccagaacagctaacaataacaacctattactcaataatctggataaagaatttgtagtgtcaagaaaagagatatatatacaaatacatatgtatatctatagttaatacaaatactcacaaagtataacatataaaatccagaggcttttgaaaaggcaattcaagaaggaaaaaaacattttttatgcatttaccaaataagttaatgtggaataaacatttcatgaagtgttcaacataaagtgatacaaaaaatgataaaagtaggttttatatgtctatttgtagtatgtgtgtttatgttatatacacatattttttaacataaattttccacttttactaaaaccaataaagataaaggaaaagtagggccaaatcccaggcagatttgatatctacagaaaaacatgagagcactttcctgccactaaatggaaatgaaacaatcctttctttgtggaacaaatggaaagtgaggatagcgaccaaaagcttaagtttaccctcacctgagttttcttatatctgctagttgaatacacacatatgatatgattgcagagagacaaagggaccaaaaaaaaaaaaaaaaaaaagcaaacaacagtcacatattgaaagcacttcccatgccaagaacagcaaacctaatatcatggcttgtgaaggcgattctgtaaggaaacagagaatttaattcaatttcttaaaattaattggaaccttgaatataagatgctggactgataaagaacctgaggcaaatttctagtacatcataatcacattttcatgaacaagaatttaaaaatcggaaagtgctataacgaaaagacatgtgtttctttctgaataaaagcaataccaagtgataagggataatcactgcttttctttcctcagtttagtgggaaagatcctatgctactggcaagttatttgtttgtttgtttgtttgtttgtttgtttgtttcggtaattacaatccgatcacattagtgagaaagctatttcccagggataaattgaccaggaagggattttgaatattttatgctactagagcatcatcttataacagtaataatttccgggaggattttacttgccttgaatattgtgcatcttcttggaactttttcttagaaatatttatagaacttttcaaatcataggtattgttatttcttaaggtgcctctttgggaggaatattagaaataccaacttcctataatagcctctaccaagaagcagagggcttgatgggataatttctaaaaacaaaccaagaaaacctaaatacatttttagtaccaaggtgatgaccatttatcaaagaagtaaataatttcatgcgttaaatcatttccttatagtttttcattagtaactgagttaatgctgaatttttagactgactagcttgtttcaactttgacacatattgtgttcaagaaataattattaagtgaataaaaatcatattctgcacatagtaaaaatcaaagtctatcttataatctgtcacataccaaaattatagctttcaatttattttctttctttattttttgagacagggtctcactctgtcacccaggctagagtgcagtggcataatcagagctcactgcagccttgacttctcaggctcaggtgatcctcccaactcagcttcctgagtacctgggaattacaggtgtgcaccacaatgcccggctaatgtttgtattttttgcagagatggggtctcactatgttggccaggctggtcttgaattcctgggctcaagtgatcctcccacctcagcctcccaaagtactggaattacaggtgtgagccagtgtgcctggcctatacctttcaatttataattctgagtcgaacattcaagagagccaagggaaattttcttgagattgtaaggagtaaaattcctaatctagttacagaagctaagtgggactacaggagacatgggtagagctgaggcctaccatcatcacaaatattgcctgagccattatgccattatttttgcaacaacacctgttcctgaagaacaacatggagagacaccaatgaataagccacattacattttagggggcaggactgggcatttgagggttgtgagaaacatgtaaactgagttgccagaaggttactagaaggaatcttcttctctagttcctactgacagatgtgtgtgaccacttgatgcaaagctctcttcttaaggatataagccacatgaaccatagctatggaaggtatagaaaggaaaatcttaagattttctttctggatatgaggcctcacttgcgactaactaaagtgcattttgttattattctttccttactattcattttaaatgagtgggtttgtggtgtttctaaaaatttaattgactgtctttggcttgtaatgctctgaagtgtaaacaggtgaaactgggaaaagaaaatgaattatccaggatttctagacagtaggatcctgttgaaagtcagcatgaccaaatattttgcacatcccctgtgcaccacacaaaacaagcaataaagctgtgcttatagaaagtttttgaaaaaaattacatcaagtcttgtcttaaccagtcggaaggcaattgtgaatggtgagattcctctctttattaattacttaaacttccataatgaaattcaggtgtgatccctaaggctctgcagcccagaacagttaaatgaactgcagaatatggtatttgccaaaggggaattaattatgttaagagatgtatactatgaataccaacaagcctaaatatgtgctgaatagtagaaaagggataaactagaattttacattataaaattccaccaacctcacaatcatggcccatcatctggttgaacatttttggttttgtttcatttttacttttgccattttgatctatgcttgcaccaactgccacatccaacctggccatctgcagcacacggggaactttttcttataccctcccctccccagtaatccatgggacctattatttaatcaaagaatcaaatactagccctcaggtcaaacaatgagaacaaactcactccctgtattttgcgctgaacattcccagaaaagagtcattactaatatgcatattaaagtgtacttatgccaatatcaaccagttagtaatagacagtatttctttctttcttttttttttgagacggagtcttgttttgtcacccaggctggagtgcagaggcgtgatcgtggctcactgcaagctccacctcctgggttcatgccattcattcttctgcctcagcctccctagtaggtgggattacaggcacccgccaccacgcccggctaatttttttgtatttttagtaaagacggggtttcaccatgttagccaggatggtcttgatctcctgaacttgtgatccgcctgtctcggcctcccaaaatgctgggattacaggcatgagccactgcacccggtgacaatatttctgttttggggtagcaatgataacttatataaatgatgaatcattccaagttccataactgcaatcggtcaaaagattaaattattttcaatctgccccacagccatatgtgttataattttatagtcctttcttaatacaaagtcccataacaacctcagagcctcaaaagctctttcactaatttgagcaaattttctcttttcccattcaaaattcacctccttaattcaccatcaagggggtggaccaggttgaggggaatcttctttttagtaaattaaaaaaaaaaaaaaaccacaactgaatgcaataacattttctaagtttctagcaaagtgttagtttccttagatttttaccaatatgtcaaaagttgatatttaataatctgttctacccaacacttaattggcagtctatccattgaaggcaaagagcagaaatgaatgtctctctctgaatacactaagtgtagtcaatcagaattactaacaattggccaggcatggtggctcatgcctgtaatcccagcattttgggaggccaaagtgggaggatcatttaagaccaggagtttaagatcagcaccatcaacatagcacgaccccatctctacaaataataatactactactaaaaattaaccaggtatggtggtatgcgcctatagtcccagctacttgggaagctgagatgggaggatggccttagcctaggaagtcaaggcttaaggcggcagtgagctatgaggactacattgcacccaagcctgggcaacagagtaaacctctgtctaaaaaaaaaaaaaattacgaagaattcatggtgtaattgagaaggctgcaaatagttgttttagattgcaggttcttgagtcagactctctgggttcgaatctcagctctgtcttttacttgccctataaccttgggcaacttccttaaggaattttctcagatgtaaaatggggatgattacagtaactacttcctcaggttgtcaggagtacatgagataatgtttgttaaatgcctctcacaatgtctggaaaatagttaatttataaaaacagttaccaccaccaccaccaccaccaccactaccaccaccaccaccaccaccaccaccaccaccaccaccaccactacacctagagaagcatgctaaagagaagacacaatacagctctcaaagagtttacaatctcaatttgcaagtattaaaaacccccactctctaaaaatatggtagacatattaagcatatgtaacatatgcaataaatacacacatcatactttcagtaaaatataaagtattcatattcaaaaggcttctgaaagtaggccgggcatggtgactcttgcctgtaatcttagaagtttgggaggccaaggttgcaggatctcttgaggccagcagtttgagactagcttgtgtaacacagaaagaccctgtctctataaaaaataaaaagaatggctgggcgcggtggctcacgcctgtaatctcagcacttcgggaggctgaggcgggcagatcacgaggtcaggagatcgagaccatcctgactaacacggtgaaactccgcctctactaaaaatacaaaaacaaaattagccgggcatagtggcgggtgcctgtagtcccagctactcaggaggctgaggcaggagaattacgtgaacctgggaggtagagcttgcagtgagcagagatagcgccactgcactccagcctgggtgacagagccagactccatctcaaataaataaataaataaaataaaaagaattagccaggtatggtagtgtgtgtctgtagtctcagctacttgggaggttaaggtgggaggatcacttgaacccaggagcttgaggctgccatgagctatgatcgtgccactgtattccagtctgggcaacagagcaacaccctgtttcaaaaaaggacttctgaaagtgagtcaggatataagtggaaaagtacctgctatacgacaagcaaagccaaagcagcagttatgtataagacacataagggcttcaacacagagtttttggaggggggataatattttaaaaaataaataaaaggttgtggactgctccatagaaataacacattactacatattgtaactatcatttcttaagagaaaggacattaatggaaatgttggaaggacataagatcagaatttaaaagtcttttcaattttatgtctttggatttttacattttgaacactgaaacagagagatgtgatagggagtgactgaggagtgtgagaaagctacctgagctgagagttgaagccagacatacaaagatctgaagcaaggtaattctgggaagcatcaccagctaattcaaaggtcccgaggcagcagtgagtttggcttgtgccaagaacagagagagaaccagtgggataaaataaaggcaggcaaacaagcagatgcaagattacataaactcttgagttgggtttgatgggtttcagcagagatgtgccatgatatcaagatgagaattagaaggaatctcctacctgctaaagggcaaagagcactaaaatggaaggaaaatcagttctaatattagagccacattaacgttgaaagtgccattcaagctaatgaaaaaactagaaagtaatgatggttgaaaagattaggatgatttaggtcaacatgttaaatttaagaagagaatgtgacacaaacaaggagccacctggaaaccactgtaaatgcaagtagcacatacttagagtctgcttatttctatacacgtggaagctactatgtacagatggtacatgtgtacaggttgggacaagataaactcccccaaaccagggggagtctaagatcatggttagaagactaaaagatttaagctttattattgaggcactcaaaatgagaaaaaagtttgtgccgacatagcattttttaatactaagacagacatttaagactatctagacaaaaattaatacctgtaagccactcttgtgcatcactttgggaaagataacttgatgctcagaccattaaagtaatgccatctagttcctggaactaccagctcaaatgtcatcttggccactcagtcaaagtagatgaatagacgacattctatttcatgatgggaagattctggaagaggtcttaaaggaaacattcaagttttatcttgtgcagaagaagtgtagatagaatacatggcacttatgagaaaagaggattgtcctattctagataacatttgcccagctgtagaggcactaccctggaggcaacagaccatgcgacctgttgcttcagtgatataattcacttgagaaataaagctgtgttatggaaagtttattcagagctgcatcatataatggcccacctgaatgtgccccattctaccaaaaaacaaattccaaaatataccaccattcatggcgagagtacttgacatgctcttgtctttgttgtctaaaaaataattgtccttcacccgagacttcgcaaaatgcaagaactaaatgcagtttccccatgacacagatcatctacatccttccacaatccccaacacacacacactagatttgtgatatcaatgacaaagtttttcttgggctcgttatatagaaaggaaaaaggatgtttggaaattttgtgaaacacctaattcctaagaaaaacatttgtatcatcatcattccaatcactggtcaggtatgattaaataatatataattggcatgattaaggtagagcagcctttctacttactaacagaaaatacattttccacctcatactgactacaggcaatcaagctctagaaactcctactctatccctctcaaggctgagaatggagcatgtgaggactttatcctcaaaagagagaaaatttagaagactcttctggcttttaaatttttcttaggtctaaatgacacatttgtttattcatgggtttttttattcttcttcttattttttttttgagacagagtctcactctgtcgcccaggctggagtgcagtggcgtgatctaggctcattgcaacctccgcctcctgggttcaagcaattctcctaccttaacctcccgagtagctgggattacacgcatctgctatcatgcctggactaatttttgtatttttagcacagacagggtttcatcatgttggccaggctggtctcaaactcctgacctcaagtgatccacaggtcttggcctcccaaagtgctgggattacaggcgtgagccactgcacccggcttgtttattcatgactccttttggtacatctatgttgagaacatattacatgccaggtacaatgacaaaaaaaaaaatgtgacaggcaagagaagaaatttctcacaatgcaaataagactatagggtaagagaagagactacttaagcatgggaattactgttgcacaaaactaaaacttaaggatagggatgtttggtattattatttcaatcatgcataaagctactcaacctcttgactcttattgtaaattagaattaaacataaaaagttctggttcctgacattttctgatggcccaaattttctattcttcttttattttaattgtaatctatttcctggattaacaggccaccttgaactaaaaatgttggttaatgttttacttgatccccatatttggagtcaggtaggtatgtctgtatatatgtacatatataagtatttttcatgcctgtggaagttggaatctacagctatataaggttaaaaaaaaaaaaaagactggctgggcatggtggtgcacgactgtactcctagcactttgggaggctgaggcgggtggatcacctgaggtcagcctgactaacatggtgaaaccctgtctctactaaatacaaaaaattcgctgggcgtggtggcgcatgactgtaatcccagctactcgggaggctgaggcaggagaatggcttgaacctgggaggtggaagttgcagtgagctgagatcacaccactgcactccagctggggtgacagagcaagactccgtctcaaaaaaaagactgtacagactgtaccagatagtgcttagaaaatgtttgcttaatctatcaaaataaatcactttagttgggcacagtggcccacgcctgtgatcccagcactttgggaggccgaggcgggtggatcatgaggtcaagagttcgagaccagcctgaccaacatggtgaaaccccatctctactaaaaaaaaatacaaaagttaactgggtgtggtggcgcacacctataatcctagctactcaggaggctgaggcaggagaattgcttgaacctgggaggtggaggttgcagtgatccgagatcgagccactgtattctagcctgggcaacagagcgagaattccatctcaaaaaaaaaaaaaaagaaagaaatcactttaaaatcttttagagttgttgaatattttgttaagaaaataccacagaaataatagtttgaaatggcactttaaattagacatcattaaaattttactgacaaatatttacaaggactgtcttttttattgagacagagtctcgctttgtcgcccaggctggagtgcagtggcctgatcttggctcactgcatgctccgcctcccgggttcacaccattctcctgcctcagcctcctgagtagctgggactacaggtgcccgccaccatgcccggctaattttttatatttttagtaaagacggggtttcaccgtgttagccaggatggtctcgatctcctgacttcgtgatccgcttgccttggcctcccaaagtgctgggattacaggcatgagccaccacgcccggcacaaggtctgtcttaggttgtcttgtcattattcccccagaatattttgaaaaaggaagagaaggtataactagtgtttgcttaagcattaagacgttcccattgttttcactaaaattgaaaaattaatccattttgttgtggattgatttgattcccaggatgagtgtaaggcaggactcatagaaactgcctgtttggcccttgctgaaataaataaatgacttacaaaaataatacccatactatggaccctaacattcttatcctctaagcttcaaccacatgaatcttgaaattgacaatagagccagaaagaacaaacagtaaactatttacagtcactcccttctactactgtgaataaaatgcattcaaatgctatttgttaaagtaaaggtggtcaccctaccaaattgctatgtaactacttctggaaatatttctacactgtaggcaggcataacaaatttctgaagtaaaacataatttggtgggtatgaaaagatactttgtaaacatcaactaataaagaaatacacttaaaaacaaaaaaaaagacagagagacagggtctcactctgttgcccaggctggagtgcagtggcacaatcatagctcactataacctcaacctcctgggctcaagcaatcttcgcacctcagcctcctgagtagctcagactacaaaagcacatgccgccacactcagctaaataactttttttttttttagagacggggggcggtctctcattgtgttgacaggccggtcttgaactcctggcctcaagcaatctacctgcctcggactcccaaagtgctgggattacaggtgtgagccaccacacctggcctaagaaatatactttttgaatgacttaatctaaaatattaaaattctaacaagtcaaaacacatgcaccctttgaaaacgacttctggctgagaacataggcaagacaaatatagcaaatgaaataggttaattaaaaaaaaacctgtcagttatttaaatttttaaaatactttttaagttcagagacatactgaatcatattcctcagttatcagcaagtgcttttgatagctttatgaaatcagctcacaagtttgttaaactcacattaagaactcaatcccagatgtagttatgatatcaaataaaggaactgtctggaggaagaaatgtacagacatagtaatcaaattctcatacaggattaatgaatgacatgtaggccaaaagatgattcatcttattttaaaagtaactttaaaaaaaactttgattattttagaataaaacacatatccttataggtttccttaggcagtgtcaaaattaattaaatgtatttatgatatattaatacttggtcatcagaaatgtaacagaaagggaaaacataactcttttgaagagtatacctcatcttttccaaatcaagatgagtcaaatgaaatttgcacaaattttccaaacaaaggaatatccaggaactagacatcattactaaattagcaaatctttaagaaatatcttaagataatgtaatgataaagcccacttttaaatatgagagctatttccaatgcagtgtctatttccaatacagagtctatttccgatacattttttgttttaatagagtcatatttgaactatgtttctttcaatagaaattgactattttttaaaacccaagtccattaaacagtgagttaagaaaaattacttgaaaaaattagctaaagtctcccaactacttacttataaagtgagaaaaataaaattaatattaggctgaggtgagaggatcacttgaggctaggacattgatatcagcctaggcaacatagcaagatcccatttctaaaaaaagaaaaactcagcatggtggtgcatgcctacagagtcccagctactcaggaagctgatgtgggaggatcacttgagcccaggggttcaaagttgcagttagctaagatcacaccaatgcactccagtctgggcaacagagtgagaccccgcttcgtaaaaaagaaaaaaaaaaagggattttgatcagatataagaaacattctgggaatcaaagaaaaacatcaaattattcaaaatgaaatatccctcatgtaaattacatgtttaaaagtgactacacattatttgcaatgtttttaaaatttcaaataaaatttatccaataaattactttatagtctcatttctggcaccagtaataatatcaatatgttaaatagaaatgctttttatttaaaatcagatttaaaagatatagtccatccaatttctacttctacatttctacatattccaatactgactgaaggcaaacacctcatttccttcagtgtttactcccctctgataaaaacgctgagggtataccaagcgtaggactctgttttccttcaaatccatactttgttcctgtgaactcacttgggggaaaaaaaaaactatatttttgtataagctgaatgagaagcacttgtaaagattgtcagatacttaatgtggcagatggataaaagggatgggatgagctctattttcagactaataaaaacctaattatttcagaatcaattatatttatgactaattttttaaagtccaaaaatgtattttgtcatgagaaatttgagctccaaaattaaatagatttagtgttttgtttcctatactggattatatttcaaaaatggttttaggtggaattgtaaagataagcaattttagcacatcttaataaatccaaagacacaaaattcaaagggatgattttatttttaaatggtaatttacgtaaaagcgattcatcatatataaggaagaatatattttcttggtttatatcttttataattaaaactgagaaataaaactgtggggaatataaatgtcttatacaggtttttatttgtcagaaattagtctattattaggttacagaaaatcttagattttaaatgacattgaacctactaagccatacatttttttaaatccccacaatatctaaaacttttacccttgaaagaaaacacactactgtttcaactataagcaaagttgtctccaagtattaaatgtatatttcttaaagacttaaaaaattaataaacattttaaagaatatatttattaagtttccaggaaatattctgtccttaccctttatttttctatttggaatacattgaacttagaaatatgtccaagataaagaaaaagtttacatagttttctgtgaaaaatgatgaccaatacagaaaatgtagtaaatacatgaatgaaatgtaagaaagtaatcatttattttttatttgcacagattaagttaatccacactgaaaactagccactgaactaaaaaagcaatagctagaaaaagtttacgtgatgtctaatgcctccaccctaattatcattaggttttacctgccaagtaaaaatagacactctagaaaatatttcaaaggttttagtatgcttgacccaggactattggcaaccattgtgaacttcagggatgattacggtatttaataatgaaatgcttaagtacacctgaaaatggatgataggcacttttaaaacttcatttgtttttacctccatttcattagagtcgttatagtattaaaaatattatatttgcaactcaaggggacatcatagtatgctaacaagctaaaacaaacctatcatttatttccactgtttcttggcagcaatataatgattttaattcaaggctttccaaattctgcaaacattatggacctttcatcacagtattagattatctatccgaatctccaaactattacatatcttagaaataattttttatttagtaatcattttaattgtctaatcaacaccttgaattgaaaatcatactttaattgccaactgtatataacctatgtaattaatttaatgcccagtaatttatagctgattatagcaacatatattttaatgagagcatgtacaagtgaatgtaatgaaattgctaattcctaaaaagtttttgcttatttataccttgcttagagttaacaggaaaattatattttatccaaacattatgcactgcaataatggcataatgaagacataagactctcctggcctaatctgattctctgcagagcagatgtagttagtacttagcagtctagactaaatataaggagatttattttaaagtgcatctttaccaatactcttgtgatggtcccaagatgaacttaagtttacttaattataatgataaattgttaaaacatatataaaatcccaaacagaggcattccaaaaataacagagaactaagttccaccaagagcccatcaaaactcaagtgtaaacctcatgtaagtcattgaaaacaatgaaataccttaaaggtaattgaataattgaacagtgaaataaaccaaaattagagtgatataaataagacttccatttgtttccatctcactctgtgaatttacatgtaagattaagtgataaactaacacttataaatataatttttagcttaataaaacagactggtcttatttgtaaacatatatatatatatatgattcacagatataaaataagggacaatcaaatactaagacatttgctgtctttggagaaatcatcatcattgccatatattcataccccatttccaaattataaattcacttgggaaaatcaaagactttcattatattgacacaaaagttaacagagttgatctatgcctttacaattctttttaaggtgtcagacacgccaagctcttcctccatgctttgtaatttcaaaacatactccaagatgcaataaagttcttagtgatcaaaatgaagtgctgagattgccagagattacaggagaccaaccactaggtctctgcgattccagcaatcatggtgacagggaagagttgccacttgtccactcttctattcatatatctacctactcacctactcatccatgcatgtacgtaggcatccacctactcaactaaatacacccaatgtttgtcgtaccttgtatagtgaggctgtccaagtctttagaagttcacacttttaagaaagggaaaaggacctgaaaaattggcagatgaaaatgaagacagaaaagaggaaaagaaagaaaattaagactaaagtagagaaaaacaaaaagtgtagaataggttatatacatcttgtaaaacaagatattcatccttattatatttctatcactcacttatctcttagataatgaggtttctacagaacataatataaaatgacatattaaagaatatggtgacatcaggagaactgtaaagttctttgaaaggcaaatagtgccgggtgtggtggctcaggcctgtaatcccagcactttaggaggccgaggcaggtggttcacttgaggttaggagtttcgagaccagcctgaccaacatggtgaaaccccttctctactaaaaaactacaaaaattagatgggcttggtggcagatgctgtaatctcagctacttgggaggctgaagcaggagaatcgcttgaacccgggaggtggaggttgcagtgagccgagattgcaccactgctctccagcctgggcaacagagcaagactctgtctaaaaaaaaaaaaaaaaaaaaaaaaaacaaggcaaataaattaataaatgcagctagaaatggatagaaatttattttgaaaaacgtatttatttttgaacttttttctggtccactggagaagaagccacaaaagatcataaacaatgtgtacgtaaaattataaaattgtatggttgaaactgtaatgcatttattccaatttcaaacaagaaagggcagattagacatttgactcatttgacaagcatcagctttagtcctctttggatttattctcctgtaattcacagaagagctctgaccaaattctaattttttgttcttcaatatttcttatctttacatttcgtcatgcattaaaatcctatttggacttgtctggcaccaatggcacattcttcctggctaacagcattatgcagatattaataatgttttaaaagtggtcaagggcatatcagcaatgcactttgtccctcttttaatgaaagaaagctcatacttaaacaggtgaactatcacatacctaaagttccagtgggaagagagaatcaaatatcaagtctaacaagatatttgttaataagagcaacaacaggatcttgaaaatacaaccataattttcagaaagaatacctaaaatttttgcagaaagtcatatttctcttagtcttatcatgaaataacagcacctaaaagcttggattctatgttcattgttcccacaaagtatgaaaaaggcatgagaaacattattaaataagactgatcacagtagagctactaactgcattcattatgttttttaaatcctcaaagccaaatacagtttttaccaccatgtccaacagagtttcagtgttataatgaagtttagtaattcctttaactacctgtgaaggaagtaaagtatcttctaaaaacttctgggtgctattgacataataaaaaaagagggagggaaattgctctataacagattttataaattttttatggtgtagtttttatagtgcatctataaaatacactgaaatgtgattatcaaatattgttcagctcccataatgaagaaggctaacattaaggatctgtccttgtttttactttgtaactcctattgtctgagccagattctcctcaggaccttattttattgtgattactgcaacatccctgccagcaagtgtagagcagacttggtcactcctttgctgaagtcagccaagagaatattctattagacaaagtaacatacgcctcaaaggcttggaagccaggggaaaaagtgagacacatacaagacaataatacataaaccaattaacttagcctctcaggaaaaccatcctcagtctcatcaaattgtgtattatctggcaatataaattgaaaatctatttatagagtagtcaggctaaatctcttattgctaaaacagaagtagtgaaggtcaaagaatgcaaaatcctaggaaacacaatttttttccaaaggctgtttaatatgcctttgatatagattactttattgacaatggttcttttgtctttctgaaaactacatctgcacaacaactaggtcaccttgaatttcaagtacaacattgcctataaatttaatttaacatcatattatccataattaccatgaacaggaggcaggtgtgacccttatggttaagctagagggaccaaggacaggataggttaatagacttgctcaaggctccagggtctgagttaactacaggctctacatgagccacaagtatgacctggctattaaaatattattacaatcacatgcttctttaaagagtagtacttccaaatcaaaggaggtaccagttccattgctggatagtacactcttcactccaactctgaggaactttattttagcgttagatggcatctttcatttcatagttggaattgaaagcatccatagagggcaatgagaaaagcaagcaatctgaaattgacgccccaggaactctgaatcagggaactctgagttgcagagaaaaggcggagcaaggatttgagggctatgtagctatgtataaatatccaaaggattgtttggtaaaaaatcctccaatagatcatttattctagttgggaatgaaagagaagaggtttttttgttcgcttgttttcgtttttgttttttttttttttgagacggagtctcgctttgtcgcccaggctggagtgcagtggcacgatctcggctcaccgcaacctctgcctcctgggttcaagcgattcttctgtctcagcctcccaagtacctgggactacaggcaagcgccaccacgcctggctaatttttgtgtttttagcagagatggagtttcgccatgttggccaggctggtcttgaactcctaacctcatgatccgcccacctcagcctcccaaagtgctgggattacaggcgtgagccaccgcacccagctctttcattttgttgtttctaaatgtaattagggctaccataaaataaagggatttttcctaataagtagtatgcttcatatcatgaaaatgttctaggtaatgtgacagcctatcttgtcggtatcattatcagaggggtacctaaatttggaaggcagtgaaatgatacatggaagatctttaaatctaagcttctgtaattacaggtcgtggagtctggcagagaaggagccaaactcagaactcagatctatgcagattagctctctgcccttcctttaataactggactcttggagcatctgattgacaggtctctaccccaatctttctactctgactgaccttacataacacgtagggttctctaatacagctgatgctattaacttgattaaaaatatttgataacttttaagtcgtcataggacaaagcccaatctgtctaaagtgacatattctggtctacacacctgaatttacatggtctcctaccacacttctctaacttccctgagagtgcctcgggtgtcaccaagtgggggtggggtgtaacacggctagcagctgtgacaccaggccttctttcctgcttggagaaggcagctttgcttttatctctttttcatatatatagatcatgtatataggttcaaaaaaaaataaacctatatataggttcatgtttttaaaacggcttagctttagaaaaccactgcttcagatacacaaaggcatcatggcacctctaacagtacaattaagtactaactacatgccttcctgcctttagacactatcttcacctcctcatcccttcctggcaaatgcctgttcgtcttttggggctgtaaaacaagcacaaccttctctgtttcttcaattcccaaggctgaattatttgctctttctcttctcccattctacacatgcctctttttttttttagtactttatacattaaaaatagtattaaacaagcttatctttcccatatacaattaccttcccagagctaggggtatgccttatttatatttttatctccacactttgcacagtgttttggatgtagcaggctctcaataaggctctgagtgaatggtagtcactggttttcaacctgtaatctttgacattctaggattctgctcaagattgagataattatgtaataataaccatggtaatactgtccttatattttccagcaacatttttcacaacccttgaattggaaatatgggtttgtggtcaatgagatgggtaaaggctggaaatttcctttaggaagtgatctccagatacatgatgatagaagtcatggaaattagatttgcctctccaaatgtcaggctacatttccatcatagggaaagagaacatttaccaccacgggctgagcaccatcaggcatattgcatatatcatttcatttaatacaacaccgaaaacaaatttgctctattatttctactttataaacaatgaccatgaaacttggaaacattaaaataattcaggctcttaataagagaaaattctagcctcgggaacatggcaagaccccatctcttaaaaaaaaaaaaaaaaattagccaggtgtggtggtatgctgtggtccatggtcccagctactcaggaggctgaggtgggagtatcgcttgaacccagcagtctgaggctgcagtgagccatgttcgtcagggtgacagagacagagagcctatctcaaaacaaacaaaaaactcagaaaattctatctcgtcactcctattgcatcatgactactagttcactcgctcattaattcactcactccatttattgatgtttatgaaatttattaagcacattagatgtgcctttaacatacaaaagtttcttgtaagtacattacttggatagattccaaatatttaatttccaggtccaagctgctttgaaatctagaaacaggccattatttaatttttttttttttttttttttgagacagagtcttattctgtcgcccaggctggagtgcaatggtgcgatcttggctcactgcaacctctacctcctgagttcaagcaattctcctgccttagcctcccaagtagctaggattacaggctctcaccaccacgcctggctaactttttgtatttttagtacagatggtatttcgccacgttggccaagccggtctcaaactcctgacctcaggtgatccacccgccttggcctcccaaagcgctgggattacaggcgtgacccactgcacccggccaaaacaggcctttatttaaagacacattttgaatttaaaaaaaggtaaatatgcaacttttaggggaaaaaacattgtatctctcatacataatatttttaaattataatgtgcccaagataggaggttttatattcagatcattttcttgagctagtttaaataacagttttttgtgtgcctttaaatactggtctatatattgtttgcaaaattgtgaccattacattttaaaaatctctacaaacattagatgatatcacataacaaaactttgacaatttcacaattttattccttttgacaaaattttattttaaactagtttaacatgtgtaaggcaattttggatttaagatttccctattggttttgttttaaaatgcacctctctggccatgatttcagcaagccaaatttcacactacacattttagaagtttcttcaactcagaacaattgcagtaatcccagttataccactacttcttagctcaaggatttggctataccacaagttatataacgttcccagaaatgtaactgctgagaaacagtcgaaatgtggttcactataccttacctgtaccaaacgtggcactcctacccccaataccagtattataaagtagttccctggtcagaaaacacaaagcatacctttaataattgggacaaacacacacacacacacaattgggccaccatttgttctaagtatagttgcataacaaagctgactgctttaaaagctggactaaatcatgctgattgcttgaaagtccagactacaagaacattggggctaagaactgtattttcttcataacctttggctaaatttgtcaaactgaactccaaaattctcctaaagattctagttctgtctcctattcatttattgtagatgttaaagtgtgactagatgcacgtcatatcagatacagattgtttaaacaacatgtgacggcaattctattatgtgtcaaatagagatttttggtaagcaggcaatcatttaccttagagcaaacaagttagaaatcaagaaggaaaaaaaaaaagccaccttaacatggctatcatttcatttttggctgtctaatctttaggtcatagagagagtggggcagagcttgccaaggttgcaggttcagacatagagagagtggggcagagcttgccaaggttgtaggttcagaaatgacttagcatttaccccccagtcaacagaaggcaatgaattccagtcaccatttctctgtacaattcctcagtggactacaaagagccaactcacttgaaggaaatgctaaaaacagaataaaagagtagtcaccttcaattgctcttagttttctctttctgtcctacttgattggtatttcctgcattacctatgactgctttctttcctcatggaagggtacttattagaataagattatatctgtaataaaaagaatagttcaaaatatctaaatgttcagatagtccgtgtagactggttataaacagatctgtaaaaaatgactaaattatatattcttattgattgaactagtatgtattaagtcctagaaaggagaaaagaaataaaagtattcatagttcttgaccataaggaacatacaattggattaaaaatagaatgggctgggcgtggtggcttacacctgtaatcccagcactttgggaggccgaggtggatggatcacatgaggtcaggagtttgagaccagcctggccaacatggcaaaaccctgtctctactaaaaatacaaaaattagccaggcatggtggcatgtgcctgtaatcccagctacttgggaggctgaggtgggagaatcacttgaacccaggaggcagaggttgcagtgagccgagatcatgccactgcactccagcctgggcacgagagcgagactctgtctcaaaatacataagcagagagagagagagacagaaaataaaaatagaatgaaagtgtttgaaaaaattaaaaaatcatgcaaaatacaaaccagtttgaatgaaaaaaaggaaagaccaggacattctatgattagctgccagattaatgatagaggcaacagaatgtcctagggatttggagagggagatgatcatgttagaatcatgggtcaacaactgctgtagagcaatggaattgactttattgatttttaaagaaatggctaaattcaggtaagtagatgaagggcagaaggggagccacatggtgggaaaatgcagggcttactggggacagcaagtaagccagattggggcaacagagtttggtcaggaagggagtggatggttagcatggtacggcaggccagggccttatggggaatgcctggacagctgtgctcaggagtctcaacattcccactgaatgctcaacatgctcggtctttatcaagggctttccatttacactgtcatgcttcaatctctcagtaaccccgggaactgggactttggatcaggagggtcagtgagttgaagagacttgctcgttagtgaaagagccaaaattcaacctcagactctatggctcacaaagtcagtgctcttgctggtggggacatgggaatttcttgagtaagggagtgaaataaaaaatttagtattccaggaagtatactctagccagctggtactgagggactgcattaaacaaaacaagtcagaagtagttccactgaaagtttcaaaatgtaagggagattgacttgttcatgtaagacatcaacagagctagactgatactagcataccaaaaccaactaatcaatagcttggtcatgctactctctctgtgttggtctcattctctcctactgcatgtttcatgtctccccgcaacatggtggatgtggggctgggggtaggcagagaagaaagtaattatcttagccacagcagaaaaagagacaacccctattacaacatcttcatataaaacctcagtaaaggactctgctagggcatcgctgtggcccggaggtagagtactgacagtgacagcacaactgaattaaaaagttgtggagggagttgcagactaaaagaatatagaatgctcttctcaggagacattgaaagaacggatggaaagacaacagttattcactataaccagtatgcactgaagttacactgaattaccaaggtaggataaattcttccacggttgaagaccataaacatgacatggatcatgcatttaattatgttatcctgagttaattcgttatcacataacggagtttgcatttttattcacagacatgttaaagttatatgagcattgcgtgtcattctaatggtatgatgatttccaaatttaccctatatctttctctactggttcacatgtcttgtttttagaaattactttaggaaagatgatttcagttttgtctccctttgtttcatttctgtttttgttttgaaagggggtaaagttatgttgcccaggctagagtgcagtagctattcacaggagtaatccccctgctgttgagcacagaagttttaacttgctctatttccaacctgggccagttcccctctccttaggcaacctggtggtcgcccctcctaggaggttaccatactgatgccacttagtgtttgatgcaaacacccaatgtgcatgatgcactacagcccagaactcctgggctcaaggaatcctcctgcttcagcctccagagtagctggactattggtgcatgccacctcacttggcttatttgtttttaaaatatgctactttcatactcaattacctttcatcaaaattttgtatatttataaattatatatatataaattatatatatatatatttttttttttttgagatggggtctcactctgttgcctaggctagaatgcaatggcacgatctcagctcactgcaacctccgcctcctgggttcaagcgattctcctgcctaggcttcccaagtagttgggatttacaggcacctgccaccacacctggctaattttttacttttagtagagacgaggtttcaccatgttggccaggctggtctcgaactcctgacctcaagtgatctgcccacctcaacctcccaaaagtgctgggattacaggtgtgagccactgggcccagccaaaattctatatttcatgatactatatatttctttttctcagccttccccaaaggaaccatttgcctattaccaggttgactatgctataggaaaaaaaaaaaaaacaacagtccgacatttggggattactggccctgaactgacacattccaagagatccaaaacatcactgtggcccaccagtcagagcaggagttagtggaggtcaggtgatcaaggagttttacctcaggtcagtcccatagtgggtacagtgggtccctgaacccatcctgtggttatttcctcagttccaaaatgtataattggaaaaaaactactgagcaactggcagaatccctgcattggtggggaatatagaatctttcttactttagaatcttctctaccttccattctgggtagtaaaacaaatatctagtgtgctcagaattagtactttgatttcaaaagtaactgcctataatgtctacgtgtatacctaagatatggacatagagaagcaaatattataatgcctcttaaattacttattttttgttttaaagacaggatcttgctctgtcacccaggctggagtgcagtggcatgatcatagctcaacacagcttcaaaatctgtgactcaggcaatctttccaccctagcctcccagtaagtccctcagctgggactgcaggcatgagccaccatgcccagcactatacataggtatcttaaatccatattatctacatttatcttaaatatacatcttaaaggatatatcctatggtttggaggtatcaagaaagtaaatatccaatttttcctaaacttattttataagcaactggaagccaatccaattaaattaatcaatgataggcaaaccatttggtgacacagaggttttgttgttgttgttgttgtttgagatagggtctcaccctgtcacccaggctggagtgcagtgacacaatctcggctcactacaacctctgcctcccagactcaggcaatcctcctaccaccaccacgcctcactaattgttctgattttttttttgtagagatggggtttcgccatgttgcccaggctggtctcaagctcctgaactcaagtgatcttcccacctaagcctcccaaagtgctgggattacaggcatgagccacgactcccagcctgaaatatagattttaatcttcagcttgcattttgttctaaacaacttgttttcaataagaacgggcagacaagtttaagccaccatttgttggagcagatcatttattggtgtgttcagatggtactgtactagccttcctcttcccctccatcctcctagccatgtgcagggaattttctctttttgttggttaacactcttcctcatctggattgccttcaactatgtgacaacgaagaattcaagcaccaaaatagcagcagctacatatcctttgcatgacagtgtaatttcttctgccttaaggctgtgtctagcactgaaatcatagtctgtttacttcgatctggtgctacattacaatgggagggatttaactcttacttataaacacacaagggaattatttctcagctctgtttagattagaattagagatgaaattgtgcagttcttgttgctgctgagccaatcaccccattgagcaaaaacttaccttcctactttactagacaagcaagaatactgtgctgtcttttaaaatgttctgcaatataactattagaaccaatacagaaaatttttggtggctagtgagtataggcaattaatcttgaaagtttcccacttgacttgaatgtttgactttctcttcagatgctttctgctggggaaggagcacttctgaattaaagaattttgcaaaagaaaatgtggccagggatattatgtgcgtgtgtctaaaactggggattatcagtacatgctaagtgaatatgaggctttataaaccaatattttaaaatttcatgatcagaaaaagtaatctttaacaccattctcttacccgtgatcgcttagtaatcttcgtgtctatgaaattctacctctgaaatatctcttcagctgttcccttctctctattcccaattttatcttttagatcctattgtctcatctgaatttttagaagagcctactaatttaatcttctgcttctgatcctttccctatgttaactttctaaattatgaatataatgtcacaatttggctcaaatgtgattttaaactataaagtaatttaaactgtaagtcatataactagtttgatgataccgtaaaggtagatataagatattaatactactactcagagacccatgaatgtatctcagtgcctggcacagaataggcacttgataaatatttgcttaatgattagtaagctttccatcgttgggcttatgagaagccaacatttattgagcatctcctttgtggcacatgcgtcaagtctccagcacttgcttgatctttagctaacactgttgttttaatgattttctcacaaagaaacagatagggtaggtattagtctcattttaagtatgaagaaactgaggtcttaagagtatataactttctcaaagtcgcaagactaataagtaccaaggctggagtttgaagttaagtctgaattcttaatcgaccctcacacttacaacatgcagctgaaactttttcttcctgttcctttgctttaatagtttaacatactatttgatacatacaaaagaatacatgtaacaaatataaattgcagagcctaaaaataaatagtaagtatcttagtttttaaaagtgagcaaaagataaatgacaagtcaccaaacagacaagtaagcaagtaaatgatgctcaacgtcatctgacattagggaattacaaatttagacaaagaataccactacacgtttgctaaaatagctaaaattcaaaacagtaccaccaacaactgttgggtgcaaagcaaatggaattctcattcattgatggtgagaaaatggtacaaccacattggaagacagtttggcagtttcttacaaatacgacccaacaatcacgctactaggtatttactcaattgattttaaaacttacgttcacacaaagcctatatgcaaatgtttgtagcaaccttatgtatagctacaaaaaactagaagcaatcaagatgtcttccaatagaagaatcgactacacaaactgcagtatagctatacaatggaatattattcattgataaaaagaatgagctatcaaaccacaaaaaagatgaattttgaatgtatattgctaagtaaaagaagccagtctcaaaaagctatataaggtatgattccaattatatgacattctagaaaaagcaaaaatatagcagtcaaggtctgtggatgccatgggttcagagtgggagagacaaatatgtaaaacataggggattttttttatggaggtgaaactattatgtatggtactctaaaagtagatgtaagacattaagtatttgccaaaacccaaagaactttatagcacaacgaataaatctcaatgtatgcaaattaaaaaaaattaactagaaagtcggggaagcctagcatgaaatgcaatctaaatatattataaataatctaaacatattacattgcatacaacaacttcccagaaaagtattggggtataaagtgcagaactaagtaactcttgaagaaagggaagtctgtaagactaaaggtaaaggaaactgtacgtaagaattgtctcccacaggggtatggattaattttgaaaccattatatatgtatactaaaattaaacaattgagtaaatggatggtggatagcgtgagccagatttctcactgttttactgagagattacagataagcaagggtaaaaacgctagaatgatccttatgggaatgaattagagctgaagacctcagtatgaactcatatttagtttaatatacagaggattacatataaaaatgtttttatatgtatatacatgggccagcacacacacacacacatgcacacgtgcacacacagagttcgctctatcagctgaggtctagaagcaataataccccagtggcacacagggcacgcagatcttggtttctgattccattttccaatgaccagggcttcttcaacaaaaggctgatcctgtctgcggcaagaaatacccaagatgagtgtggagcctcttacagtgccagagttaggaagtgccaaaagaaaaaaaatcacctaaaaccccacaacgatgaggctatgtcaaagggacgtaggagctaattaaaagaacatcctatgccaaaaatggaacaatttaagcaacaaaataacagagtattgaattataatccaaagtatgaaccaggcttgatggcacacacctgtaatcctagctacttggtaggctgaggcagaaggatccctggggcccgggaggatccctggagactaggagcaatatggcaaaactgcatctccaaaaacaacaacaacaacaaacaacaacaaaacaaacaaaaaacaaagtataaaataaatatccatgagtctctactgacataagtaaataattgaataaatcaacaaataaatggggtagaagagataaacctactatgtagaaaaattccaaataattccaaataatttgtgtaggtattctatccaaaagaaagtaaagcataactactctctaagtatggctctctaagtatgacctgtttccaaacagtagagtatgaaaaaagaaaaaaaataaaaataaaaaagagtggctctagagtggaaaaagtggagaaacctgacaaacactacctcaagcaggtgataaaagtttatatcaacagtgataagtcacattgacagtgtttacccttgatatgatgtgatgtggcactgtacctctgggatcttccttctaagtgtaatcatgagaaaaacatcagacaaattcctattgagaggcgctctataaaatacctgaccagtacacctcaaaactgtcaaggtcgtcaaagacaaggaaagtctaagaagctgtcacagctaagtggggcctaaggagatgtgaaaactaagtgtaatgtggtgtcctgtatgggatcctggaacagagaaaagcatacataaaaactaaggaaatctgaataccatatcaactttagttataagcaatgtatcagtattggttcattaactgtaataaatgtccccctactcttaacagaggaaaatgggtatgggatacacaaaacactatgtactatctttgtaataattctgtatatctaaagtcattctaaaatagagtttatttaataataaataactagctatgaatgtaccacccaatcagaaactagaatattatctgtaacctacagccatcctctgtgctccatctctccccttacttccggtacctcgcccccacctaaataaatcactatcctgaatgttgtatttaatatctttcctcgttttagcacagtcttattacacatgtatgcatatatacctttaaagagtttgcttatttttgagctttataaaaatggcactgtactatcttctgagacttgcaccagtggattatgtataagaaaatttattgtggcactctttctgaaagaaaaatctggaaacaaagcaaatgtcccaaataaataaacagtggtatagcttgcacaatgaaatattacacaaaagtgaaaaatataaactacattcaacaatgtggatgagctttagagaaacaatactagagctgggcgctgtggctcatgcctgtaatcccagcactttgggaggccgaggcgggcggaccacaaggtcaggagatcaagaccatcctggctaacacggtgaaaccccgtctctactaaaaacacaaaaaattagccgggcgtggcagcgtgcgcctgtagtcccagctacttgggaagctgaggcaggaggatggcgtgaacccagaaggcggagcttgcagtgagccaagatcgcgccactgcactccagcctgggttacagagagagactccgtctcaaaaaaataaaagaatactagatgagaaaaggtaaaggtgttaatctgaagcagaaggccctttgtcaaatggccacaacctacctcatctatctcacttcaccgaatctatttccagtcacaccaaacttctccatgcgacctaaacattccacactcttggacacccacttagcttttatttttttaaaaaggcatgttgtgatacaattcacataccacacaatttatgcacttaaagaacacagttcagtggcttttagtacatacagagttttgcgaccatcaccgtaatcaattttagaatatttttatcacactacaaagaaacatcatactcattggcagtcaaatcccatttcttgccaatccctacactctccctggccctaggcaaccaccaatttactttttgtgtctatggattttccttttctgcacatttcatctacagtaaacggcatagtatgacatgtggccttttgtaaatgactttcttcacttagcataatgtttccaaggttcatccatgttgtaacatgtattagttgcatcatcattccttttttttttttttttttttttttttgagatagattcttgctctgtcgcccaggctggagtgctgtggcgtgatcttggctcactgcaacctccatctcccgggttcaagcgattctcctgcctcagcctcccaagtagctgggattacaggcatatgtcaacaagtccagctaatttttgtatttttagtagagacgaggtttcaccatgttggctaggctggtctcaaactcctgaactcaggtgatccacccgtctcggcctcccaaagtgctgggattataggcgtgagccactgcacctggcctatcattcctttctattgccaaataatatgccattgtatgattatactcacttgcctttgtacatccagtttcttctgtcattgctctctgcttgtcaagttcctatttacccttcaatgcccagatcagagattacttccctaactcccatggcattccactgaaatattattacacttgtcacattgtattataattatcatgtgtatttctcctcctccacccactagtgaactgtgggctccccagacgcggggacaaagctttgtgcatctttgggttcatggcagttaccagaatttgaccaactatatctactcaacaaatgtttattgaattattgaatgagtaagttttcccacatttgtcaattttacatttattatacaaaaggagtatgcatactgtagaaagtgtgtgcaacaatgcagggttactatggtctcaaatctgggttcacatacgagttctgcttttgataactcaatggtcttgggcaagttgcttaatcagtctaagttccatctgaaacatggggataatatcacactcatatggttactgaatttaataagttatgtttttaaagagtttaacccaatagtggtagccattattatgaccaataataaaagccactaacagaagggtcggggaaggggcggggacctttaagcagtctgattcaggccaggtgcagtggctcgcacctgtaatcccagcactttgggaggctgaggtgagcggatcacctgaggtcaggagttcgaaacagcctggccaacacggtgaaaccttgtctttactaaaaataaaaaatcagctgggcatgctggcgtgcccctgtagtcccagctactcgggaggctgaggcaggagaattgcttgaacccaagaggcagaggctgcagtgagccaacattgcgccactgcactccagcctgggtaacagagtaaaactgtctaaaaaaaaaaaaaaaaaagtctgattcaaattcttcattttacaaataaagaaactgacacctcgtggggttggggggatgccagaggccactaaaggagggagcatggtgtgatggaataatcacatactatgaggcacgacatagctgatttttgaatcctagctctgtcttttactaactgcttatctttgggcaaatcgttgttttccaaacatcaattccctcctgagtatacgggggagcacaaatacctagctcacagatcagctttgtgaattaaatgagaaactactcatgtagtaggtttgtgtcatgaacacaaacatatacacatgtgcacatacatgaacatacacatacgaacatagaataatgcaataacaaataaattggaagaaagaaaagttttagaaagaaaaatgtatagtctaataaaaaaaaaagaggatagaaatcaccttaaaaggaagattaaattttgggaaaagtgatttatagtcagcctgcaataggaacagcatcttataaatatcagtgggtacaataatgtaggatatttaggaataaaagatgtttataaaattaatcattgttcatcttgccctctctccaaactggcttattttaaactttctagtattttctgtctgatattcctggagcagagctgaagaaaataaatgttctttctgaagcctctaaaaatagtccatcaacatgattttcctccaaaaatgaaaaccataagactggtaacatatttaaaggtgatggggcaggttttaacacacaactgtgccactgtttaaaaagtaccatcatgttcttttccttaggaagtgtttgtccattcactaaacattataaatgaagtagtagcatactcaaattgcaataacccacagaaattgtatagcaccatttaaagcatactattgatggggcataagtggctcatgcctgtaatgtcagcagtttgggaaactgagatgggaggatcgtttgagcccaagagcagtctgggcaacatagtgagacctagtctctacaaaaaaatatttaaaaattagctaggcatggtggcatgcacctggagctacctccagctactctggaggctgagatgggaggatggcctgagtctgggaggttgaggctgcagggagccatggttgcacctctcgacttcactccagactgggcaacagagtgagactctgaccctgcctaatgaataaagtaaaacacagtatgagcccacaaataatcccaataatttgataatatatgaagatctcaagaaactgtgaagaatacacagtggtattttatctctgtctccactaatttactggtgcctttatttatttatttatttatttatttattttttttgacaaagtctcgctcttgttccccaggctggaatgcaacagcgcgatctcggctcactgcaacctccgcctccgaggttcaagtgattcccctgcctcagcctcccgagtagctgggattataggagcctgccaccatgctcagttaatttttgtatttttagtagagatggggtttcaccatgttgcccgggctggtctcgaattcctgacctcaggtgatctgcccgcctcggcctcccaaagtgctgggattacaggtgtgagccaccgtgccttgccaattctgattttttaaaagatccctcacacttcattttttcctacaactttgtagcttggctgttttacatgaattaagtattaaataaacaagtatttgttgaatcttactttatacccgccattgttctggcaactgggaccaaaataaatggagatcctcctctccaggagcttgggttctcatgcagtgtgataaacagcaacaaacaaatgaatatgtaatatgtgagaaggaaatacgtgctatgaagaaagtcttgaagacagcaagggagtgagctctggggaaatctgggcagagggaaaagcacaaaagctccaaggtaagattacccgtgtcaggttcaaggagcagaagcgggacagtgtggctggagctgagggagcaacagggagagagctgggagatgaagtccaggaagtggtggaatccagatcagatagagcttttgcttttccccatgggagccacaggagagtcttgaacagaggagtgatatcatctaactacagtttcaaggctccctcgggttaccatgagagaatagcacatagaggagcaaggcgggaggagggagaactttcgagaccattgctgttgcacatcaggagtgatgatggaagcactggggctggtgagacgtcattaggttctgaatatattttgaaaggataattttaattgcacaaccttgttccatttgtcacaacatgttccctttttaaactgcagtctaaaagccaccttctccaagaaaggctttaaataaccttatggtctccaagccacttatataaaccctcctatttttccttaatctgtacccgcaaattgctttttttcttctatagactaaaggtcattgctgtcttagcctaatagaaacacaggaattaagtcagccaagtgatataacatggctacttcctaagaaatgacagtggagcaggcttaaaaggctcatcagtctagaacactcttgtctgattagggcctccgttccgacagcatcttcactgtgaagtgagacgaccttgagaatacaaagtgatcaaccagaactcatcttgtgggtcctctggtgtttttccgatttttaattcaacatagtgcacggacttcgatgttcaagtgacagcttaaccagttgtatttaaataatggcatgagcctgttcatcacttggttagaagaccaggatgcactggtattatagcatttatgcaaaaaccacagagacagaaaacagtatttgagaaaatgtgagaaagaatacagaaaggtctggaaagatatacactaaagtttcaatggttacctctaccaagtgacagttggaaccaggatgagaaagcaggatgattaaaggacactttgcttgatagtaatgtacaacctacttttgagaataaattattcttattgtgtagttaactttttaaagggtccattttagttatttggctccttcagcactattgaggcagatggaattccataatgtgtataaaaaacagttttatggaacattaatgcttgtatttcatattctacttataaccaaatattagaaatagttgaaaagttcctttccaagctgatatttagattcatgaaaggaacactggacccttggtgataatgaatataaattttcttaataactgataccctctatcatgttctatactgatacggtttggctgtgtccccacccaaatctcatcctgaattccagtggaaggtgactgaattatggggactggtcttttctgtgctgttctcatgatagtgaatgagtctcatgagatctgatgactaaaaaaaaaaaaaaaaaaaaaaaccccgggtgcggtgtctcacacctgtaatcccagcactttgggaggctgaggtgggtggatcatgaggtcaggagttcaagaccagcctggccaacatggtgaaaccctgtgtctactatacaaaaattagatgggcatggtggtgcattcctgtaatccccgctactcaggaggctgaggcaggagaattgcttgaagcgggacccaggaggtggaggttgcagtgagcccagatcctgccactgcgcagcagcctgggctacagagcgagacactgtatcaaaacaaacaaacaaaaaacaaataaaaaaacatgggagtttcccaagggagtttccctggacaaactctttttgcctgctgccatccacgtaagatgtgacttgctcccccttgccttccaccatgattgtgaggcctccccagccatgtggaactgtaagtccaattaaacctctttttctacccagtctcaggtgtgtctttatcagcagagtgaaaatggactaataatacagtacattggtaccagtagagttgggcattgctgaaaagatacctgaaaatgtggaaggtgactcttgttatgttttagcaaagagactggcagcattttgcttctgccctagagatttgtggaactttgaacttgagagagatgatttagggtatttggcagaagaaatttctgagcagcaaagcattcaagaggagacttggatgctgttaaaagcattcagttttaaaagggaaacagcataaaagtttgaaaaatttgcagcctgacagtgcgatagaaaagaaaatcccattttctgaggagaaattcaagccagctgcagaaatttacataagtaatgaggagccaaatgttaatccccaagacaatgggaaaaatgtccccagggcatgtcagaggtcttcatgatagcccctcttatcacaggcccagaggtctaggaagaaaaagtggtttcgtgggccaggcccagggtcctccagctgtgtgcagcctagggacttggtgccctgtgtcccagccactccagctgttgcagaaaagggccaacatagatctcaggccgtggcttcagatggtgcaggccccaagccttcacagcttccatgtggtgttgagcttgaggctgcatagaagtcaagaattgaagtttggggctggacatggtggctcacacctgtaatcccagcactttgggaagctgaggtgggtggatcacctgaggtcaggagttcgagaccagcctgactaccatagtgaaaccccatcactactaaaaaatacaaaactacctgggcatggtggtgtatgcctgtaatcccagctacttgagaggctgaggcaggagaatcgcttgaacccgggaggtggaggttgcagtgaactccactgaactctagcctgggcaacaagagcgaaactccactcaaaaaaataaaaagtaaaataaaataaaagaattgacatttgggaacctccacctagatttgagaggatgtatggaaatgcctgaatgcccagatagaagtttgctacaggggcagggctctcatggagaacctctgctagggcagtgcagaagggaaatgtgggcttggagtccccacacagagtccctactagggcaccgcctagtggagctatgagaaaagggccaccatcctcctgaccctagaatggcagatcctctgacagctcacaccttgcacccggataagccacagacactcaatgccagcccacgaaagcagccaggagggaggctgtaccctgcaaagccacaggggcagagctgcccaagactatgggaacctacttgttgcatctgtgcgacctggatatgacacatggactcaaaggaaataattttggagctttaagatttgactgccccactggatttcggacttacaaggggcctgtagcccttttgttttggtcaatttctcccatttggaatggttgtatttacccaatgcctgtacccgcattgtacgtaggaagtaactaacttgcttttgattttacaggctcataggtggaaggggtttgccttgtctcaaatgaggctttggacagtggacttttgagttaatgctgaaatgagttaagactttggaggactgttgggaaggcatgacttgttttgaaatgtgaggacatgaaatttgggaggggccagcggcagaacgatatggtttggctgtgtccccacccaaatctcatgttgaattcccatgtgttgtgggagagacccggtgggaggcgattgaattatgaaggccagtctttcctgcgctgttcttgtgatagtgaatgagactcacgagatttggtggttaaggaaaaaaaaaaaaaaaacaacagaagcttccttgcacaaactctctttttgcctgctgccatccacataagatgtgatttactcctccttgccttctgccatgattgtaaggcctccccagccatgtggaactgtaagtctaattaatcttctttcttttataaattgcccagtctcagggatgtctttatcagcagtatgaaaatggactaatacatataccataagaaaatctggcaagaaagctaaaagttaacaggagaggttaacagaaaacatgagctgagcccaggaatgaaaaaatggggaatggcattcctcatcaggaagcccacaaaaagaaacagcaaggaaataaaatggctagtggaggatgtgaattttagcagatgctaaagatagagagatccaggacttgtagaatcatagtttcaagaagtagttcctctggagtttcttgttttcttcttttatatttaaattccccattgtgcaatctaatttccttagctctcacaataatgctttcacagtagaatcattctacataacttcaaaaagaaattcttcatacatgaggcataggatgtcaggaagagagaggggggaaaaacccctaaacaatgggtaacagttgataataaatcccatacaaggcaaggcatcacaaggatgcagcgtgtcttccgagtacaactggcttatgccttgacagactatgggctggtgacaagttgagggatctgtggcttgatagacgtttcctaggaaatgaggattctgcagttggttttcactgtgctgccaaactgttctgggaaaaacagatttagagaaaccaatgaacttctttatctccatgcttccctgtgtccaccagagccacactcattctgtaatccctgagtccagcttgtgggcagacacaaagcagcatgcttacctgatatagtaagatgagcagtaaacccaaagatttaaatgaggtacagctttctcacacagcacaatggtacactgatggcacagcacctgaatttaattgcttctactactttgactttggtgttgaggagcatggatatgtatgacaaactcctaattcaacactgtgaactcatttcttgttattatgtttcacttgaaactgtctaaatgagttagaataactcattatttttttcacccaaagggtttgcctgctacatcttgtttttatctcaattaattttgtgtctgctggactaacacaaattaccacttccatgtcttgcacttttgatgtaaaaataaagctaatttgggaggtgtttaaagctttattaatatgtatatggccattagcagcgcctatgatgttagcaagcttctttctaaaacttagaaattctccttctgattctgagctgcagcattcccactctgaccacatcatttttagcatttttcttagggcacaaagaggaatttcacacagggtcatagaaaagttggtttgagttttcctaccatttatcttacccattctgctcagtgagtcagacttacataatacatttctttctctgattttcttcagaaatccagaggcagcactttctcccacggaagtgcatggctgctgtgtaacaaccaagcactattccgcctctgtttccccttctccagcctgaacttagactgggcaagtaaaaaaagagtcacgagtattctaatgtgataccgaaatacagatgatgagattctctcttaaaaggaagaaaggatgcaaaggacaagatccatactaaataatgtggcctatgactccctctgcactccccctgtaagttcccccagccttaaacaaaaaagcccaccagtgctttcagcatagtagggcagctaaagaagaccaaagaggaaatgtgaccatcaattgggaataataggtcctgaggctaaccacatataacaatggaacaagtaaaagtaattgaattgtgcttagagaaatgaggattgagaaaaaggcagcattgcatcagtctttgagagtatgaagctatacagccagttttcctgaatacttctcccaagtcttccattttctggatgtgtgacctcaggcatgtgatttgaccactctgtgccttaatttcttcatttggaaggtagggataatatttgcactgttctccctgaggttttatgagcactaaaaatctagtgagtaaaaaaaaaaaaacatttacttagaatagtgcctggcacatattaagtatagtcgatcctcaggtaacaggggtttgaactgtctgagtcaacttatatgcagataaaaaaatacagtattagtgggttacaaaacccacatttatggatagccaactttttgtatacttgagttccacaggaataagcatgtgtagatttggaatggggtgggggtagtcccagaaccaatgctctgagtatacccagggtcaactctactccataaacatttgttgaatggaagggtttggacaaactaagtcaaacattaaactgaatagcaagtaagatataatgtacattaaaatgacaggatctgtaagctatttctagctacagccacagaattaaataaatttgagaagtaaaatgcaaaataaaagagttttaatagttttctgctattaaaaaagagaaggttaagattaattaaaactaatctttaaagtaggtattcccaccatgtttagtaataatttgtcattaatgcatatatattaatctggcatctttcacatattgcttagagctatgctagcaaatataatagccactagctacatcaggctattgacagcttaaaatgtggctggtccaaactgagatgtcctggctgggcgcagtggctaatgcctgtaatcccagcactttgggaggctgaggcgggcggatcacctcaggtcaggagttcgagaccaggctggccaacatagcgaaaccctgtctctactaaaaatacaaaaattagccaggtgtggtggcatgcacctgtagtcccagctactccggaggctgaggcaggagaatcacttgaacccaggaggtggggtggttgcagtgagccgagatcacgccactgcactgcaacctgggcaacagagagagactgtctcaaaaacaaacaagcaaacaaacaaacaaaacaaccaaaaaacaacaactacaaaaaacaaattgagatgtgctatatgcataaaatgtacattacatttcaaagacctagtatgagaaaaataatgtaaaacctctcattaataattttcagtactgattacatacaaatgttatgagttaaataaaatgcaatgttaatcataatttcacttattctatttattttaacacagctattagaaaatttagattacatacatggctcacatttgtggtctgcattacatttggatcaataaggaatataaaccgcactattattaccactacttcaaactaacagttattgagttcttactctgctagatgttttaaatacattatttctagcatcacaatacctctgtattttctctccttttataagataagatgttctcagagtatatattgccccaaatcacaaagctactagtgtcaggggaggaatgaatccacatctgtctgagtgcaaagcctggtgctttctcctatactagagaccacatggaactagaaaggcctaagcccccatttgccaacagaaaaggtaggaaaagaattcacgagcgacatagtgcatatatgaaaagcaaaaatgtaaactagaaaaagtatactcataaggaggccatttgccatgttttcataaaaaattcaatagagaattaatataaaagtgctaaatctgatacctagttaacagcagaaaatgcttagatgttatatagcatgaacaatcagaatacaacactatccatacacttactacagctctgtaaaaggatctatatatcatgaaagaagactgacagggacattcaaaattgataatatctttgaataaaggcaactcaaaaatgagcaggtggggtggggactttgatcctcaggggacatttggtaacattgggagatacttttgatggtcacaactcaggaggtactactggcatctagtggactgaggccagggatgcttctaaacatcctacaacgcataaaactacttcccaacctgctgagattaagaaatcttataatagggtaatggtgttacaaatttcctcctctactttccacattcgataatgttaaattgtcttactatacaagaaactaaattaaaaaatataaaaaaattattactaaaaaagtaacagaaactaaagcataatcgccaacatagaaggttattttatatatgggggtaggtgctgggtaatacaagagggtcccttaatatagtagcaaattccttctaagtacttcttagattcactaaaaacgacatctgaaaaggatatatgcaattatacatagattaaaatttggccgtgtttcctcaatcactacttgccattggaatgactgattcaacatctaacaggaaattggcactcctttcactgttgggatagcatttgctaaacatcaaaatattttttctcactcctttgagcaagtagtgcttcacacgggtgttattattactgagattgacaatatatgctgctatttacactgcatttaggaagagatgggaagagagatttttctgacaatttttttcagtatctgcatcattatgataaaaaacagaagcttaaaacttacacttgtataaattctgtgtaaaaactactcattttgtgagcttaactatttgtactaacagattacctgattaaagatttcacaagagtaagtatatatgccatgcttgcaggcatgaaagaaaggaaatctgaaagctgtgtatatactcatctttttcttcatttattcagttacatcaaaaaggggatttcagaataaaaatatgtacaggaagaacctatttaaataggtttattgatgctataaggaaggcctaatcacagtctatgaaatgcttgtgctacatcatttgaccagagaaaacgcaagtgctcttttactgaatatagccagagcaatgaacaatttagttttttcctctcagcatgaaccatcgtcttggtaatctccagtaaacagcacattgcctggcacgtagtgagcactcaataaatgttaggtgaatgaatgaacatttataaaatcataccatgtgctatccagagttgtgccaaatctcttgacaagaagtcatatttcagttccctttctcctaagtttcactcacacattcattcactcaccaaaaacttactactcacctgtaagtttttatagcatgtcacacacaccacctttatgatacttatcactgctgttttaattatttgtttgtaggtctatctctcccactaaagtgtcagcacttcaaagacagagaccatgtcttgacactttgttctctgatttaatcttcaataaagagctggaggataagaaaataatggttccaagaacttgcctacagtctcataatttaaaagtcgtagagccatgatttgaactgaggatggctcactccaaactatcttcttcccattttaacagactatagagaaaatgagagtgaaggcagagtgtggaatgagaagactgtgaattaagacaaaacaaagcagaacaaagaagttttagaagctaagtaagacccaatcagtgggttctattgcaccagcaccaaggaacagaaagcacaattcaagaaactgatatggacaactgcagagacctcagaaatagtctctagaaagtcaacgtatccaacatttatggaaaatcgaccacaaccatttggaccaatctaggtgaactttttgagggggaagaactgaatctcttttctgtttctttatctctaacttataatttgttggaagaatgaaagactgtatgacataaccctagtgaaagagatcccagtcctgtagagtgaccaacagataaaagaggtgagataaatcctattaataggcagcaaattgtcagactggagaattagccaaaacaaagcagacaagagattctgcagtaaatttatcctaattggaattttccaagtacaaaaaattgaaatgcttatcagggtcatgccatctcaatgtaatgataccctgaacaggctcttagtaagtacaatatgttaatattggttttatttgttgaagaccaaatggcagcgtaattaggaaaatgagttctggagctcacttcactgcttgacttcttagctcagctctgccatttcctagctacctgactttaggtaacttaataatgccagttgagagctatgcaaagcagaatagtacctaatacgatacacatgcttaacaaatgtttgctgttaattgtattgtcattttcaaaatgttatattaacatataaatttttaaagaatcatgggacttcttcaatgcgacattctaaaattactgaaagtgaaaatatatttttttaaatatttggataaatccagaaatctggaacattttcattaattcaaaattaatgaagtgaagccaaacaaatatggatgatgagggtaataatgatgataatagtaataattcttctaaaacataattgtatgtactatggtttgaatctttgtcccctccaaaactcatgttaaaacttaatcctggctgggctcagtggctcacgcctataatcctagcactttggcaggccaaggagggtggatcacctcaggtcaggagttggagaccagcctggccaacatggcgaaaccccgtctctactaaaaatacaaaaattagctgggagtgatggcgagtgtctgtagtcccagctactcgggaggcttaggcaggagaatcacttgaacctgggaggtggaggttgcagtgagtccagatcacgccagcctgggtgacaacagcaaaacgtctcaaaaaaaaaaaaaaaaaaaaaaaaaaccacgaaaaaaccaaaacttaatcccaaatataacagcattaaaagatagggaagacttttttttattttttattttttctgagacggagtttcactcagtcacccacgctggagtacagtggcgcaatctcggctcactgcaacctctgcctcctggattcaagcaattctcctgcctcctggattcaagcaattctcctgcctccgtctcccgagtagctgaaattacaggcattcaccaccacatctagctaattttttgtacttttagtggagacagggtttcaccaccttggccaggctgttctcgaaatcctgacctcaagagatccacccacctcggcctcccaaagtgctgggattacaggcgtgagccaccacacctggctggagggcttttaagaggtgtttggtcatgaagggttttgcccttatgaatggagtagcccattcatagattaatggattatcatgggagtggtttagttatcaagggaaggggtctgttataaaagttggtttgggccaggtgcggtggctcacgccagtaatcccagcactttgggaggccgaggcgggtggatcacctgaagtcaggagatcaagaccatcctggctaacacggtgaaaccccatctctactaaaaatacaaaaaattagccgggcgtggtgccgggcgcctgtagtcccagctacttgggaggctgaggcaggagaatggtgtgaacctggaaggtggagcttgcagtgagccgagatcgcgccactgcaccccagcctgggcgacagagcgagactccgtctcaaaaaaaaaaaagttggtttggctctcagttcagcccccttgccatgtgatgccctgggtcacctcgggactctgtaaagagtccccaccagcaaaaggccctcaccagatgtggctcctccaccttgggcttcccagcctccaggactataagaaatacatttcttggttgggtctggtgcctcatacctgtaattccagcactttgggaggctgaggtgggtagatcacctgaggtcaggagatcaacaccagcctggccaacatggtgaaaccctgtatatactaaaaatacaaaaaaatattggctgagtgtggtggcgagcacctgtagtcccagctacttgggaggctgaggtacgagaatcacatgaacccaggaggtggaggttgcagtgagcctagatcacagagccactgcaatctagcttgggtgacagattgagactttgtctcaaaggaaaaaaaaagaaaaagaaatacatttcttttcttggccaggtgcaatggctcatgtctgtaatcccagcgctttgggaggccaaagagggaggatctcctgagctcaggaattcgagaccagcctgggcaacatggtgaaattctgtctctatgaaaaaacacaaaaattagccaggggtggtggcacatgcctgcagtccctgctacttgggaggctgaggtgcaaggatctcttgaggcagggaggtcagggctgcagtgagccatgttcgtgccgctgcactctagcctagatgacaacgtgagaccctgtctcaaaaaaaaaaaaagaaatacatttcttttgtttataaattacccagtctcaggtattcaattatagcaacagcaagtggactaagtatgattatgtgtgcatgtctgcttaaaatggtatctttagatataccaataaataaatgtttttaattagaaaaaatgatgagaagcctgaaaatatacacattgaacatctcaaatttcaaaggagaagagcaaatcactcccataagatttcaaagtgacaggtaatcacaggcaagataaataacagttacagttcagtctaaatcagatttttttttcaagtatagatgctctctctcttccaccgcctttcccccccccccccccgcaaagccagacccaacctctgcattcaagtaggaaacctggaagtctcaaaggaatttttggtacactattgttcagaagcactttttggtacattaatgttcagaacctcctactgaactgtgtcagggaaagtggaagctgattagaaaataagagctaccggccaggcgcggtggctcacgcctgtaatcccagcactttgggaggctgaggtgggcagattacgaggtcaggagatcgagaccatcctggctaacacggtgaaaccccgtctctactaaaagatacaaaaaaattagccaggcatggtgctgggcgcctgtagtcccagctactcggaaggctgaggcagaagaattgcttgaacctgggaggtggaggttgcagtgagccaagattgcaccactgcacgccagcctggtgacagagcgagactccgtctcaaaaaaagaaaaaaaaaaaaaaaagaaaaaaaaagaaaataagagctacacattgactataataataataatgaaatagacatcccacacccacaaacctgccactgtatcactcttattgttttcaggacatttgcactgacactgggccaatttttgttttactataagaggttttaggatatgtctttaaaaatcatactgtgtacaagacaggttggttactatcagccacgatcactaacaaaacagttccccatcatcagtcctaccatctgtactcccagttctctccacacacgggcttggttgaacagattttgaactggccaaggtcactgcacagctagcctccacagatggggacagtgtgaaaaacctaattgcagctgtggataaacacaaacaaggacacacatggttggcaatacccctgtctagacttgatggtggctcagtgtcactaagcacaaaaaacaaggacatagtttcaaggtaactatctctcagcgctggtacaaatgctatcatcatgtggtctaaatgtctccgagatatttaagtatcaatttaagaaatggtaatagacaagcaatatttcctatcatacatacattctctcaaattctctagggaaaaaaatgcctttcttaaacaaaaagataaagcttgggaatcagcacagtgccataccccatgtgaatgtcacaagcattgcctgcacacaacacagaagatactgcattagggaaaaaatgaaatatcctctttccacatatttatttcatatgtatcaaaatttccttttcccactccctttccaaaacaaattacttggttagagactttactttgtttttgtttcaacaaaatttaattgggtacaccttctattctatacccctaagacactcatcaaaatagaatcacgctgaagatggtatcctagattttcccccttgaaatacatatggccctcagggaatgtggattgtcaatgtcttttctagacactcaacatgtctggtcactcaggtttaaagccaaattggttatgcattactttttgagaagttgttaaaacttaaaataagttatcaagtcagtgatatttcaaaagattgttgataaaaaagaacatataactgtaaccatactgaacagttgattatagaacgacatgtcagtgcacatatggcagtcggataaattatgcacatctggattacttttggcaagaaacatagctaagtgtctaaagccaagtttagcaatctgtcactaacaatatgtacatttattttaaaatgtcaagggctcaaagtcatattttctatttcttcataaactttccagctcttcgtaagacagcaaacaggtgacaaaacacattgcccaaactgccaaaggctgtataaataaggggtaattttgaacttctcaccacatatataagaggactcaaagtctgaaacaaactcatgtgttgtgggatgtactgacatataggtttcaagtgagattgttaccatttcacttcagaagttggttagaaaatgctttcatttaaagatatggctggcttacatggagtagtaaacaatataacactctggggaaagcaaatggaaatagtctagtggtgtctccttataaaaggaaaagaccagtgtctctgtgatcagctcagattaagtttccttttttccattgccaattactgacatcatttaagccccaaagaaatgttttcctacttctagtccccttgattaaaagaaaagccaagagacacgaaggtggctctcaaactagcagtaacaagaaactttacaatgggatgtatgggcagcagccaggtgggaatgtagcagtacctgtaagcacaaaactcctcttgactattatgctgcttcctagtttttctagcattccaagcttcttaacagcttcagtgggaatgccaagatatgtcatggagactgggtggggtcccgtcattccaggtgttgccttccagtctcatttgtgctggcagcagagaaaaaccagagtggaactattttatttacagagtgatagctgaatattcactctgtgtcagtctttcttctagctcacccatttggtaattttactgttgactagcatctttactatataccagatctggattataacatgttcaaatggtgtgggtggtgggaaatcctgtgtctctaaatcatacagattggtattcaaacaccaggtccactgcttacaaactgagcctcatctaaagaaggaggatgattatgaagcacctacttcacagtgtggctgtgagaactaaatgcctaaaacctacaatacatccaaaaatagtggctataatcatttctgttccttttctccttcttaaagtgacagactgggactaataaagtccacaaaccacagattgtcaataaaatgttgtaaatccaagagtaagctaataaacaactgagaagaaggaagaagaataaagaagataagatcctaagaggaaaagatatttaacttttaatttttatctgcttttctgcttttgtaaagtttgatgcataaagctattgaaatctatgtgagcttaagtgtctttccctgatgaaataaataaaagacaattgcctgtgttattaagaaaaggcacatgttttcagaactgtcagtttctattattcaagtcagagagattttactttaatagtattagaggcagagtgaaaaatacatctatttccttcttaattttgatattttctatttgactctgaagcttaatttttaagttatatcacattaaaaatgctcaaataaaagacacatataagaaggtaaaagagtaaaaagaattttaaattaaatgagtccatttgcccatatttcacttccccaggtctcagtggtagcaatcttcacacactattaatgttctttagtcttttactccttacactcctgaggaattttatatccccacaagacacaaaaactctagaaatataaattaagagaaacactcacagaaaaacccaaagcagatctgacagaatgattcttagtacagaatacaggaaaaaaaaaaaaaaaaaaagtcctggcctatcattatactgtattactttaaataagttaaagtctcctggcccaaagaagctattataagataatttataatttagatggttaaatgaatgttcatgatctttgccaagttcaggacaataaatatagggggttcttccaaccctaggaatctgttattgtcactagacaaacaaggtaggcttgagaaaactgatatactttccccaggtagacgtgaagcttcttcatattgaattacagaagtaaagttttagtgaatactactttacataatttttctatcacggtcatttaagattttattcacaaggcagccaaaggcgaaaagcaaaaacagaagctagaacaaaacagtctttgggttaataatatatattcctttttttttttgagataaggtctcactttgttccccaggctggagtcagtgccacgatcttggctcactgcaacctccacctcctccgcctcctgggttcaagtgattctcatgcctcagccttctgagtagctgggaccacaggtgtgcaccaccacacctggctaatttttgtatttttagtagagatggggttttggcatgttggccaggctggtctcgaactcctggcctcaggtaatctgcccaccttggcttcccaaagtgctgggattacaggtgtgggccactgcacccagtcatatagttcatgtggagttttaaaattgtagtaatttaatcttgtatttaagttatacccttaataagtaccatattaaatgtggtaaaatgaagagtacggactaggtaagaggataagatctagaattagaaagacctggatttatacactgactctgcagtttgtcttttaacccattatactaccttatatctattcataataaattatgtatctgaataagtgtgtgtgcatgtgtaaataatacatacacacgcaccacagagttggtacaacgattaaatgagtacccagcacaatgcttggcagacactcaatagcaaactaagaaatcaggataatataggccaggcgcggtggctcacggctgtaatcccagcgctttgggaggccaaggcgggtggatcacgaggtcaggagatcgagaccatcctggctaatacagtgaaaccccatctctactaaaaacatgaaaaaaaaaattagctgtgcatggtggcaggcgcctgtagttccaggtattcgggaggctgaggcaggagaatggcgtgaacccaggaggcggagcttgcagtgagctgagatcgcgccactgcactccagcctgggcgacagagcgagactccgtctcaagaaaaaaaaaaagaaaaagaaaaaaaaagagaaatcaggatagtatagcagtaatttgatgaaaaattatggattcatatcataatatacgtcaatattaaatcctttctgataaactatttgaaatagtgacaaagaacatatacaaactctttgagaaagtattcttcactgcagaattaaatcacaagtaagaatcctgtaaaaaaatcaccttctcaaggccaaaacttacatttttagctgacatctcgttacaatggtactacgttctaatagattgtggaggtatataattacaacacttaaaagatgaaactaaatgaaaaataaaattcatagtgttaatagagtccaatgtaggagtgcttttttttttaatcccccaaactatgtagaaaacatccatggaggaagacatcagcgttaattcctaaaaaggctcctgtgctcatcaagaggcctccaaccactggaccactgcagttgccacataatctgtctgaagcaaattcttcctcttagcagttgctgaaggagtggtgacttcttattagcttcccttatgagaacatcttctatgctacgcaggatgtttcaagtaaccccaaagatgtttagttgtgcttcatcatcataaatgaagacttaacagggagaaattaagagtaccgttaaatttttcttatgcctgttaacatattgtcattcatttactcaagttcttcaaactctgacctccttttggctggaatgcaacaggatgaaggatgatatcttctcaaactgtgatgtttatttaaggatatctactactcaaagaaagaaaatgaatgtggtaggaatatcatgaaaataacacggaaaacatggctccagagaagcaacgtaaaaagtgtcttaccaggcccaagtagaaaatcaccctctttagacagttcattaaacttttcagagattaatcactagagagattatagcagtggctatgaaatttatggaagcattcccccagaaaaatgaacgcagacactgagccataaatgtaaagaactcaaaaggaagcaatctaccttccaaacaagtgttgaaaaggtctgaaggaatttggttgtctatgtcagccattatacggggaaacatgatgctcactgttctaaggggaaaaatgttcaaacatgtatactaaatgttgccctggggttctcattacttaattaacatgcacacataaaatctggagtgtgtacaacaacagctagccttaataataggtaagtcgcgtcagtctctttttctaatattctattttaagttgtgaaccttaatccaggtaagctgtctgtcatttggcaaagatgtgaggttttctcaggaaagggtaggtatgtaaggcagctctaacatgacctgatttttaactacctttcaagggatattttacaatgtttttgtgaacactctggtggattctgggaccttaagacgccattcctttggaaatatgtaattaataaagcgttatgggaaagatgtgtgatgacaatgtctttcttgagttatgctaatttgattacaataaatttaagtaaattctaaagtaattatttctttcaaataacagcatttccagtatttaaaggaactgtccccacaagagtcttctgaattgaatttaatttgtctattacttataatatgctcttaagtttaacaaaaagcaagcacaatgagttattcctaacacccaaattgatggggttttctcattactgaatctcatctgctcctaagtatgcttacattgtaatcaactgaaaaccctcagaatagcttttgcttaggatatacgttgtgcttactccacaggctggtctgaataaaagcaaagtgtagaacccaggacaagtcagacagtagcagtaccacactctctgtatataattcattgtccaacaccatatgagtgaagaaacaacacgaacgaccacacacaaaaccttcaagtcactaaatgatacacacaggaagctcagtaactccttcggggtaaattttattttaaatttctatttagacacatatgagaaggcatactagtactccacacattagttttaaaagcattggcccatggcaaatattcaaccctgactctatccttacttcatgggatggcataagacaggagtatcctccaaaatttctgacctccctaacattaatagctaaaatgactattctcgctaaagtaacattgactgaacatttcctaaacaaaacaattatgagcatcattctcaactaccaaaaacatcttaatagatgcaaaatattaaatcataaataaaaataatcacatataagctaactcactatcctactaaaccttgatagcataaaaatcagcttaaaataatcattaaattttattacaattaagtgctattataaataacatgcttgttttagtagtaaagtatcgcttaactaaagtgataaaagggggaaataattatttaaatgaattactatcaataccttatttaattcaaaagaattcagtggtttgtgcatttcactaaaacatcagatttaatttactgttatttttaaaaagtaaacgatatttacagattaatagcaagtatttaaaattttacaattttaaattacaatttatataaaaataaatgatcagaataaagtcagatgctggaatagtcatacatgtattaattcctatattataccattatttttagttcctgaaaataagttggctttttgtcatctcatccctttgctatgatttcgctggataattatgcactgaagttcattactcaaagcatccagttgttgaacagaatcaaaatcacccaacccaataaccacagagtaaagaattgaaagaaaattggatataaccatggatcttaacagaaacaagtaacaagcaaatagggcccaatattaagtgctaatgcaaaattccattgccttcttttcacttgcaaacctacacaatgtcaacattttctgaaactgattttgaataatccctcttattttcaagtataggaaaattaagatatattgatgagaaaaaaaattctatcatttccctttctaaatgctattttcaaatgaacaagatagatagatacctgtagaaaattgggcagtgagtacaggcagtgatgtaaactgtattagaacaccaaaaattcaaaataaaaacaaatttaaagatgcatattaaggccaggcatggtggctcacgcctgtaatcccagcactttgggaagctgaggtgtgcaaatcaccagcggtcaggagttccagaccagcctggccaacatggtgaaaccccatctctactaaaaatacaaaaaatagccaggcctggtggcacatgcctgtaataccagccactcaggaggctggggccagagaatcacttgaacccgggaggcggaggttgcagtgagctgagatcatgccattgcactccagcctcggtgacaagagtgagactccgtcacacacacacacacacacacacacacacacacacacacacacacacacagacacagatgtatattaatttaatcatttagtcctttaggaaatgaccttctatgaatgctatgagcactttctatgaacaaggccctatattaggtatatgtgaatcaccatgtacttccaaggaagtgtaatcactttcaataaaacacaggacataggaattctaaagttgaaacagctttgggtattctgttagataggaatacttttgaagactaacaatttttaaatattgcactagagagaggtgaagagttgaaaggattagagacagaaacaaaagacatcgctgctacgcacataattcattcagtgctgctggttacaaatgatatggtattcaagttactttttcaagcttttcatttttatgcataatttcttcaaagatgcctttggggatggacaatttcagccagtaaattattttttacataagcatttaggtatggctataaaatcatttttgcttgtatcatgttctcatcatccccaagaaaaaccccatcgtccccaagaagaaaaaggcctaacgttttgtgtttttagattttaacttcatctgaaataataatagaaacatgttaaaaccaactatttgagcgttaataaatttctaataatattcatattcaaagtagttcaaaattcataaaatataaatatcaaacagggagtacaaaaaaaccctgagatgtctattcatcacagcaaattcagctgagtgctctgaaactccccctgtcctttaaatgtcacaacagaggagtgaggacaattctcttcattcatcagaagaagatggggacctgaacgttttctaaatttcaagtctataagcatcttagttttccaggaagtccacgatcaagacgccaaatggtcagtttctggtgagacctctcctggcatgcagatggccacttcctagctgtgtcttcacgtagggaaaaagagagctctttcactccttcttcctcttaaggccatcaaccctatcaaatgaggatcttacccttatgacctcatttagccttaatttacttcctaaaaaccctatctccaaatatagtcatgttgggtgttaggacttcaacatatgaactgggggaagggcacaagttggtccataacttaaatcaaaaattatgtcctatgtcattcatgaaagtatgcgttatataaaggatttttgtgtcaagttattggttattgtgtgatgcccatttagccttagtttgaaaacttttaacaaagcagttaaaagtattcaatctatttgtttgaaataactccttccatgggtactctactaatgatggaattgtatcataagcatattaaacttgagaaagaaagaactgaaacagtcccttaccaccgctccatctgaatttatgttctgaagatggaagacatgaatcctggtatgtttaggctttgtgtccccacccaagtcttatcttgaattgtaatccccataatccccacatgtcaagggagagaccaggtgcagttaactagatcatgaaggtggtttcccccatgctcttctggtaatagtgagttcccatgagatctgatggtattataaattgcttttccccctttgttcagcacttccccttcctgctgccttgtgaagaaggtgccttgcttcctcttcgccttctgccataaatgtaagtttcctgaggcctccccaactatgctgcactgtgagtcaattaaacctctttcctttataaattacccagtcttaggcagttctttatagcagtatgaaaacaggctaggtatggtggctcatgcctgtaatcccagcactttggtaggtcaaggtgggcagaccacttgaaatcaggagtttgagaccagtctggccaacatagcgaaaccccgtctctactaaaaatacaaaattagccgggagtgatggcgggcacctgtaatcccagctactcgggaggctaaggcacgagaactgcttgaacccaggaggcggaggttgtagtgagccaagactgagccactgcattccagcctgggtaacaaaaaaaaaagaaaggaaggaaggaaagaaggaaaggagggagggagacaaatacaaatccccctaatgggtctcagttctctggggcttctcatgatgagaacacttccactacagtgtgtgattctagtatttaaaaacgagtattctttttcatcctgacccttgaatgcaaatcaaatactacatcttgtgcataacaggagaaataggagaatgctccactgttggaaagaaaactacagcatgaaagttctaaaatattttcaaagggaattttaactttttatgatttttctccttataggttgacttttttttaaccaccataatattcgctgtggttttagaagttttaccctttcaaaaactacatatacatacgtgtgtgtatagacagatactcacatttggaaggaaaaaatcctggtaacattttaaattatcatcatgaaaaagtatctcttgtgactgcaagttgaatatgttctatcttccagagatacactaaagacacataatctaatcaactcctaccaagataaaataggaagaagccctcacaccagccccttggctctcctttttttctgtgtttttctcctctttgtttctgagtgtatattgctcttgcacctttaatgctcagaaggaagatgaagcttcagctaaggccttactttttccttctcaagcctcatatttagaggggggaaaattagatgcaaaatcaccttttgattatatgcaaatttgtcaaatttttccattaaatggtatattaaggaaatagaggctgctgaagaattgggcatagtaaaagacctagatttgaactaattttatcattttatttctgactctggaggagtggctacctttgttgaaaatatgggaaaaatgaaaagacagatgaggcctacgaatcttcatattttagagtaaaaataagggaaacagaaagaaaaatatgtaagcaaatgtggtatgtttaaaggttaggatttcacacaatgcatttatttttctcactagttatgtttgacaatggggcttaatttaccaaggaagaaataaccatgacgtctttctactgtctagagaacaaatcaaagaattgtatttcatgagcagtgccttccaattaaaaaagaagaataaaggaaagagaaaagctcatatattctgttgagtgtgtagcaaatacatagtaccactgtggctatttaaacaattgaggctaatggaactaaggagaacttctaatgcaactgaaattgatgcaatggtacactttaatttttaagtgtttctcttaaatattctatgcaatagggattgagtgctcatttgattaacttattgcagggatggttgcgcaagaattaaatgtgctttggctggacattgacaatgaaatgaatctgaatatacttaaatgtgatatatactgttgctttgggtcaaaagttttttcatgagaaaatatcaccaattaactaaaatcaaagagaaaatgtcattttctcctcatttaggttcttttaggaatacattaactatattatcagtgcagcacctgtctttattaataatagatgtaaatgttggttctctgagctgtcaaacttacaactcaaacttcctaaagtaaatcgataactataatacatgactataataatgtagaactgtgagttctgcaaaatatctaataagttttgagtaccatttaatctgggagtttttgtttcaaaggacaacaatacctcagaaaaggtttatcactgatgagttgttcattattcaatgaagatttatcatacatatgctaaaattaaatggagtagggagggggctggagaattaatcatacagaaaagaagatgactgaatgatctatatgggggtagtaatccccacactgccagcgtttattccatagccagggtgccatgggaaccaaggggctgagtcgcccagtctttgggaggagtctcatctcagaggaaaccaggaagtcttccaggaggaccactggacattagccaggctaggggtgaagggcaggggcactgcaggccgttggagtgctcttgtacaattagccttagccagtgggcttggcactctcagcctgtgtaaccaaacccagaaggggtctagaaggcctttcaggacaccgtatgcttcagaataggagcggattctcagtccacagatggttcctgatagagtggctgggtggggtaagactattcttgggctcatctagtcttagagatctggagactcccagaggggtggaggagtaggatacttttggggccactacagtggtactgactcttcaaaaaaaaaaaaaagagagactgtaacttaaagtgatctaaatttattcatttttaagggaaaaagcacaacagaaagaacaatcactctgtctaccctttctcctcaacgctgcccctcgacatctccctgggagaagctgtaagactgccattgtttttgtacgacccccagatgcacaaagttgtggggagccttcacattgccatctcccctccagagccagatttgtctgtggcattagtgcactgaaagctgaggggtagggttgggtattctctggaggacaaagtgctaatgttcagtaattctgcaaacatatgaagacaacattgcctacctgccaagggtgtggcaccatgttctggcgaaaaaaactgcaactgatttcactcatccaagcaaattcttagggtgtaatgggagttgaaaaacatcatcttggaacctactaaagggacaaacatgatatgaaaatgattgggcgggagaggccatatttatgaatccttagtgaggctgttttatggttcagatattatggctttggctaatgtctgagtatatgtatacacagattttaataaaaacaaccgtgaaatttgagaatccacttcactgaaattatagaacaaatatatcttggatactacattttgcgtaaggctgcagtcattccctttaggtgaactgaaatgacactgctaccatgtcttttctgtacagaacagggaaacaatgacaataagaataaatgaattgtttaaccctgtgagcttcagaatgcttagcaaactactgtgaatcaaaagatactacagaacaatctttggctttacttgacagtatttaacaggtcttataagtctatttattttatttattagtcctttattttactcccaatgacctcatttccttctcctttgctatagtttacagcaaagcaatttgaaatagcaaatcaaaatattatccgaggacaaaatgtaataaatgcagaaattgagaataagtttttttagaaatttttgttgcagtgtgacatagctgtgactcccaaatatataatcagtggcttcatgtcactgaacgtacagactaaaattgccagttggtgatgaattagggaggaaacatgggtatttccccacaaatatttttattagtattggtttaaaacatctggcaattgtacataaaatatttttaaattcccttcagctatcaatatataaattattgcaaaatttattaggctaacactttctaacttgtactcttagatacagaataaagatattcttggtatctggaacactgtagttgcttccattgtctttggcaggttttcactaggagaatggtcagcgccataggtggtaaccacggcttagaagaaaagagaagaggtggatgggtcccaggagaggcagactgaaatacctatattctctcctaagcgtcccatggctccaggcaccacacatgagcttttttttttttttagatggcgtttcactctttttgcccaggctggagtgcaatggtgctatctaggctcaccgcaacctccctctcctgggttcaagcaattctcctgcctcagcctcctgagtagctgagattacaggcatgcgccaccacgcctggctaattttgtatttttagtagagacggggtttctccatgttggtcagagtggtctcgacctcccgacctcaggtgatccgcccgcctcggccttccaaagtgctgggattacagccatgagccaccgtacttggcctctacacataagctttagcatctggatacttcagctaatctgggacaggtccaatgaatatttccacagtttatcactttggaagttataggcttttttcaaaatcccctttaattgcttattagttctatagctctataaaggcaaatagcctcatcctgctcataggaactttagggaagtgctttacaatctccagccttcaagacattgagacaatgaaaaggcctttttttttttttaagtatatgtgtttcgcagtagcttaaatagacatttaccagatgtaaattttatcaggctttgtgttgaagagatttcttcaagtggtgattgttgactctaactgtaatgtattttatgatctctccagatagaataggagggaaaaatgagaatattaacccttcctctacctgctattagttaatcctaacaaatactctatgaaacatacatgctatagccaaaaaatacacactggtccgctatactagaagcaaaagaaatcagaatgggttaaaaaaaacaaggcaactagcctaatgatacgtacaatgaatttggccttcatttttctaggctctgggtttgcttttcacaaaaactggaatcaagttcctctaggcggttgacttaatgatttgaaaacagtagtataaacaaaacatgaagccacatgggagagacgaggaatttatatatgcaaagtcaacacatactttatggctaaataattttcatggttttaataatttaaaaaatgttcaaagctgaattaatagatgattttcatgttaaacctgggtaagcagaagtaaggtgtttaagaactcagagtcactgggcgtggtggctcacgcctgtaatcgcagcactttgagaggtcaaggtgggcggatcacgaggtcaggggatcaagaccatcctggctaacacagtgaaaccccgtcgctactaaaaaattagccaggcgtggtggcaggtgcctgtagtcccagctactcgggaggctcaggcatgagaatggtgtgaatccgggaggcggagcttgcagtgaactgagatcaagccactgcactccagcctgggcgacagagcgaggctccatctcaaaaaaaaaagagagaactcagagtcatataacctatacatggtactgccgagatcttgggctgcagctcctggtttctatactaagccatgttattatgctactttagcaatttctagccctagatctccttaataacaaaaatcaaaagcatgtcatggttagattctttgaattctgccactttcaggaagtagcacctctggtttggatagctaaaaggaatagcagaggtattaagccacaactgcacttaccacaaatattccactcttttaaaatataaacatgtgactgttaaaatataaacatgtgactcgtttccattggcattcaccgctttcacaaagacaatggaagaagccagtaacactgctacatctacaggaaacaaaaatgaaactaaatggctccaaatatatatatatatttgagtctcttaagttcaagtgattctcctgcctcaacctcctgagtagctaggattacagtcacatgacaccatgcccgactaatttttgtatttttagtagagatgaggcttcaccatgttggccagactggtcttgaactcctgacctcaagtgatctgcctgccttggcctcgcaaagtgctgggattataggcgtgagccactgtgcccagtcggctccaaatattaataagcataaccagggtactgtattttggatattagctgattgattgtacagttacaaaaatatgatgcatcctaggaactatccattgaaattttcctgttaagatagcaagatatactgccaactagcatgactgtttccagaaagcatatgggaaggtgataaagaaggggcaaataatagagcaaaacacaaaaagaccaagagaaaaaaacaattaattctacaattggggaattgtcaggacaaagatatgtataaattaagataaaggaatgtgaagtatgcagtgctgactgaagaggtcatatggggttgtcaaaactgggctatacgtatgtgactgaaatggcagaaaatgtgaagtaaacgagtaaaagaaaacctgcaagactaaattaaacagaacaaagacacatagtatgtacacatagtactttaaaacaaaactgtaaaaaaaaatcatctatttggccattgaaaacaagcattttcccatccttgcccactgttagcatgaaaatgatttactcagcttggtcagaggtagattaacctgatgaaacaaccaaggcaaaacccattctcaatgtgaaaagtaatgaggattttcctcagtttgtgtccaaggacaacactaggcagcacagccctagtgaagcataaactcctagcagacagaaagcttcctgagggcagctataatttgttgtttacatggaggcctagcagagtccttttcatactgtaagtgttctatgaatgtttattaaattaaattctacttaagtagctctcttttctaattagccttggcaatcaagtagtttattaaaataaaaaagtccaagtattttggaagtgaattttgtagcagcaaattcaggatgggaccaatgacctacaaattgagctgcagcaaaatattggctgggaacaaagtagatcctaaaggtggttttgtcagacaaagtgcaacaaatctcactgaagaacaacagtcatatggagtgttgtcgcatatgaatgattacttgaaatcagtgttagaatctcaaaaagaagtaacttggtaatgcaaagtaatgctattcaaagtgctgtaaaaagataaacaggtattctagtctcagctccagcaccccccgcctcaggaagctggctcagcccactgcagtccataacggtttttgccaactgaactcaaagccccattaatgcagaaaataattacaatctacccttgtggcatctattaacttttctttaatcatgttttgtctctccaattagactgtacgttaattaagggtaaagagtttcagacatttcttctgtagccatcacatctaatactatacaagggtgatttaatattagataataaatttaggtaatttacaacattaatagttactattaataggaaaaaaatcacataatcctccccataattatggaaaagcatttgataaacttcctcatccattcataataaaattcacttcacaatagaaaaggatatcttttataaaaaagttttttacctactacgagattaaaggcatttatctatttaaataagtaaatatcccacagaaaacatcacacttaaaggaaaaatgttgaaagcactccttttgtaagccagaggaagtcaggaacactttctgtcaccaatcctattcaaaattgtccaggagataccagtcaatgtaggtagacaagaaaaagtaatcaaaataagacatgaaaaggatgaaagaaattttcatctgctaatgaatttaatatgtgcaggcatgtattaatattatattcaaatgaatcaaaaggattaaaagtctaggttttctggctacaaaaaccaacatacgaatgtatatttcttgtattttatagcaacaattagaaaatgtcactttatgcacaaagatttgcaaaattttaaaacccagataataccatatactgataaggatataaacaaatggaaattcttatctactctgggaaacttcttggtagtacctaataaggttggatatgcatataccctataactctttctattcttaggtacataccattgagaaatggttgtacatatacaaatgttacattcattaacattcacagcatcagtgtttgtaatgtccaaataatgaaaccaacccaaatgtccatcaacagtagaatgaataaatcaattgtgatacactcaatatgatggaatattacacagcaataaagacgaataaaccatagcctcagagatgagtatggatgaatctcaaaataataatgaacaaaaatagaagaccacagaagaatgcatttagcatgattcccaatttatataaagttaaaaatataagatggctattacatatattatttggagatgtatatatgggtggcagaagtattgaaaagcaaaaaaaaagaaacaggcaacacaaaattcaaggcagtggttacttctaggtgggaggtagaggatgcatgaaaatgaggggctcagagaataatacagcacagggagttttctatttctatttcttaatgtgggtagtggagacattgccatttgctctaatactactctttaaactacatacacatgttccatacattatacattttttatatatcacagaaaaggaagaaggaagaaaggaaagaaagggaaagaaggaaaggaggagggagagaggaggataggaaaaggaaagataaaaaaggataattataaaatccttggaatgctaaggaaaagaagcttgccatgggactctcttttaaatgaaagtacacatacttctacaaacactacttagcaagaaatatgcacaacacaaccacaaggggctataacaagacatcacgcttagggctgagattagactcctttcactaaaattgatgagtcatttgtcacaatacagatgttttatggctgaaaggaatgactgaaaacactggtattttcttatgtaaaaaacaagagtttctccagattaaatttcctctaaaatttttaagtactaggttgaaaaccagaggaatctactttcacttttcttcaattatttgcaataaaacaagaatatatatcagaccatggggaaaatctttttcttccacactttggaaatctaaaaggtactacttttatgtactaccatctaccataattagatttaatctaaattgtgctattgagaggcgagaaacgcaattaaagtgtcaacactcccaagaccagccaaacaaccttttggcaaatgctaatataaatgttttcataacctatgttttttaaggtcactattcaaattccatagttatacatatctctgttttcagagactttatttctcaggttttgaagggctggagaatgttactcaaacataaggtcggtaaagaaattttagcttagaagtctcctataatgctacagagctgtagtctgtagcagtcctacagggcactgctcatatgcagtaagcaaaggtggggcatggggaggaggaagaaaacagatccagagactgtctgcagagcatctgttccagcaacccagttgtgggccttctcctggaccagtaaaactccatctggtatgggaagctaactgttccccaggtggtgtgcccacctgtcaactgacagtcgggcttgtgccactaagaacaagggcagacacattttggcacagacctttggagcatttctttaacttaatggctgagcaagacttgagatgaagagatgaggaaacacagaaaaaaaaaaaatgcaatgggccctgctggtcccaggcatcagctagggaatctaggtcacgcctacaacaggcgtctgatggggtataccatagagggcggagagtggcagggaatggtgccagcctctgcctttctgggcttgccagcccttggcagggattctggaaaatgagacatcccaagtcaaatgcatttccgcacattcctctccctctcctgcctctagctacttacatgtggttaatagactgctcaaattgaaaacacacacacacacacacacacacaccaccaccaccaccaccatcaccaggatatggaatctatacacgttcgttccggaatgtttaggttgaaaatacacgtacaaatatagtctcctggtgaagctctgtgctatgtatttattccaagtgatgtccacaatctttttggaattcttctggcatctggctttagaatccttggcatattcttgtcaataccctcaggtgatgaaagatgttttattctaaagagtacattttatttaccaggcttatggaattagatgctccatcaatccatattgaatataagaataaatggatgggtgaaacaagcacatacctatagttcttagacaaattcctaatgaaatgaatgaccaagcatggaatgtacaattttttaattttaaaaaagcaaacaaaaaataaaaaatagagattttcttgtatggctcatatggtagaacccagaagaccatttcagtggaacaaaggagaccactgaaataaccagagaaccactcaaggtgatcctggatataggggctattaaccttttaatctttgcattattccttaaagcgtttagatccatttgctccttgtcttctcctatcctctagtcctgaaatcaccagggcaccaagcctcgagaggctgctctctcccttactgggctgggtttctaagatatctctgaccagatctcagagataactccaatccagaggatctttaggcggatctttattctgccaaatcctacactgatactaattttcaaacttagatgtattttaaataggaaaagaagacccaaattatatcattttaacttaccttattttttcctgtaaaacaatatatcataaattttaaaagtctctgtgcttagaagaaggtggcattcatacatttctggggtgtcttttaaagagccttattggtccatagttacatcccatacacatatatattataggcacatttacatgcagacatataaaggaagtattcataaaggatgagtgatgaacaaacacaaagccatgctttgatgttaaagatgcagtgcttcactgttgagaaggatgtgtaattgaattcttggtaatcactgagaatggtgtctattgttgaatgtagagtgctcacagaagtcttgcctagggagtttgctctgttctaaggtgaattctccatagctcaactcaaacatgaaaggtgtcctggcattgagccaaatgcctaggccagggtgttctctggatcctgctggggtcactgaaagaccaaagaaagcaccccaaacctggcctgacatgaaccgagaaaacttgggcagcatttggccccagggtaaggatgtgacagagcctgctcattctccctgcactcactttggcacacattcagcaatgctctatttgattgctacctttccctaataaagagctaggcttttagtggatgttctgattctcataatgcaaagacagaaggtatgtgtgaaagtctccagtaacactatgcttcctgcacatagtctacccattaaatgactgacttggatttcttgcaaagattgaatgctggaggtaatttaataatttaagtataatataaacatttaaagttaaaaaaaaaaaaaagaaaaaagactgatctgggttattaaactttttaaatatgaaagtgatttctgaaaaatgtgcaaaaatgacttttactcttttcttacttaaataccattatcatacaatattcaagtgattttgctattggtgggaagtttagaatgcatcctgatgaatatcaaggatctgctataaaaacagattctcttaaatataatttatgtgcatgcaacacacacagtgtttaaaatccacattcttaagtgcagatgtgttttcagtgtggtctcagagtgaaggtttctatacagggtttagtctgagaaacaactcgggaaacagatgaaaggcatttcagatgattaccctagagacacagtggttctcaagacttgaggcatataggccatcctgggctagtagacaaatttttgacatttaccacctgcttagcaaatgtcataccagttcattttgatactcaccaaatttgtgacttcctagaccagaccacgtagagtctcatatggcttttatttggattgccttaaaaattgccatattttcccaatacctaatagtacttcaatttcttaaaatacagaggaaaaaaagaataattttgctaattaaatcctgtcagaagtacatgaattctgttttaaaacaacaatattaaagatttttgattaggaataaaacatggaaattcccaactaagatataacatagcacaaaaaaaaaaaaccagtaatgatatagagactacacaaaggtaaaataacagcaacaaaaaaggcactggggtatataattcatatatgtattttaagtaactattaccattttctcttaaatgccctaataaaataaagcattttaagatatgctataataccttaataataattcattaccattatctacatgattcattttacctacctctaaaagagaattactatcactttgctataaagcaaacagttctgaaaactacccacttggaatgctgtacagtgaccaggcctgggtctgtattgctcactactctacatccaggacacaatgcactgtttgtcccatcataagcactgaataaatttgttcatctgacaagtatttatgagcatctactatgtttaaggagctgttctaggcacctatatatacatcaataatcaaaacaaagatacctgcccaatggatattgccgacttgctaaaagttagatcagcagccttctttgaatatcaactacttctgacatagagatgtggcacaactatatgaatgaaagaagaaaacagtgtgaaatcaagactcgaaattcttttgagaactaagatatattttctaatgcctctgtccttcagtgggcctgcagtgggcttgcataggacagggaaaaggatttaggaattcactgccactttgaggtcatatgagttgatctaaaatctcagttcatctttcctccatcatatgttacctgggtcacagagggcatgaatttaataagaggtattaaaaaaaggaactactatctaatgacaaggccgccttttaaactctgtaatagttgtttcctgtttatgcataggaagatgtatatttagaaaatttatagttctttttagaatggctaacaattaccagaatatgacacgttttatagccccgtgccttttcttaaactcttccctttgtccccaaagacccttttctactgtccttttcccttctcatctcttgtttgttaaactgatgaatgaaaaaacacgtgaatgaatggaggttgagagctgctaaaggctggttacaaccaggaaagcttagggaggaagctggatgtttacagaaatggctttaggtgtcattagttctgtaatgtagtcctgtgttgtttctgaaaacaaagatagacaggacagtaagttaagcccaaatcagcaggctttctccccccaagtactagaatacaatagccactctgtctcacaaatatataaaaacacacttggcttagtttcttcaatatattactctcatttcaattgagctcatttgtaaaaagggcccatctgcaaaatggcaactggggcctgtccaagtagcaaaaaacataaaaaaaacatccaaagagaaaaaaacttgaatcaagacttcaaagttaaaaaaaaaaaattagattacattttaaaaatcaaataataaaatgtttttgttatttttaaaaaaatttaatgacaggagattgttgtggtagaatgaaagagcatatcacacaaagtccaaagagtcaggtttaggtcagtattagaagttggatcttgcataatttattacttcatttttgtggaccttaagtctttcatttataaaatggataaggagataataccacatttcccagaacaatcaggagaagtgcctgatacaatgtatgtgaaacatacttaccactgttcatgttagttcatattaatttcagttcctcctctgcactccttagtactctttacatatttccagtggcttttaccataatatattgtgattatctgttatatgtaggttattaatctttgtacctgtcattctgttattcatttttgtacctccttacacaatggtggcacacaataagtgtgcaaaaaatattgtttgaagagaatgaacacaagttgttttgttaaatgagcaatgacatttcatttcatttcattttttattttttagaaaccaagtcttgtcccgtcacccaggctggagtgcagtggtgccatcttggctcactgcaaccaactcctgggttcaagtgattttcctgcctcagcctcctgagtagctggaattacaggcacccgccaccacacccagctaatttttgtatttttagtagagatggggtttcaccatgttggccaggttggtctcaaactcctgacctcaagtgattcatccaccttggcctcccatgtgctgggattacaggtgtgagccaccgtgcccggcctaataatgacattttaaaaacacagaagtatgcttaaaattctaaaccaaggtatttctcatctttgaaaaagttgcttttgccaatttgtagataggcaggcctatctacaaacaggacagttttctacagctaagtcttcacatactggttactatgtaaggcttaaatttggtctatttaatgttgaacaaaattctttatcctgttgaacaaaattattcttaacacagccagagtacctgaatcaagactatgggagtagccagtccatctcctgggcacccttactgcacaaagaaaacaagttacatatattttatagctctaaggcaacaactacccatggagtaacttatgtctaacacaggccgggcacagtggctcatgaggtcaagagatcaagaccatcctggccaacatggtgaaacctcgtctgtactaaaaatagaaaacaattaactgggtttgatggcacacacctgtagtcccagctactcgggaggctgaggcaggagaatcgcttgaagctgggaggcggaggctgcagtgagctgagatcacatcactgcactacagcctggtgacagagtgagactccatctcaaaaaacaaacaaacaaacaaaaaacttatgtctgccacaaccagccaataacactgccatttgtttaggcttccatttttacttcaaacacaaagttttagattctctctctatcttaactaaaatcaagaagctggcactaccaaatgttatttaattctatagtgagatggcttttaattggctagtcttacaaaaatggtagtcaaatacaagcataattgtgatcaataactgtaaaatagtttgtagtatataaattccaaaattcttttgaatatgaagaaaattttacattcaagtagatcacttttaggttcctataataacatttaagcttggtaacatgctaccagaacttggttattttttggtaagccatctttttcatctaaaaggagtaaaagaagaataagatgtaaaatatactcatttaagcttaaggtggaggaaggaagaactttaaaacctaatttggtttgaccaattaacgttctgattgtactctacagggagagcacacaaagtgtatacatgcacacacagacatcagtgctgatgtgcagggacaaatttaagagctacctcccattatgaggacataaattcacaaacacactcctacagcatttccaaatggaaagcatgggcatctcattaggggtcgaacatagggcataaaaaagtacaacgaccttgctgggtttggcttctctttcacatctaagttccttgtaaaacaggccaaccatgagaggatgtttaaaacctgtagcattaaaaaagaatctagggtcatataattatttcataaatatctgtaagactgaggaaagttggatgctcctctgtttcctgcaattcaaaggtaagtgaaaaccaactttggaattaatagctttcagagatctgaaagcgttctaataccaggattttcaatgctgcaatttaacgacaaccctgctgttggccttttctgacctgttgtgaagtaaatcaggcaaactaatgtgggctaacaagtctttttcacaccgttcgatccccctgcttctcttttctccgcagacatcgcctttctcccactttctgtctagccatcctccgtcaaagcacacaaaatggccactgtaaccctgcatcactgctcattagatcacaggttagtcaagtggaactgcccggggttcccaaaggagagctatacttcaaaaatctgtccatgtcaaatgaagaaaaaaaccctgagcgtggggtcacccagatcaatgatcaaaagaaactgagaatgaagggggaaaaaagcacaccctcgtttttgttaaaaacacacaggtctgatttattataaggaatacagagatacgatggggtttcctcctcttctgccctgttttcattttttaactaagtaatttgttttaatcaggtcctgttggttgttaaacttcagactttggaaagtctacaactaatccttaaaatttcccccaaagaaaacccattctaggaaatccagttttaaggaggactcctaaatgtttccaaaaacacttgaaaagcaataaaagtaatacaaagtaatccatctttaatgcttgagaagattctatttaaatctgagagtaagagttggtgcgacatacactttaatatgctttaaaataatccgagtaacctcttgagccttcaaagaggggaaacaacaatctgtcaatcacgttaggagcacacacaagtgacatactataaaaaggcagatttctggattttggtgaggctgcaaagatatgcaggtaggcctataccttgtttaatcatctccctcatttcttctatgctattcaaagtacaacattctatatttgcatttgtactttttgaaaaaataacactactaatataacagtaccgcaaacttgacatattaaaaatgagggcagaatgatatatctggaacatcttaaagaacaagacttggtatcaaatttcacaagtgaaaatcaccaaaagatttggttttcctggtttcctcataactagagagaaaagtacattttatcggctaatgattaaaaaaaaatttctgcccgcaataccacatatatgaatgaaagtaaaataagttaactgcttataatttaacctagcaaaagttgtaagggttgtgtaagggctttatagctttgcagtattttcttttttacatttggaatttattctttaagtaccctcaaaggaatataaatatattcctttgtgactaaattaaatattttttgtttgacttttgtgtatttaaaaagcactcccatgacacttactctataccagacactgatataattgccttatggaacattaactcattcaaccctcaaaacaaccctgtcaggaggagggggaagaaagcagggagcaactgttaataatgagtaagactctctatgtgctatgccctcctttaatcctcaccattcactacaaggtaggttctagaattagccccattttacagatgagaaaacagacttttaagtttttgcccaatataatttagatggtcaacagtgagaaggatttaaatccaaaagttctgacttcccagtcttactgtttgtcatctccaaaccaaagtgccaagttaaatattcatcaagttaaacctgggtatatcctgtgacccccccgtaactgcaattttacatgtattcacttgagaaatgcttgcatatacaaggagacatgtacaaagatatttatcaacagctctgtttataatcacaaaaaatctagaaagaacttaaatataaagaaaacaccagaacattttttaaaaagctgtaaggcatcacatataaatttttatcacacaaaccattatcatatattatttagagacacatgtatatgtagtcaaagcatagaaatgtacactgggaaagatacacaccaactttaagatatttcttgcttctgaaggagaaaggatgggaaaatgatgaggaagggaaaggaaggggctttaaatgcagctttcatgatttgtttcattaaagaaaagatctgaaacaaacatgataaaatgttaacattttatcacgggtaatgggttggatgggtttgtctgatattttctatacttacctatatgtttgaaatttttcataataaacacggtatgactgcttagatgtttacctcatgcaatcacaaataaattgtgaaattactgcacatggttcctctaagtcctctccctcatttgactcagtaaactgctaaaaattcataccttggtaacaagttagagattaaactattaaaattaattttcttaaaagtgttttagaagtaccatctttaagaaaatcactaaatttgaaggaatttaatgaattcaaatacggactatattaatatatagtctatgtttcattttgttgctaaagaaaattcattaagttggcatttctaaccttttgacattcaaagtttagtaataaagcagcctggtttcagactgagaattgtaaattagagctgaacagggcacttgactagaaaagtgaactacttttcactgtatacctttttgtaaaattgtaccacatggctttattaatcattcaggctgattattaaaataagattgaagatttaaaaattatgtaatatcacatggggatccaaatgaaaatgatagaaatacattttctatagaaccttagttagtcatacaatcttaattgacagaggatggatcaagcaatctcaactacaattctttacaaatgtatgcatatttgtaaacaaaatgagtgagagaagagttgttattctaaaaataattgtggtgaaagtaaacccacaaattacagccacaactcttcctttaacatcttaaaaatatgatacaactttaaataacatatatttttcagttcggctttaccaggctaaagaaacatatgacaaaattttgactaactagagtataaataaaaacaaataatgaaagaattataatttttgtattccatttttaacagatgaaattacaaaattacagattcatattgagtgttttataaaaaagcaatgtctaggacctaaaagtcagtcattgcttcaacaaaattattttctgcatctacactgctagaactaatgttctaaataattgaagggctactacaacattcagaataattaaagaagcctgtatttccctagagcagaaaactgtgctgtattagcttaaaactgtattagtttaaaagatttaacaatatgaaaagaaaacaaggagcttctctggtaaagaaaaaaagatagctatagtgctcaaaaacatttccattaacagtaacaggccattcattactcaagtacctgatgacctcatgctttgccttaaaatctattctcattttttcacttaaaaaatggacttaatttgcttattaacataagtcattaaaaagccagtgttaagaaaacagaaaaatgtcccaacttatacttaaagaaaaacatcaaagttaatatgcaaaattggtatccaaaatatgcagaaacatgtatttccatattcatggctgtctatttaaataatttacatattaaacatttaaataattcaaatatttacacttaactctccaataaatttgaccaatactattttattttttgttttgtttttttttttgagacagagtctcactctgtcacttagactggagtgcagtgatgagatcttggctcactgcaacctctgcctcctgggttcaagtaattctcatgcctcagccttccaagtagctggaattacaggcgtgcaccaccacgcccggctaatttttgtattttagtagagaatgggtttcaccatgtcggccaggcttgtctcaaactcctggcttcatgtgatccacccgccttggcctcctaaactgctggcattacaggtgtgagtcaccatgtctggcctaataaataccactttaaatgaaactatatgaaaactgagtaaaatgtaaatctttatgtataacaagaaagaaagtgttctttctaaacaatttgtgccatgttttggaaaatcgggacatttatctggacacagtgatttgctttcccataataataataataacagtagtaacaatagtgttttgtgcatatacattgtacctccatctcaagatcttttttggcctatttttcaggatccctctaatgattattcagtcttctcttcaatgaaatatgctaacgcctgatgagagagcatctttctttcatagcacagttaacaactgtaattcttcaaccagctgttctctaaggattcccctgacaagctcttattttcattgcattatttctttgttctccttgtctaaactgtacacaagttacccagattttccactctggcccctttcaataaagaactgctttggcttgacaaataattagtcataaccagtattaaaaaataaatattacaaattctacatgctaaaattatattgttctatgtgacttctaaattacttaacagttcatatgtagaaccttcttcccataaggctccattggtttaacttctcatttatgaaaacaatcccagttattttatggagctagttaccatgtaaacattatagcccataatcttatgtcaggtgtagcatgaactaaaactcaatctatgtatactgtgtttagggcaactgaatccagatacttgaacatattaagatataagcctaaataaaacaaaattaaaccctacttgactcttctcctttgtaacctagtaaaaaacttgtaaattttttttttgttgtcaaatatttatatgtgtaccaatttagatcttggaatttctactaaagaaagtaattaccacttcactattagatactgtgataacaaacacagcaaagaccataacaggcccagtcagttgaaagctatgtgctaccttcaaaatgagatatttttcttcattagacctttgtagtataccttcttattggtattgaaggtgtgcctcatatcttcactcaaaactactagataaccttttttcatggtatcaatcctcgaagtggtaatgtgactattgaaataatagagtcatggctgaatataaaattctatataaagagatattattaaagaaaaagaatgagagactgtagataccaataaacaaaagtgaaaggaggtactataaacaaattactcaggtttggattagttcatttccaagcctatgtacactggaagagtggccacttctaagttgcattcagtctattacatgtaccgttgtacatgtccagttcattgttttcatcaaaggcacatgcaattcataggtaaggaaaaaataaagtggcaaggagaaaaagcctgtttctaagtaggagagtattctattcattgcaaaagatgaaagcaggtatctcttattacatgtttttgttctcagaggaacaaggccaaaaatatgtgattttcgtatttgtgctaacgcagcagaacttttcaaagtcactgccagaaatggaccagctttcttacctgttttttccatgctttaagttaaggatgtctgcctcattatgaacattgctggttcccccagacttctgtagtctggctttgctgtgattactggtcaaaacctttaattacagtatatagtttgtgcagctgcctggaaattggtctcagggtcagtggctcttcccgttcccctctttccattcttttgaagcaatattgctgaactgaaggcattgttccagctttctggtgtgctctgtctgctgcacattatgaatagctttgcaatcactctagcaattggttcttcaactgcctttaggttgtcaattgtaattcattggcttcaggcaccttttctcttttcattctcttgaggtcttttattacttaatttgcaataatattagggaatgtcttcttcagacatgtcactaatgccttactgattatgaggctgggggtacatttgactttcatacatgcgcctgttaaaatgtttcaatatttccttcatctctgtgacttgtgatgccaatatttgcagtaccttgcaaagaagtttgcttaatgctgaagtcttctctctaaagaataatctaaagactcctccttaagatattcttattggggttaatttatataattagttatagttatttttataacttcccaaagatatgatttctcatttttataataggaactaagatttcatattttcttcccatattatgccctattcttttttaacatataaaaattataatttcaagctccacacaactcagagatactgaagtagaaatcaatggctatgttttcagaaccttttaagaagacctgtatttgctcctcagacatatttgtagagattatataagaaaatattaagactattcaaaatgagtgacaatgcttctgcattacagaatcaagaggaagttttgtttctgttttttcaggggaaggaataaacaaatatatctcttgctccattaagaaaaaaagtaaaccatttgtgcattatgtctcaaatccttagttctggataaaatccaacagattaacccttctcattagtctcagccatctcagagcaaccaagggtattttaaagcagacactatgtaataataataatgataataattatcataattataataactaacgcttattgtgctttttatcttcaaagtaccttactgacattaactatgtctctattttcaaattaatttacctcgacaaatgttttattaactttgtaagctatggaatgtgtagtgactgagttctcttttgcaaataaaaaaataaatgaaaggaactaagggacaaggaaagggtaccttaaacttttgcctcaaatcagccattgcctttgttgaatgaggattaatgaaatgctaatttttataaaatataatattaacatacagatctaaagtgtgaagatcaccactacaacaacacaaatacatactacctcaaaaagattagaaagtagccaaataatattgtttggataaaatcagtctctaactttactagttatgattcattataaaatatttaaatatgcatacaaagtattaaatataagaattttttaaaatccttctaagtttcacttacgtaataaatgattttattaattaaaaggctacatttttttatttgtttgttttttgagacagagccgcactctgtcacccaggctacaatgcagttgtgtgatcttggctcactgcagtctccacctcccgagttcaagcaattctcctgcctcagcctcccaagtagctgggactacaggggcgcgccaccatgcccagctaatttttctgcttttagtagagacggagtttcactatgttggtcacgctggtctcgaactcctgacctcaagtgatttgcctgcctcggcctcatttgtttttaataaattgaattcatcactttaaaaccatgtcattatgttcccttagagcttcattatgtaccagtctctatgtgataaatctaaacaggaaaaaaatagattttgatgctagcaaacaacataagttctataagataaatataagcaattattttaaaatgtattaaaagaatatcatttggccaagatgtccagccaatttctatgagggattttggaaagagaatagtaccctgatatggtgttaaaaaaagtccacaaatagacaaacacaaatgtagaaacataaaatcaaacatttgtaaatacgataattaacaagttgaatctttttaaaactatgtattaacatggttagagtggtgaggattcgaggaagatgtggtttgtaagcaatattaacaggtcaggtttggtgtttcaggaaaataaaaatttttatattcaaggataaaaatagatgcattggcttgagtaaagagagagtaaggaaatctggataaagttgatggtatgaaggcagtaagaaaggatgtatggtaagattcggaggtagtcactctttcaaacaaaatacagttatcccttggtatcttttgaggatgggttccagaatctcccatggataccaaaatctgagacgcataaatccctgatatcaaatggaggagtattatcatataacctatgcacatcctcccatatactttaaatcatctctagattacttataatacctaataatgtaaatgctacgtatatagttgttatactgtattatttagggaatattgacaaatagactatacgtgttgaattcagagaatggtgtttttccctgaatattttcaattggttgttggttgaatacatgaatgcagaactcacagatatggagggttgactgtttattgaccacagagacataaacaagccgtaattcctgtccttcaacaaacttacaaccttaaggagtagacagagaagttataggcgaaattctaatattatgatttggataagcgcaggttgccaagggaaatcagatgagagagcccaactttggcatgggcattcaagactacttcctgatgtaatacatcatcttgagggggttgtattagtccatttttacactgatgataaagacatactcaagactgggaagaaagagaggtttaactgaacttacagttccacatggctggggaggcctcagaatcacggtgggaggtgaaaggtacttcttccatggtggtggcaagagaaaaatgaagaaggggctaaagcggaaccccgtgataaatccatcagatcttgtgagacttactaccacgagaatagcacaggaaagactggcccccacgattcaattgcctcctcctggctccctcccacaacacgtgagaattctgggagatacaattcaagttgagatttaggtaggggcacagccaaactacatcaggggttttcctagtgaattaggaatagtgagtggtacataagcataagtgagtgaagaaaaaggaatccgatgcacattaacatagaagatctgtggaattacattcgattccagaagggattaaaagattattaatattagaaggttttaaaatatgggtatcatgaaacttcgataggaagtttgcttgttctgctctgtgttgaaaaatagtgagaaaagaggagatctaggggtgtaaactattaggaaactctgagaagcacttcagaggcagaagtgggagaatgagactgtgaaaagtctagatgtggagaataaaaaagagtacgaattgaaaaaggcttcaaaatgttcactttacataaaatgaagatatgtatgtgactgaaggaagatagtggaaaggaatgggggttttaaaagagaacataataaattactttttgtatatacattgacatatattgagatgtataactttattaccctcacctaaataatttgcttgataaaatggacatttcttatataacgtatttgctcatggaaattttgcttttggtggacaaggcacactttaatcatattgcttggtagatgcaagaaacacaggtatacagaggaaaaaacagtgagatcaaggtggatagacatagaatcaagaaaatcaggtatacaaaattaattttatcaaagaatgcatatagaaataaatgaattaatgtataataaataaaatattctggctgttttagtacttacagcttaaaagttgctcttcaaaatacacttaaaataatgacattcttatacctaatgaaatgattgctaattcagaaatatttatttctcttgataaatattttcaagagatagctgagtcattcagtggaaaattgacttccaaaccctctcattgtttcctcaatatttaattgtaacagcgtgcagtgcatctgtaaggaatgaacgaaaaacagtttgtatctctcataccattttagaataagtatacgtcccataggggaattttcaagctgctcacaccataggtatgtacactgctccatgtgaaatcaaatcagtattctaaaatgctgccaagaggcaggtcaagatacttggaaaactcttaagatttagagtatatgacactttccaatgattattttacaaacacatttctctacacatacagaaagcagtattaaattaagctaagcattttacacgatttaaacactgctttgcattttttaataaaagatttgtcacatgaagtcagagaagatactcagtacttcataaagctaccaaaaaagaaatgatctgttatcaagcaatataaatataaaataatttaaactatagtttattatctagagacacagattgcccaagaatttcagtctttcaaaactctgtctgatcctttgtagaaaggaaaaaaagtacacaaggtagaaataatcacctataaataagtagttataattaaatgtgatagttaaataccatagaaacacactagcaccctcttccagaagatgtctaatactaaaaagcgaaaattaaataaactcttcatgcacagagtaatgaatgcattgttcaaaaaaatctgaatatttataaccaaaataaaacatggtctaaaaaaccagtaatgtttatatcattacaaaaatacttgcaaatacttttctcgcatttatatcttgtttttcaaacataacacaaagttctatgcatgtcataataacaaactgaattaaaattgcataaaaattgagaaatggcctgatcacaaattttaactttaatgttgacaccctaatttagaagctgtattttcctgtgttaatgagccgtggaacaaatagagccattcaaccttataattctgcctcaaaactctgtttcacagtcttcatatttctcaattagtatttgctttaatagaaaatattcaacaaatacttaacactgtacttttgatatactatttctgaaaaagttaaatacttttggattaaggatatagacaaacatcaaatcagatgacattgctagaaaatatagactgtttcatgttaacaaaacgtgttcttttataagacacaatgtccagtaaaatgaaaataagattttaaaaaccaggaggtaaaagaatcacaatcagcaactgtgtagaaggaaaataggattacatttattggctactatatcaacttaacttctcataaaaccctcctgatctattaaataacttcagaactgaagtatgctctcctatgggagttgtaaaacaaattagttacaattacaattcaatacaaatgagaaaccaacctatttacccttaagatttctctcattttatagctttatcatttaaattagatcagaattttccctaatgtaccaagtgggccacttgacataataataaatttttctcgaatgctttctatagagaaaaatagttgatatgagtaaattctggaattcacctccccaaagtgaatacaacaaacatctgttgcaagaattgcttggctttcagacagtatgtaaagggtgttctttttcctagagttttgctgttgttgttgtttttttaagcttgtttaaaaatacatgttttcactatcagctctcaagacataaaatcttaaaattctggtaagttaaacccaggtcattaccaggtatattacagaaagaaaaaatatgtaatgtacaagactacacttgcttttgaaagggcaagaaaataattgggcatgttgccctctctctgtgggttacatagtaattttaaccattgtcttcatttcttaattcagtgctccacacaaacatagcaacactcatagtaggggaggggactacatatacaacttccttatgatttttattctctttggagtcccactgataatttgactttctcttttgaatttcactggcttctccccacttctaaagtcaacagtatccagacacactcatcaaccaatagtgtgtttgtacagtttcactccagtgacaggataaattattgcacattttctgcattaaacataaaatgtaataatttcaatggagtgagaagaagaatcaatagcctttatgactgattatcttttctaactgaatcaaagtttagtgctttttggtaagttgaatgcaccttccttgattctgacagatcagaattttgcctaaaattcacaagtattttgcagattaaaataccatctttttagcattggtaaattccataaaacatacacaaattagcaggtgcaaatgagtaagaatgcttatcagcaatagggcacaggatgtgcaacacctttaggaaagagagaataaaaagacgaccgttatctaaatacatttctagtaacacatgactttgctcacttttcaatcttctactgcctcttctataataccaatgcctgctcccaacgattttaaagttattgtttacaaaatgtttaagattcaattccacaactccatttttatgccaacaataaggtactgatttaattcttaaaacattcctgagagcatttcaacaaggcattttaatacagtacacagagaaacttctctgtcatcaagaaatgggaaaaatctaggatatatccttttctttttaggccagacccaaagtaagtataaccatgtcactgtgcttccataaacttcaagacttataatggaattagcccatgtatcccattaaagcagtctaaagtgtagacatgcacctgtatggtatatgtttatttaattatggggaaaaatgctttacttaaagcagtccccatattggtattatgcaaattccattacaagcaaaagttttgagaaaagtaaatttaaaatggatacaaataaaaaggaaactcaaagccacatatgctccagtatacacaagtttagaatcattttcagaccatatctatgacaacgctacatttataactatcagtcttactgaaagatgaatcacaaaaagaaggaaaaagatatttgctctttacctaggaaagacagccagtcaacacacacaaggaatactcagaagcaattaattgctaaaagcttcctttattcaatgtgatcatctttcattcctatggagggtaaccataagtcatatgttaggtttaaagatacattactttcaattatatgatgtctaaggaaaacagatacacaggttcataactttaaaagcagaaagaaaaaatcttttttcagatattgcaaataacttgaataaagttatctgaagttaaaatggcacttatatctatgttttatcaatgtgtatatgtattatgtatatattacatacacacattatactgtctacatgtagtagtgtacacatacatattacaagattttttagaatgaatagctgaataacaatgcattctcagcaaacgaccttataatcataaactacccttcattacatactattatatctactctataggcagaaaaactgatgctgagaagttaaaagatttacaaactaaggtcttaaaagcacattaggagacaccatcattataatgctgaagatcttcacattaatgactttctgaatagatttttattgctgttttttacttaattacttaatattatctataaggtatttttcaaactctattctttaaaaggtgctacgtacttaatgctgaatgaggcaactaaagtgagacatgagctctgtctgttgaataatgggtccttgcctttcttttttttaaactgtgtttctaaaatttgaataaaaactctatttatatggttcttctacttaggtgtttaaacttcaaagtaaattatccaaattaatcctattaacttatcataataaattggattattctcattttagaggtgagaagccaggcacaagaataggctatctgccgtgggtcacacactaagtgtgagggaggtctggagttagaacatgttatgtccttggctcctcatttatttttcaggctgaaaggcaagattgttcatattaatcatctcattccaaaatcacttgaggaagcatgcaattttctgaaggagaggggaaatcatatcctgaaagttacaagtataaaggaatacatcaggagttttgatttcactgtacttacgttataattcactataatttaagttttaaaaactattcacatatctcattactgcagtaccatgaatcacaagctctattggctgagactctatttgcctagaattagtctcatgcttttataggagagatacaagctaagaaataaaattaaatgaggaagataaacattggttccatgttaaaatgtatttgatggcatggaatttgcaagacatcaattttcagcctagcagattacagaataggatccattaatcctagtcaacattgaacacttcagaggaacaagaacatgacacctgaaggcgagtaatgcatggaaatactcacgatatgttcctagaaaagctgaagaagagaatgaactaagtccacaggttaaaacaacattaaataaccaggcctttagcccctcaaaatagatgaaaaatataaccagaaacatcttttaaccattgctaaatagctagaaaactctgtgctctccaagtagggttaggtatgtaaacaagtgctaacagattgatataggctttctgcttcctatgaaaactaaggtttcatgttgaaagcagcataaccagcacattcctaattacatgcatttttccaggttccaacgtggcagcaaaagtacaagcaaggaagacaaagagttgtcatgctaatgagacatacctcttgtactgagcgagctgctggcttgtcttgatgattggccaatattaaaaagggtaaagtgcataactgtggatgctgaagagctgagtgcagctcatttctagcagcttctaaatcatcctctgaagaggcactgtctaatacaaatattaccccttgagatccttggtagtagcggctccagtatttccggatgttatcagcccctgtcaaaaacaaaacaaattttcgttttaaaaagagctttcagcaactgaaaaatgttcccaacagtaattcctactggaaaccaatgtaccttttaaaaattaagtgctaaactctgtggtatggattaaaacaggaatttagaaaaggcagaaatcacagtggatgggaacaaagaaggcagtagagccaataggtagatttggccttgaaggaagacacaaaatccaagccattcttaatgacttttatataaaaatgtgtgtgagagaaccaggataaatacttcctagacttaaactcaaaaggatattttcagactttaatcatctcaaatgaactacacactctctaaaaattgagactgaacctgcctcagagagctgcatggcctagacatccaccaacgcttctttccaaaccattaacattagcttggtgatacttttttaacagaactgcttgctgatcaggacagccttgtttaatttcacctagggagttattagcacaatagctttatgtgtcaaagtgctaaagtttgtgaaaaactaaaatcatggcctttgatacaattacatgattctgtttggcttcataacccatgaggaaaaataacagacaacaggtgtacacttatgatctcaatgagataagatgtttattaaaacaaacaaataaacaaacaaacaaacatatggagaggctgggcgcggtggttcacacctgtaatctcagtacttttggaggccaaggcaggtgaatcacctgaggtcaggagttcaagaccagcctggccaacatggtgaaaccccatctctactaaaaatacaaaaattagccgggcgtggcggcgggtgcctgtaatcccagctacttgggaagctaaggctgaggcaggaggatcgcttgaacccgggaggtggaggttgcagtgagccaagatcgcgccactgcactccagcctgggcaacacagcaaggctccatctcaagaaaaaaaaaaaaaaaagcaacaccacatggagagtctcatcagccaaggcatgtcatgtagtattcctctttgtatttccattatatagcacaacatctaactcaaagttcagtactggaataatgaaaattgagggaatgagggagtaaaattatatactaattaagctttacaaatttgagactagaacaaactctagagatgatttagtccaactctctgaggaaactgaggcagacagaggtaaagtaagtgatcccttgtcatgtatctaataaatcacaaaattgggatttgcatgagttagcagacaacctgcccagggaaggcataggcacttcccattacatcatggtgactgttttcatcactttcattcaagaataggaggggcaatatgtgtgcatgtgtaggaaaggggtgctactggttatataacgacaattagatttcaaggaatttcaccaatttattgcatatgatcaagtcctaaccagttaataactgtatttcagtcatccactgaacatctagctcctatgtttgacatattgttatgtgttagggaaacagtggggactgcagttggtgtgccctggctggcaagggtcacctgtttgcttctcttcccaactctgtgctcagtgacatcctgttggtagcttgaaatcaatcagggtgaaagcactgtcactatggaaatcagcaaatcctacatatcgagtcctttcatctcccagagagccaacacaccactgatgacactgagcagcttatattttctgggagaaatagaaaagaaaactcaaagattataatagagtacaagaaagtgctgtcatagagatactcattaggtcctctgggatcaagagataggcatttcatccaaagtggggcaattcttttttaatttcattttttaaatttgagatgggttctcgctatgttgcctaggctggactcaagactcaagtgattctcctgcatcagcctcttgggtagctgggactaaaggcacataccatggtgcttggggcggtgggggtaaatttcttgaaagaataatatcagtagccaaacagctcccatttattaaacacttcctatcctccaggtactaagtgttttaaaaagaaaagctcatacaattcttacaacaatctaaggagggaagtataattgactaagcctttgaaactaattttcaggtcctaaaatctgtgatttcaccattatactatacaaaaataactaggtatatatttaataagaggatcaaggacatttgatgttgagtaatgttaagtatgtgaagacatgggatatgagcagggttgatgcatatcaagcagggtccaactaagaaaacaaaacaaaaataaagaggaaatttaagccagagattatttaatatagggaattcattacttaggtggtggtggaactaaggaaacagcaggggtactgagataagcaacatcttaggtccggttccctagacacagagcctgagacatcatttcttgtacacccgatttagagggagtgctgtcaggagaaactagaagtgaaagaagtaagctagaatgggggaagaagctaggcaaagatattgtttcagaaatctagcctcagcttgatgcgataaggaactctaaagcatggattgaaccacagaagttgtctagtccaaaggcaagggagctgagctattacacccttgtatagtcattagccatccctggggagcaggagggggttggggcatgatctcataatctcccaaacatatttggttggggcaattactgtcagccaagggcaggcctctggagaagagtacaggtgtgagtcattagcagccaatacccacagcagctgggagatggatgcactggcccaggaaaggagatctgggtaggataccaacagcatctgctacaggctacatccagacactatccatatgcttgagaaccatccataagctggagggacaaaactggaggcagtgttactcggtggtaagtgtttaaaacaacaaaaatagtgtgcatgtgtatctgtacactagcttgttataaatttcactaacatgaaggatgtgcagtgcacagttttcattgtaagactcaatgcagcatgctttattgtaaattccacatagccaactaatgcccacagaatgctttcattgagtttctatccacagccaactaatggctgcaattgacaaactagtgtagttctgacatgaatggtggctgctcaaagtgttttacgtatattaaatcacttacccatgacagtctaatgactatcatgaggtaaatactgttatcaatctcattttatcaacaaggaaaccaaaacacaaaacgattatgtaacttgcccaaggttacacacctaataaatatatttaggtctaatgtgattgaaatagagatcatggactaaaaaggcaatgaggctaaataaagaactatattaccacataagctaggagaaaagaaatggaaccctattggaacaaaaggtaagttaatgcccacatacattaatggaaatatgtccaaaaacatttcccaactggttaattcaatggatagttattaagtacctattccatccatacaagtctctgagctaggacctaaagagatatttagaaagccattattcctcttaactgaaaccatcaaatcctgtaaagtaatacaaattacaatgaggcctgcaaatatagcaggcagagcaaatacatccacacattagatggtgtccagtgagtcaggtataaagagaatttggttgcatgttttactagagcttgtcccttggaaacacacaggacacctggaaattcaacttgtgcagtcaactctttcaatgagaaactatgttttcattggccacatttaggagtacatatggtacctgcaaatagtgagacacatacacacacacacacacacacacacacacacacacacaaacccaaagagaaataccataactttaaaaaatgtcccttatatgacataatgtatgaataatatattaatagtgaaaagatccttttctttaatctcctgctacagtttcacccaagaattcccttaatacggcagtaaaagttattattttattaacttagctcttaaacacacttttaaaatattctatgtgactaaatgggaagtaagcaaaatacatttttgctacataccaaagtagacagttgatttgacaataagcacttgtacaactgtttgagttgtaagctacttcacacaactccatttttacttgaaatttcaactgacaaactatgattattcagatttgactgtttgatagacattttctcaaaaatagatgtgcaagcttgtcatttcaaggaaaacaaatgatagtatttgttgtcaatggtaaaatttgttttcaagcaaaagctagaattttagaaaacttatttctgctaagttttaagtgagcctgacagcttttcagtgatgagattggtggtgatattaatagacagatattcataaagtaatctgtaaacatttggaagctctacactactcagtgaaccaatattttccaaatgacgaatgcatgatgttacaaaaccatgcatagataaaaaaatacattcaaagtacaagaaagaccaatgcaagttaattaactgagtacaaaaagttccctgataagttttccagattccacactacaactgattaagaaacaaccacctgttgaagaatttcagtatagtatcaaagaagacaatcaacagttacttaaaaaggttattaaatcatgcctccctttttgagttatctatgtgagactagactttcttcatatacttcaacccaaacaacatattaacaacagattaactgtagaagcagatatgagcatccggccctcttctattaaaccagattaaaaagatttgccaattttctcactatttttttgttttcaaaattgttgattttcattaaaaatgttatttatattaacatgttatgagcttattattcttttataaaaatttttaacatggctttaatttctgacatggcacatatggatactcattgtctttaatgtgagaaaaagacatttaagatctactgaaatttaggcataaatttagagctagtttctagcgggaataaaagtcttactttaaactatctttattctaaccttggctgactcaagtcccaagatagaagagctggagttgggagggcaatctcaaaactaagaggtctacccaggaagcatcctaatctccttggtaccattatatcggaattctaacccagtgatcagatacttgaaggcctagaaagattactgaattgtgtgttgcccaggaactttaaatggcatgcctcccaggagattccaaggtaggtggtcctcagcctacattttataaaacaaagttctacgtaccatacaaactgatatgccagttgccctctcctcaccttatcctccctcaacacttattctggatgtctatgtgactccaaacacaattttacatcattatcttagatgtcaattcctaacaattgcattgaggaccatgtctgcattctgacattggcccctcctttatgttctcactatggttcatgccttcatcaccttccagctggatcagtaggatgaccttccaacggctctttgcacagctccagttaaattactcatacttgtcactatgggttcaatgccccttcaaaaattaagaggtagaacctttaagaggtgattaagtcacaaggacttcactttcaaaaatggattaatgctgttcttttggaaatgggttcatttgaggagttttctccattttctcctctctcttgcatgttctctcaccatgtgataccttctgcacgttttgatgcagcaagaagacccttgccagatgagaccccttgaacttggatttcctagccgtaccgagccaaaaaaaactcctattgcttataaattacccagtctcaaatgaaccaagatacttacctagaaaactagcacaaactatcacaaatatactaatacttgtccagaaaactagctcaaattatatcactactctgctcaaaaacattaagtgcctataacttgaagttctcaaatgacttgatttagcatttatagttctccataatctggctccactttgccattcctaccatgttcctctgttgatctccttagatactccacaaatgagcaaaacgttttgctctcctggaccagacctaaggtttccacccttatgcatttggttttgttatctcctttgcctggagttactaccgtgtgagttgtccccttagttcttgtaaattcaaaccactacatgcgcttcaggggccagatcaaatgttgcctactccaccaagctttacctgatcttgcagctgggaataatttctaaaaatcttctggtctgtttctcttggttctccatgtaacactttctaccctgtagcatagtaatctaaatgcatagttcatcttcctgattacactggaagaaccatatgggagttttgtgcattttcgtgtctgattcatcaccatactctgaccacatctaacccataatggaaactcaatagtttttaaagaattaatcttttatagaatacttattctgatttctcaaaagtagaatgtagaatttaccaagcaaatcattctttgctatacaaataatctatctttttggttgatggtggtggcttgagtaaagttattagcaactaatttttatgtttctggtacatacccagttctgcaaggaatctctcattcagcatctgatattaagaattccttaaacatatttacaatgaaacttcactctactcataggcctttctcagagtcctgtcgtagtatttgaaaacatgcagccataatacagcacgtgctaagcactgtactaaaaccacaaagtacattaacctatgttccttgggatactttttgattctatcctatttatgaacctttatactgttctgatgtccaacagaatcagtacccaagagaaactgaaagcatagaaagaaaaagctgtgggaacagttctggagaaatgttcccttccgtactcctgcaaaagccaacagctgactccttagaagaaccacagatgccaaggggatcacaacttgcatagttccaaatgttttttaagcagctaattcttgagccattggcatgacacaaaaaacaaaacacttttgtggtattctagaaaatctggtggcaagactagaaaagctagtgggaacagctttgctgcaattgacgttgaccaaagcaataaattgggaagagccaaaatggagacttcctggctgacagaaagatatttgttgcatacccaggatgaaataagatcttttaataatgcggaaatgctactgctttctagcacaacttgccaatttccccaaccagtattttttcttttttatcagaaactttaacgtaccaatcctgtgacaaaactgataaagatgcaagaggttctagattaagacaaactcacggaaaaagttaaaaaccatctaatgtctcatcctatatagcataaagtataattagagtcacatactataagccttgatgttcaaaagtggaatagtaaatttgtccctcactttgagtgttttttcgtctgtgactaatcagacctcaaaacaagttattaccatatttactcacataacaaaattgtaagagaattatgcttgctctgcaatatatgactgcactcacatttgctctttcatcttttaactgtctctatgacattctttttggaaatgcttatcagagctcttaaaatgagagttccatttctccacctggcccattccctttgatctagttgttgtccccctattgatgacagaaggccacccagcatcatgttcaggctcaagcataaaatagtgaatggcaaagaaaaagtctagatttcagggaggtgacatcaatgtttaattttataatgtgcatatcgaattatgtaattagataagtcaatgcactttataactcataaataaatttgggcagctctaagtttagggatcaagtatgttctaaaactttccaaagcttctaatttttttgagaattcagtacacaattttccttgaaaacaaagcagtgaatctcaggagtgagattcagccctgaaggacagaatgatggtagagtgatgaacagcatggactcttactgagttcaaagcctggctctgccacatatcatctaagtaacatgaaaactccgcttaattgttccaagcctcagtttccctctcaataaaagagaggaaaataataatacttaattacctcataggattgtgaggattaaataacttttttcacacagtacgtagaatatgctaactgttcacaagtgttaactgtcattttgttgtggatgttactattatcatttgtccaccatttaagcctataactcacagaactactgaacgaagaactaactcaagttagctcagtacctggaagtaaaaggctaccagatgctgaacaaaagaggcaaagaatagattttctgtaattcctgagaaaaccaatgttataaaaaaataaaccaaagtttttacttgggacagaccctttctttttctgttcaactaactttctcctatgtcctgtatcaccttcagactcagtattttataatctccagtttcttcctccctcattgctgtctagatttcttcccttgactaacaccaaataagaaatttctccccttcagacaaaaacgcatgttctttcagtacaggtgtcttcaactagacatgaacacaaacagcatgattagtcgtgttaacattcaggtgacacccttatgaaaaccaaaactgatcactaatacaaactggttttgtccacatgtgcacgtgcatgcgtgcgcaatgtgcgtgtatacgcatacctttgagagatgatgttacctacaaggctgacatacagtatacatacacatacatataaagctattattacactttatgacatttctctttcttttgttataaagcatagataaccaaaaattggtactatttttttcagcggcttgcatggttgcacaaataagagctcaggcagcatgggttaaggcagggggtgccatttgtaggcaagtactcttctttttttctgtcaagtagatttttaaataaaatataattgaattgtgaatacaagaaaagcaaacacaaatctaagcacaaaatgggctttttcttaataattcttgtaactgtttataacccactttttcagccttttcacagcttttgcttaagcattctaatttcactggttacctgtctccatagctctactaaataatttttataaaataccccaagattctcatttgtgctgttcatcactgtgtctccagtatctatacagaatctggcacagagcaggccattgatatttattgattaagttaattaatgagtgaatggggagtgattatgtaaactatttacccatcgattcgaggacaagaagtctcatttttatatagtctaaaagaactcttactcacaccctctcttctttttatattccttttttttttttttgagacggagtttcgctctttttgcgcaggctggagtgcaatggtgccatctcggctcactgcaacctctgcctcccgggttcaagtgattctcctgcctcagcctcccaactagctgggattacaggcacctgccaccacactcagctaattttttgtatttttagtagagacagggtttcaccatgttggccaggatggtttcgatctcctgacctcgtgatctgcctgcctcggcctcccaaagtgctgggattacaggcgtgagccaacgcacccggctccttttatatttcttatctgaaatactgtttcttctctctgagcttctttctaaagcggtacagtccctttttttctattctcagaagcaagcttcccctttgtgttttgaaattgccatttttaaagaggatgctagtaacatgatcatcctatttcagacaattcgaaatgaatagtttctatgagtgaaggtggatgaatgaaccattaaaatcatgtcttaaagtgatcagacttccctctttacacaattactatatattaaaacaagactagcccactccatcacatataccatcaagcaggtttcttcatacttaatcatatcactaaatcagtcattgccaaccttctatcttatgctctggaatgcatcttactgtctcaagaggcaagtggaactctcaaaatgaaattaattttaattaactttaaaatataagtgttaatgtgtcatacagcacttggaaagagaaggttatacaaaagagagtgacacagcattaaaggagtagggatcaatgcactagccaaaaagaagacaaatgactttgaaacattgcctgaggttaagcacttcacttccaaatacagtttcccacgaagaacacactcaggagaaaagggagagagacagtgtaatttgaatgatgttacacctactgtctaaattttatttagattaggatagttaaagactatatttgcctgaggacagagaataggctacatgagaagagacatttattgggtatccagtaaggttccacagtgctgaattttcttacaattctgatattagattaggacttattttcatagttgactgataagaagatatcactcctttcatgctcttcttattctagacaggtcgaaacagttatagggcagcacatataaaagtatgttaatctgcttaagcttgtaattctgacataggatcaacgtccattttttaaaaatttgttttaaacacatttatcataggcttgctgctgttctgaatattttttcttatatacaaatgactgaccacagaaaaaaatagcaaagaaaaaaacacattatctaccacacctccactctttggtttgtattcttcaagattttgtctctttcttaattagaaaaatgaggattttactacaaacctcaaaaatcagatcattctattcaacaaatacacaaacacagtcttagcaaaaatcaatctaaggtcatgcaccattgttaataatagatatataaaaaactttagaatgacccatattttgtattttcataaagccagaaaccacatattttctttctttatacttgccataatggcatcataggtgctcaatgattttggatttaaagaaggttaggaagagcatagtcattccaagctaattactaaaaccccacagaaatgttacatggtgaaggctaccccttcatgtttgtggtaggtagactctaagatgacctccaatgatccccacttcttgatattgacccctggtgtaatctccccttgagtgtgagctggcctagtgccttgcttctagccaagagaatgtggcaaggtgatgggatgtcacttccttgaataggtatcttctgtcttgctatcagattctctctattgcctttctggtaagcaagttttttgttttgttttgttttgttttttttttttttgagacacagtctcactctgttgccaaggccggagtgcaattctcctgcctcagcctcctgagtagctgggattacaggtgtgcaccaccacacccagctaatttttgtatttttagtagagacggggtttcgccatgttggtcaggctggtctcgaactcctgacctcaggtgatctgcctgccttggcctcccaaagtgttgggattacaggcgtgagccaccgcgcccagccccagtacgcaagtttttatgaagcaaactgccacactagagagtcacacatggcaaggaattgagtgtattctctcacctaggaatggaggctgctaggaaccgagaccctcagtctaacgctgcccccacaaggaaatgaaatctgccaacaaaaacaggaattagaaagagatccttttatggatgaataatattccattgcatggatataccacactgtttatctgttcacctgctgatcagcatgtgcgttgcttccatcttttggttattgcgaatagagtggccatgaatattggtgcacaagtttttgtttgaacatctgttttcaattattttgtatgtattatctacaagtggaactgctgggtcaaatgttaattctatgtttaacttactgataaaacgtgtgctgtttaagtccccaaatttgtagtgaattgttacacagcaatagataattaatgcaaagtttaaaataaatttgcagctaggtagaaattcccaaatgtggattaatgaactacagggagaaaaaaataataatttaccattggtctgactggcgactcatgattcccccagtcaatagtatttactgcattctcaaaatacttcttaaaaagcaacattaaaaaaattgctatgagggtttgccgggtgccatgtgttgcgctgtgctgtactgcagagattttttttaaaaaagaaaaaggcacagtttccaccctcagagtgcacagatctccaattaagaattacctctgctgatattctccaaaattctgttcatcagcttatttcttctcttgttgtacatcctctttgggaaagtctttactcacattgtttcatctacctctaatatcacgaaaacactcagttcaaatgctctcatctaattttctcctgagcaccaatactcttacttcttctatcatatgttcccttctagatgttccccaggaattttaaactcaatttgtccccaaataaactaattcttgctatgcactcttttccagcccaacctcttgaattccctgtcagacttagcagccaagattgaaactatgaatcttaagtcattctttaccccttatcctttattcctaattctcaatcaactgcccaacttacctctcctctataacccagtgtaattgccaagctctttgaaacttttaaaacttctctgctatgatttgaatgtgtcccccaaaaagcatgtattgggaacttggtcctcaatccaacagtgttggggggtagggcctaatagaagttgcttaggtcatgagggattcaccagcacaaatggattaatgctgattataaaaaggcttcaggctgtcagttcaatctcttactcttctgccttctgccacaggataacacggcaagaaggcctttgccaagtgccaatgccatgccttcgaacttcccagcctccagatcttgagctaataaacttctttttttaaatttttgtatttttttaatttatttttattttattttattattattatactttaagttttagggtacatgtgcacaatgtgcaggttagttacatatgtatacatgtgccatgctggtgtgctacacccattaactcatcatttagcattaggtatatctcctaaagctatccctccccacttcccccaccccacaacagtccccagagtgtgatgttccccttcctgtgtccatgtgttctcattgttcaattcccacctatgagtgagaatatgcgggtttttgttcttgcgatagtttactgagaatgatgatttccaatttcatctatgtccctacaaaggacatgaactcatcattttttatggctgcatagtataccatggtgtatatgtgccacattttcttaatccagtctatcattgttggatatttggtttggttccaagtctttgctattcccaaaatctccttaagctgataagcaacttcagcaaagtctcaggatacaaaaccaatacgcaaaaatcacaagcattcttatacaccaataacagacaaacagagagccaaatcatcagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagagttggaaaaaactactttaaagttcatatggaaccaaaaaagagcccgcatcaccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagcaagctgaaactggatcccttccttacaccttatacaaaaattaattcaagatggagctaataaacttctgttcgttataaattattcagtctcaggtattttgttacaacagcacaaatggactaagatgttcctctggctgtttttcctctgctacacttatggcttacctagaaaattcttatgcagatttcaagcctgaacccaaacattatgaccttgtgaagccttccttaattttattttttataagactactttctctatccattgtgatcctgcagcaaactgattatctcttcaatttcaaaagctagacacacaacaaagcatcagtttttacatgcctagttctttatgactgttgtgggctgacagatttctgcacttatgttctgagaccaatttttctggatattttaggtagctaatataggaatcaacatataatcttcactcaattcatgtgtgctgaatttaaaatagccatctgatttatattatgattcacttaatcaactaacaagtatgtattgagtagcttctatgtatcagacgtaacactaggcataaggaatatggtggcaaaccaaatagacatgacccctgcctgactcatgagctcacagtctcacaggtcactgagttgataatacatttatgacactatgtcatttaggcttcaacctatctctgagcaacacaagtatttcctatatttattattttgattctttttttttttttttttgagatggagtctcgctctgtcgcccagactgtagtgcaatggcgcaatctcagcgcactacaacctccacctcccaggttcaagtgattctcctgcctcagcctcccgagtagctgggactacagatgagtgccaccacgcccggctaattttttgtatttttagtagagatggggttttaccatgttagccaggacggtctcgatttcccaacctcatgatccgcccacctcagcctctcaaagtgctggattacaggcatgggccacggcgcctggccttactattttgattcttaaataaaaactggaaaattaaatttcttttcagtgagttataagtaaattttattaccatcattagcactgcattaaaaacaacaaaaaaaccaatcccttcctgatacctttcaacatatatgactgtttgtatactatctaaatcgaaacatctaatatctaaatctgaacattgataggatgcctcaactatccagaagacagctaaaaattaagaaccatgggacagccaacagaaatgtctccaaattaataacctaaagctcccatgcttaacattctaaaaagtccctcaggtccacacagaaacctggcatagaaaaaaaagtgatcacaatttcttggctccctattcagagcatattagaagtagtaaatcattatgtgggtgatggaagagagagagaatctgccagaaacaggcacagagacagtagcaagaagagatagctacaacagagactaaatcaagaaattaaaaaattaaacgagaagagataataactatgaaagaaaataaggcacagaacagaaattaaaagcgtagcagttcagatttaatgtagcatgcaatagccacccactttcccaatagtactgtagggtttctgatgtccatcaaataaatgatgaattatattcctggcattttcatttattatcatttgaacatataaatgtaacaaggaaagtctgatgaacgccattaccaacaatcctgtctaatccagcctcacctcacttcctcctttctattattttaaagcaaaccgttaatattacatactttcatctgtaaatattttggtatatatctaaaagatgagaattctttttaaaacatagccaaagtaccatcaatatatgtaaaagaaattaaaatcaattgtaaagtttatagcccattttcagcattaaaatgtcttaaaatattggctggatgtggtggctcatgcctataatcccagcacttggggaggccaaggtgggaagattgcttgagcccaggagtccaagaccagcctgggcaacagagggagacctcgtctctacaaaaagtaaaaaatcagccagatatggtggcacatgcctgtagtcccagataattgggaggctgaagcaaaagaattgcttgagcctgggagatggaggatgcagcgagccatgactgcaccactgtactctagcctgtctcaaaacaaaacaaacaaacaaacaagcaaaaccataaaatgtttaaaaatattaaatcaaaatatatttttacattcttaattttattggttaactgtcaagagagatttaaaaaaagtgttctgggaagcactctctttcctaatgcaacacccagtgacgatgtggcatcattaaattatgatattttgctattgaaacttaattctttaatcaaggaaaatccttttacagaaaatcattaattttgtttagtctacaatagctctttcagatttaaaagttaacaatgtaatttattattatttgagggccacagactaattccctgaaagtgttatcagaaatgatatattattaacttattaggagatcataggctatcgtgagaaaacttcatgtcaaaattagttgtattagtactgagatgtaattattcttcaaaagtatcataaaatcaaaaacaagtagggaaaaacaaatacaatgatacatacctgggaaatatagaattgatttttggtagccaaaacttaggtagaaaattaaagaaccagggacacaggtacataatcatctcttctttcaattaaaagccatggtttgaaggaaacttaaatgaatggcactctaggtagttgatttggaaactaggaacctatttggcacatctaaggaaggatgcgtatgtatgtgtggaggggagaaaatgggcagaacacaaaacagctttaaattgaatttgagagaaatgtctagatgaaatctgaaactacaaatcttatcttcttcctaacttagatgtgccttggaaggattacagaagtgctgagatccctgtagcccttggggtgtccagtgggacctggggcatgctctccccatctcttgtcatcacctctagcagtaagcagtttctgtttatcctaatataccattaaaatattatcattttcaatgtttgataatgtgaaaaaccttgcaaagcattagtccaaagagcttattagcctgtcattcaaggctcttgatgatttgacccaaatgacctttctaaccttgaatcttttcacaccatttatgaaacgtttacactggtcaaaatgaactgctcgtgttttccccttacacccttcatgcttctcaactgctgttgcctctggtttgaatttctcctcctcctggggatctactttttccctatctttatattttcaagtataatcgattcctaagcctgcattaaatgccatctgtaccacaaaacccttccttttactgtatttgtatataatcttttttcccccactaaggagccagagtagtcagttatctacagtttttaatgtcatgcgtaactttctattttgtaccattgttacttatgtaaaatgtttttagtttaccaactagagtcaaagttctttgattgcttaattcaagtaaatttactccagcactttctgagaaacttttatgtgccaagtactatactaggtgcagaggataccacattagtgtggctacactatcaccagaattactgagtattgtttttaaaattctagcccagctactcgggaggctgaggcaggagaatggcgtgaacccaggaggcggagcttgcagtgagccgagatcgcgccactgcactccagcctgggccacagagcaagactccgtctcaaaaaaaaaaaaaaattctagccaatatgataaggcagaaattagtaagaggtactgcaactggcagggggaaaaagtatgattatttatagatacaaacccaaaataattaatgagaaaacttagaactaataataacatggttccataaggtgataagaaacaaaatttaaatgttttcaaatactttgataatacattaaaaaacatttaaaaatccagcaattttaacaaatattttaatatgccaatatgtacatggaaaaatatcccaatatgtatatggatgaacacacaaacacatacgcatgcaggcacagaaacaaaatatgtcttatactaccatatagtataagaaatattttaattctctccaaatttaatgaatatgtttattaaatatatttatgcatttaatataataaacattttaatctttccaaatttactattgagtttaagacactaccagtcaaaatctcaaggaaatctttaacccaaaatttcacctggaaatcattaacccaaaatctttcatgcaaaatttcactaaaaacagtcatatttttaagagcaaaataatcaatagacacaaattacaaaggagatacaaacataaagaattttaatttgttatttaaaaaatataaactaaaattatatggtacttttttttcttaagtgaaagtaagtttattaagaaagtagagggataaaagaatggctactccatagataggggctgctggttgccatttttatggttatttcttaatgatatgctaaacaaggggtggattattcatgcctcccctttttagaccatatagggtaacttcctgatgttgccatggcatttgtaaactgtcatggtgctggtgggagtgtagcagtgagaacgaccagaggtcactctcattgccatctttgttttgctgggttttagccggcttctttactgcaacctgttttattaccaaggtctttatgacctgtatcttgtggtatggtaccatttttcacttatccaactgcctaaaaaaatctaaacgataatctgcaacaatatgaaagatccaataacaaagacaatagaatgtatttctaataggaatgtaaatctatgtaaattttctaataagcggttttgtattatgtatcaagagccttacgatgttttaatcctgaattttctgtttttaatatctaatctaaggaaatatttagaaactcaattcaaacataaacttttaaaagaaaatcagataaatactaagtgccagatctataccaaattacacaggacaacacaggcatatagaagatctgggaagtgcctaccaaggacatagatactgaaggttaaattattttatcattaatcatcagaaattgtctaaaccatattaaagagtcgaagttccacacaagtcggattcagttaggaatactgacagaggtactgataaaaatgagttgataaggaggagggtagatcagcaatcaaaccccgaggagagagaaagtggcaagtgctggcagtaccccacacaagtattatccatggccaaatacgtgatttgtccagtcttggtagcaggcatatcgctattaacagacacactatcagagccagatgccattagacatgtggccgctataaggtcctcagttctgacaaatgtatacctgattcagctgacagtttcatagcaaagaaggataagaaaacaatgacaaatctaagtctccaaacttaattgtgaccatcaaagaagaaatggttactatgttattctagagactacactaccaaaaatgatcatttaccctagactgtagaaaggatttcaacctaacaattggaagaagatgagaaggcggagaccatgaatggtcatccaaaacaggaagacagttaaaggaggataaagctatcagaaagggaaagattagaggctaaaatgaagttatactcgcaaaaatgttaagatcagataagaaaaaaaactagagagggcataaaaagagtaactttgaaaacagttaagaggaaagtaaatttgcagataggagagagtatatcaaacttctttaagttaactcaagtctccagatccagacagattacatacaagatagcagaaaaactcagatgtaactgcaaaactgctctgagcaatgttatgtaaccctggagaatgggaaggttaccagatgattggtgataggcaaatattgccccagatttaaaaactgggatcattgtgaaccaccatgggttcactaagaataaatgtttctaaataattctcagctccttttggactgacttgctaggttggtacatttggggaataccatagtatgggatcatttcaggaaagtatttgacaagtctcttacagtatccttgggaaagaaagaaagaaatcagacggcagtagttcggtagctttgtagctgatttaactgacttacccccaaattcgtggatttgtgccaacatgaaaggggctaggtcttctatgatttgcaaccaatcttggttttcacagcacttcacacgtaactctactatagcaattatcacactccattacagttttataattacatgtctattattccctatagcctgtgagctccctgaaggaatgattagctttttttttttttttttttttttttttttttttctgagacagagtcttgctctctcgccaggctggagtgcagtggcacaatctcggctcactgcaacctctgcctcccgggttcaagcgattctcctgcctcagcctccagagtagctgggactacaggcacgcaccaccacacccagctaatttttgtgtttttagtagagatgaggtttcaccatgttggacaggatggtctcaatctcttgacatggtgatctgcccacctcggcctcccaaagtgctgggattacaggcgtgagccactgcgcccagctggaatgattacattttatccatcttgttatttctagcagggagcctgagattagcacagagtagacagtctgatacatgtttacatattttaattgaattaaaaagttgaagaaattattttaatatttacagatgtctcaaagctgaaaggaattgctaatatgttggatgataaaagaaaaaaagccaaaaagttcttgacaagctggaacaatgagccagcacttacacaatgaaatttaatagagatataagtaatgtctggtacttggaataaaaaaaaaatcagctgaagaacacaatgggaaagacatgactaaaaacagctggatgttttgacagcttatccaacatgggccagtagggtgctatgattcgtgttgttggcatgaaaagaaaaagcaaacctaaaaagagatgaatatcactggtcagaccacatctatagcatcatgcttctaggcacatattttacaagggaccccacaatttaatacttctccaggagacaaggaggatcgtgatagacctggagaccacatcataggaaaaatagttgaagaaatggaagataattagattgaaaagtgatccttcagaatacatgacacctaaattcatgtttcccaattactatctaggggagctgtactatttgttagtgtggctccacaaggcagagctaagattattttaacaaagaaacagagagttgcattttagtaaattataatgaatgataataatgaaaactcttcaaacatggcatatatacatactttctgagactgacttcctcaccatgcaagtactcagtttgggactgttcagttcagtcacatgccagagatttgaaaacagcaaattcctatttggtgtaacaggtttgagcaagaaatgtctgatttaacaaatatggtttcatattcttttatgagataaaaactgctggaaggtagaatgctattataagactcatttctgaaggagactgcatacccaactttcctgacactgcttctgagaaggacaggttagaccactgcccactgcagcaaatgcacccatagcccactctgagttccagagtgatggtagaaaatctggaaaacactgccttgtctcatgtggggcagagtttcaagacagcagaaggcaagggagatcagaaacatcaccttgttattcaggtaaactgtaaaagtatataaaaatatataagccatcaagaacaatgaatttataagctttattcccactctctttgtatactgactcccagattcattgactcatttagtacaattttatcagcaaaaaaaattttaaaaatgactacttaactaatggataatgtatatttaatatgcgattttctaatcatccttcaaataccttcaatagccagctacatcatgagagatatatctgcatgtttaagattaattcaaattataaggagaattcaaaagtgaattaaaatgtgacttacagccagtaaaatacaagcaagtcaatttttcaatgcatcttgactaaatgtaaaatatcatctgtttttgtgacaaacaagtctgtatcattaatcatatgcttccagctgcaacagctcgcattcaaattaaaaccatgaaatagcatcacagtgtcaagattcacgcaaactgatcttttaacagattgtgagggaaaaaaaaacatacattaaaagaagaatctggagaaaatgttacacaataaaaacatctgaaagagcttaagcacacaagatagaattctggtttttgaactgtattggaattaaatgttaaacaaaactcacagcctgctcttaaacaacgaacacatcataaaaaataattctttttatagccacagggctgagagttttgctgtttatatctatcccagcatacaaatccatagtactgccaggactgtcccctctgactttactgggaagctagacaggacagtctgcctgggttttttttttttttttagtttagttcagtttgtgtccaaaactggcccaagaatcatctcttcttcagtcactacactcttgcctgccagttgcacagctccaaacattctccttccagctacagatattaaaatgttttgttgttttaaaatttgatttagaactgcagtagataaccttttttttttttttgcttcaggctcccctaggtcagcaaggcatagtaatgttcaaacagtgcaacagcagccactcattgcacattaaaaacaaggatggtgccaggaaccagcaaagtgatatattctaggttagccatgtcaggcattttccagtcccaaagcaggtttcatatggtcagcacatgggccaaatgatgcacatggccgtcctgcacttgccccttgtgtcctcctctggtgacctgccccattgaactccctggacgagattcccagcgatgctatgcaaagaggacatgttcctctgagagtattttctgcattagggctcacattgtattgccatgggactttacacttttagggtataacctgacatgccacaaccttttcttccactcctcagttgacacctctttaaactggtggcccagccctagcctagtacacataaaaacgataatagccactctgccaatcaaggttaatatttcagcttctctaataaacctggggtagacaccatgatacaatatataaaaacaagaaaagtaaaaattcagaactttatctcaaaattgtgcaggctcttacctactagatttccttatcttgtaaccatcatttctttgttcttttgttccttgttcacagagatattgttccagatgataaatggaggagtatgtaagattttaatttcatcacagcctataaagaatattcccaatgaaatttaatgtgaattttaaattgtatattatagttgggcatggtggatttcagaagctttgaatcccgtaacatggattttaagagagaaagctttttttttttttaaaggaaagtaggatgaggaaataatatgaggagaacatgcagtgactaatcacttacaaaagagaattttagagtcaaagtatgccttagaaatggtctggaaaatacgcagccaaatcaaataacttaatatgtattgagacttcaatgtttacagaaaatttgaaaccttttataaaaccactaattcttttgtaatgctacaaattacttaataagagttactaatgtataaatctctattattatatttaggattttcttccagaagagtaccaccacacatcttaaaataggaggatctcgatccaggtacagtggctcatgcctgtcccaacatttcgggaggccaaggtgggagaatcacttgaggccaggagttcgaggccagcctaggcaacatagtgagaccccatctctaaaaaaataaaaataaaaattaccaatggaacaggatagagaatgcagaaataaagctaaacgcaaccaactgacctttggcaaagcacacaaaaatataaattgagaaaaggacatcttatttaataaacggtgctggaaaacaagatgaccagatgtagaagaacaaaactggatccctacctctccacttacacaaaaatcaacccaagatggatccagacataaatctaagaccagaatctgtaagaattctagaagaaaacctaggaaaaacacttctggacattggtctaggcaaaggatttatgactaagaccccaaaagcaaatgcaacaaaaacaaaaataaataaataaatgggacctaattaaactaaaaagcttctgcacagccgaagaaataatcatcagagtaaacagcccacagaatgggagaaaaaatctgcaaactatgcatccaacaaaggactaatatccagaatctacaaggaactcaaacaaatcagcaagaaaaaaacaatcctatcaaaaaataggcaaatgacatgaatagatattcctcaaaagaagatatacaaatggtcaacaaacatgtgaaaaaatgcccaatatcagtaatcatcagggaaatgcaaattaaactcataagatatcaccttaccccagcaagaatggccattattaaaaagtcaagaaaaatagatgttggtgtagatatggtgaaaaaggaatgcttatacaccgctggtgggaatgtaaattagtacaacctctatggaaaacagtatggtgatttctcaaagaactaaaggtatatctaccattcgatccagcagtcccactactaggtatctacctaaaagaaaagaagtcattgtatcaggaagacacctgtacacacatgtttatcacagcacaatccacaactgcaaagatatggaaccaacataagtgcccatcaatcaatgagtagataaagaaaatgtggtacatacatacatggaataccactcagccattaaaaaagaacagaataatgacttttgcagcaacttgcgtgaagctagaggtcattattctaagtgaagtaactcagaaaagacaaaccaaatactatatgttcttagttataagtgggaactaagctatgggtacgcaaaggcatacagagtggtacaatgaactttggagacttagaagtgggagcctgggaggtgggtaagggataaaaaacaacatattggttacaatgtacactacttgggtaatgggtgtactaaaatctcagacttcactagtaaacaattcatccatgtaaccaaaaaccacttgtacctcaaaagctactgaaataataaaaattaaaaattagctgagcatggtgatatccacttgtagtgtcagctacttggaaggctgaggtgggaggatcacttgagcccaggaggtggaggctgcagtgagctgagatcgtcccactgcactccagcctgggcaacagaatgagaccctgtctcaaaaaaaaggaataaaaaatgacttttaaaagtattttaagtatgttcagagatacacctaaagactttaagcatcttttctacatttctaaattgaaagcatactcattttggatcttaaccaatcaccatttaaacaagttttcatctgctccagtagagataatttcgccctacaacttgataaatgtttgcaaaatagacaactatatatgagtaacagcaaagaaagcccaaatttaaaatctatcaatgtatctatctgactactatccatcttaaagtccacagtagtctgacaactaagcgtccaagaagtctcctctgtgtttttaacttcctggattatagtaggtctctcttaacttactggaacaaaaagggtgattaattgatatctaaatacatttagaagattttgaaagaaaaaaaaaaaaaaacaaggcagcatgtgctctgtccctagttcctgaagtatgaattgtttattataatatggtaatcccactaccagctctggttgtaccaccaactatgattttgaaataaagggtttaaatatatatatatgcgtgtgtggatagacagatagatagatagatagatagatagatagatagatagatagatagatagagatagagatagagatatgcttacacagcccacatttaaaatctaccattatcttaaagaaaaagaacatgatagtggtggctcccactccatggagatcactgatggcaaagtacagagtgggaaaacatatttatgttttacccgcttggcatattataaatagaacaatctcaaccaggcattttgccaagatgtggaaaaatgaaatgaggcaaaatgcaaatggaaaataaaattactttttatgccaaaataaggtctggatggaaaactttaaccaaagatatggtctggatatggtaagacttatagaagatcagctgaagatgatttgaaactgcaaagattcttgaacaacaaaaaatggtatttcattacccatacacaaaacacaaactgtctagataggaattatgctaatatattttggaagcagatgctttctaatatattttttcaccttaatgtcattaccgttttttccccaacctgctcctttctataagatctgcactttgccaaatgcagaatcaccaacacgaataattattataaatataaccaaaatggttgggaagaaaatgttatatcactatggttttgagtatcactacggcatgaaccacaactgggttatactgagaaatctctcactctttatataatgaatctgtcatttttttttattaactgagtgctgctgtacacagacagatcaatctgtcttctcttattagcactgagattttaaaagtctacacattaagttaattgatttgataatttctttatcttagagtttgaagtgcttacacatttaatcttaacaattcagctatatacgattacctagaaactgacggttttctttccgagtcctttcccagtcactttcatcttttttcaagctttttttaccttaatctgtctagaataaattttcattggaaagcaatccaagaaaagggccaaagtctccacaaaacacaatttcaacgatttttaactggagataattaagagtatcttttaattttgcaagttatagaaatatttttaatagttttagtgtggtataactgacacacaataaactgcatatatttaacatgtacaatttgacaagttttgacatgtatacatggtgaaaccatcaccacaatcaagataataagtatatccagcacctcaaaagttttctcatgacccttttaatctctctctttcacttattgccatattttccttctcccactcccaggcaatcactggtctttctgtcactaaatatgagtttgcattttctaaaattttatataaatagaatacaaatttatctcagtaggagaacactattttattttgcttggcttctttcactcagcataattattttgagattcatccatgttgttgcatgtatcaatagttcattcactttgattactaaatagtattctattatacagatgtactacagtttgtttatccattcaccaattgatgacatttgagttgtttccagtattgtgttattacaaataaactgtgtacaagattttgcatcgatgtaagttttcacttctcctaagagtggaatggctggattatcaaattggtgtacatttacctttttcagagactgttaatctgttttcaaaagcagttgtgccattttacactttcaccagctctatagctacagtaagtggaggagttaaggtcttcaaaccctaactgattccagatcctatcttctgtaggctccatttttttctaaattagacatcagctttggccagaatttggatgacaggagatggaaatttaaagagtggcatgggggaatttggattataggagataggaatttagggagcaacatgggggagtttgtctaatgacaaaaataaaggatgctcacagcctggggaactaagtaattcctatctcattggtaccaggagctaacctagacgacagagacaaagtaaagatcagtcagaaagaacaactcagaacagaggaccaaactgagccacgagggttgatcagtgacagcccatgctctcctggactcaccttgctggcccattcatgcctgtggcctccctctccaatgacctcccatcacccctcataaggacaagatgctgtttactttccatccgaaatgactgtggttccgggagttgttaggaggccaacgtgttccatgctcttatgttaatagtgtggggataaaaactaaacaaaggaagcaagcatctgacaataaatgagtctactggaagtgaaaaaaaaatccaatttaccaattttccttttatggatcatgctttggtgtctaagaaatctttgcctaacccaaagtcacaaagattgtcttatatgttttctactagaagttttattgttttaggttttaaatttagaccttggatccattttgattcatgacacaagactggagtacttttaaattttgttggctgtgccattatttttgtctatttgctattaatttctaattttactggatattaaccagaaaacacataaaatatggtcacatgtgtaaacattatatggataattcaaagaacatatattttctatttgattataaaaatatacaattatcaattagatcaagtctgttaattggctatttaaatcctttatatatttttatttatttgatctgttatctgctcaaataaggagagctaaatttccctactaattgtggatcgatctgttgactttacatttctcttagttttagctttatatagttcaggattatgtagttaaatatttaaaggttcatgattacttagttatcttagtatatcaatatgaaatctttttctttagtctatttaatgatctttgcttgaattctatttcatctcatattactttaagtactttcttttttatggccttttttaagggtatcatttcctatatatatttttaccttaacctatctttttttgtagaagtgtcttttgtcaccatatatagctgaatatgtaatatttttatgctatccgtattagaaaagggaatttaatctacttacatttattgtggttattgatacagatatacgtgttttctatttatcacaacttttttgattgttttatttctttctttcttgaactttgctaaatgtatcaaatattctttgctttttgtccttacagtacatttcctttcttaaaaaatctttatgctttaaaaaaaaagttatggaaaaaaattcatgcactacagataaagcaaaatttgtatttgatcccggtgaactcttactccgttccctaagataatttattatatgagctgaataggtaaactttcaaaactttcttaaaaattcatttatgaatatatcatcctatttttattatcatgtttattcttaattgcctttaagacacataaacttcaatttttttcttctttaaatcataatctataccctaaataaaaaaagaacataatatacttttatgcttgtttctctttacctgaccctgccatcttccatgttaaaatcagaaataaagctattttatgtgtgcatgcatgtgtgtgtgtatgtgtgaaagagagagaaatcgtaattaatagtttatttttgtttataatatttctaagtatggttattttcttattaattatatttggaattgagagggctcattacatctaaatatttttttttcatattttatgctttttctcctactatttctttgataattttgtcctttccagtttctcttttctctaagagaattacagggatgctagaacttctgtaactattctctatgtctctcaaatttttccccacatttctgaagtattctttttgtatgtcattctgaaaaagattccctagttcaatctttcatttccctaatttatatgtgagttgtattaatgaccattttcattttaaattttaaagtcaaactttaaattcttaatttctgtgcttgagtctttttcatgaatacatctctctgaatgtcttcttctgatcactctattacctctaggtccttgaatattttttcttctcatttttcatttggcatctttctttcatggtactgatttacttcatattgcggtgtgtcataattatatgctcatcttttgtttgagaatctctgtgtgccagctcttttgtttaccattgtctgtttccagtgattaatagggacagacaagtggcttgtctcctgtgtgggtgggctttctaacccacctggcagtcagcacattactgaggcactgccctacctctctgggtctagcacccacactcaaggatttagtttgtgggtaaacacagctgctatccactacttaacacaaggagaaaagaaaaataaaggcacagctccaaatgtggagctccaattaataactctgatgagccctttgattaataatcctgacgaattcctcttttatttcgtgtttccattgtctgtacctttagctttgtcttgctttcttttctttgttgaggatttaaatctatttttgttatagatttaatttattgtttcttttcttaccatttttttcataaaatagaattttggctatggaagaaaaatataaagacatatataacaaaagacatttaaaaaaacaacttccaattttcaatcatgtacgttgcttaaatttaagggcttcacacacttgtaccaacagtgataattaactttacataaattcttcgcattattgctgctcacaatgatgccataaataccagggaatttcaagattaaaataatcaagcatcttcagtagaatctttcaacaatactttggaccgcaagaaattaaatgcaacaaatttttgattcctcaaaagaacactactcagatctattttaatcagctttgaacgtgtcagagaatcaatctagtctgttaagtgataaatagctataagcatattacctcttcaacagttgtcgagttgccattccatttatgggaatctagttttatgtttttctgagaacttccataatcattatggccaacatcactctcccaccgaagtatacaaagaaacagtctcagaggatggtgtgtgtgtgtgtgtgcgtgcgtgtgtgtgtgtgttcacccacacctgggcatggcagggattgcatcctcagggcctggcatggagttggtattcattaaatattcactgaagtgaattaaataacaataacaaaacaaccttttgcttgtgaagtgtctagcattactcttgcatcttgggtcataatttggcaaatttccctccagcttgaaactgctgagatattttatactatagtacagtgaacccttaagattatggtttgtttttcaatgattcataaatctccaatcttgtttcatctgtaaactaaacttagtgtatctccatgacttttgtctcatctgtcccttttcgtagactcttttcctctgtgaagtctcctttctccttcctatatgatcctaactgcatcttatactcagtcttgttacaggacttaccacaccagactgtaatgcttctcaaggaaaacatcagagtgataggaactttgtcaagttagtattagttattttttattttatgtatataccctgcctcacaccatacacacaaagagctttgagacttatccaaatgtttactgtacaaaaaaaaaacaaaaaacaataattgaagaacccaggatgaaagaaaaatagagtgaacaatgctacataatcctgtacagaggttagaggtaggatctacgatttgtaggggccaaagcaagatagatactatgactttcaagataaaaataaactagttacgttatacttaaacaagagaattgttatcagcatcttcgactgctggaaaaaaaaataagtagccttggaaaagttaagtgcgccctgcccaatatcccatggcttgttttgttagaggaaaatactggtctcttgacttccagtgctgttgctgcactaccacactgaaactaaatacacagtgaaaattagttgctattatggcaatccctgggagaaacaaatacttattcccttgtgagggataggaagttaaactaagaacccaacacaaatgttctgtgaggcagtttagtagagctggaagatacgaaatgacctgatggcccctgaagaggaaacagtggtgcagcagcaaccttcagaggcacatgagatcctcattgccaggggggtcaaaaggccagaaaaatcatttctagaacattctacatgtatatacagtcttagaaaaagtggacccttaagtgctatactagactatgactgggaagataaattttttaaaatttcctaaggcacttctccagaagaaaacaaaaattaaggtcaggtctacctcagccagtaacagacttctgggcccctagattcatttatttggctctgctgactgtttggctcagttttcccttagcaagtgtaaaaaacacttaaacaccaccaccctgggatcctattcaaccaattcagatagctgtggccttttaactcacatccaagtgacttggctttataccaatatcatttcccctagtataggctaagcctaagtgagaaagtacacagctcagggagccaggagttaactggctgttctcattccaaaaaggcctggttcttttccttgataaggaaacaatattatatcaagaagttgcggtcattcagtattacatatcacactagatccatgactataaaaagagaattagtggaaataccaccatctattcttaaagcatctctccaaggagctttagataattgaaaatgttctcttccagcccaatcccttgggaaataaatagaggtgatttattaaaacttacattttacgtataagaaaataacaacaagaaaatcaattgcagagagtggcagaggatcttgagggtatcctctacttgctgaaccacacttcttccttagaattatataataaatacagaatatgtacatttacttgtgtatagctgcctgtgatttacctatagtaaggtcaaaagcattctatggacatggtcttccttgagcccttcttctgtgctgtcattttcctttgccagggaaatggtttctcaccatccctcccatggacacctatgtctggaaatgtctaaaacacttttcgaatagcaagttgctttctcctataccagcaagaaatttttgcaactccacctgtccctcaaagcaatgtggccacaataacctctgcaagtctgtctgcctatgctgtttctttttctaatacccaactaatttattgatttatattgtctttacgtctcctctggctttgcagtgtggcatgagtctcagagccagtgattacattacattcataagtatttggctggagttttaaaaaatgagagatggtagtggggatctggagggggatgatgcataatatacatggaactgtgaaaatgcgtaagataaaaattaaagaagtcttctttcctctaaagtaagatttaataaaatgagactctgacgaaagaaagctttattttggtgaaagacatcaaatggcatgtgtacaaaagacagaaactaaaagaaataggcagcagtgccccctgggttgcctgtcaagaagtgtgtcctgtacagtttctggagaaattaagaaatgcaaataacctgggcagattaacagcacccgaagataactagcaggatacaaacaaacagcacctttcactatgaggaggcgtattcctccaggcaaacaaagaaacaggacagagtcaacatctgtttcatataacagcttggctgctgacagaagaaaccttaaaaaaatggcttagctgacaatccacaaaaatcattcaatcactattgcatgggccgaagcaaacgagtaaatgaacacaacctgcactttctatattaccctaaaaaagttgtcttttctttataggaagaaaaaaattaaaatgaaaatgcaaacaaaaatcttcatgaactttccccttttgattgacaacaggcagcaatgaatactgaatcataaaagacagccagctgcttttcagctggtctttgcctttctcaatgtcaattgcgaagacaccactttcaaagagaacattgggtaaggatggtggctgggatggggcatggggagacaattcagatgtaacacattagaatattaagaggaagaaaacaagtcatttgacacacccagtcctggttacagaattcagttagggagtattatgatgtctgggtccttatcaataaataataacacaccaaacatgttaagaactaaaaatttccatctctggattctatcaattcacacatacaatttcaaaatcaagaggaaaacattcatgactgcatagaaacctgtttgtaaatttaagtactggacatttctaaaatgcaacattatcagagctgtgacatcactgcagtgtggacaactgctttcaactcagctaaatgccgtgacatcactgcagtgtggacaactgctttcaactcagctaaatgccagatgcttcacttactttcataatgcggttaaagtacataaggcaaatgcaaaatgaaagcaattaagaggcaatgatagaagagatttttcaggtgaaatgtgaaaacagaaggaaaggtgatgaggtggagcaggacaagatcatttgatattaacgcacgcacagtgccaaaactatgctaggtagctaaacagagactccagtgagggccttttcgagttgcttctcagtttaaacaggtgtaatatcttgtttaagtggaagagaggtatgaccacaaagagaaaaaaaaaatcaatacatgatttgcattatttctgaccttggaaaaaaggctttattgaaaggtgtcctttattgcacagaattgagaggcggcaaagtgagagtatgatcattataaaagcaaatcttccataatgtgagctataggccaagcaaattctcagtggttgacctgcatttactaatttagccctcacaaggattatatgacataggaactattattatctcactttacagataagggaacagagatacaagaaggtggtagacttgcctagaatcatacagaatttctgagctttgaaacaagtcactagaaggaaggaaaattctttaaagagtaatccatcagtccattcagcatccttgttaggtatcttgtacaatatccagaaaaataaaataatctagagcaagacaagcacagtaactaattaaaactaaaagagaaggaattgagattagcttcaccaaaaacctcctggataaaagactatataggaaaacaaaaagttcacgaagtaatactataaaatgtcctgcgtaggaatcaggactaatatccaggcttgctaataccttggatggtattagaaaaccccttcaggtgtgaaagggcctaaatggatatctgttctaggcctataagaagtaatagttgactttaagaagtcaagtatggaagagtttcctctggcacctcttacttggtttatgcaggaacagtgcttgttttgacactataaccaccacaactttctagaactgagcctggcatgtaatacatgctcagtaaatatttgctgaatgaatgaattacaaagaataaacgaataaaacagtgaaatgtttgtggaaagttttagatagtttggaaagtagaagtaagactttgattcagaaggtagtcttgaagaaatcaaaggagggaagcaggattacagaaccagaagtcagaaccataactgagcaagagtttgacttgaaagatctctaaataagagagtgtgagagagaaaatgaatgataaaagcaacagaaataattagagattaagtcctataaatgtctttgagcagagagcaaggtattcatgttttgtcaatatggtattttagggatgggcgcagtggcttatgtctgtaatctcagcactttgggaggctgagggcagatcatttgaggtcaggagttcgagaccagcctggccaacatggcgaaaccttgtctctactaaacatacaaaaattagcgacgtgcggtggctcatgcctgtaaacccagctactcgggaggctgaggcaggagaattacttgaacccatgaggcagaggttgcagtgagccgagattgcaccactgcattccatcctgggcaacggagcaagactctgtctcaaaaataaataaataaaaaataaaaaatggtgttttaccaacacactgttaaccaaaaaaaaaaaaaaaccaaaccaacatgtgaagacttcaaatcatgcaaataataatgatacaaacagcagcaaataacaggtgggagcacttctcttgtgccaggccctgggtaaagtgctgtaggtgtagagtgcactggttaggcacaagagctcagactgataccaacctccggctccaaatgaccacagtcaaatcatcatgtctggtgttatcttatctgtgagataataatagcatctactctctaggcatgaagttgcaaagactgagactgtgtaggggagagaaaagggaataagggcaaaacagaagaagaaaatttagagctccaatttcacaaaaagataggcataatcactgcagcctggagggtgtgacaggtagttgagaacaaggcattcttaaaatagcaaaatagaaatggcccaccaaaccactgggctagactatcactgtgtcataatttaccttgtacttctgcacttaatttttttccctttcatttcattattttcaaaattttcactaatttcctatttctcttttcatgaatgtctccatcactgaatgaggagttccctgaagatgagggctgtgcttagatctttcattctctgcccataggaccatgctagacccataattaattgtggtaaaatgatcaagtgaacagtaagaaaacaccacatgaaaagaaattgatgtgaatgagaattttaagaatttttcaggaaaaagatataaaaacactttcacaaaacagaaaattggtaagaggaaataataatttttataagtaatatatattcaacacatatatattcacacacaaacatatgtttgtgtgtgcaaacatatagtttgtcattaagatccccaaaagtgactttcactgagtgtaactccattattcattgtttcctcaccccatatcatttcttctaaatagataatgagcacaggtttatgcgcttccctattttgaagaagtgagaattttaacttaagactgggaaagagtgaagaagagccttggaactatctgaaatgggtagaggaaggacattagcagggagaacaggggccatgctgttctcctgaattaaccccaggataaggagaactacctgggcattcctcactaagaattcatcactgtcctggctcttaatctctatatttaccacctattttcttgaggtcctcccctgaattcagaatttttctctgattgacaatgtgattgaactctgattaacctgtcttctgagcaaccctccactggtgaataaaagcttcatatcttcacacattgatcataaaacatataactctctcctcccagaaattctcagtcaagcaactccctctcagacaacttgatttcagccagtcataattccccctaagtgcacatacaccttattttgggatgatccccttcatatctagcatacacgttaactcctaggaaagctacactttatacaggttagcctagcttttcatgtgttcctggttgagacataacctagtacctagcctcaaaaaatatttgaggaaatgacttagtgaatgagctgtcaagaagtcaactcccttaagtgcttgcccccgagcatgtgacacaggatacacaattggattctactcagaaagtcccctcttccttcagacactgtgtcaactggaaacagagctattaaagttgagaaagtaaaagaatctatgcataggctagaaatttgctcttcaatactaacacatgccaaaaacttatgtatcactagcctggaacgaatgtatctgctctgatccctgaggctctgccttttacctgcatctcttaacctcattacgaaataggtaccaactaaaacataaccaccaaatcctatggtatcctctccattgtaatttccatttcagcaactgtcagggaacagctctttcggcaaaattaaaccgtgcttgagaacagacctattcccaccttatgtacctctagtcccctaacttgatctttcattgtactgaattttgatggcacagagccaaccttacgaattccttggtgttcactttttttaaaactgtccacatacagttactgtttgtttcatccaagtaaacatcatatgtaataaatgtcttattaaccaaccaatagtttcttatacctggaaggtgttcaataaaagctttgtgtccaacctaaaaataaaatacttagtaacagccatatttaaaacccatataactctcaaaccatgcatttacaatgtgttctttgatttttaaatatccataagtaatattattgtcaccaaggaataatcagcagaagccacaaagcaaaaaagcatttttttataaaccatgcatctggaaattttaaataggagaaagattattttgtttcatttgaatgttctgccagctgcttgtatttcttttttgaattaaattaaattaaactaatttctagacgttaatttatcaatagtttctgagcaaccattgtatttaaggttttaagcatatggcatggttaatatgccatacatttatttttcttaaaagtacaattataatttaaaataccctaatagaacacagtcttttaaaaactttgcatagaaaaattattataagaacattcatgttttataatttttggagtcaaaatgacaaaaccaaatgtcttaaagaaaaatcggaatttattgatcatggttgttttatatattaatgctataaagctaaaagtgaatatgaaattgactggcagaagcgaacctgtcctacacatagcgaactgaaaacagacacctgaaaagatcagccagttttttattagataaaaataagaaggtaccaaacgctattaaaatggcgtaaagttggtgttacaatctcatcgagctaaaaataggtcacagttagaatgaccttaagggaaaataaacaaaacaaaacaaaacaaggtaaggccaatatcacaaagtgattaaagagatggaagataactctctcctaagtcattaaactcaccgatatcatactgaactccagagcacttagtattttcatgcgccattagagaatttagtgggttcactgaattgactgatttctttgttaatctatttacatgggttaagaccctgactaacataaaacacaaccaaaaaatgccagacagagagtgtaatgaaagactgagtgatgtatggtttggggtacagcctatccgataaatgtgcttggccagcaaagaacccattggcaaagatttattatcggaacaaatacattctaaaaagatctaatacaataaaacctgcagtataaacacaaactactctaaaatacaaatcttttccccgaatagttgatctttcaatgatattaaaattctcttcatatgttttattcaagaattttttgaacaagtaaaaccaatgagctgtataaattgccaataatagtgtaattctttgattcattcaaaaaacccccaaagtttatgttacttagaactcttcaacaatttttaaaacatacgaagagaaggaaatatttctaggaaatatattatcaagataaaaatgaaccacctactaaaataagttatcattatgtttgaattacatataatacattattaccaaattcataaaagttaagggcagacatagaaatgatttgaaatgttatacctccaagttcttttacattcaagatggcattctggaatggcactgctttaatactaaaacctaaaattagaaaacaaaaacataaaaaaagaattagcaacttttaaattaaaacacttaggatgctcaaattgtctctttttaggctggttaagatttatttactttttgtagctgatatttatactagaaacacataatttccaaggtaaactgataactgaatattatcttctgccattatcaaaacatagttgttgtggctgggcacagtggctcacacctgtaatcccaacactttgggaagccaaggcgggcagatcacgaggtcaagagatcaagaccatcctgggcaacatggtgaaaccccgtttctactaaaaatacaaaaattagctgggtgtggtggcacacgcctgtaatcccagctactcgggaggctgaggcaggagaatcacttgaacctgggaggcagaggttgcagtaagctgagatcgggccactgcactccagcctggtgacacgccgagactccatttcaaaaacaaacaaacaaacaagcaaaaaacatagttgtgtattacggcaatatataacactatcccctttacttcaaaatattgccttattctttaatttaatatgtaatgtcactctgcaacttttatcagatataagaaagacatttgaaagtatagagaaatttcaaagaaaatattaaatctatgaggacctctgcatctaactttaattcttaaagttaatgtcttataattctttctcacatataactcagcaaccctagaaattaaggtacttaaattataaccatttcatattagaattacatagtatttatgttagtgtcttctttaaaggacatggttaatatgtcatgtatctatttttcttaaaagtacaatcataattatccacttatgcataggcaatcattttataatacatgtaatacaagttttatattataagaaaatattcagagtatacagttctatgattaactatatatttatgacttaactattaccattcaagacaataaattcaactgtgacatatgcaagtgtgtatatacccattcacacacacacacacacacacacgcacacacacacatgcaaatatacacacagattctttctgaaaggatccacaagaaaccagagctaatgactctcaggaaaactgggaatctggaaattttaaataggaggaagattcttttgtttcatttgaatgttttgccatgtacttatatttcttttttgaattaaaagccctatgaatttctaggagttaatgtatcaatagtttctgagcaaccattctacttaaggtttttaagcattatttaatatgtataattttaagattaaaaaagtttctttttcaagaatttatcaacaaagaagacaaattatgagtctttgaggtaagttatgaaaaaatatataaagtattacatggataaaaacaattctttcaaatgggtttgttttgctttataaagaaggaaatcattacacaccttcttagtctagcctatcttttgcacttctttgctgcatgttatcccagtactttaataagctgtacattaccttccacctaaagcagtacatagtatataatgtttgaagaactgactttggagtcagacagaactaggttgaaattctagctctgtcccttattagctctgtgaatgtgggcaacctactagccttgctcgactttctcatctgtaaaacagggatgataatatctacttcatagggttgttataaggataagataatgtatgtgttatgtttatcacagtgcctggtacaccataagcatataatatacgattgctggcattatgtttccattgatgctttttcgttgatgattcaatcattaggtatacatattttctgcctgcctgaatataattacaaacttgattctgggtgctcacttattaatctaagtatgtagttggagatgtaaaagttaccattgaatgaaaagtacttttgttggagtgacgaagatgtcaacagctgaagtctgctgcacagaaaggatggaaaatgttcattgggccctctaacaatcttctaaaacataccccttcctttgtgggcttaatgcagattgacacagtcagcacagcattatggttaatggtgcatgaagtcactgaatcctagtaaatgagcaggaggaaagaggaggcagtcccatgtggctgaaacactggcatgtacctgagcctgcaggaaagcctctccaggtgtctggcctctgggaaattaaggaaagtcagtgccaatcataatattcctgctggcacagaaattcacctgcaggagacttggatgcctgaatgtatctacctacctcacacgggtgttatatggattaaaaagcaatgatggtgaaatcctgaaaatgaaaagctctctgcaaatattaagcagtctattagtggttatgctcaggacaactcaagtgtagattttctagagaagtaagacaggcacaggcctcaactttgaaaaggaaatggttatggagcacatcaccaatgtttaatctgctttgattcttaaaagctgacaatacgcaggctctcaaagggaagtaatatccttccagaaattgctgcacctatgtgcaaaatacaacttttgaaatttattaacccaacaggcagattatgtcactgttattgtctttaaattcttgcaaagtcttcataagttgactactaaaacgtcttcaaaagttcacactaagcaaagtatcctagcaatgttattttattattttattttttttgagatggagtctcgctctgtcacccaggctggggtacagtggcgtggtctcggctcactgcaacctccatctcccgggttcacgccattctcctgcctcagcctcctgagtagccgggactacaggcacccaccaccacgcccagctaatgttttgtatttttagtagagatggggtttcaccatgttagccagcatggtctcgatctcctgacctcgtgatctacccgcctcggcctcccaaagtgctgggattacaggcacgagcctccgcacccagccccctaacaatattatttataggcatataaatgtcccgacaaaatagtcgtaaatgttttctccaaatagaacttgtgtggttagatttatactgcaaaggtatacacagtcatccatgttgctgtctccatattatttttacggtttagcttcagtaattaatgttcaaaagacaaagtctagatagactgattagtccagaaaataagaaaatgtactatttacagaagagaaacaatgttttttctattttagtcattctaaacatttgaaaggattaaatggaactaaaaatctaaagtcatactttcagttcaccagaaggacaaccaagaagggaaattattagacttttttttccctttacatcaggttggatgaggccaagggggagaattaatataatatttaggagggataccaaaggtcaaaccatcaaaatacctttctcaaagggttgctttgaggaataaaagctaccagacagcatttgctctagagaaagaaagtctaggttcaaactcttcctattccatttattaactgtttgactttgagcaagctaactttgttagggaagcattctctggtgtcctcgaactagactgatttttctgagtccatgtttttccagtattcagtacccctcctaggtgattttcacaattgtaactacatatcggttgatttgttttatatttgttctctggctagactgcaaggatccataatgaagaaacaagctacactgtattctgtaggtcagtgcttggcatacaataggatctcaatatgctaagtattaatatctatttcctaatttagctgctataacaatcctaaagttggtatcagtactactgtcccaagaagaaagtgaagtgccaggcacggtggctcacgcctgtaatcccagcactttgggaggccgaggcgggtggatcacgaggtcaggagtttgagaccagcctggccaagatggtgaaaccccgtctctactaaaaatacaaaaattagctgggcgtggtggcagatgcctgtaatcccagctacttgggaggctgaggcaggagaatcgcttgaacccgggaggcagaggttacagtgagccgagatcaggccactgcactttagcttaggtgacagagcaagactctgtctcaaaaaaagtactaagtgctatattcgaaacttaaaaccaggtctcatcaccagagccctacactacactgtagtgtctcctccatataccaacaaactgagggattcacagcattttgtccaattttgagcctaaatactggtaaagtcaactgaccaaaatacacacgtgcctaataaatgcactaatttactgtcctccctgtttataaataacccaacacctaataaacccactaattcattgtcctcctgtttataaataacccaacacaagaaacccaaataagggttttcaggtctatatgccattgctttcttattaatgaaataaaaataatagcatgagtttagaaggtacattttgtagaaataattaataaaatcaggaacttaggaggggagggaaaaagtgttcaactgactcatccatgacagtgtaactactctcttgcttcttcaaacaggaagtgtcctctgatgccatcttcagggtgtcagtgtgctaacgtgacaagggactatcctaggagtccgaagcacagctcttagactcaccagccacatttttgtcttgccttggccttgaattcctcatgtgcaaaatgaggactaaattagctctttgagatgtcctctaaaattagcattccattatttatattaaacaaggagaaggaaataaaagtaaccactgagtcaatcatcaatggcctgtagtatttggctgaaggcttcacggttaagtctccccaggctccattcaaacaatttgatggctgaagcctaagttacgcagtcattttttcctggcctatctaagctacattagtaagactgaaacctcccctaagatttaaccccacaaatttttaataaatatatgacttagtaactctttggggaaataattgtttgcatagcctttcagtctttgttttgcagtccttaaatccaacaaaacctgtgagacaagaaagatgaatttgaagtttttcatgcactgaaagcattcctggaattgtaacaaaattagttttgggaggaaggttagtctatttttattcattgtgtggaacacacaagtatttcacttggacctacagactaaaccctcctccccttccctcaagtctgagtgcacgcacacagatacttgtgtgcttctgaaattcctgggtcactctaagaattgctgaagggaaagacattctacagatctggtggctttgacctgcaccaagggcatgatttatgccacagcagttttgtgatgtttggacaacagactaacgaaattcttctaactatgatttcaacatcataaaaggaaatttaatgtactggcatttataaaacacaatcctttaaaagatatcaaaatctgactttctaacttgtttctcttgttggcttaacacatttgaagctaatactgaagttatttaaatgtcttcttcaaattttcatgaacattttcaatctttttcaaatatggtatatatccctagaagatgttttcaacctttttcaattcaaagtgttcagttttctctaggttattctccatgtaccatcaatatattctcctaagcctttagattccattcctctgcttcaaaaaaaaaagtgaacatttatgtaatctacagtttaacaacccctcttatcaacaaattcctcatacatatacagtaaaggaattcagtctggatagagttcacttttatttctagactaaggtgcaaattactcaaattttctctcctcaccaacaggtcctgctctctggaggatttcttggctctttgagttttgacaatttaagtatcttttaaaaattatgtcagaggtgaaaaattgctgaagttaataaaccaataaagtttgaattctctttctgaagaaaaggcagacattctcgccttgctgaaattaaacgaacacatccttctcatatgttttcattttaagaaaccaactctgaaggtagattctcttttcgaatgttcaaaactcttcaataaatattgcatttttaattggctttatattttcaagacattatagagaaataatttaaaagaataaaggttttacccataattcaatcacatcaataaagtacactgttattcttatagtttttctctagttttttaattcaaatgcatagttttccatggtttaaattcaaaaaataaatgtaaatctaatttttaatttttaaatagaagactgtatatattcttctaatctataatcattttgatcaagttaccataatgtaattaacaaactcccttgttgtatggcatttaaactaccttaaagttttagttgcaatacaaaatgttgcaagaaattgctttatgcatatagtttcccttaagttacttacttaaaataaattgccagtggcataattactaggtctgtgaacattttcataacttttgatttatatgaacaactgctttctaagaaaaatgctttccaaaaaaaagggatatcataacagtcataatgtaacaatcataatgtcacctgtaatacatgtgcataccaatgccactacaatcttaccagcactgactcgtctcataaagaaacagattttggtaaatttaagtataaaactaacgtttacttatctattctctagtaaagttaaacttctggtaaagttgaaacttttccattaatttgtttgccatttattctttttatgaattatctctttatagacttggcacagtttatctgttagattctagatgttatttgtaagtgtggttgaattctctaagagggacagccatatgcttatctgtaatatctgatgcaaatacttccaacagtatttttttatatttatcttaattttagatttccaatggttttaaatttttatatagttaagttccttgatccttcccttgtgaatgattcactggaggcctagtccagctattctgccatcttccacactgaagtctacatacacatgtggatttctgacttcctcaattcttttccaagttacctttattactattggagtttgctgtttatttcagtaccctccttccaccccctttgttcttctttacttacacacacacatacacacacacacacacacacacacacagagagagatacacacctgctatgaacaaccaaaagaattctggacctgggcagtaagtttgaagatgtcagcaatgcctacctcaaactccagcactgaacagttgtggatccccgataactaaagtcagcctgtgggacctcctctgctgcctattcgccaacccttctctaccatcagtaacttgtttctacaacatcttgccctcctttcactataatgaacacacaggtccaaacaccaagcatctaccccttttctcctacatcattacttcctgcctcccatggccaactcagcctcacctttatcattacagagccttctcagtgaatcatattgaaccttatctttcttaagaagtcttctccatgctccagcatttccctgcacattttttcttcctccatacactagcaaacagagcttttccttctcttatcagcgcctctcagcacaaactttgcttccttctacgcttttagaacacttcatcatagccacttgttaataacatcctacctgagttatgacgtttacttatatatggacctctgcattcccacctaccaattttcagggattttgttcatctatctgaatgaactcaatatttggctaacagttgtccaccacaccctatctgcttctattcttatgggcaacattcttaaaactaatagccagagctatcctctaagtttctgatagtttttcagatctctaaaactatcagctctaattcatatcaaccatctccagtttatagcaaagagttgtcgattcaattaaattttctactttaacaatcatgccatcagcaagtacgtttttatttattctttcacaaaatgaaagcattttatttatttttcttgcctgatttactggctagaatctctaccacaatgttgaatagatgtggtgagaacagacatccatgtcttattcctgatctgatcaggaaacaattcagtctttctccattaactctgacaacagctgtagggttttcacagatgccctttaacagttgaggtaattcctttctagtcctactttgttaatagcttttgtcaaaaattgatgctgagttttttttgtttttgttttttgcatatcttcacaggatcatagtttcatcttttggtttattgatattgtgaataaactgattgatttttgaatgtgcaaccaactctgcattcctagaataaatgtcacatgttcatgacatattatcctattaaaatattattgttgaatttaatttggtatatttttgcttataatttttgtatctgtgtccatgagggctattggtatgaagcttttttttttttttttttttttttttttttttttttttgtaatgtctctgtgtggttttggtatcagcttcatgctggtcttaggagttggggcatttttccctcctcttcaattttctggaagagactaaagaattggcagtatttcttccttaaaatgtttggtaggattcactagtgaaaccaactagacttaaaaaaagaaagaaaaggtatcaatttcttaaacagatataggtctatccaggttttctatttcttcttgagtgagatttgatggtttgtccttcaaggaaattgtccattttctctaagttgtcagatttactggcataaggttgttcatgatattcccttattaacctcttactatttatagaatctatattgatgtcacctttcttattcctgatattggttatttgtgtcttttttattttttctgatcagtttggctagagttttaccagttttactgactttctcaaagaactagcttttggttttactaattttctctatggctcttctatttcattgatttctactttgatctttattttcttctgcttatttgggtttaatccatttttcttccagttccctaaggtggaagctgaggtcattgatttgaggcccttcttttctgaatagacatttagtggtataaacttttcttaaagtcccgttttataggcaccacaaattctaatatgttgcattgtcattcagtgcaaaatcctttataatttctcttttgctaccttctttgattcgtgggtcatttagaagtaagtgagtttgtaaatacttgagattttttttttcttcttgttattgatttttaatgcaattctatcacggtctaagaacatattggatataacttgaagccacttaaacttatttagatttgctttcataaaccaggttatggcctaatttggcaaatattctatgtgtacttgaaaagaatgtcttctgttgttgggtggagtattttataaaatgttaatcaggtcaagttagctgttagtgttgttgaagtctgctacgtactggctgattttcttcccacatgatctataaagtattgagagaaactgacgtcgctgattgtaattgtgggtttgtacatttctttttgcagttctgtcatttttttgtttcatatatttttaagttctgttaggtacataaatgtgtagaattattacagtctcctgaataaatgatcccttcatcattatgaacttctttatccccagccttattcattgctctgaaatctacattgtctaatattaacatagctaccccaactttcttttgactagtgttagcatgatgtatctttttccacctttgtatatttaatctatttgtgtctttatacttaaagtttgattcttaaagtcagtatttggttgggtcttggtttttaaaaaaatctattatatcaacctctgtctcttaattaaggagtctagatcatttatatttaatattattattgatgtttaggtttgactgtatcacctttctacttgtttcctatttgtttcatctattcttgttccccttttcttctttttctgccttcttttggattatttttgataattctattttcatctcatttgttgctttatgggctctcatcctttgttttgttattttattggttactttagggtttacagtaaatctttaatcagtctaccttcaagtgttattatacgacttcacatatagtacaagaatcttccaatagtgtacttccctttttccccatgacctttgtgctattgttctcaggcattttacttttacatatgttgttaaccccataatatgtgcttattattgttgtttaaagacatacctcttaaagatatttaaataataagaagtaaatattatataattatccacataatttgcatttctggcagtctccattttatatagatccagatttccatctggtatcattttttttctgactcaaggacttcttttaacatttcttataatgcttatctgctagcaataaattccttcagattttgtatgtctgaaaaagtctagtctttatttttactttctttttaaaagagacttttgctggatattagttgacagttttttccctttcagatgctgctccaatgtcttcttacttgcatttttccagtgaaaaaatgtgatgccatccttatttttattcttactcatgtaacatcttttatctgcttttaaggtattttctttgtactactttgttctcaagagaaaaaaaaaaccaaaaggatgtgtgtttatatgcatatttatatgtatgtataggtgcatgtatggatataaatatatacctttgtttatatatatatatataaatagagacagagaaatactttaagaaattggctcacacaattacagttgctataaacccaaaatctacagtttgggctggcaggctggagacccaggaaagaatcaatacgcagttcaagtccaaaggccatttactgaagaattccctcttgttccagggaggcaagtcttttattctattcaggccttcaactggctggatgaggccaaaccacattatggaggacaatctgtcaaaatccgcagatttaagtattaagttcatcccaaactacccttatagaaatatccagactaatgtctgactacatatttgggcactgggacccagccagttacacacaaaattaaacatcatattctttatcaccggttttgaacaattttattatgatgtgccttggtatagttatattcacgtttctttctctctctctctttttttcccccacaagagatggggtctctctctctgtcacccaggttggagtaaagcagtgtgatcacagctcattgcagcctcaaactcctgggatcaagcaatcctcctacttctgcctcacaagtagctgggactacaggcaagcaccaacacatgcagctaatttatttatttatttatttgtagagatgggggtcttactatgttgcccaagctggtgtcaaattcctggcctcaagtgatacttccgcctcagcttctcaaagtattgggattacaagtgtgagccactgtgcccagccttgctcatgttccttttgtttggggttcagtgagcttcttggatctgtaggtgtagagttttcttcatgttcaacaatgtttcagccattatttcttcaaatatttttctgtccctttccactcaccttcatggactcaaattaccctagcttaggtttaaagttgtcccatagctcgctggatgctctttgcatttttttctctctcagattgtctctatgaacagatacaatacagtgataataacagttttaatgtccccctttgctacttctaatatttacatcagttctgggtcagttccaattcgatgattattctcattatgaatcatgatttctggcctcttcccatccctgataatctttgactgactggcagacattgtgaattttaccttgttgagtgatgaatattttttctttaaatcctatacagctttgtgctgagatgcattacattaccagacaaccatctgaggttttgggacttgctaatattatctgtcatgtgagtccagagtggtactccacttacggctgaccttgccaagtactctacccagttccttgtgagttataagtttttcagtccatctggtgattacaggcatagttttcaaccctgtatgaacaccaaccactgttccctctagtcctttaagatggttcttgccctggccttgggaagtttcctcacatgcatgcattgaatattttgctggatactcaagggagactctgaaaatctttagtgttctctctctgtacaactcttttctctggtattctattctatgaacattagccatcttggtctccccttgctctcggcttcatctcctcaatgcagggagttcactgagctccacctcagctccctctggaactgtgccacagcctggaaactctcaaggcattaagctgggacaatcacagagcacatctcatttgtttctcatttctcagggataactgcgtttcctggcttgaaaattgttgctttgtatatttcatgagctggttgctgttgttgttcttcttcttttagatgggagagtaaactagttccagttattccatcttaccagaacaagaagtcctcactcatccttgtgctcactgccctctcttgagcatattcagtcttgccttttcccctgatgaccaccctaaacctctgactactagcatgctcaagagaccttttcttatagaaacaaattctcttagcactattttctctttttctgtccaccttcttgaaagaactgtctatattccaaagagttaaggagtgaaaacgatggtctacccctcaattcctttgcttgctcttcatcccctcaattctcaggttggtttccacctcaatactctactgaaactgtttctaccattagttattaattaccacgttgtcaccacatccaatggcctttctcagactttagacttacgtttaccttatttgactggttcttttgatttcttgcccatatttgacttaaaggatattatatagaactgtctgacctatattccttatcaaaagcagatgctgtaatgtaagctccaaagagcagggttgtttgtatattttgttaactgatatatcctcagtccttaaatcagtggcagtcacataacagacattcaatgaatgtggaatgaattaacaaaatataattggtgcttagcacctttcttcccgctttctacccattacccctggacaagctcatccaaatctatgactgagttgtctctcaaatctctctagtctgcttggcttttagcatttggatcactgttggatgtcttgtcaaacctcaaaatcagcatgccccaaactaaactcattatttttatcttaaaactctgtcacattctccctactttttttttttttaacaattcaccaaaacataaagctataaacttgactcatatttgattgttttatcttcctttcctcttgaatacccagcataactgtcacttttacagtagcagtaacatccccacaagtattgtccctgctggatcacctctacatctaacaggtctcccccaacagcttctctaagtctctagccttagatcccaacatcccctaaatctctgcatgctgtgccttaacccagtaagaccactaatctttctctgaatatacctatgctttctatccctaactctcctcaccccattcctctctgcttagaccttacccatcatatgagaccctactcaaatgtaaccttaactatgagctttctttgaccctccagattagaaatgatcactctcctcttttaactttcatatttacaccattaatataacacatatcacattctgtcttagcacagagcctggagtatattaaataagcaatatatgtgaactgtttttatcaatacacaacttatcttcctaacctgggtgtaaacttcttgatggcagcttcctccaaagaggcctccaaaaagacattatgccaggttcagaacaatgacaactcaaagaagcttgatatccaaaaaattagccaacctaacaactaattcatcagaaaatagactagtgcacaattctggtaaaacgtattattaaaaaatttcataaaaacaaacacaaaacataacttacaagtaagaaaattatatacagataatcttttacactataattcaaaactgctcctctagcaatagtgctagaagataactctgataagtgaagaaaagcatactttgtgttactcttacacatattttagaagctattttgattgaaaagacttaagctaataaagtttatataacttcattgcacattactcaaaagatattcacagttttataaacaaccaataaagtacctacttccaccagaaatcctaaaccttggataccactaaacttcacttgaacacctgaactggcatcctatctctagctatgtaacaatagccatgtcaccatacctttgatcttcaggtaatttagaaacagaatatggaaaaagattcctacctgtcatataagggctgttataaggctaacagaagactatatagattcaatttactttcatttgcttattaacagacatctgtatccatgcctaaaccttgtgacagactctgggtatacaataccacatatgatgctctagctgcccttaagagattctaacccaagatggggagatgggcacatacataaagcagtgctacaggcactaactgggagaaatacggacaacgcccagtggggagaggagggagtactcagttctgtccaaggagaaaagaaggtagtcagaaacagcttcctgcaaagaggctacacatgagctctgctaatcttctctggggtctctactcattacaatccccttatcctttccctcatcctaaaatcaagcaatgtctctaaccctttaacagctccacagtttcttatctcaattctaaaatctgaaaagctctcaaaacctgcacttttttaaaacttacttgccggcaaaagctgacgtgaactgaagtaaggttcttgatcaacaatatcctttctactttttgtaggaaatcctagttaataattccatcatccaaccatcacgtaagccaggaattgagacagccatggctttctcactctcaccctccaaacccaactacactaggctttgtcaattctagctctcaaatatatatcctacctattccttcctcttcttccccctgtaactgcctcagccaaggccttcatcatctcagttgcaccatcacagtaatcttctgcctccgcctccaactgcgctactcacaatttagcctccacatcatggccagcttgattcttctcaaatggacatctgatcatgtagtttccttgcttaaaatactctgatgtctctgcactatctacacgaaaagcccaaactcctgagcacagtatgaaaggtctgctaagattcagccaccactgaatacaatttgtctcctggcactctattaaacatacactgcagccacacacaaatgcagtttctaggagttgccaatctgtttgacactccttaccttcacactgcccctctgctcctaagtcctctttcttttccaccccctcaccttatttcttgtaccagacctacttatcaacctcaaatctaatgtagcaaaccaaatcatgcatccttcccttccccaggtccaggcaacactgtcatgccccttccttccatgccccatctatttctggatatgaacttaatgtttatgcagccagtatactgagactcctggaatgctgaaatcatcgcttatctcatgtctaacactggacctagcacatagtaggtgctcaaaataagctggctgatgaacaatcttttcaactttccagaaaacatctcacccttctccttccttctcagctctctctgcacagcagctctgttctctatctcttacagctgttcttccattatttcctcttatactcttctttccttcttcattgtcagaagagaaagaggacacatttgggaagtgaagaaaaaccctagccaggatttctcactaataacttgacactgaaaacattttgggcctgataactctttgctgtgggggctgccctgtacattgaaggatgtttagtagcaccactggcctctatccaccagaagccagtaatacccctccccacaaatgactccaaaatgtcccactcagaggcataatctcccctgattgagaaccactgccctagactgactttgcttggctccatcaggaagcaataggggaaggctgatgcatgatctcttgcactgactttcctccaggtgaaaaatgacaaggaaagaagattcagactacatcagtttactattcagggagtgtgtggccaagaaacataggctggagtgacacttcaaggaaggaaagtactctatgggcccaagatgaatccattttgtcatatatcagagttccagatttcaggattcatttgtattaatattttcccaagcttcatttattcagtgccactgaaatgacctgctagagggatataggatacagcaatttaatgctattaaattcatttcaaatcttttttgaaaaagagatagtgtttaaaattaaaataaactgattaaagcattaaactataagtagaagggaggggataaattgcacaggaaactaggacatcttgggatgagaaagaagaagggacagaaccccagcacagtacccacctgtggtcgacacgacgttatcggggctttcactgcagagtttggacaacagactggttttgccagaacctgtgaggcctatgcaaaccaggtcatattctggtcgtgcaggtggtggtcccttgcagcaaagtgctctaaaacactgccaaaagaaggggaaaaaaatgttcctttaaatgacagtatggaaataaaccatagtcacatttaaaatgactgagtaagtattaagaggtaattgaataaagtattacctataaggaagaaaacggtaactttagaacagtgaaacctggagacaccactctagccaagtgatcaaagttaacattcttagttatgaaatgtttttctacttcatgcctcccttcctgctatggcaggtgcactgcaaaaagcatgacatcatcccacagcttgcctgccaaaaccacacaatctgaatctaagcatgaggaaaccagataaagccaatctaaggagtattccataaggcaactggcctgttctcctccaaaatatcaatgtcttaaaagtcaaagaaagactgaggaactgttccatgttaaagaagactaaaaagacataataataaaatgcaatatatcttggactggatcctagatcaaaaggggaaaaaaaaagccataaatgacattattgagacaataagtgaacactgaatatagactgcatattagataagagtactgtataaggttaaatttcctgaatttaatcaatgtactgtggttatgtaagaaaaatcattgttctgagaaaatattctaattatttataatacctctaagtatttagaggtgaagggtcttgatgtccacaattaactggctcagaaaaatctaaatctccagctccatctttatctggtgaggagagtgacaaagccaacatggcaaaatgttaatgactagtgatgctgagtaaagagaatagaggaaaactccttgttctggtcttaccactgatattatttcaaaatacaaaaatttttaaaatcattaaatagagtctctatacataccactgcctttctggcctttgctaaattctttttcaggtcaatcaaccagggtactatgaactgtagtatagtttgctctgcaagagttaaagacaaggggatctgggccaggcacagtggctcaggcctgtaatcccagcactttgggaccagtctggccaatgtggtgaaacccagtctgtactaaaaatacaaaaagaaattagccaggcatggtggcaggcacctgtaattccagctactcaggggactgaggcaggagaatcacttgaatctgggtggcagaggttgcagtgagccaaggtcacactattgcactccagcctgggcaaaaagagcgagactccatctcagaaaaaaaaaaaaaagaaaagaaaagaaagaaagaaagaaaaacaagaggatttgggagacagggtatcatttgtgcagcttttgatctttctacttatcccatatccataggggccaactatgtgccagcttatagagcctgaaacatttagaccctgaatgattcatgagagaaagagggaaagggggagacagggaggaaagaaggcagatccactcacttttgggtcatctggagattacgagagaagagacctataaaaaagcctgtgttgattcatctcactcagataaaatctgagtactaattggctgtcatactctcgtaaatcaaacttgattatttctctccctcatttctcacatctaatcaacaaatctagttcatatgacctctgaagtagctctaggatctgtccacttctgtccagcccaggccatcatcacctgaacaacatcaatatcctcccactagttccagtatatttgctcttgtgccccctattctccacattgcagtgactggattgcttataaagagaaaatctgaccatacgtgcttaagccaccccagtgactttgcccagctctcgagcccaaacccttaccatggtctaccccacactccatgatctgctccagccaagctcaccagcctcattgccctcactcccctacatcctccagccatgccctctcttacctcaactgaggcatctaatatgctgttccttcttcccccaattctggacttagccaacacctcatcatttttaggtctcaacttaatcatcccatcctcagggcagtctgctccaatcctaagattgtgttagcaattcacgtccagctctactgggcttttataaattcattacacagacaattgcagtttcttattcatcaccagcctgtgagaaccatgtctgtcccccttcatctcagtactcccagtgtctagcagagaacatggcatagaatctaccctcagcagataattgttgaatgaagaatgaacgacacttaaattttacctaagcaaagaaaaaagaaaacatagagactaacaggatgcttgatctatgttctctgagccctccacgcttcaagaaaatactgtcaaaataagaaaccgctgactttttcacttcgcttcaatgccattagttagcctagttcccaaaagagtggttttggtgtacaggatcaactttcttggtaaattagagcttctttttgtcctaaattcacttttcctctgttctcaagaggttctgcctgcttctggtaaacaattctatgacccatattcttcatgggtttattcatgctaattgtatttcctctcagtcttttcaagcctgaggagtcctacttatttcagtctgtcttcatcctatgagatgttcttctctgatcttcctttagttccagcacaccctctcccacaagattaatgaccataactactaacagcattctaaacgccaacacatcacttcatggattcatatgaaggctggctgatactgtctgactttaacaagcttttttataaagtctgtctcccagactcagaatgagagtttttctcagagataggtttatttgtgtatgtgtctgttccctcaaagatggccatggctagcagctgttcagacttagaagtggtcttccacattcaattaggacagacaacaaaactagtcacacagtttcttttactgggctgcgttggtcttgtttggggttcaaggaggagagatcccattcctgccctagaggccttcattctcactcagctccttgccagaattcctctggactatctcctggaggagggctggcctgactaccctggcccaaactatcataaaccttaaatatcaaatgaaactgtatgtgaatgattgctagagcatccggtttaaattattcatgtcgttatcactcatatttttgccaaacactccagaatttcatcttcatgttctttttaaaatccagagtagaaaaactttgtagccaactccattaatatctattttacctgtttattctaggtcacctaagccacttctgacataaaagatgattttgcaatgatagcagtgatattctactccactgtcttttctcttctttctttctttcttttttttttttcagacagagtttcactcttgttgcccgggctggagtgcaatggcacaatctcggctcacagcaacctccacctcccgggttcaagtgattctcgtgcctcggcttcctgagtagctgggattacaggtatgcgccaccacacccagctaatttttgtatttttagtagagacggggtttcaccatgttggccaggctggtcttgaactctcgacttcaggtgatccactcacctcagcctcccaaagtgctgggattacaggtgtgagccaccatgcccagccttctcttctctttctttttctctcttttttttttttttaagacagtctgtctctgtcactcaggctggagtgcagtggtgcaatctccactcactgcaacctccaaatcccaggctcaagcaatcctcccacctcagcctcccgagtagctgggattacaagtgtgcaccaccacacccagctaatttttgtatctttgtagagatggggtttcaccatgttgctcaggctggtctccatctcctgagctcaggtgatccactcaccccggctgcccaaagtgctgagattacacacgtgagccactgagcctggtctctcttccctttttatattctcaccagtgatatcatctccagtcccatggtttcaatcatataaccgaatgtcataaggacatccaacatgacatctccccctccgtctccccaagctctttctctaagtccaggctctatagttccagctgttctataagaacccaaaccaaaactgaataaaacaaaagcctccccacaaaaccacaggctgtggaaataaggttctttggaacttaatggctagattgatagttattacaaggcaaaatctttgacataaatcacagactcttagaaatcaacatgtatttgaactgactgaataaatcatcctatgggtaacaggaatagtgtcagattttgagtcaacaagataaaactttcaacagtatgctacttccaatggggaaggaatggtcatgttttctgagtcagttcctaaaaactgtaaagagttttcatttgttttttgttttaaaacttaatgaagctttggatcctatagtcaatttacttaaaattactcattttggcctctagactatactgtaccaaagttcattgtgtgtgtctcctacagcagctcttgcattgttaagagtaagcccctttcactgttgtacaatgcgaaacacaatgctgtcggcagtcctgacagcaagcggcaaactcaggcctcattcccaggccaaacactaaggcattgtgtaactctgttcaagcctcataaacctatccatgcttcagtttccccacgattaaccagtaacattttaacactctctgccgcttcctttcttcaggaggatgttatgaggcctgggtgcaatacatcatgctactaagaaaggcgccatacaggtaaataactgctcattgcgattttcatttttccaaggtatcttaagtgacagttagcttccttagacaagggcctggccacccaatatacagcccagactgtagtacttccaacagcccacagcagcctccacatgctccattctatcccagttcagcccaagacactaaacacacacaacctgtccccactcccctggtagcagcaaatagagaacagagccagtctgaatataagtataccctcttggggggccaaccaaggtcatggtctccactgcctagactgcttcagctcacaggccttttcacacgggacaagttatgacttggtcttttttaaaagaacccagtgtatctactatattatgtcaggacacaggatgtttccccattctgtgtacccacaaacttctagtgctgtatttgaggaaatggtgtgcctaggtcttgagagagggcaaagaccagaatcaccagtaataactgactatatcgtagactttggacaaatcatgtaatcatataatcaacagctgaaataatggattagcttgaaagcagaagcaaaccccttagaaatatgtgcttaaaaaggaaggtgactacaaatattggaaagaaaagaaagcaaaagataaaattactagagtaaaataaggacttgcatttcagtctgatgacctagcaccaaggcagcaagattatcttaaaatgttcccatttctgtttggaacagaaataaggtatttatttccccaacagtgccagacattttgtaggtctagcagagcactgtacacaatcagtacttgatgaataacccctcatgtcaacattgcaaagcactaatcaagcatttaattgtacatttcattttcctctatatttctaccttaatgactccggccaccctccaaatcaccactattccttcacatggtctgagcacttaacgtttctatgccaccctgttcctgtgcacacagaataaaagttcctccccactttcctacttggcaaactcctgctcaaagttctgtttaaagggcacctcctctgagaagtgttcaattccctcagagagaaataatcctttcttccacttcttggtcctgtacagactagcactacagttaatactatgacacatgtattcttttctaagattcactggctgatagaaatatgcacacagacacaaagacatatccattcttggtcctattataggttcaaaaagcttaatcttacagctaccaaggggtggccaggcaccaaaacagaacagcaaagttgtcctacaaatatgtgttactagacgagaatctagctcaaaatcctcccactttggcactggcccctgcattgccagtgtttcctaccatcctgtttcgctaaattcccagccctttgggacatggcatttgtttcaattgatgctctgtttttcatcatgaatacatgattttattctgagcatgatttcaatttgattgaagctctgtatagttgctggaaacttttcttcagtcggctttgggacttctccacagccagactacccaagccccacactgttcccttctcatttcaatactggtctcgccagacagaaacacaaggtctcctatgacagctcaccaggtctttttctatgtggcccaagggtgaggccaaggaccacactcgataaatactttttagattaacgaaacatccatgagttagtacctaaagggaagagaaaagtcacccataactttaagtggatatatttcttacatagttggcttccaaaccaaaaagaggcagctattcattctgacccttctccaactctcataatgaagaaaaaaagaagcttctaaaaagaagtcaatttctagaagtgttttctaacactaagcgttgctcaatgagtaaaacattaagaagtgcttaaatatgtaaaatgacttgatttagaacaaaatattttccaggtctgtaacagtcagttatggctctgtcttttgaaaatgtaaacccagtacaaaatacaacacattacaaaatgtgttacgggatttgtcagagctgcttgagctctgtaggagacattgggaggggcgggtgtcctagtaaattaaaaataaaactgtattgaacagcagatataagtgacttatgggtattaattcatctattccctagaaaagtaccatatgatttcaatttaaagaggaggaaactgaggctcaaagaagttaagtaacttgcctacgtggaacaggattcaaaccctggcagtctggctcctgagctgttttccaaacttctgcaatgataagcctctaatttctgagggcgtgtcattcaaaggaaactttagatccattctgtgttgatagagggcaacaaagagataagaaaatgtacccgagagctattaagtggcagagctggggttcgagccagggttattccactccagagccctagttcatgccctcaagtcagggatcagagcatcagaagtggggtgttctgttcttttgaggaggtgaaagagtgctttaagtaagtttgcctttgtaactgaagagaaaaacaccgggcaaaggaaggcgaagatacaagtctttgtattgcttctttacttgtaccagcaggtttatggccaaagtatctctcattccaggcaaaagggacctgcagctctcttggagttagagaagttgggtgagaaatagcatccttaagattcttgccctgctgaattagagagcaggggaggaggaggagaggagattgactgggatggaagaaaaggggataccaaagtgctgctggcttctctctttcacactgtttgcttctttcatttaacccttttttgtcctctggaaaggataaaacttatgtattaagagaagccagccaggtgcagtgactcacacctgtaatccctgcactttgggaggccgaggtagggggatcatttgaggtcaggagttcgagaccagcctggccaacgtggtgagaccccgtctctactaaaaatacaaaaattagccaggtgtagtggtgtgtgcccgtagtcccagctactcaggaggccgaggcaggagaatcgcttaaacctgggggactgaggttgcagtgagctgagatcgcgccactgctctccagcctgggtgacacagcgagactgtctcgagaaaaaaaaaaaaaaaaaaagagaagcccatgtgagctgcagagatttccaaccctaagcacagcagtaaggaaaaaaatctcttttgaaacagcctcaaattatatgtatatataaattataccttaaaatatatgtgtatgtaaattatatctcaataaagtaaaataaataagcaaatactaaataaaatatgttggaggagagtataggaggaaatatatgaataaactgggttgtgcagaaaggcatgtgaaggagaaggtctataatgagcatgcgatctcttagctaatcctatctttctagttgtaagaagagaaacaaaaatcaaatatgcttcgatgtcttagggtgactagtggttcttgcaaacaagttcaaaatggcatctatagcaagaaaaataacaaacagggcaaaggagtgctgtgaagaggcccctggctgccagacacagcccagctgaagacttctccacgttccaagagcaacctatgttttgaggtggaaatcctgtcatcctttaagaccctagtgggaaaaaaacaacaaattgtttttatagaaggtgggtcaaacctttcagccatgtgggctgctgggagcacacagatgaaggctttggactggaattgtcccagggctgaggcttctggccaatacatcacactgcctcaggacactaaatctgtctttgccttaccctttgtatttctcaatccacattcctttttggggtgaaatactccattatttctgctttgttctgggctgtctcctgtctctgtccctattaactcgtggcaacaaaagaaacaaacagaagcaggggatttcatgcttagcagctatagacattggcctcacggctttgcagaggggcagacatctgagactttgaatggaagagagtgctgctgcgctgaaccagacccggggcccacgtggctcccagtctgcatcagtcatccccgatcagtggctttcaagagtctcggtatgtggaattcaagatgaaccaaaagtgagattttaaaagttagggcatgtatctgatgattagatttaaagaaatgaattcaagattctcatataattcccagctatgcataatttcacatcttctcacattggaaatagatcagaggaataggatttttttcttttactaggaaagaaaactaagtaaaaaaataaatgtttcttttaaaaaaatctaattcttacattgtaatggcttgaagggaaaaaatcaatttttataaaaacagaattatgcaataaaaccagcaataaaatacccaggcataaatgtctgtaacgagacctaacctttatatgccatattcataaacatctccaaatcagggcctcatctaggtcagtttcagaccatgtactatttttttcctaaagagcaaagtaatacaatttaaaggaaagtgaatgagaaactaatgcattttacagcaaatctctttttttgctgattacctgaacagaacatttctaaacaggaagtaggccataaaaatacacaaacacttttaacattccttaccaagggcattttctatattttaaagacttaagaagggtcaggacatgaaaacatttaaaaggagctaggtggtcgggcacagtcgctcatgctggtaatcccagcactttaggaggtcaacggaggaggatcacttgaggctaggagtttgaaaccatcctgatgaacatagcgagaccccatctcttcaaaagaaaaatttatttctccacatcctctccagcacctgttgtttcctgactttttaatgattgccattctaactggtgtgagatgatatctcatagtggttttgatttgcatttctctgatggccagtgatgatgagcattttttcatgtattttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcctgtttttctcaggtttgtcaaagatcagatagttgtaggtatgcggcgttatttctgagggctttgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtctttggtagcttgatggggatggcattgaatctataaattaccttgggcagtatggctattttcatgatattgattcttcctacccatgagcatggaatgttcttccatttgtttgtatcttcttttatttccttgagcagtggtttgtagttctccttgaagaggtccttcacgtcccttgtaaggtggattcctaggtattttattctctttgaagcaattgtgaatgggagttcactcatgatttggctctctgtttgtctgttattggtgtataagaatgcttgtgatttttgtacattgattttgtatcctgagactttggtgaagttgcttatcagcttaaggagattttgggctgagacgatggggttttctagataaacaatcctgtcgtctgcaaacagggacaatttgacttcctcttttcctaattgaatacccgttatttccttctcctgccttattgccccagccagaacttccaacactatgttgaataggagcggtgagagagggtatccctgtcttgtgccagttttcaaagggaatgcttccagtttttgcccattcagtatgatattggctgtgggtttgtcatagatagctcttattattttgaaatacgtcccatcaatacctaatttattgagagtctttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcgtttttgtggagaaataggaacactcttacactgttggtgggactgtaaactagttcaaccattgtggaagtcagtgtggcgatacctcagggatctagaactagaaataccatttgacccagccatcccattactgggtatatacccaaatgactataaatcatgctgctataaaaacacatgcacacgtatgtttattgcggcattattcacaatagcaaagacttggaaccaacccaaatgtccaacaatgatagactggattaagaaaatatggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattaacaatgagatcacatggacacaggaaggggaatatcacactctggggactgtggtggggtggggggaggggggagggatagcattgggagatatacctaatgctaaatgacgaattaatgggtgcagcacaccagcatggcacatgtatacatatgtaactaacctgcacaatgtgcacatgtaccctaaaacttaaagtataataaaaaaaaaatcaaaaaaaaaaaaaaaaaagaaaaatttaaaaattagccaggtgtgatggtgtgcgcctgtagtcccaggtcctggggagggtgaggcaggaggattgcttgagcccaggagttcaaggctgcagtgagctatgactgtgccactgcactccagcctaggcaacagtaacactgtctttaaaaaaaaaaaaaaaaaaaaaaaaaaaaaaagagagagagagagactaggttccacaagtagaccttcaaatggatttaaatatcaccacaaaaatccctaggaggaaagatctcaataaagtagattctttccattcactgtgcttttggaactgaagctagaaaggcttataacaaaaaaaaaaaaaaaaaaaggaaaacaaaccaaaattgtttttcttgtagtccctaaaagtggaaatcctattctattcttcacttaacaatcttttaggctccataaagatggagctcagtcccatatattctactagtcaccaattcctatgaatctgtccaactttgcctctactatttccctgttcctcctggatcccagtgcctttctttgttcaggacatcaccacagtcctttggataaccacactatcttttctcctaactggtgtcattagttcaggtcttatcctactccaattcagtctccagaataccatgtttttcccgtgatttaaaatctttctatagctacccacagctgtcaggataaagtacagactccttatctgggcagacaaggagctttatgatctgacctttgccttcatttctggcatccaatagttgttatggggaccacaggaaataacgtctataacagctaaaacatggtttgacacacaaaacttaattgataataatattaattattatttttcccaccaaatacatggccctcaaggcaatcctatgcacctccatgcagtttctgatccattctctttccggctccatgtcagtaaaggggctgaccctctgcctacacatccttcctcactattttcctctggctggctcttagttacccttcaaaattcagctcaatgatcatttctttcaagacaacttctgtgaccctcactctgatttagatgaccttctccaaactccctgagtatcttttctatttcactgtcataacactcatcattctgtcaagtacagttgatttgccatccatcttcccccactggacttagagcacttgaatgcaggcactacttttaattcaactttggaacatgagtgtctgaccaagccacatggccagatgtgctccccagtgatgtgcgtggctatgattaaaagcatggttagacaagcctgaaatcaaaccctatggcaatcaggacaagttacttcactgatagctaatctagaaaatagggatcatctcacaggattgctgggagtagcaaataaggtactatatacaaaatgctcagcacagtactcaataatcaataggtgttattatcatcatgagtgctaatattagatttttcagttacaatagtgttttcccaaagaaaacttatttttatgaccacacatcaggattcttctcatagtagataattaaagataattcagggtttaggcttattttaacaccaatttggtcaaagatctgatatgatatgccaaatcccaatggtggctaatgacacagaggcagtccatttggtttgcaataataacaacaattaaaagctcgtagtatgacatatagtgggacaatcgttggattattttcttcccctaaaggtgaagaaaacccctaaaaacacactttcaagaattactggtctattctaacagttaaatcgactctttttgaatataaatttctatgtagacctagacaaaagcataacagagcagaagtgtccgtaatccctgtacatcctcaaatcacactgctttaactgctgacaaagacaaatgtttactatggtctagcgcggagaagccaatacggtgagcaaaatgctatctcgcctcacacatcaacacacgtgccagacagattctgactgcaaagtctgttattggtgatgagagaggcagagagggcacagctggatatttcagatccacagctgagctggcagcagtgggagttcaagccatcttctcactttaaaagctggaatgaatctgtgagagttatttaaaggtgtgctttattaaagaggcactttctgactactgtcaaacttcacgagcaaaagctgaacacacagataaaggcagatctatgtggggtcacctatcagatgtcagctgatctctttcagcacccacaaatcacttattgaaaattaaataccaaaaaaaattttccttcaagattaaatgtagcatgtggacttaatttatattactaatccttttagtatttgctttatattattccctgaaattagtacaggcacaaatgccttaaattatgtttcttgaatttatagcccaaattacatagattatacaagtaccatatacagattcatgaagatattagagaggctccatgggccttatacatttaactagagctttactagaataaagtctcagtagcatcgactttttttttttttttttgtcaaacaaagcactcactctatcaaaggagttcttaaactaccaggaaaataagattcttgaacatcccaagtgtttcttaaaaagggatgtcctcattttccttttgtacaaaacagggttcagattgcaaataacagaaaagcaattcattggaaggatactgataattcacagaattgatgagaaggctaaagaacagcaagaactaaggcagcccaaggtaacactattataagtttaggagttgccacttatgctaactgcttgccaccctgcaccaaactccactgcagccacgagaatgacatcagaaggctccaaccccgggcattgtgccactgagctggagaatctaaccagccaaaccttgctggctctcatgctggggccctggctaccaggttgttgaggaaaaaattgctgccccctaccatcagcaatggaaggagggaaccctgtctccaagttcttgtgggattttctcctaagcagggcagccaaaaccagtatcaactatacatttggtccactggcccaacagacagcagaacttatctagtactacaattgaaggacataaaacagaacatatttattcatcttccaattccacagactgattctgactgaatgtgccagagtcttgggaatggctaagagtcagtctgaaccaaggcaggtgacaggatgagggctggtagaaaccctggagtgaattttcctgagcaaacatgttttgccctcttagtgtcccacttgttatttaatactcagctctcctattctacatgtattcccttctccctttctattttcctactgatacattattacatgtaagaagatgaggctggctgtgaatgtagaggaagcaaatgcctggcagttcttatgttcatacttgcatatttttgctttcctttcaccttcaatgtcttatggggagaaaatgggacaggacatacttgaagccatgtgtagcacctagcttttgttaaacacaaaaactccatgggacagtctgggctattgtttgtcactagcagtgtagatagacagaaactccttaaggatgtgtgactagccattcttttctttctttcttttttaaataaaaacattctggtttttgacatgtttgtctaagtaaggtacaatccctcaagtctcccttttccaatttgcatatcacaccataattgtgaagcaactgttacaacaagaataaaaaaaactactcatctggaacatgcaacaaaaaatggagcaatcatatttatggttagcaataaataaataaaggtccttggctaacaaactcagctttcccaaaaggaaaaaaacctgaaggctcacagtaaactatcatgttaagaaaaagcagtgggggaatgggagtgggagggaaaggattaggtaaaggcatgtattttatagaaaaggacattaggcctcatttgcttggtgaatctgtggaaataatttatgatattctatacaaggaattatgactccatcctgaacagactgcttatctccccatggctcttcacaagcaagaaagggcatgctcatgactctttgactttagtgttaacattgattttataattacaataatattggataccaaggtcctcaagggaattagacatggacagtatttgccagagataaaatattcatcaccaacagagtatataaaatgtatctgagaggatcagggctcacttgggacccacacaagaggaataagacatcaccagaaaaatgcaagaattctctgatatgtaaaaatctgaaacaaagaatgtcagtcttaacaaattctgcacatattaaaataagacctcattgtcacataatctgggggcattccagtagggcagagaataaaaaattgacctgaaattttcttagagggcttccaaagcaaatacataacaaggcccacagctctctttttaatcctattaattttaaatttcttacaaatcacaaacttctctttgcctaaggtttacgtctcaagctaaccattttttttgtgcaatctttagggttttctacatacaggttcatgtcactggcaaagtcaatgtgcaaaaatcagttgcatgtctgtacactaataattaacaacctgaaaaggaaattatgaaaataattccatttataatagcacgtaaaagaataagacacttaagaactaacttaaccaaggaggtgaaaagcttgtacaataaaagccacaaaacattgctgaaagaaattaaagaagatacaaataaatggaaacacatcccatgttcatggacaaaagacaataatgttaatctgtcaacactacccaaatggattcaatgcaatcctatcaaaatctaaataatttttttatggaaataaaaaagcccatcctaaaattcatatagaatcacaaatgacaaaacaatcttgaaaacaaagaacaaagctggagctccagacttacacatacagatttcaaaacaaacgtccggtaatcaaaagaacatgttattagcataaacacagacatatagaccaatgaaatagaatagagatccccaaaataaacctttgcatatgtggtcaaatgattttgggcaagggtgaaaagatcattcagtgggaaagaacagtcttttcaacagatggtgctaggaaaactggatatgcacacacaaaagaataaagttgtacccttacctaatgccatatacaaaagttaactccaaatgaataaaagctttaaatgtaagacctaaaagtataaaaaacatagaaacatagaaagttttttcttagaaaaaaacacagggcaaatgcttcatgacattgaatttggcaataatttgttggacatgataccacagacacagatgaaaaaagaaacaataggcaaattgaactttatcaaaactaaaacatttggtacaacaaaagaaaatgtcaatagtgtaaaaagttagtccatagaatgggaaaaaatatttttaaatcatatctctaataagagatcaatgtctggaatatgtagacaactcctaaaactgaacaataaaaaaactgttcaaaaatggacaaagaatttgaaaagacattcctccaaagaagatatacaaaaggctaattaagtacatgaaaagatgctcaatatcactaatcatcaggaaaatacaaatcaaaactacagtgagggctaggtgtggtggctcacgcctgtaattccagcactttgggagtcaaggcaggtggatcacttgaggtcaggagttcgagaccagcctggccaacacggtgaaaccccgtttctactaaagatacaaaaaaattagccaggtgtggtggtatacacctgtaatctcagctactcaggaggctgaggcagaagaattgcttgaacccaggaggtggaggttgcagtgagccaagatcaccccactgcactccagcctaggtgatagaatgagacgttgtctcaaaaaaaaaaaaaaaattacagtgagatatcattaggatggccactgtcttagactgttcctgttgctccaacaaaatacgtaatttacaaagaacagaagttcattttctcacagttctggaggctggaaagtccaggatcaaagcactggcattttgtgtctggtgagggccttctgctacatcttcacatggcagaagacagaaggatgaaaagggcctagctagtttcctggaagcattggataaaggtattaatcccattcataaggccatagcccccagacttaataacctcctgaaggcctcaccttttaataccatcacattgggtcttaggttccatcatatgaattttggggaggacatgcacattcaaaccataacagctactatcagaataatggaaaataacaagtgttggcaaggatatggagaaattagaacccttgtacactgttgggaagaatgtaaaatgatatagccactgtgaaaaacaatatggcagtacctcaaaaaattaaaaatagaattatcatctgatccaataatgccatgtctggatatatactcaaaagaactgaaagcaggatctggaagagttgtttgtacactcatgttcatagcaacatcactcataacagctaaagcatagaagtaccccatatgtccatcaacaaatgaatggataagcaaaatgtgatatatacatataatcgattactatttagctataaaaaggaaggaagttgtgacatatgttacagcatgtttcaaccctgaggacataagactaagttaaataagccagccagccgtaaaaaagacaaacacagtttgactctacttatataagatagaattagtcaaagtcataaagaccaaatgtagaatggtagttaccaggaaataaggagggggatacaggcagttattgttcaatgggtatagaatttcagtgttacaagatgaataagagttatgaagatgtatgctggtgatggtggggatataacattataaatgcatttaataccactgagctgcatacttaaaaatagttaagatggtgaattttatatgtattttacaaaaataaaaaaaaattttgaaaaaaaatcccacaatttataactcatcccaaacctattcctcctgaaactttcctccttagttaacaacagctccattttttcagttgctcaggccaaaaactctagaataatccttggcacccctttttctctcaaaccacacatccaatcaatcagaaaattctgtcagcaatagcttcaatatatatacagactccaactacttctcaccacctctacccttaccaccccaatctcttgctttgattattccaaaagcctcacactggctccctgctttcactcaaacctccgtatagtctatttacagcacagtagccagagtgatcctgttaacatatgtcagatcaagtctcttttccactcaaaatactccaaaggctcccatctcactcaggctaaaaattaaagcccttatagcagactaaaaggtcctataaaatctgcctccttcctccttcctcccccactcctaattatttctatgacaacatctactactatttcttcactcagtcagttactccaagcaacctggccttcttgcagttcctggcccacgcttggtaacatccaacttcaggacctttgcacttgccattccctctgcttagaaatctcttgccctagatatacatatggttcatagtcactcctttatgttgtttgggtctttgctcacatatcacctttcagtaagacctgccctgattactcttaaaaactgcacatgtaccctaaaacttaaagtataagtaaaaaaaaaaaagccaaaaaaattgcaacctttcccaccacaacatgttctaactaccttacatgttttcccacagaacttactgtcttcttacttactcagtaatttactatttatttgtttattgccagtctcccctcactagaacataagtcccatgacggcaagattttttacaattgttttattgaattatttcctaaccttttatcattggacagaggttgatggaattctatattctagccgcatttttcttgaatggaaggaacatgcatccttttaaatcacatcctattaaatttggcaaatcttatacttttatgtgactcctcctgtgttttgtcttcctctagaattataacactaaggtcatgctaatgacaaagagttggggtggggggcgggtctagacagagttttaaagttttctaatctttacaagaagacacaagaggagaaaccagtcagtctgttgagagaaaaaacagaaaacgtaagtgtcatgaaagtaagaaaacttaagtgtttcaagagggaggaggtaagcaactaagatgaatgcttctgagtagttagatcagaacacacagataaccattgtatctggaaatatggaggatattggtgatcttcacaagcaccatcttactggggtggtgaagacagaaatcaagagtatgtatgtaggtccagtgacacttttcatttgacatgtttcacgtaggacattccttccattcccatggcttctactattttgatggcttctgaatcccatatctgcttcaacgtcctgctctggagagccaaactagagtttttaaacttcctgttaaacatctctatctagatctcccttaagtactctcaaactaataaaaatccaatttcagtatcaatcctaccacccacaaaagaaacttgttccttctttctatatttcctatttcagtaaattgcagcatcatccaatccatcatccaaagcttatcctcaatcctgtgtctctcacaatgtccaaaattgatacaagtctcttacttgtattgatttcacctcttaaatatttctgtaatactctaatccaggggtcctcaacccccaggcagtgaaccggtactggtccatggcctgttcggaaccaggcctcacagcaggaggtaagcagcaggtgagcaagggagcattgtggcttgagctctgcttcctatcagatcagctacagcattagattctcatagaagcgggaaccctactgtgaactgcacatgtgaaggatctaggttgcttatgagaatctaatgcctgatgatgtgaggtggaacagcatcaccctgaatccatcccctccaccccagtcgatagaaaaactgtcttccacaaaactggtccctggcatcaaaaagcttggggacctgtgctctaatctattcctattgttttacaataaagccttcatttttttttttttttccagaactgtaactacttcgacttatgtactctgcctagcacatcataggtgctcaataaatatttgttgatttcctgaaatagctcacatggctctgttataaattgctcagatctaggtttataaaattaatgctttcccttaaaaagcttggttgaatttttttaaaaaactgaataattgggggctaggatgatattaaataattgggggcatggatgatattaaatacagttatttaataactgtaaataaaaacatacaagttctgttggatgtgggtgtcccctgggagactatggtagtgaacactaaaatcctaatcgccatgcattggaattattccgactattactttctttagttccttcttatccacccagtcttctttgaaaacatgtttccccttcataatttagctctatattgtctaaaagctataacttcaatcaaagaacttaagcatttttaaagccaacaaaatacatgacatcaattattatcagaggcatggacccactgcgatgttcattttgaacaagacgagataagtcattcctggaagaacataggcaaggataaaagatgattcaagcctaatatgcaaggctcctcacctctccatcatttttatgagacccacaacatagtcttaaccccaataacctccatacggcctcaccaagaaaggatagaaaagacctcagaagtattttggccctaaaacatttttgaatcaagctagagaaagttatgaaactcagttgtcacacttgacttgcatccagaaacacaattcaaatgaagcatgtagtctaaatggctgatagttttcagctggctgtactttccagccacctaatatgaaaaatctaatctcaccctaataaaaatcttagacctggcaaaaaaagaaacatatagctttgtggtaacgtgaggagaggagggaggtaacagaaatggtagaatgacctcacagggttttgacttttaaacactaatatttatagattaaaaactgtctgaaaggttaagcttggaaagaatctacttcagatacctgatacagcacaggcacaaaatgaaccatgtttgatctaacttgtaccaagggagaattttacctttagctttaccaacttcccaagaggacttctagtcatgctccttcaaatcccaaaggcctgcgtagtgaggtatgccacaaagagtagggtgtctcagtcctcctctactagtagatggaagtcacaaggagatatctcgagacattcaggatgtttatttactcagaaagtaaatctacattccttttgtccaacaggcaatatcattcttatttctcaaggcccaaggtccataactacttctccccacttaaggcttacactacattctgtactctcaaaatacttagttaatgttgctaatgtactatgtacttcactatgtacaagccaaattaagccacctgtggtcaatatatacctgggcagcaaggctcaagatagatcctatattcagacatcatcaatgaaaatacagaaaaaaatcaacccagactttactgtatttatcctttattcattaagaaacatgcaaaaagctcaggagaattttaaaaggttacaaaacatggtgatggtttaaatagctactacaacaactgaaggccccacagtcatttcacaaactagagaaggaaataatttgctccttccactaatctgacagttggcccaacctctgatttcaggagaccttttttcttttatctctagtccacttataagcacatatgaggacacacacttaatttttctctattttttctcatgtctaaagtaatacctgtaatgaataagttgatcaatcagaaatgtgtaaaggaaaaaagaaatgtcccttcatattcaaccctcctagagatgatcagtgctcaatccttcaacttttctatgcatatactaatatatatatacatctttctcttttcttttagtacaaaaatggaatcatagtatgcatacagttatacaactagctcattattttcctgacaactatgtattagtcccattttaggatgagaaaacagacccaaagaataggtgatttggcaaaggtgactcagctaataagtgatggagtgggaatcaagcccagaaatctggctgcagagtttcagtgctccccttccaaatagcagaaaagctgtagcccatcttctcctgtgtgctaccaagcaaacctgtgaatatgctaggacatattcatcaaagcagaaaaggattctacctgactctttttaatgtcagcatagaattctattgtatggctaccccaaaatttatcagtctccatttggtggctaaatacatggttaattttaaactatatagaatttagatttttagagctagaaaataccttaaagagtatgttttatgacatcaaaagttctcaacatagatgaacttactaaagccccaaatcttgaagcacattcatcaaaaagatcacaggattgcttggtagcagacaggagaaggtaggctgcagctttttccactatttagaagttgaacactcaaatttgagagccagatttctgagtttgattcccactccaacacttactcagccacatttgccaaatcacctaaaaaactgggccacctttgccaaatgacctaagttacatatatggtcctgttttctcatcccaataatgggactaatatacagttgtggtcaggactaaattagttataatgtaaaatacttagagtattgacttacaaataaagcagtaagtggtaataacaataattattatttatgccatactagttcaagcttaccttaaaaaattattaaaatttctgttctcggtgtgggtagaacagaaaacacaaacttttggttgttatttgagattttggcatttacacattcagtgctctttcttcattattctttaattattaaaatataaaactgtgattaaacagctgcagtgggatatattgaattataaagtatttgagtatattaaactgaaatagaattctaaatagaaatgtgaacatacagttatgccagaattgtttgttacctatagaagcctccttcaaatgagaaatggaagaaaacaagaaaataaaaatcatcagtgccactgcattttcattcatatgagtttcacaataaaggatgaaaactttaaactctgaagaatatactagtcaatatatattgattcttcaatagtaaaaacacctgggatatttttgggaaacagataagttcatttcagttcttcacaacacatagatttgtacttcctttcatattggtggtatttgttttcagtttgttttttttttatttttttacttgaacagactagactgaagtgtagtagcagagtccaaattgtttgaacatctttcagcagcaagaacacaatgttatctggcaattcattgtaaaaaagcagcatgaacttgtctgggtgctctccaggtaatgagaaatatctcatgaatgccagggaaagaactttaaatgactgctcttttaacacacctttcaggcaaatgtcttaaggccactgtcacagaaaagcacctgattgggagggggatgcccctacttcatgatcacactagcttggaagataattaaaactaatccttttacctgcctacatttcttacaagcactctgttcagcacagtacataaaaaagatctccatgttttgcaccaagattcaatcagtacttccacattttggggggaaatgcaagtccaaacaacagctcattcacttatttaaaacattcagctattttaaaaggcttagaaaacagagcataaggagctgaaattgtggcaataatcaatagcttaccaaccaaaaagagtccaggaccagatggattcacagctgaattctaccagaggtacaaggaggagctggtaccattccttctgaaactattccaatcaatagaaaaagagggaatcctccctaactcattttatgaggccagcatcatcctgataccaaagctgggcagagacacaacaaaaaaagagaatttataccaatatccttgatgaacattgatgcaaaaatcctcaataaaatactggcaaaccgaatccagcagcatatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgttaaaaactctcaataaattaggtattgatgggacttatctcaaaataatatcagctatctatgacaaacccacagccaatatcatactgaatgggcaaaaactggaagcattccctttgaaaactggcacaagacagggatgccctctctcaccgctcctattcaacatagtgttggaagttctggccggggcaatcaggcaggagaaggaaataaagggtattcaattaggaaaagaggaagtcaaattgtccctgtttgcagacgacacaattggatatctagaaaaccccattgtctcagcccaaaatctccttaagctgataagcaacttcaccaaagtctcaggatacaaaatcaatgtacaaaaatcacaagcattcttatacaccaataacagacaaacagagagccaaatcatcagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcatgaaaatagccatactgcccaaggtaatttatagattcaatgccatccccatcaagctaccaaagactttcttcacagaattggaaaaaactactttaaagttcatatggaaccaaaaaagagcccgcatcgccaagtcaatcctaagccaaaagaacaaagctggaggcatcacgctatctgacttcaaactatactacaaggctacagtaaccaaaacagcatggtattggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacatcttatacaaaaatcaattccagatggattaaagacttaaactttagacctaaaaccataaaaaccctagaagaaaacctaggcaatactattcaggacataggcatgggcaaggacttcatgtctagaacaccaaaagcaatggcaacaaaagccagaattgacaaatgggatataattaaactaaagagcttctgcacagcaaaagaaactaccatcagagtgaacaggcaacccacaaaatgggagaaaattttcgcaacctactcatctgacaaagggctaatatccagaatctacaatgaactctaacaaatttacaagaaaaaaacaaccctatcaaaaagtgggtgaaggacatgaacagacacttctcaaaagaagatatttatgcagccaaaaaacacatgaaaaaatgctcaccatcactggccatcagagaaatgcaaatcaaaaccacaatgagatatcatctcacaccagttagaatggcagtcattaaaaagtcaggaaacaacaggtgctggagaggatgtggagaaacaggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttatggcagcactattcacaatagcaaagacttggaaccaacccaaatgtccaacaatgatagactggattaagaaaatgtggcacatatacaccatggaatactatgcagccataaaaaatgatgagttcatgtcctttgtaggaacgtggatgaaattggaaatcatcactctcagtaaactattccaagaacaaaaaaccaaacaccgcatgttctcactcataggtgggaattgaacaatgagaacacatggacacaggaaggggaacatcacactctggggactgttgtggggtggggggagggggcagggatagcaccaggagatatacataatgctagatgacgagttagtgggtgcagcgcaccagcatggcacatgtatacatatgtaagtaacctgcacgttgtgcacatgtaccctaaaacttaaagtataataataattaaaaaaagagaaaaaaaagaaaaaaataaataaaaaaaatttaaaaataaataaataaataaaaagaaaatagagcataattgtgtatcaaaatgacaagtcctcatcggaggcactgcatccaaatttgcttacctcaaactttgagaagcagccaagatatgaaaactctagagaaggaaaaacttatgccatgactggcaataagaaacaggctatagaaacaacaagtgtttacaaaccaattgagggtacttaagttacaccaggaaggataataaaaaaaaaccatctcaaaaattagttgatataatcataaaccaacaccctaaaagggttacctgtactagggttaggcagaggtcagtgttgctctgtcctcacattcatggtatgactgagagaaaatacagggaatatcttaacttaggtgccacagaaaatacatttcaccctggcaataagcacttcagctgttgatggcaaactttttattcatctttccatactctatcacagataggcgaaaacaacaactcaataaactgaaccataattatacttcttctgcagtgcttcttctcacactttattgaaacatcacttgttatagtaacaaaaagcctaccttctcaactaatcggatttactttcaccacttttttgcagctcagttggatgatcacgatacatacaacacctacgccctttgtctccaattaaatccctcaaattcagtgggttaggaaaaaaaaaaagagttgagtgattctcatttatctcaatagctttccttggttttaccctcagttcaaatctatggcttaccagagagaagaccagagcgcaatatctccgtggccttagtcctgactctataatgaatcacttttagtttcttttcccaggtgcacctctttccatctttctcaattccttcaccctatacttcaccaactaccccacacgctcctcaccctacaccttaccaactaccccatacccaccacatcaccatgaaaggaataagcttttgtgttttcagagtctgagatatgaataagattctttccttggtcaaacttcagttaggcttccgaaccttctcctaaacccatctgtgcacttctttgtgaaatcccattttagcaaagagcctggctaagtcagttcagcaagaacccccatatctaatttgatcatccttctcctccaccatcccccaggtgatgtctgatcaccccagccagtcttccgcaagaatcctgttaggttggtttagccagagtcccccttaccccttatgcttcttcttagtaattttccatctactgatccccaccctgctctttggctatgaattcctacctccccatgctgtacttgaaattgaactcaatctttcctcttgcactgcaagaacccaatgcagtggtccctatacctatggtgatggtcctgaatagtcttcctggcctttactgagcatcattgaataatttttctttaacatgtaaccctaagtcacaatggaccatctccttgacctcctaactttagtaactagggcctcttagaaaacctcaagtcagaaatttaaaattatatagggataaaaatcaagagagcaagctatgtaactggcaggaaattcaaagcaagaaggaattccctcacagcacaaaaacatgggtaccaactagagtatatggcacaaataaattcgaaatttgacattttaaaagtcatatgaatgagctctctctttagctcaataatgactcctgtccctttaagaagtttattatttaacttatttcttaggcaagtataattaagaaacaaccactcatattgtagaataatcaaggcagaaaaattatatgtatttgtgtgatacagtattatggtaggcagaataatggctcctccaaaagatatccatatcctaacccctggaacctgtgactgttacgttacatggccagggggcatcaaggttactaatcagccgaccttacaaatattattctgaattaatccaggtaggctcaatgtaatcacaattgtccttaagcagaaaggaggaagtcagaagagtcagaatcagggagatggcattgtaagaaagactgactaatcactgctggctttgaaaatgaaaaggggccaatagccaaggaattcaggcgacccctagaagctggaaaaggcaagaaaagggaatctcctctaaaggaatgcagcctggctgacatcttagtttcatcctggtgagacccattttgaacttctgaccaccagaactgcaaagtaataaaatggtgttgttttaagctacttagtttgtggtaatatactagcaatagaaaactaatacaagtgggatgccaaaaaatgaataataaagacctagctcttttcagttatataaaaggtcatttcatatgcaattatccttaaagtatttggaggggagggtgttgtacttttgttttctttgtacctatttacaaggtttcctaaagtcaaattattatctgaaatatcacctttcatgaataaaatcaatagaaaaaagtcttcatagatttctgatgtgccagaatatatccaatacataagcaatatataccagaagtcctagggaagcaccatttttccattataaggatagaaaaagttaatgtaattattccccattctatgccatgatttcagggggttccctattttccatgtacttatataaagctcccaaattatctttaaaataatcctagcttgttttctcctcacaacttggcctcatttactctcctgaatcaacagtaagtcccatcccactccacccttactatactcagctccccactcccccctcactgttaaatacacatttcttggtgtaaacctcagaggacacaaatcggctttaataccaacagaaaatataattatccctaatcagatacaaagagttttaatatatttcaaaaccaaactgaataacatttaacttctcttggtcacttaccattaacattaactatatagcatatcgccaagaatatcgacttttttaaaaacaaaatacttcgcagcatcacaactcccctttctcatctattggaatagattctggataatcaactattttatatttaacactatttgatgtctttttataagcacaaattaaacaaaaataataatctcttgtttttctttccttatataaagtctttgaaagtatgagaaaatatccaatgactaaagtcaattttataaaattatattttgggagatctccatgtcacatacacaagcttctacctcccctcagtaacactggttttaagattcttgaagataattttaatcatgacaacatttttatgtatgtgtagaaccatcagctagtactattccatacaaggaatcactcactgttggtcaataatgttttcagtaatccaaagtgaactgaggaaaaccaagaacaaaaagggttggttggttggtttcccataaaactaccttttttcaatttaaaaggacttatttattcaaagattataatgttcctacaggcaggggcaggagggtattaaggtcatgaaatgaactcagtaatagtccctgagggttgtttttctaatgtccttattggcaaactaagtcccacctttgcccaccccgccaaggtttttttgtttgtttttaatattatggttctataaaatccaaaaatctggaagctgctacctaaacaactttgaaaatttgagtggtaaaggacatagtgttaagttatatacaattttcttttcgagagaggaaatcaatgtctgtgtttgtaaaatgttaaccaaaccacaaaatatctttttgtgataattatattaataacagtgagggtgaagacaagactgaacttttccatccatgaagacacatgatgaaaaacaaatcacatataactattatctacgccagactccattctatttgctgtaattcccacaggagacatgcaggaattctgcactgcccatgttttcagaaattaggactttgacttttccttccctctgcacgtttctgctgagaagccagtcttaaactgtcataaataaggtaagacttttggcagatgcacactgcttcgaattgctcatctgtacctatattgcctaaatatgaatctccattatccccttggcaattacattaactccagactgtggccttcttaaaatccagacaaattacccaatgcccatacttctttctagaaactaaacataatgtacacactctaaagtttccagtcaagtcttgcactttttttctcaacctctttacatttcagtgcagatgaataagattttaaaacgtaaaggagttgatgcttaaaagcacaccgtaggtattgtggatcaaaggccataattaaaggatcagttctgaacattgtgctgattttggagcaaacaaagctcatttagtagttatcgctcagaatccaatccaggtatttgtgtagcttgtgcactgtttttcatggaagtacctggaggaatgtatagtcatttacgaagaatcatctttgctatcaattcccttgccttttttttttttttccttgagatggagtctgactctttttgtccaggctgaagtgcagtggcacaatcttggctcactgcaacctccacctcctgggttcaagcgattctcctgcctcagcctcccaagtagctgggatttacgggtgtgagccaccacgcctggcctcccttgaacttttccaactccttggttgcacactcctcaaaaatcccaacaactgcaatggcatgaagagcgctcactttggatgaagtactttccaagcactttgggaggattattgtttttaatcctcataactcccctgggaggtatacactttacatcaggcccccatgacggtaaaggcatctgctcagagatcgcttgcccaagatgacactgctaacaagatctgggatttgaacacgagtctaatctgctttcaaaacaatataaaccactgcattgcactgcctgttagggaaaacccatcagggaataaaaaggtattccagctagtttgttccaaacagaacaaaagtttagggaccacccttggcaaaataacaacgtcccagaatcattgcctctccttactggctggcccatctgacacttaccgaagagcagttctttgcctttagagtataaccttacagaagctgagggctttgttagttaaactattatgctagaatcccaaccagaaactgaaacctgatatcgtgttcatgattaatcattcaacaaatcttatttgagcaccaccataattaactgttaagtaacttaaattctgctgtggaggactaaatatgtgaaagccatgttcctgtcctctaggaactcctggtcaaaggcacagtaagaacaaagactgctccagaaacagtaactaaagttacctgatgaccgaccaactctctaacttccttgtccttttcctcaaattcataattttctggtgaatggagaagaaagacatgaacactgtttaatacttaaaaagtatctagtggaacagactaaattgtcctccttcccccttattcttcttctggtttggccctttctcctccacccccagaatctgtattttttctttggctaatctagattaatgataccagattaagagaactggacaggaaaaacaaaacaaaccaaacagtggcagtaataaatagattatattgatctggcccaaagtctatgtctgtttaatgctagtagttacatagtttatgtagagttgcaagggggtaaaaaactaatcccagcacctcaaataccataattaggacttctcgaagcttgaaaagggtgccagtaggatcaaccttctgagtttgtactcttcattcattcaacccatattgactgagtgcccaccagtgccaagaggtagatatttatagtgaacaaggaagatatgcccacagccctcattgaagttatagtctagaaggaaagtcaatagtaaacagagtcagaaatgcatgtttaaatactgtcaatgagaagcactatgaagggaaagaacagggtgcctcttaaaagtttaccagattgtataccgttatacttcaaaaagctgagagggaaagaaatctaagaggtaagtgatcttatttagatgaagagttaggaaaaccctctgtgggggataagaaaacaaaaaatatcttagctgaaataattaggagttagccagacaaaaaaaatgaggagaacaacgtttcataaagaaggaactatatttgtgtaagcccagaggggaaaaagaacttgatttgtcatagaaattgaaaaagctagcatggtcaagaagtagccgtcagggaaagaggagaatagaaacacaagaaaatgtaagggcagccaaccttatcaacacacctaaaccagaagtcttcaaatgacttctaataatgtctctgatacaaaatcataatgaatatacaaagcccagatgtaaaaaagtaagcaattaaaatacaatgcattttcaaaattctcaagtgaccaagatttgtaactggaaaggctcgtctagtccaatgaaccctacatctttcaaatgagaaggggaaccccacgcccatgcgtgagatgctgtcatcctctctgaatctcctttctcaaagcacccacgttcctctagcagagaggagtcttgcttttcctgaagggttcttctacaccacatgatgacaatatcctatacaaaagggacacagaagccactggacagtaggtgcacaagatgtggcacgatactaactcccatggcccctttcaatatacaaatgtatgtgggtatctgtctgcacagggagactaagagaattttaaaaagaggccaaactgcacttaaaactcctccagaagagatattttacttcacccccaatgttacctcttcttaaaaacatgacagttacaagcatctaaacacagacagagcatgcttctatttagtcttattcctgctctacagaattgttcacactgcacctacactttctgaccaaaccgcctattgagaagacaatctgcagttacacaaatgagaaaagacctctttaaagtggcaggttgaatacagtcatttagttccactttctcctaaaactgcactaaaatgattttaaaagacatttttttaaaaaagataaacacacttggacataaaaaataactacattttggaaactagaaagcagaagaacaagtggtaactggtccagcagacaagaagctgactctaaacaggcagtgaaagaaaggtgggccacaagacagtttgttccctgggattcccaagaagctcaggaatggctggaatccaagatcccttataaatgggcatgaaggagggactaaaaacaagaggattggttcagatctctttaaagaaggacttaagagttctagatcctctctccgatttcacaagctgggcaactggctctgccaccctggtagaaggctacaccttttattttctgtactgaagatcactaggcacatattaaagcaggagtattgtacagaaaaggagaattaagtaaaactttagcatagtgaatattgagagcccaaggccccttttcccccttgcttcccccaccactgaggcccaggcttacattctccaggtgggagcctgaaagattcttctttggaatatctaactaccccaagagagaaaacctaaagatatgttattgggagctctctgataaaacagccaaatacccacgggagaaacacacagtagataaatctcactcttgcacacagaactctgaattagcttcaaatgccccacttttaaatataaatagacaagaactgccaggcgtctaagaagtcattaatatgaaagacagaaacctaacacaggaaaaaattttttaaacttggggtatgcagaactatacaatgagatgaaaatctaatacatatatacatgcacatgcgcacacacacacgcacacacacacatattcacacaccaaagcacaccatgaaatttcagaagactggaattgccaaacaggattaaaaacaaaatcatcaccaccaccagaaaaagtacttcagatacaaaatgttcaggatcaaaacaatgatgctgctctggatagcaacagctagaagcttagaaataaatggcatcatgacttcaaaactatgatggacaattatttccaagctagagttctataccaactaaaccatcagtcatgagtccaataagcaaaatctcaaaaaaaccgacttcccatgaactttggagtaagctaaagaacacaaagacctggaagccagcaagcatcttacagaagaaagggtcccctcaacatgataattcagggggccccccagtgacgacagccatgcagcagggctggtcaacaaccagtccagattggcgtagatcagaagctctgagagaatgtcaccaagaagatgaactagatacaattttatagcacacctatttgaaattatgaagaggagatttatacaactcaagagagacagaatattgactgaatgatgaggacgtagcaaactaagtaaatgacaaaataggacaatgactaactcaagagaaagtagagtttaataaagaagaaatcataatatgacagcaatgaatggcatttataaaggcataataatgtaaacacatggatttacccaaaatgagaacattaactatatgggcagaatgaaggagtagggggaggtaaagatgtgtgttggggtgaatggagagagaaaagagcgaaatcctcaatttccaaagcagaagccaatagacaatgcctaaacctgaaaaatcaagaagtagctatataagtacattaactagaatgatggtggtaaatataaaaagagaaagagagagagagagagagagaggctaaatacagtagttgaaatggagaaagctagagaaagagaagttagagagggcatttgaagggagggaaggaagaagaagttcaccattgaccactggttttcacataataagttctataagattatttgatcttttagaaaatgttcatatacaaccctgataaaaataaaaactaaataataaaaagccaagaaatatggactagaattgaatatccatttctgtctcccttatactattagaaaatgtatacctgtattttacagcacaagtagtaccattctttttaaaggactattttgaggtcgtctttagcttaaagcacatataatgaaaaaaaaaatcattcacctcaggtcatttcttttacctagacattggccagacatgctgtataaagagactaatttttgaacagttacttgcaaagtcaacattcttccagagtgtttgaaactgacagcctttcttattttttatcttttatttattcatagcctatcttctccctcaaagaagtaagaaagctatctttttcttacatggcaactttctcttcaaaatataaagatacacagtgacttagaggattatagaatgctaataaaacagaagagctaaggagttctttgaaaaaggaagaaaaggtgaataaatggtagaaataacattaatttcttctttgtgtcctaatatttggcttgaatacaatgccaacttttttttccttaatgtcttccatgaaagctgaaaaggcaaagaggcataacaagtaaaattaacaaaaatatgctttttctttgttattaagtattcttctaaaaagcaagacatttttaaacgtacccacttcaaaatatattgtaagattctgtgacacaggcatcattaccataaaatcctcccaatcaaattataattttctttttcatgaactatatttcttaagcaaggcaagaacattttattaaaaataatgcctattatctattttattttactataatccactcactttccagccaatttgctccgaatattctcttggaaacttgtacttcaagacaatggcttcactcattacgttatttcaacaaaatgataaatgtattgtgaaatatattatatttgattatcaagctaaagcattgcaaatggccatcacagaacccaaattcacccataacattctatcccccagaatagtcctctgacaacaaatgataactgtacatgacaaatcctttgaggcatctgggccttaaaaattaaagggccattctgactaaagtatgttgattttccaaaggaagttttgttgcagttgttgctgctgttgctattatttgaattgactaatcctcaagtaggttctagccaccctgaagaatatttacaaatacaaatatattagaattgaaagagaccttatatgccacatagttcaatctcttttccttgagatgcaaaactgtggcacagagaagttaattcagttgacaaacaactcatggttaattcagtctcatagaacccaatctagtgctttttctgcaataacacattacagagtctgcaaaaccagcacaattactacctgacactgtcagcaaacaaaatgaaaatacacatattttaataagtagtttttgcttatttttgcagtcacacataagatgttatatctttacacaaaacgaaactaggattatttttattgttcaaaagacagactgtccaattatagctattactgaactagaaatgtattttcagtttatcttcccaaatcaagttagtggtttgtttggtatgcacaaagtattccaaaatgtcacagagtgggggctattgcagggttttctcctgcttccaccagaccacaaagggcaacaagtttggaggggacaggaaggttgggagcagaatacaaggagctgtagagctgttctatcggttcaggttttaagatccatgaatagaccctactcaccgagtgaaagccctgacaattttatctgagcattagaaaataattccttgggcagttaaaagattggaatatcaaagagctgacattagttttaggcagcgcttaaatgaaacacttttttttttttttttttttgagacagagtttcacttttgtcacccaggctggagtgcagtggtgcaatctcagctcacggcaacctctgcctcccaggttcaagcgattctcctgcctcagcctcgcgagtagctgggaatacaggtgcccgccaccatacctggctaattttttgtatttttagtagagacagggttttgccatgttgggcaggctggtcttgaactcctgacctcaggtgatccgaccgcctcagtctcccaaagtgctgggattacaggcacgagccaccgtgaccggccaaatgaaatacttttatactcttatcttacttttaaaaagaatatgataatcagagagttcaggaaggaaataaagaggagtagataaagtccaaaatgaggaatatgcttatctggagcacacctacttaaccagaaaagagtaatttgagtaggaagaaatgccaagtcactaatttgtttaaggatcttggttattggttgattccattaggaatgtgtctggctacaagtaacagaaaattcatgttaggtgctttaaacggcatcaccaaacctaaagggccagagagtaaatatttaagacctgcaggccatatagtctccgtcacaattactcaactctgtcatagcatgaaggcagccacagtcaatacgtggctgtgtttcagtaacactttacttacaaaaataggcaatcagccaatgggtcataatttgccaaccaatggtttaaccaaaatgtcaatccctggtttaaacaaatgagacttaattaaaaagaagctggccttttttgtaaggtagtaagaagggcacatcagctccagatgtcacatttctgtttaagaagaggaaaagggaaaaggaaggtagaaaagggaaaaggccacatctgtcccttttcacaggaaagcaaaaactttccccacagaacctcaagcagaccccctcccccataagatcactagtcagaaccgagcaacacagccacatctagttgtaagagaagctgagaaaacagggaacacaggagtctaagtggcttagaccaatcatggttcattcattgcctggggctagacacattgctgcctcagaccagggtattttagcaagaaggataaatggctattgggtgtacaatgaacagtgtttgtcctgttggactattttttctgttttctctattggcataatctgctcaaagaaaatatgctttcttagctgtgaactaattagtcaaatggagattgagaaagattaagcatgtttggtggtaggggtggggaacaaataagagtgaatctactgttagctacctaaaagtagtgatttaatgggggggagatgcagagtgagaaatctgaatagcagtcctgccagcccagttttatgaccttagccaaaacacttaacctacccatgcctctgtttctccaactggaaaaataaagttgttaaattagatgtctctaaggtcccttgacacactaacatcctgtatctcctttaaatatgttgtctgatcaagcaaacatagcataatgtatccagttaaaatttcctcctaaaaatagtaatgcccaaatcacaaatgtggaggattcccaggcagaataaagttttaaaccaaagaagaaaaaggattttattgaaataacttttcacacattgctaaaacactggcattccattcaacccttccaatttctaagaaaacacacgtgtaagaagggtagttaacttttttaaaacactataaatgtgtcttgtaaaaattatactgtttcttacaacaaacttaaaatagttctcaagtccaaaatggtaactgttctagctagacgactaactgaggatgctcgagtcaccccctccactgccacaaccccaaataagcattgcaaaagataaggtggcaggaagtagatttacttttgagatgctctctcaaataaccgcccttttaacaatgcactggaaattaatcaaaacacagtcaggaccattgaggttccttaagaaacagacttttcaaaaggaatccaaatgaataactcttttagcagtttgaggaaaacaggaataaagaaggaagacaagaagagaggcaggaagggagagggagagaacgttctggaggaaaattttgtttagcaaaaatgttcccatatttttttgagaagtcttccagttttatatccatatagcagagataataaaaatcttcaataaatgggtcataatttatccaaaaaaataccacaaactaagtgaaagctctaacactccaagaaattagtgcagaaaattattttaacttagtaccattaacccaatattcaaagatttgaagatggacaaaactgaaaaaatccatcagtttattgtttggaaaaaatgtaatcttttgagatttaatttagttgagcaacaattgtttttgctacaacttatcagatatacttacgactaaatttgaacacatatatgagagagaagtcttttaaaacaggccaaaatagcagtcccaaacagagtaatcaaatgattactgtatggcaagagcaaaaaagaaaggaaggaaaggaggaagagatggaaggggggaaaaaaggagagaaggaaggaagggggcttgatagaaggaccactacccagagatgcaggggctgctgcaggttaataagaagccttcagctccagcacatttaatagagaatactttattcactaactgatataactttgctacagccactggagtagataagagatatctttccagtaaaaattctgcaaagattctgccctgtactagaacaggcagcagttctcaatcctgacataccaaaggggttagcaggagtttccccaaatgcccattctcagacagatgaaagaacttcctttgaaaaatgctggagcttttcacctccgcaaagcttttttccctacatattgtcctctgtggccatctcagcattttcatcagctcccagcctcttcaccatttgtcatttgcaccaacatacaataggaaaacacattttccgacatgcctcagcgtgtccaggatgagatgcaccctcactactaagccgcattacacgaaaatgtgtgaaatgcattgcttgacccacttacacaaaaagacgcacaccatgtttaacacgaaacgtcctgaacacttcctgtggccatttccattcttctgacttcatttcaatgattgagaacttaagaaggtttgggtcatatttatttatttattttaaaccctcatgtctctcactttccttgcaggaacctgtgactcttgcatagcatagtagctgtgaccccacattggaaggaggtatgatcaaaggcagcctggccagacttgggaaaacatttccactgagaatggacatactgcctgtcaaaaggttattcccaccgcgttggggcagcagatcacgttactccagagtaacaacatgaaagggcaaaatctggccatagtcacccacatacgtgtttttctttccaacaagggcaaatgggagacaccagccagagcagaacatccttcttatcacttgagggggcttgggggtggggaggaggcctttccctaatcaatactgctcctaagccgcagccactgtttaatgccttttatatttttcttttcattcagaaacagctcacattcaacaagacttttctgtcttaaagttttttttttttaaatccaagcaatcacaagctatattctgtggaagacaaaataactttggaggcgtaaatcttaatgtcaatgacaggaaggctttggtgaaccattaccataaatctgacaaacgctaatttgatgggtggctgtatctgtctgctgcacggccagtctagacagtctattgagaaatcctaaaacacaactgtttgttccctgtaacaccatctggatatggcaataagcgccgacccagcgccattcacacatggatcaaagcacatgctaatgctatcatgaagtcatacacataaaaaattcaatctgagaactcgaagcaattttcctaagtcttcagcgaagaaaccccagacttagtgcgactcaagctaagtgcgcgaaggggggagggggggaaaaaggaactgaatatttaatgagcttgggcttccagaggaatgttaggccacccattgtattggaaaaggctcatgtcacacttcagtcatggtacccgtcagggtgcccctttacaaaaattgatctgaagacctttgtaattacctgtttcagtcaggggtggggggctgggggagtggattcatgacaagaaataaaagaatggatccaaggtgtaaatctaacattacattatattggtctgagctggcacaaattttcaatattgcatacaatattaaaaacctttctcattaaactgcactgtggcattagatcaaagaatcaagggcctcctattgaactcctttaaatattacaaacataagagcaagtctggctgtgcataaaatagaaacaaagccaattttttttgtccaccctcatcctatagctggctggagagaaacattgcttgagaaatctattgtaagtcaaacacgaagaaactttacttctcgcaaatatttaacaggcataaatgaatactagtctctagaatttcactttgacagaaatttttcagtaaatatgttactccttcaaaactttaagctactctttcaaaaagtatcactcaacagcatcacttcaattgcaaatcatagaggcagtggtttcatcctcaccaccctgtgatccaaacttctcaaggaaacaaagttcttactacacgggggtgttattccactgtgtacttctaaagtaactttgactcatgtgcttcttggctggcttatattgtctatcagtatctgatggaagaacataactaacaaatatcttataaatttgttattactatacttatctctgtttgctgggagacactgcatatgttatatcccaaatttccacatactcagcataagctatgcgcaaattcccaccagcacattttattttatagcagttataatagttgtctctatattatgggtatatgtatatgtatgtgtacacacacacacacacacacctaattaaatccccaaaatgtactaatcattccatggagggtgagtaaaaaaatataacagaaaaatctgttgggaattacatgctgtaactaagtgcttcagctagcacaggttgtggcttatgctgcaaatttctagtttatacagtagttaagagaatgtatataccttagacccgtacaagttaagcataaaatgataactgaaacagaacccatctacttagactacccagatgttttatctctttctattctacctgctaatgcctttaaagacaatagagaacaaaaaacattaacattacattttagttttttaaatagtttaaggtaaaaacaaaagccagattaagtctctaatcaatcattttacaattctagatagaaattaggtaaagaaataggaaaacgagataaacagttaagccacagttttcttaaaattcagttcgatttaaaaggaagatttatcctcccaaagtattttgtaaaacaaaatatatttatcttttccaatggaattttagtaagacaatgcttttctttttttttttttttaaaaagggagaaaacactaccaatttcacctcccatcctatatgaaatcttccctaaaaatatcttaaaataagagaagttcaggaaatataccaattgcaaatttactgtgaaagattccattttaaatgatgatcacagatcgttagttatatttagcctagagagttaattattataatctgaatcacaaagacaaacagaagagcagcctatttttctgtaatgcatgttcctaagggacctgcaaaaaactaatataagaaggtaaaccacccttccctaaggatagcgttattccctgactttccaaataaaaactgtagagatattagctttcttcatctacaagttagttgtatatgccaagatatcttagcagagttcaaaagtattccatttgcaaggcatacatgtagacctgtaggggtaaaaagaaataaacatgttcatagaaatgtacatctcagatgattcaccgtaacgatcagatgttaccctcggtagaattagaggaaaaaacactgatgcaaagtttaagtgagaaattataatcattattgttaaccattttatatatttatatagccattttacaaatataattaaaaatcggtatgtcattctctatgttggactaaattacgactaagaatttgttgtctaccagtaatggctttctttcaggctgtggctataattctgttaagtttaaaagggggaaaaaaaatcacccaaacattgcttaatgtaactaatcaagcattttcaaaattaagactgggaatgaaatgttaggcagtatttgcagggattaaaaaatgttgtagtagaacagtactgccatctaccgacaacttttaccagtgcctagggagtgtttccaagagcaacctcccatttatttgtgtctgacccaaggaagacttcagagagacactgttcaagtaaccagaaagaagtaacattcagattggccacggttttacctctgacttttaaagacttaatattttctctctttctattcaaaaagagcatggtttttttaaaaaattttgagttgttaaaatatagtgacccacacaatgaatacttcctagtaactaacatccagccgagaagacggctatgcctattgctacagaatgctcatgctcctacagacaaatctccttcaatgcagtaatacactgtatcccgtatccccgatgcagaattagattcactatatcctctaatgacaaaagcagatcacaaaatttcataagcaagattggatgtatttatgtgtatgtcaatcataaagcatccatattaccacccaggaatcactttatttggggtcactgtgggtccaagtctggcactggattcccgcggtagcataaaaaccccttagggtttagttggtggggaagtcgtggggcacactgacatcccagatttgacagaactcagtaaaattctatacataccaaagacggcaatggcatcaccagcaggaagagccattgcacaccttctataatgctcaagataccaagtagatgctttacacaagttctatcagttttgtaacttaaaagtagatgttgagtggggaaatatgcaatataaagactctttaacctatgtgatggagcagctgaagagcacagctagtcttctaattttgtacatggatgctgcatcccattaataatgtaaaatatatatataattttggtctatggattttaacgttttacggaaaaactgctactgctgttttttttttttttaagacagtaatctgaaaacaggttacagacagaaaacatgtaaatgacagattttaaaaaggatttagtcggcactaacatagcccttttaggccacataattgaagaactccaaggaaccacaaaataaactgaaaaccccagacataaagagatccacttattaattaaaagcagctctctttcgctattaaaataaggttggccatgcatactttattgctgtcacagtctcacatgaggcagtattcaaaacacataaaagtaaagttgaatagttctctatgtagggaatggagttaagtcatgtctgcttgcacaaaactgttttgcaaagcagccatatatagaagatcagggtggaagaaaaaaaagactaaaatgcatcaaatctcaaattcaatgcctttctttggtagggacagtgaggtgtgctatggacaacatgagttgaatcaagaaaggcctaaaactttccttgttttaaaactagaactagaaatcaagacaatcactgcaaagaaagagacagggaactaattaaataaattacatactaattaaatacaagttatttgggaactttttttgtaagtctaggttttgtttttaaacacaaaaagtctgtatcatactggtttatctgtgagaagaggcactggtcacaaaaaagagagacggagaaagaaagggggaaaaagaaaagaaacagaatgacaacagtaactaccaatatttcaaaatgtggtttttaagaatttccaaaaatcacacttccaaaaatcacagaaatgttgtggctaaaaagttcattcctgatactaactgttctttaaaagccatgggcaaccatatggcaaaatctagaactaaaatgaaaaggacaaaatgtgtccttccatatttaatattcatttcttgaaatggataatctagtggtatcttgaaggaataaacatatttctttgcaatgacttgctgaatgtcagagcataacaagattatttacagtctttaagaaaagtatggaaacaagaaattcctataacagattatttaaaaaaaacactaccaccttattttatgggttactaataatcatgtaactctttcaactgtagggtaactgccatacaattacaatgcctagttatttatgtctcacagattatatagtactaaagaaagttacctgttaccatatgtagacacttgtggttggcagatgtggaaaatactttaccataaagatcaaaattggcttaaaaattgacctagcatatgaacgtgatttatttatctccactcccctcccccacctctgttttgtttgcttttcctgtggatgaaagaaggaaaaatagaaacttctaaagagatatacagctttccagagtcaatggtttaatctaagtggagtcagctactgaactttattcagctggtttctccccagagcacgtcttcaccgaagtttctgtttgacctgtttcatttccttggaaaattctggcattaaatgcagctattactggtcttaagttagaaacattcttcttgcttgattttttaaatatgataatcaccttaattttttaatataataagcaccttcacactcatcctatgtttcatggtactaagagaccttcggacgccgcatgctagttccactttcctacaagtttgtttactagtgaaattaaacagtcaatcccatttatctctgaaatcagcagtgtcccctagcaagagataagagacaatgtgtgttgtataatttactgggaactaattcatggtgaccaataaattgtgcagtcctcctaaagcaccccctttgccgtggtgagatccgcagtgccgactctcgtcctggcactaagatagataagtcctaagagtgaaatcagtagacatgtgtcttttttttttccctttaattctgaataaaattccagaatttagggagtgaaaaacacttccccaacccccgccaaaaaaatctgacattttctttctgccgaaagtctaatttctctttccccaaattgcttcaccatatggaaggaaagaatctccaccttttatcttcaatctgtatcacagtttgggcatatacgagaattttgtgttcacttttaattttcttgctagttaagaacaactaacaactttcttgtatgttaggactcaaaatacgtacctcaagagttgtggtacatttcacacaggtcagaagacaagcattatggaaatgaaatgattttatgatgactttgctttaataggggttttacacaggggctttcctgggaagatgtccaggcaaattgtgtccaaagcccagaatgaagggaaaattcaccttgatgtaacatagttgaagagggatttgctgatttgtcattttaaatgaaacacaaactccaattccagcccagttatgagagcattcctttgtcctcttacttaagggatttttctttttcctttctttcctttatttctttcaaatcctacaatttgagaaaccactcaagaagatggggtgtgtatacacacacacacacttcatacatacatctgtacatgtacacacacatccattttcaaacaagcgctaataagagtccagttggctctgagataatatatccaaaacgaatcccactcttcttaagcataaacttcacacaaataactagatataaacaagccacatttaataaggataaataaaatctctgtcaagcttacaacaggaccaaaaaaaagtcatgggggccagagaagtaatttttaggttatttggcaagaaacatgcacacacacacacacacacacacacacacacacacacacacacacaaaaccctcatgcacatgtgtgcatgcacagtgtgtgcgcacacatacacagtttttcgtttggaacatttttgaacaatgaaaaggcaagagaaatttaagcgtcttgggaaatactcttcctgtgccaaataagcataaacaaaataaattctaaaagcaaattttaaatactagaggatggaaagtaaaaatgagccaagctggagtggaaatatcaatcctgaaagaatcagaaagcaagtttctcttgaaccccaatgaatcttgcatttctaagaagcacaattcagttacttgagctgtcctttgaacaaaaatttaaacttaaagaatatatttaagaatataattaagtcagctacctgggattttattcaaaaagtgatactgattattttccccaaaacatctaggaatagtgtggcaataaagtggcactgtgtttcaaaaggagccccccaaaaccttcaaagctaagattctatttagtcaatgatttggctaggactcaccacataaaaaacacaacacaacaaaaaacaaacaagcaaacacacttgagcagcctgtttggatattgtagtacttgttccacagaagtcatcagagtgttctaggagcttctcgtctaggttaacactgacactgctggtcagcaataaatcaaagctatgctcgtcatacaagcacgtaaaatcatcaccttaaatggtatgaaagtatttgtgctgttagaaggtagggaatggggtgaggggaggagcaaggataaggattccttctttcccattccactctcgggttctcttgatcttcccagggtggaggagcagtaggaaactgttcacccacccagttactgtgggaaaaaactggagggctctagtgaaaaatgggaaaactcttccccacacctttatctcaagccttggcttaaggtataatactttttattttttattttttttgagacggagtctcactctgtcgcccaagagtgcagtggcacaatctcggctgactgcaacctccgcctcccgggttctagtgattcttctgcctcagcctcccgagcagccaggactacaggcacgcgtcactatgcctggattttttttttttttttttttttaagagacagggtttcaccatattggccaggctagtctagaactcctgacctcatgatccgccagcctcggcaaggagacaagttacttgatagtcaaactgggccttaaaattatcacgcatcatgttattaaaaggcagtgaccatggaagggtaaatgtcctccctcctcctttcatgagaacactaaaccatcctcccaccatgtaaaaaaaaaactacttatattttttattaaaatttacatcatgtaaaaaaattatgtccaaaacggcttggttaaaaaagaccacctaggatatgtttgtgttcagatttgttaaaatgcagagatttaaagaactaaaattctttattaaagaatattttcaataatttaatggtagctttcttgtggcgttttagagttcgcacacagtaggctgtggtttaggagctaaagttgaatgcgatcccagagtttctttaaataggtcattttagagatagaaaagggtctacaggttgattgacaattgacaaactatttggcccactaggcataaacttctattagatagattattggggctttcacagataaccttggtaacagcattatctaaatatgaaaataacaataaaataacaatcaattttatgattctcaaatcagagctttaagaaaatagatccaaatagcatatgactaagaacttactatgtatcaatcaaatggcataaaaatacttgcaacatggtcatcttgaaaaatttacaatctacctccacggtctgtctgaacaacaaacttaacacaaggcagaatggactgaatactgagaataaatggcaattatgagagcgccggggttgggaagagcttccttgacttgagtactggaggcatgtcaggagcaggttataagaatgctgtggcacttgagcagcaccttgaatgttggctgcattcagagcaaaaagtacgcatcagtacaagcaggagaataaaaattcagggcatcatccacaaacagacatgccagagcttacatcatattaggatgttgtgtgcttgtggccatacaacgcagggacacaatgaaagttaggttttagaaagttaagactcagcagagtggagtgaggaggagcgaaggcaatcacaaggaggccggggtaaccgtccaagccagaggatatgtgggctgaactccaaaggcggcagtgggaacgcattgtggtgaccctgcacgcaactgaaaggagataccatctgactgcatggcaatgtgaagaagggggatgagacaaggatgacaaggcagatggcatcacaactgagataaggcacaggaaatgaggaaatggaactgatggagggaagaaggagaaggatttaatcttgaagaatccaagtatacgaggccagcaggacagacacgtgcaataggcggaattagagattaatcagttgactgattaattgatttcacatccactatccaacagactttcaatgactcaactatgggagtccagaaaattatacggaaaaatataaataactataaatcagcatctgggctcaacattcagatactggattgtgaaactcaagagggatctagggactgaaactgaaaacctggacatcatcagtgtaaaaatgatagttgtcaccaccccttgagagtgggagtggtgggaagggaagggagagaatattcatttttttactttataacaaacttttattgtttgaatttttatcaacagcacatactactttttgtggtcttttaaaagccaatgttttaaaaaaaataaagcaaaaagactgaagccataggaacaggcagtatcacaaattgacttctcaaatatgtgcagttaatgtacacaagcactcaggtgggaactgagaaacacaaaggtgatttcaacccaagtcctgtgtgaatctaatgggaaaataaaggcactggagtcaaacaggattcaaactcctctcccactaatagttacataggtgaattcttaaattccctcaagttcaactatttttctctaaaaatgaggcaaacaatacctcatagggttgctgtaaagatgagacaagttaacgtaattaaagcccctaaagggtagcatttggcacacagtaggtactcaattaagattccctgatttttcatccttctgccaagatggggaaactcaaaatttcagtcaggtttaaaaagagactgaaaagaagtgatcagagggaccgcagcagaaaaaaagatggcaccatgtcatggggactagcggagagaagcaaagcgcctttatccatccactcaacataaatgtactaagcattaacacctgctggagtggataactatgtcaaaggtggtggagatggtgagaagtagattatttgacaactaggaaagaggtccttgccgacttgcaagaagagtcccagcagaacagcaggagaagatactacttggccagagggctaaggaatgactgggtggtgaagagtgacagtaggaagaagtgacagttctttgagaaatttgtaactaagggaatgagaggctcttgtgaagcgaaggtttcaggaaagttaagtagctcataggataaaaggaggaaagtctgtggaaagggagaaagtgatggcagggaggaggtggcagagttcattcacagtgtaaggccctgaagctgacaagagggtgcccaaagtgaggaggctgaccttgggaaggagtaaggacacaccatcgcatcgggaagcaagtgtgagaagtaggctggaaatacagacaaaggttcaggtgtaaaggagagctgaagaaattcaattggattaccatctaccttctcattgaaaaaggaagcaagattactagcaaaataaggaaagctgatggaaatgggaccccagggtgaagaaggatcgaaaactaaaaagactttcccaggagcagtgaggttccagcagagggaggtggcacacatcaatactaagcatttagcccaatgtgattgggctaatgtgatttcctccagtgattttcagtggcctgggatatagacacggggggagtgggaaggcagtcataatagtgggcaaagcagaagttaaaagggcaagggattctaaggatgccagtgagccaacagctgacacggtggactggggaggtcaaggcctgaaggttgagcagggaaggaaggatgagactgagtgacaagaaaagcggcaggtggaaaatggccgttaattggatttaagatgaggaacaagcacgtttagaggaaatgaaggaatgagtaagtgaaagaacagaaggctgtgactggaagacagctccaagcttgaatccttagaaatgaggcaattccaggccatggaaagggttgaagctggctgattaaagggaatgcagaaattcctggaatcgagaggccaggcctccagccattcatgacactggaagccgtggttagctatgataatatcagaagaccaagctaggcaaagaggaagagatccaaaggagaagaaaatggaggaaacagaaaaaatataactttctgaatagactaatttcaaagactgttaaaaataatctttctttagaaataatgccttgcttttagtctaagttattaaaaaaaatgagtaaaacctttaaaatccacagcagaaaaagccatttcaccatttatatgtcttcaactgaagcaaaaatcaaggacctgactctttgttcttcaactcaacacatctgatacggtgtggctatgtctccagccaaatctcatcttgaataattgtagctcccataattcccaagtgttgtgggaggggcccagtgggagataactgaatcatgggggtggttctcccattctgttctcatggtagtgaataagtctcatgagatctgatggtcttataagggatttcccctttcacttgtctctcaattctctcttgcctgccgctatgtaagacatcccttgcttttcccccatgattgtgtggcctccctagccatgtggaactgtgagtcaattaaaactttttcctttataaatcacccagcctcaggtatatctttattagtagcatgagaacagactaatacactatttcaaacaagatggcaaagtaactggtaacaactgaaggaaataacgctgcttctgtaagcactgaggccaagttgtctgagctcaccttctcccttcacacactggggaaggaggaggcctgatgacaggatccctacacagcttgctcaagcacaggtgagccacagcacatcctcctgcagcaagcaaggtggcatgactaacacaagacctaacctcattgcctttacacagctctttcatatccattacctctcttaatcctcacaggctctctgggaggcaggtattactatgagcggctttttatcagtgaaaaaatagagacttgtgggccagaagacttgctcaaacgctgagtctggcagaaaccaaggccctcccactccagaatttagccctttccactaaatcccaccaactgaatgactgcaagggccagatgcacaggagacagcgcagttcagaaaggcctgaatacttctgggtcattctcaaagtcacacagggcagctaaaacataaagcaagataagcagcatcagcaggtattccttagggatacttcacttacaactgaaagaaaagataacttttccacatttgagcacattgaacaattgtcagtgtgctcacaattcatgagaagacaagaaaacccagagtctacagaaatcaaaagtgacagaatcatcatttcagagctgtaggtacaaaacagtaagtggtctctgggtgtgcagaaggagttaacattttctacagagtaacaccttttctgagaagagactggactggcagaagcaggagataagaggatgggttggaaaaaaccacaacatcttctcaaaccaagagaaagacaagatagaagtagagaaggaaacttgggacttgtatgtctgtaacgccagaggaccctgggcaccttacatgaaaattatcagaaatgcaaattatcagatggctaatttctaaggtcacctggtgccaaacacattacaatttcagtctctgcctcacacatctcacatccctaaaaatagaggcaaaggggacaaaaattatcttcagaaagcctggtgtccactaagcctggcaatatattctatgacaagccacattttatcacagaatactacaatctgaaaaggttccctgagatacatactgctaatctaaagaagtgttgaaccaaaattgtaactaaatcaccaaattctgcataaacccagggggtagaataggttcaatattcaggactagctcaaacaggtgaatttactcagataactgatgaaatctcatcttctaaagtccttattaccacgaggactgacccccccacccccacccacccagacaacaaaagagaaagtcaattaataattatgatataaggttattctcacctcccccattactgtttcttggagtttttatgaggttttgcaataaaaatttatagctatctgaaatagttctaacctcttccacaagtagtttgcttatttgttcatccttttcctctagcccatgtaaataaaacacaaccttcactttcatggtaagaaaaatattccctttaatgaatttcaggaatcaggaagaaaactgcgctagtctcatggatctcatgttaaggattctaagaattctttacttaagagatctgttttccttattcctcaatctcctttaaagaagctgagcatttttaaaaggatatcatagtattactttaaaagcaccaaacatagcatccctgaaaataacatgtttcctgtcgggagaagcatgttaaggtgtctgtgagagatttctggggtttattctaatccatgtttctggggggcatctgggacactctaggaacacaagggcccctctttccactttggttgtcactagtcacacagattttcttactactcactgcttgactgagtcgtctcaattcattaaacattctctgagctattggcaagacttcaaccatggtgacatttcctttacactagatcatccaactatagccttcctagaaaacaatgcttggacagtagcaaaagcctgttgggtcagctaacgacatcaagttataataagatctcaaagtttgtctttctttttaatttttgttttcttctctagcagttacaacatgcaccttgagatggtaatagtcaaagtattgactgaatgtgcctgccccctggtggctggtggggtgaaggacacactgtagaaatccttcgggtacctgcatcagaatcagacacgagagatatgaaagcaagcacacaaatcagaatttgctgtagtggagtattacgaagatctggtataaaatgaaataaaatagagtttaaaaaaggaaaacattactaacaaacagttttagagacaagtcaccaagatcttagcttgagatacactaacccaggctcctcctgccaaattatgagcaattattgtgctaagtatctatgtgcacctgttgttgtcctagcttcttccaattaaattataatcttaagattattgttattcggaagaaggagtctaggttagcatatctcaagctaagagcttggaaactgaaacacattttaattgtggtcattgctccacaccataggggctccctctgggacatggtctcaactggctctggccgattctgatccccaccggcaatctcacttcccgttctcccctttgaggccaaattgtccatggtgactttaaacctggattcatagatgccttcaggacagggaaaaatctaagcctgtgaggcagcaatacggggagtaaaggagactgaggagagacctgtggtgactaggaacatggcttcctacaggcattcaaactccattgtttaaaattaactctacattgcccaaaaaacatttttagagcagtgctctgctcacccctgtaatcccagcacttcgggaggctgaggcaggtggatcacaaggtcaggagttcaagaccagcctggccaatatgaaatcccgtctctaccaaaaatacaaaaattagctgggcatggtggcaggtgcctgtagtcccagctacttgggaggctgaggcaggagaatcgcttgaaccggcaggcggaggttgcagtgagcccagatcgcgccactgcactccagcctggagacagagtgagattccatctcagaaaaaaaaaaaaaaaagaaaagaaaagaaaaagaaaaagaaagaatgaaaagaaaagaaaaggtgaaccaaaaaagcacaaagaaggaagaagagaatgtcctgaatggcctttcccaaccaccaaagacatgcacccagatgcctcaatacggtctcctcaaatgccatgggactacgtcaaaaatatatatatatctttccaatgaaccagctcctgctcttgattttcctatttctctcaaagaaatgatcactttcccagccagctggacttggaaaaggtgtcatctggaccctctcctcctctgtgaggtatgagcaagtcttccctgtaatcctgtcctctccctctgtgcgccctcatccaggttctcactccctagggcctttttcttgttcctatgcatccagcattttcccttagagatcccagtataataaattactcaaatatgtgcagtcctttgtagttacaatgtgcttttgccatattttctattttagttttatttttgagtatataacagcttggtaggtaagcaaaaaaaatactatttctattttacaggagatgaaagaaatattgagaggaattaagtgatttggccattgccactacagaatctcactaatagcatttttacctagatcagtagcccatttctctctcctgctctctgttcctctttctctctctccctctttcccctgctctttctggtctccagcactgtataagccagttgcttggggaatgtttccacgtggatatcccacaaacacattaaactcatcatgatgaaaaccaaatgcacccttggctcctctcaacttgctgctctgctgttctctagttcagtgaacaaggatcacccacctagaaacctggaagtcctgactcctcattctccttcactgacccatccagtcaccaattttcaagtctacaaaactattaaactgtttctcgaaaccaagtttctctcaatccccactgcccacttctgccaccctcatccagcctataacatccacttctctgtctctctcataacactcttatctgcacagccccagtcaatccatccctcacacttcaccttgaataatctttcactctgcttcttacaacattttgatgtctcaccaaaaccctcaaaataaaaaccaagctccttaacaaggctggcagagctcatcagcttctctgggtggtaactccttatcttagcttaggctaccatgacaaaataccaagaccctgggtggcttaaacaacagaaatgtattttctcacagttctgcaggtcggaaagtccaagatcaaagtttgagagggttcagtttctgatgagggctctatttctggctagcaaaccattactttgtcctcacatggcctttccttggtgcatgagtgtggagagtgagggagctttctggtgtttttaaaataaggacactagtagtatcagattagggccccacttttaagacctcatttaaccctaattccctccatatagaccctatctccaaacgtagtcactgggggacagagcctcaacatatgaacttggggagacacaattcagtccatactccctctccaatctcaagtgaaggcctgaccacttagcagtctacgctgcggccacactgactgctcatgtgctgtctctaaatccaaatccttgtggagccctctccagaaccctctccttttccttaggctccctataccttttgcttaactaacccctcactctttaagtctcagcctccatagtcttagttcttccaaaaagtcctgcaatctgacctgcaagccctttcccctctgggattagaggccctcaccaaatgttcccatgatcctgaccacatttgcctgtatcctttactagattcttggctctttgacagcaggtactgaggctgtctgttcacggctgcaaccctaacataacccaagagcactattaatacatagtgctctttcaataaatatcattgtcaaatgccattctcaaaaaggtaggcagaaaaacaggaagggaaggagagaccagagtaagcaatggctccttactatctatggaaaaaagtttccagttgttctgacattcgaagctcccttccactgggcctcaagaccctaagttcatatttgaaaggctgcacaggagaaagcagagccttatgctgcatttgggggtaaaaatagaaccaacaggtagaaatatgggagaaacagggcagagtgggaagggcaggggtgcttaattaaagacgcatgcccacctaccaggaaagccacaaaattgcttctcagaacttgtgttcagggacctctccggtctgctctgccttcaagacacattcttttctcctctgatttcctctattcccacaagagccatcaattggagtctaccctcagccccttgttcggctgacactcatgttcacccctgccctcatacaccatccttgtttgcaatggcttcacaacacccagttctatgcttctcctagtccagccgttttcaatgtgtgcatggactcctgagggtccccaagaccctttcagaggatctgcaggatcaaaactaatgtcatcatactaagacattatttacctcttgcattgtgtttgcattaacattgatggagagagtgagtgagtgaaactgctggccctttagcacaaatcatgctggtggcaccaaactctaccagctgccattgtgttttacataaaaatggccttgatgaagcagtaaactatcaattttattaaatcttgacacgttactattctgtgtgatgaaatacatacaaaacatttctgctctatgtaaaagtctaagggttgtctcaaggaaaagtactcgtgaacctaactaacttctcttttcatggaacaccatttttacttgaaaaaatgacttacaggcaaactataattattcgaacttgggtatttcacagatattttcttaaaaataaatgaagtgggcatgtcaattcaaggaaaacaactgttagtatttgttgccagtgataaaattcaagctttcaaatgaaaattaaattcttagaaaacttgtatctgccatcatgaacttgacatatttacaagactgatattgtgttaacatttggaagatttacataactagatgaaccaatattttccaagaccaatgtgtaatattacaaagtcatgcctgagcaaaagagtctttcaaggtccaagagagactactggcttttaacataactaactagaataagttcactgatatggtttcaggttccacatggcaactagcccctaaggaactaccatttgattgtttagatatagaatcacagaagactactcacaattatcagaaaaggctattaaaatattcttttccaacttcatagctgcgtggggttgaattttcttcacatactttaaccaaaacacacaacagattaaatgcagaggcaaatatgagactctagctgccctctattaacccagacattaaaaagatctgcaaagaggtaaaacaatgccattttctcactaatttttgttttggaaaatatagttctttttcatttaaatgttattcatattaacatgtaatgggtttatttttatttattttttgagacagtctcgctctgttgccaggctggtacaacggcaagatctcagctcactgcaacctctgcttccctgattcaagcaattgtcctgcctcagcttcccaagtagctgggattataggcgcgtgccaccaagcccggctaatttttttatttttgtagagatggggtttctccatgttggccaggtctcgaactcctggcatcaggtgatccgcccgtttcagcctcccaaagtgctgggattacaggcttgagccaccaggcctggcccgttactattgttatttttaaatgcattagtaaaaaaaaaaaaaattttaattgctagaacattaaatatcaatacccacattaataaaagctatttgggagccttaataattatcaatggtgtaaaggggtcctgagaccaaaaagtttgacttcaccaggtgtttgaacactacagatcccatcttgcccatgaagcttccctagacatccccaccccaccgtgctcccttctgcatcctacaatagcatccactggtaaggccactattttaataatgatatggttgctttatactaatgaattatgtttttgtacaacagtctcctagtgtccatgtttaagaatttaagggactttgctttccaaagctgttaacccaactagctctgtgaaagtgaaacaaaattatggacttaaatttctgtctgtgtcaaaaaagagtaaaatgcaccctctagtggacttgtaagctcacagaacacaaaataaatttattggattgtcagaagaattacaactccgtcccagaaaattcagattataaaataataatatatgagcatagggaaattaattttaattttttgataatatgtttttaaaagagctaagaaaatgtgaaaccaaatctagtttgaatgtagttcataactaaatgcaaaagtaaacctgaggtcacacacaaaaaacttctttcttaaattcctatgaattgattatacatcggctatccaaaataatctgttcaaattatgtcttattaactacttataactttaaatacatagaagcattaacatggataaagttgggattattattagttcaatttccaaatattaaaactacactcaacttacaacctgggcattccaatggccttcacaaaatctgaaaaaggacctttgaaggataagaaccaatgcttggggtatacttttaactctgtatgttaatgttaaaaggatttaattctatgcatctttctctaggatgacataagaaaaacagtgtaaaaatacactcaaccttatcagataaaataatgtaatgacatggaaagaagtctgaaatatatggttaaactaaaaaatgtagtcacagaataacgggtggcatgatctaatttatgttttaaaaaatgtacgcacgtgtacccatgtttatgagcacatatgcacgttaattctatagttaaaccttttttttttttttgagacaaggtctcgctctgtcacccaagctgtagtacagtggctcgctcatgcctcactgcagccttgctcctgggctcagcctcccaagtagctgggaatataggcatgtgccaccacacccagctaatttttataatttttgtagagacagggcttcaacatgttgcccaggctggtctcgaactcctgggttcaaatgatctgcctgtcttggcttcccaaagtgctgggattacaggtgtgagccaccaccccgggctatagtaaagtattaacatttgttatttctggcaaggaatatgcattagtagcaaaaataatggaagggcatttgactatacttctatactgttaagatgctgtgagcatttttaattcaaaataatcaaatatggaatttttaaggaaattacagttataattaattcaaagaactgtatgaaatgggaattgttatttcatcaactaggacattaaaaggtttgagtaacaataagaaatttgatatagctatttggtttttaaatcattagactggaaaagaaaattttttaaatggctttatcaccagaacacaatgtctgattcctctgatgataatgcaagctgaagtggtatataaaatcctctctgccacttttaaactctggcagagatagctactccttccaactgatagtgtctgatcggataactatgttcctttttaaactctcaaattctataatttctgaagtgctgagatactgtcatagttatggaagcattttctagctttgagtttttatagatctagcctcagccatacagcctggtgggtacaggtactttaagtgaataactggctttattaatctcaactggaagtggccgagttgaactgaaactaaacacagacacacacacacacacacacacacacacacacacacacaaatcagtagtattaccaaactacaaccactaaggagcatactcatccaattttaatttgagcatcagacgcaaaaagacagaaacaatatgtatgcttcgtctgtcattctaatctgaacacacaatgtcttcaagtcaacaacttaggtagatggagcagactggccaaaaataaatttctattggcaacacttctgtgaaattctactggtcctttataatgtgccagtgtttcactctctaatcatatattgcccagtgcatacattcatttaaacaaaatccttcttttcttcaagtaattaaaactctttaatcttttatctattttaagcctacttccattaatatttgtatttagacatttgtctaaagtgaaaagtgtcccaccagagcatgctgaaccttggtatcttccttgtgaataaaatttagctggacacatagccactcaactacagaatgcagtttccagactcctttgcagccaggtatggccgtacgacatcattggaacatgagtgaaaatgatgtgtacaaaggaattgtttgttctccttttccactcttttcacttctgatatggtttggctgtgtccccacccaaatctcatcttgaattgtagctcccataatccccacgtgttgtgggagggacctggtgggaggtaattgaatcatgggagtgggttttcccccagctgttctcgtgatagtgaataagtgtcaagagatttggtgggtttataaaggggagttcccctgcaaatgctctcttgcctgccaccatgcaaggcatgcctttgctaccccttcccattctgccatgattgtaagtttcctgaggcctcacctgccatgtggaactgtgagtccactaaacctctttttctttataaattacccagtctctagtatgtctttattagcagcatgagaatggactaatacaacttccctattggtagagaagtaccctgaagtattagaacattatacaattatcttaatagaaacagcatgctgacaatgcatgatcagacaggtagatcaatatagacaccaaaaagggggaatacatctaagtacatacagggaataacaaaaagcagtagcattttatgtaaattagtattgtctatttaaaaggaaagaagactattaataaagtcagtaaaaacgcatcaagaataacacaatctgaaacctggcacagagaatgcaaactgtgtttttaagactgttaccacctgagggcactacttcagctgactagaagaaatgcgggtgatcctttgtagaatttgtcttgaatttgccaaaccttcaaaaataattttttagccaaaaatgatcactgtcgtatctacggttaatgtagcatgtcaaaaagcgggaaacagatggatgactcaccaaatggggctgggcaaccaactaaccatatgagggggaaaagcaaagttgcatccctacttcactacttactctaaaataattccactgggatttgaattttaaatagaaaaaacaaatccacaagagtaccagaggacgtttactataataataatttttaaatctttatatttttaggggcagggaagagcattcaaaggatgaaggaaagcatctgaccattctttccatatcactaactccccaacatccttcctggcattatggttaccccacccctgagtttaacaaagttaaaaaacaaaatgggaatggaaaacgagggagcaacccagtcacttaatttttcatgccaaagtcactcaattttttataagcccagattcaggggttgaccctttgtgccctggaaacactgcacgtgaccccagcactgctagctccagcttctgagcctgaaatactctttagcctaaacctggccctaatacacacaacaatcacaaaaaacaataagaataataaagaacccagcaaccgttggaaccctgaggaagccgacggtgagtgaaaccttcccgacttctaaaaccagctccaagtcaagtctgtgaatttgagtctcgcaggatgcccctttcttcctgtatcactccgccagagaatattttttaggaacatagagcactagaatgagtggctatctctaaagccatcttaagtttatattcttcagcagctgactcaataacctgactttgacattaagccgacttcacagaccaactgtcacttcaaagaacaagaaaaaccttgagtaaaagttaaatgaaaagtgttttccaaatcactcgcaaaggaaacagatcaggttgttgtaataaagaatgtaatcaactcatttcatgagctaaaaaggtatcctcagaaacaggaacgcttgactcagggtagactgactctgtcaaaggtttggggcctgatgttgacgactggcaaagaccgagatgaaatgaactcattttgacattcaagttagagttttctaatctaatccatagcaatcatcctgaggtaaaataccaaggtgccacttttatagtcattgatggggaactaagccattaatgactcttctaagtaatacagcagttagtgagtgacagaatcaagactcagatgaggtcctctgactctacaatcaaaggtgtttgactccatccctctagcaccctccatggtggaaacgacatttaggtcaatttataacatccgaaaaagacagactagctgtacaactattaatagataggaaattgacttatctttgggcaatggcaagggaaaaggcttttatgaatgccattttttttttttttggaaaagtaactaaccctattatcctaggcattggattttaaaaatgccatctgaaatatacagttcaggtatctcttctgaagtaaaatattggtatgtatcagttggaaaagactcttttccaccccccaattgttagtgtagctaagatgatacacttaagacttacacgagtaaagaatcacctcaaagaaatgctcagtaagtctttggtttctctggattggcataagggagtctgtgtccctgtagaagaggctgccaggggttccccaatatatattctcctctcttttgtagtgagagaactgagtacataggcttatgtgttttccagcctcacttgtagttaagtgtgaccatatgtctatgttctgaaatatgaggacaaaaagaagttaaattctagaatgtttccttaaaaaatgggggcatattttttgctcttcttcctttctactgtctgaaacgtgggagtgatggctttagctcaaataaccattttggacaatgatgtttaagccaccattgcagatggtgaagcaacgagatgggaggctgggtcctggaaggttaggaatccccatactagccctagactatttacctgcaagtctgtttccctgggacagaaataactttctaacttgtttgaactgttgttcactggagagtagaacttaattctaacacatcatcggccgggcgcggtggctcaggcctgtaatcccagcactttgggaggccgaggcaggcggatcacgaggtcaggagatcgagaccatcctggctaacacggtgaaaccccatctctactaaaaatacaaaaaattagccgggtgtggtggcgggcacctgtagtcccagctactcgggaggctgaggcaggagaatggcatgaacccgggaggcggagcttgcagtgagccgagatcgcgccactgcactctagcctgggcgacagagcgagactccatctcaaaaataaaaaaaaaaaaaacacatcgccaataatttttttttttttgctttgtaatattcaagtcatcagttggctcaaaaggtgtcattaaatcatcaaaattttaatttacttcaaattaaaaaatattttccacaagcacatgtctgagtatacatgcaggtagagtggggacacttgcagaattaaaaaggatcaaaagtcccactgtaaggtacatcaagtatcgttgatccacgcttgcacagaaacctacttatgtccttttcacaacacctaaaagattgtgttgcctaacatactgtattgcaagtgttcgtttaggagtttaccaacaccattcccactccctgccatctagactaggaagtttctggttcaccatcaaatcctcaatgcctagcattgtgccaggcactcaaaaaactgggtgaacatgtgaaagactggccttcgcaataaggacccttctcatgatttgaaatcctctcaaaatacaagttgaggatccctaatccgaaatccacaaagctccgaaatccacaaagctccgaaatctgaaatgctccaaaatccaaaattttgtgagcgtcaacatgacactcaaagaaagtgttcattgaaggttttgggatttcagatttttgaattggggatgctcaaacggttaaagtatctgcaaaaatccaaaagccaaaacacttctgatcccacgcatttcagataaaaagtactcaattggtactagttagatatggtactaaatgagttctgaaattactcacatcccatcagtaatctgacaataaataaacagtcattttaacaaagtctccaaacttctgaattattaatgatgcttaatactatataatgatacttaatcaaagtcccaattcttaactattttactaaaaataagcctgcctatgtttataccgttctgtccataaagaaagaaagaaaaaataagccagcagaacaaccagtaccagaattatatttagattaccctggtaacctagattacctaaaaaaacctaacatctaaaaaatccctaatccagattaccagagtaatctaaatataattcacccaatggttgtggtagtaaaaatatcaccctgtatgtcattattattcagaatcataaggaaataaaccactctacataagaatattctttctaaaatgtaatatactcagcctttttgtcttttatttctttacctatagagataattatagttactcataggttcttttttccaagaccacatgatttttaatgtgcttctcaaataatactctctcaatgaaaggtaaaataatagtgtttattatataatttgctaccttcttaagtagaatacattcaacataattcaactttttgttatgactcatgagagtaggtcatcttaaaaataactaattatataattccgtgttgaatccgattccttatataataggcatgtgtagacaagatatgtagcaagcacctaaggtttaaaaaacatgagcacatcttgaaatggacaaaaagtcatattaaatgttctcctttttcaagatttcaggatgttgcagaaagaatgccataacttctgggggctctgtcatccactgagtttgaggaccaactagagcaataattttgaatctgtatttcttttaaggctaatcttaatatctaagtcataaaggacttgacagaagtataaaggaatagcctcacgtatagcctgagacacatacaaaggcagaaatcgggctgaatgacctagtcaaacactgcacacagcctgggtaaacacccaattcacggtgtccttacctgcctcgattagcaagatggcccagcaatgcctcctgagggacctatgtgcccctcttcttctcctgcatcacttttaacctgtacacgtacacacacgcacacacacacacacacaattaagttataagttacatgttaaatccagatggtttgaagggctaaatggtaaagtaataatgataacagcaataataacaaatatttagggaatatatagggaagtatttttacaatcctgcatagggaaaggccttctatacttttcttcttcaacagtgccttgattggtcctaggggaccacttactcccactcagtccacgtgatttgggccgggatgagcaacctcaaactccgaagataagcatggatgtaggcctggccaatcatagtctcatacaccctcctggtcacagggtctgttcatgaataggacacataacctaagccaagacaatcagaggaaatgagactctagaataagacttctgttgaaactactgggaacaaatattttcttggaagggttgctgagaggccagaatgcaaacgcagagctcccggcagccatcttgccaccaggaagggaagcctcttctgaagatggagacagcatagaatgaggcggacctgaaaacggggttaggtaagcaagtcaactgaatgatgtcgctcgtgcctctgaatacagaactgcctaaagttgcacttacccctttttttcctaggtcagtttacagtttggggctgcaaacaaaaattataacgaacacacctccttagagcattccaaatgaaattaaaattgcaaaatgcacaaaggaaaaaaaatctctttgctcataccttttcaatatagagaatataaatcaagatctgaataccaatccctagatgtagacaatcttaccaacataaaaatgtgattgcctgtcccagtatgaaaaacatcctcctgtaaacattgctacaacaatttttgaatcatttaattatttgaagattacatctccaagtatcaacaataatagaatattattacctgcttaggaatagacagattcaaaaagattttaaaaggaggtggcaggccattaaaaacaacatgacaaatcatttctataaaactattattagtgtcatgaaactgtcctggtagtatcttttgagaaaatatgcaccaaagaattcctgaaaatatgctgctaaaccttgattacagccttctgtaaatagatgtaatctaggaaaactcaaaagcctgttatttgtataaatataacatattcaagctgacaagctgaaattatccgccctttgtattctcctcataagcacagactgtgttataaacaaatccttgctagtctaggcaccagttgaaatccccccctccaaaatggaggctattgataaaaggcttttaataagtcgtagtacagatagaaacacatgtatgtggtgactgatagtaaagtattaagttttcttataatactaaaaattcaaatgcttagagtccagacaagacaaaagcagggaccaaggaaatggttattgatgaccatgtaatgaacctgaaggaacgagtcccaaccaaagggggcagcagtcactcatgaatacatcttcccaattctgatttttcaaaagaagctagaaaacaaattttgtgtgtaatctcttgatatcaaaaacatgtggcccattggcctctaaagtattttgcttgacacacaatttcttaacatttgtcacagacatttaagatctagagatttcacacaaaattttgcagtgactgttgccaccttgtccaagatgtaagggtgagagattcggaccaatctctaaagaagctcaaagttaggactgagcaagtatgggctggaatttgagcaacgatcaaagagcaagtatcccagcagttatgcacaaatctctaattcttagattttagacaagtcatcttccctctctgggcctgtttccataaaatgacaaaactagattaagtaataatatgaacgtttccttcagcaatacaattttatcattctataagaagtccctaaaatagcatccctataagtgaaaattctagatttcacccataactaataatgtacaaaatagtttacaaaagagaaacacccactacctgtactattcatattagtaaatgagtgtgtaaaaataactgacaaactaatgtaattcacagacctgtgtattaagtagcttcatgaattttatgaagtttttcatgtcaaataccattagagaaaccacgctcaacctcaaaagtctcacaatcacacagaaagggtctttatctgtaggaagtatggaacagaactactgaacaaaatgaatgtattttaataccactccctaaaacacgggaaggaattctctcctgtatacacccaaaagtttttctaaaacgggaaaaaaaggtgaaatcacaaaatcaaacacaataaaggtcaagctaaagaatcatctagactggcagcaataccataacttcctgttataaatataaagtaatgggctttcaaatcagaaatgcaatttgatagaaaggccattctaccaggctctggaaattgagtccaaggtggacactatctgcctctctccagcactgtccctccccatcattatcaccattaatgatttccctaattccacacattacgtaaacaaagaaaaaggtagccataaaaaaaaaaaacatcagaaggttaatcatcagcatttattaaaaattaatagcactactggtgttttcagcatttttaaatttgaaaattttaaaattaaaagtataattttaatattaatatcaatattaattttcaatgtgtgctatttctaaaatgaagaaaatactctaataatgatcccaagtaaattttctttatgtaaccagaatcaattcagcgggagaggaatattcttctgtctgggtataattatgtttggggctgcctgcattaacttcaatcttccctcctgacatctttataaatttaacttcatgataatgttctattcctttatcctacttctttaaaataatctctcaaagaaatctttaagaatgttttataataatcacaagaaattagtaattatggatttgtaattagtaaccactgaatcttagcaggaattacgaaaaagaaaatctatggaatagtatgtgtcaaacaaatagtcacaccttgcttgccttattcaactgggcagaaatcagacttcagtgaaaacttttaaaaacttctttcaggttaaatgagcagacactttttgaattaacagaattctaatttttaaaatctcttaaaagagacaatctgatgtattaacaaaagaacaaaacagaagcttggtgatctggactcaggtaccagctggtgctactgctgactggctatgatgtaacttcaggcaagttcaaaaatgctccctgggtcctaagcactcttgctctgtgaaatcaggatggggacttcttttttttttgagatggagttttgctctgctgtccaggctagagtgcactggcgcgatcttggctcactgcaacctccgcctcttgagttcacgtgattctcctgcctcagcctcccaagtagctgggattacagacatctgccaccatgcccagctaatttttgtatttatagtagagccgagggttcaccatgttggccaagctggtcttgaactcctgacctcaagtgatccacccacctcggccttccaaagtgctgagattacgggcacgagccactgtgcctggcctaggatgtggacttctgaagtccatcataattctatggtaagcccctttctgataatattgtatccaattcacagggtaattaaaatagttcaaagagttatcaacactgcacccttttgtcagttcttcattgtatatccacccaggggaagtgtcattgatagatttctgagccttaatcccttaaatcataacaatatcccagaaatattaggtgtgtcctagaaagtctataaagatcttcactcactttttttttttttgaaacaaaactgccttcccttcttcctcctgttctttttctctgtcaaattaaaatatttcccttaaggtaaacttcacaaataagggtctacaaactcctctatgcgcccttattctgggttttcttttcactaacatgaagctattctcatctacacgatccctccgacaacttgcccactccctacatttcagaagacactctcaaagctcttgctctgtagccccgacctatcccccaagcttcagactctcacagaaactatgtgttgtacaaagccacatggacatcccatggatgcctcaaactcaacatgtccaaaactaacctcccccaaacatgttcctcctcccaaattctctatcccacttcacagcacctcatgcccaccaccatcccaggcacccagccagagacggggaatctacctcaccactccttcatctccctgactcaacacacatgatacacagacaaggcttttatctcttacatgtgttttgaaactgcccccttctctctattcctgcgaccatcaccaagttcaagtaacttttcttttattcacatgttttcatcaagcttaggttctcaccacctcctgcttaagaggcaaaacctctttttatatacaaagcatgcatacacacacacacacacacacacacacacacacacacacacacacacacagagtacataaaacatatacacagtatctctgtggtattaaaatgtcataagggagagggtgattaagaaaaaaatgtctaaaaagcccaggatggtcggggaagcataatgatgaaaaggttgagaaatgctacagttattggatttatagctccttatcagcaaagactgtataaatgtacatgataaaatctctaagataaataattcaaattaaaataatttgcatttttgttttctccaaaaatttcttttgtatcttggatattattgaatgtaatttgccctctgccaaagggatgatgccactggatagtcatgaagatgaataatttcctattaaaagtaacctagaaattaaggagttaaagttttgttttttttttttaaggaaattgttttttaaaacacattataaaatatgtgtgagaaagtagctaggactgaattaagattgaatagttatttatgtctgtttcctgtttagccttttgacaatgttcagccccatattttatagtcggctttggataaggcttcccagaataaccttgatgtggggtcggctggtagggaggaccccagaactacatcctgcaattcacaccctatgaacgcatactctgctaaactcaacaacttcaaaacaaaaaacaaatgtcactgtcccatttcctctgcaaagccctgttttcaaactccaaaacacaaagaatgggaggaaaggaagagaaaaaaaaaaaaaaaacccgaacacgtttagaaacaaaggcacattgtgagataacattaagagtcctttcatattttttaaattcagctaaaaattccccttcaaaatctgaaaaatggaacaggtgagtctatgagagaaacaaatatcacattagcaacgtatttttgatgtgtatagaacatccttactcaatataacatactaatttatggacaaatgcttgtcaggttgggcagttataaaaatgaaaacctcaaatcacagaaaaaaataaataaaataaaatgaaataataaaaacctaacaacagcagaggaacttccatgaatggggagagctggtgaatgtgaaggagaaaaagatgatggagcttttttacagcacgaagacaaaaattcctagctttggaagtgggtctctgaaacatgagggcatatttgattaaaaaaaaattaagaacaataaagggaagaaagctgatggtaaagaccagattcttaatacaccatcaaaaatggagggcttctagtaacctgctatgaactaaattgtatctccccccaaatgtatatgttgaagctccaacccccagagtgatggtttctgaagatggagcatttgggaaataactgggttttgagaggtcatgagggttgtctcactcagaatcaaagtcaaaccaacaaaactatctcttaccatgaccaacaagaccatctctcttcaccatcctatcccaccccacctccaaccttacctatctccatcttctctttctcggactcactctcctgcaaccatagttggcctcctggctgttcacttactaaccaaggttgctctgattcagggcctttgcaatactgtctcctctgcctagaaaggacttccctccactgtctgcatggcttactcctatagcttcttcccttacagggaaataaatttctctgactcccatcccatacactcttttttctcactgccttattaatcaccagagcccttaccaccatctgacattctttcatttacttatttgctaattgtaggtcttctctactcgaatgtaagttccatgaaggcaagaattttgtctggctcatcagagcaatgtcttacacatactaggtgttctttaatatttgctgaatgagttggtcttgctcatctctgaactgttagtgcctggtgctagctgtgtatatgttgaactaatgagtattcaaaggaagcaagtcatgggaatagatgaattcactccccaagacagaaaaagagaaaaaggccaagcatggaacactgagagactggtaatacttaaaaaaccagactgacggctgggtgtggtggctcacgcctgtaatcccagcactttgggaagctgaggtgggagaatcagttgagcccaggagtttgaggtcaacctgggcactgcagtgagaccctgtctctaaaaaaaataataaaaaataaaaaaaagaatcagtgatggaaaagaagccagtggaggaaacagaagaagagcaacccaaaaattagaagaaaaattaggatagcgtattatggaagccaaaggaaaaatgatcagtagtatcataacttggcagacaggatgcgggctgaaaagaagtggatgcatataaaattagttgagctgaggtagtagagtccaactaatgacccagttgcagttggctaaaaaaagtggaggtagaactttctatgtacatctcttttagaaagtccatcagtaaagagaaggaagagtcaaatgtgcaatggcagggaaatagagcagagaaggtatttttcagaatagaagatacttgagtcaacgaagaaggaaagacagaagaagatataagaggaagtgaagataacagagaaaaaagttcagaagggaacgggaagagtagaggtaaccaattaaccttgggaataaggaaggagagagataggtaacaatatacagaaacacttgaaggagagtaaaagtgcaagaattcccatctctagtttctaagtgaaggagttcatgaggtcatatctgagagtaagaaaggagaagtgtggttgtggttaagagcaaaaaaaaaaaaaaaaaaaactttaacagctgtaggagaaaagaaggaaatcaatccctagttgtctgaggaatacacagaattcctaaggcacgacagaggagccaggagagcttgtaagtaattaatcagtatcaaagccagccaacagggctatagcagtttctgtcacacagcaattggcagcctgccaggagaaaaaccgagttagagtggctgtgcctgggactgcatctcaagggtcctgtggagaatatattcaatgactggtcatagggtgtgtcagaccatttttgcattgctataaagaaatatctgagtttgggtaatttataagaaaagaggtttaattggctcacagttctgcaggctgtacaggaagcatggcactggcatctgtttctggtgaggtctcaggaagcttacaatcatggcagaaggctagcagggagcaggcctgtcacatggcaggagtgggagcaagaggtgggggtcgagggaggcaccacacacctttaaacaaccagatttcctgagagctcactatcatgaggacagcaccaagaggacagcatcaaatcaaccataagaaatccacccccacaatccaaccacccctaccaggccccaccttcaacacgaggaaccacacttcaacatgagacttggggggacaaacacccaaaccatatcacagggcttctggctaagcagggaaataaaagcagcaggtttgggtgaggctgacagaattggagaacaggaaagagatcagattttcaaaatcagcatgatgatgagaagcaagtttagttaaagttggagaagaaaatacctgattgtgcagtctctgaagtgggaagaacaaggttcagtaagttctgaggagtagaaatgaaggtcgctaagagacgaaggtctgtgattttggtggtcttgatgagagacatgatggtggagagagggagaagtacagggacatgggtagtagggacgggaccaaaaaaaacaccaagagctggtgacaaagggccattgaagatggagcagagtccacaggtcctgggggcagcctggagggagaaccatgttggctgtgaaactaactggaaatcccacatcttctgatcccagaacaacccagctctggagagatctagacttacaagtaggcacagtgaaggtcactagggtcaccattttagtctacctgaaacacaattcactctctgaaagaagttataaaaagcaaggtccacctcctaacagtgacaggctaactttatttaactaaatatagttttactatatttagtaatctaacttcaaatgctttcaatcagatgctatattaaattgaatcagcctatcttcctaattattaagcatggcttggaaaagctgaaggaaacacaacactgctaatttgcacagaggcttagaaagtgattcacttgaaagcccctcccctaattcaggtaagaaggaagaagataagtaaacaatgatgtaaagctttaattactggctcacactttttatgataaaacacacactgcaaaattctaaggtggccaaacaactcttaagcatgctttgaactttagtgcaaagaaagagatacgtctgtaggcttttgacaaacatctaggtattttcatttaattttcccactcttgtttgttgagtatgtttttccacaagcagaattaaattaaggaaagccaggctttttaaaaagtaattgaatattagcattagtcaacagcaacagtttgtaatatggtatttccactgcagcacctagggatggcagaaaacggaggctgctgataaactgtactggcatcttatctgtacccttactagatttctaaagtttatttaaatggttattctgtatctgtgtctcataaagggatgtcatcagaactgccacctaaggagctattcctaaagacctcagacctactgattcagaatctccaagaataaggatccaacaagtagattttaacttcttcagtgtccaccacactgtcctgtttaagaacacctgtagtgtaataaggtaagcatgaagtgtccccaattaagaacacaatcagctttagagcagtggttctcagccttgtctgcacaatagaatcaccctggaggacattaaaaaatcccaatgctaggccacaccacaaaccaattagtacatcagaatccctggggtaagacctagatattggccttttgctgcccatgggattcccatagtcaatcaaagttgacaaccagtgaagcagaggaccacgtcaaacaactgtttaatgaataaatgaaaaagactaatttaaaattctctgaatttttccttattgaacacaagaaatgatattccatgctatcagcaacatgcagactaggatcaaagggctatggaccttatagtaactggagagattgtctgtgagtcatcaggcagacaacagaaaccaaactaagcaggtggcaatgtgttaggaaactcctgaatgcatttaacatttagtaaaaggatctcgacatcactccaggcaaaaggaatgttgatctagtagttaaggtaaattttctttatggaagagactgcctcattaagtcaccttgtgcaatccagttcatttcttcaaacctttctgttgcaaaatagcatcaagaaagttctgaagtccaggttttagatacttattttgctctttttaaaaggaaaacacttgctacttagaagttcatctatgcttttgctccctggactttctgaagtttcagcaaacaagtctttaataaagataccatgcatttaacaaaggacaagatttctctcaccagtttaaccaccgacagggttcatgtcacaggatgagggtcaatcaggattggtcaaagtgatgtctaaaaggaagaagctgaggcaaaattaacatggagttcatttgggccaaggctgaagactgcagccagggacacttccaagttgccttagggggtgctccagagaactcaagagagaacaagtttgttttgttttgtatttttggagacaaggtctcactctatcacccaggctggagtgcagtggcccaatctcggctcactgcaacctctgcctccgggctcaagcaatcctttcacctcagccttccgagcagctgggaccatagaggcgcgcaccaccatgcctggaatgttttttattttttgtagagacagggttttgccatgttgcccaggctggtcacaaactcctgagctcaggtgatccacccgccttagcctcccaaagtgctgtgattacaggcataagccatcatgcctggcccagaggtcaagtttttttttttaaaaaagcaagaatcaggagaggggacaattacaatcattgttcaccaggaattctcattgtcttacaaaaataacattgattattggctatacattgttgaactataggtatacggcattttatggcttctcggcagcagtcagcatagcactcaaatagcaagtggcttcaagaggtaattatttagctcaaggggagtgatatgactcctgtttcattccaatgcctctcttgggcctgaaaatttaaaggggctcacgttcttcaaataatggattatgaagctgggtcataccacttccacagggcaccaagagcagcccaagtaatcaacatgtaaccccatgtaatcaacaccagcccagggagctgggagtagaggttaggaagattgaagaactgataaaaacaaagtaccaccaaatgaaaatctgtactcactcaattcaaacacaagtgggttccctgccaagcctcaagagaaaactggaaataggttaattttaaagttacagttagttatgtaattgacttaaggaatcagattttttttttttctttgagacagggtctcactctgtcacccaggctggagtgcaatggcgtgatcacagatccctgcagcatcgacctcggagctcaggtgatcctcccacctcagcctcccaagtagttgggactacaggtgcacaccaccacgtccagctaattttcccattttttgaagagacaggattcgtcatcttgcccaggctggtctcaaactcctgtgctcaagcaaccctcccaccctggcctcccaaagtgctgggataacaggcattagccaccatgcccagcccagatgatacattataagtacctacataaggttaagaaaccagtgagattattttcctaaactaaaagaacttccacaaattttggcaatctttgaagatcactaacaagtttcttaagacatgggagcattgcaagataggagcttgggggtgatgaaatagagccagaaaaactggactctattctgcataaattttctttcaaaattaagacaatcttttgcagattaaaataaggatcttcaaactctgtttccgtggatcactgattctctgtgccctgaacagagtcattctactacccaaaatcagataatgaagatcctttgtcaactaacacggaggaatagttaagaagattgttgtcaatttcatgatgcactcacattttgtaaccttgggtacttgctatatagcttgtctacacaagcctctattatataaggagtctgacttattacaaaattatacattagctattcgaagcttattttttaacattttgaggtgtcacaggaagaatgctaaaacttctaggggctctgtcaccactaaatgaatttgaggaccaaccagagcaacagtctgtagtctgtattttcttttatgactaatcttaatacataaatcataaagaagttgacaggagtaaatgcatagtttcttttagtagaagagctctaaatcacaaagaccctcatgatggttttatgaaaagggtcctttcaattccctagcacctagcctggtgcctggcatgtagtaggcccttcataaagtggtttgacctgaagatggagacataagcactgttgtgtgtccttacacgagttacgtggctggcacagccttgctttcctcatccagaaaaaatcaacaggggagaggggcaggggataaatgttatcacaaaattgtttacctaaagtttaataggaacttatcatttgcaaatcatattagtgaaggttgctttttgcattagagcaactgtgctctcctttctgctttggacactagcaactctaaattggtttccagtctttcacagctccgtgctgtgctttcaaatcctcactccagtcccgttgtgatctgaatgtttttctatcacgcctgtttagagacaaggtctggaaacatggcacagagtatagctaaccaccttggccaattataggcatgaccctgtaaccttgttttttcactgctccaatccttcaattccaggaacttatgttcccaggaaaagctagttactgaaatggacacacgtataattagtttagagaatgttccaaactctactccacgtcattttttttttatccttgcatttactgtttgttttaatggctggaaagggaagtttaaaaggaaagtgccagaaacaaaggagaatgtttaaaacatacaaatcaccctataaacataaaaaataaaaaacaaaggagaatgcttaaaacatacaaatcaccctataaacataaaaaattttaattcactggtagtaaaagatgcaaattaataattactattaacttaataaatccacaagatactttatcttaggtagtaaagattttgtttcgtctccctttaaattataacatctagagttgagataaggaggtgaagaaaaggatagtttctctcatactaagctggtggaagtataaataacaggttgagcacacctaatgggaaaatccaaaatctgaaacgctccaaaatccaaaactttttgagcgctaacatgataccacatatggagaattccaaagttgaactcatgtgatgggctgcagcataaaacagtcaaaactttgtttcatgaatgaaatatttaaaaatattgtataaaattactttcaaacgctcaaaactacacaaatacctggaaattaaacaatctcctcctgaatgatttttggggttaacaaatcaagatggaaattttaaaattcttcaagatgaatgataataatgacacaagttttcaaaacctctgggatacagcaagaggaaagtgctaagaggaaagtttatagcactaaatgccaacatcaacaagtctgaaagttcacaaaatgacaacctaacatcacacctcaaggaactagagacaaaagaaaacaccaaacccaaagctagcagaaggaaaaaaaaaaataacaaagatcagaacagaactaaatgaaactgaaacacaaaacaaaagattaataaaacaaattggttctcttaaaagacaaaactgatagaccattagctacactaaccaagaaaaagaagagagaaggttcaaattagttcaattggaaatgaaaacggagacattaccactgacaccacagaaatacaaaagatcatttgagactgctatgaacaccccatgcatacacactagaaaatttagaagtaatggatagattcctggaaacctacaaccctcctagcttgaatcaggaagaaatagaaatcctgaacagaagaatacacacagcaagatcgaatcagtttaaaaaaaaaaaaaaaaaaaagccaacaaaaaaaaatcacagggccaggcagattcacagccgaattctaccagacattcaagaaaaaattggtaccaaccctactgaaactatgccaaaagactgagaaagacggaatcctctctaactcagtctatgaagccagtattaccctgatagcaaaagcatgaaagaatgtaaaaaaaaaaaaaaagaaaaagaaagaaagaaaactacagatcaatttccctgatgaacacagatgcaaaaaagactcaacaaaacactagcaaaccaaatccaacagcatatcaaacagacaattcaccatgatcaaggtggggttcatcccagggatgcagggatggtttaacatattcaagtcaataaatgtaattcatcacataaacagagctgtaaaaaaacatgatcatctcaatagacacagaaaaagcattcactaaaatccagcattgctttgtgataaaaaccctcaacaaactatgcatagatggaacatacctcaaaataataaaatccatccatatatgacaaacccacagccaacatcatactgaatggggaaaagttgaaagaattccccctaagaactggaacaagacaaggatgctcactttcaccacttctgctaaacgtagtactggaagtcctagccagggcaatcaggcaaatgaaagaaataaagggaacccaagttggaaaagacgatgtcaaactctctctgccaatgataaatgaattcagtaaagtctcaatttaccaaatcagtttacacaaatcagtagcactgctatacacaaaaaacgaccaagctgagaatcaaatcaagacctcaacccattttacaataactacaaaaaataaaatacctagaaatacacttaaccaaagagatgaaagatctctactaggagatatatatatctctgtcccaaaatccaggctcagcagaaggatcaaagccaacacttcaccaaagaggaacacacccctaggaaagccaacatttgacttttgacctgagctgctaagataaactgggccaaatttctatttattaggaattcctatttggaagcccagtcgtgcttgtaggctctggatctgaggtgctatgaatcaggatcagagccagtgaccatgtggaatgtggagccaatttcaacataaataagcagataagttgtatgatgcatttttattataatcatatattactttcaaaattaaaaacaaatgcaaaaacttttggtaagaaataacccaagtatctgattgcatgtcagagaagaggatactggtttcctgttggtgaataccacctgcatctattccaagcccacacaaagaaagtgctggaggcaaaacagggataggtacttgttttcagaccacaattgttggtttctgctttcctgttggtttttttcagagctgtctataaacacaggagtattgacttattactgccataacaaaaacaccttgtatttgcaaaacatacttaagtggaggtacgggaactgttctgtagacactggctaagtcagacacacagtcatagaatcacacgggctgctgagctcaaagcactttataaatcaacccatccaggccaggagcagtggctcacgactgtaatcccagcactgagggaggccgagaggcaggaggatcgcttgagtccaggagtttgagacgagcctgggcaacatagttaagactttgtttctacaaaaaaaaaaaaaaaatttatgagtgaggcgtggtggtgtatgcctgaagtccaagctactccagaagcctgaggtagggggatcacttcaacttgggaggctgagctgtgactgtgccactgcactccagcctgggcaacagagtgagaacctgtctcaaaaagaaatcaacccatcctcccgttacagatggatactcatggagggacatcaagttttcacattattcacgagctatgtctgtctagccccatttttttaggggatctgaggcaagagattcatagagaaaaatcaaggtgctgggaaaagagcaattactaatccttaaagaactacactctaagagagtccaccttctcttgaaaggaagtcctagatcacaagctgatcctaattcaactataattcccatactgtccctagaatagctccagaatgtacaaattccccagggcacttaattctacctggggccaaaaaagtccccaatgcagctcaacatcctctggagtaatggaaagccaccagatcagaaggggaatggaaggagaggggcatgaaatgaaaaacagattctccctaagattcagtgatcaagccaaagctgccaagaaacatgaagatcacaggcccaaagcacccaccctgagcccctccaggctaagctgaggtggggaaacgggggcagtgtcatggaatggggagaacatgatgccagaggtggttgcctcaggctctgtaaggaaaacacacattttgaaacatgaacaaccatatagacaaattcaaagaaaggggcaagactgtattcagtctagacagctacttcaacccttgttgtccagtggagacactttcaatccagccaagctatcctcttggctctcaatttaggacagagaggcctacgttgaatgattagagcctaatagggtgcacctatgatcattcatcttggacccagtattcatcaggcctctaaacaaagaacagaacagcctggggtcaaccatgggcactcacccatttgaataggcaggactcactcaccccacatacacacacatactcatatatgcacacacacacatactgatatatgcacacacatataaacttaaccttggggttggctgctgtcaaacagttctgtcatccattcctgatgactcacaccagagaaatagatatataagtaaactggaaaactacaaatcacccctaaatcatttctttccaggaatgaggatgtgatttttcagcaactcaacatttctattagcttatttatcccacacatcttctccttcccaatactgaaactagttgaaattccctgaagtgacggcaagtgaaagaaacaggttagagatgagtggaaaaaagaaacagtccaggattttaacagattttcatggttgggaggtcatcaacattcagacacccaaaaatcaacaatatctatagacccctacactgcaggggaggtaaatgactacaataactcttctgtatctcagagaacatacaggcataaagaatggccaagtaatgtgctatctgacaaataggacaatcagcagtatacaacattatcacatggtcttacaacatcacagcaaaattataacattgctttacaatgagcaaaaatccttttcgttcctggccagcaacttgattgtaatacagatacccaatattttaagaatcatggaagaggatgcctacccaaaacacttagaatttccactacttttagtggtacaactgattctgtgaatacagacaaacaggaatgcaggaaatgctagaattcattcgtcaacctgaaataatttcccccaaataaaccctgaatgtgttagaattcaagagtgatgcaaaccattgtctaagcccatagtctcagaggaaagcacatttattaaagcacgttaatgttcccttggccatcctagcgtgaggtatacagcatgcgcatctttaatggtgccactctggaatgcacatcctgcactctgcactcttctttctttccttgtcctactcctactcagagccactctgagcttaaatgcaaaccagcttctctgtactagcagaaaaggaagaaccagggtagatgggatgaaagtgtgattccttcaaccattatcataacaattacataggtactaagtcaccactctatttgacattacagattcattaaaatgaattccataattccaaatcgttttcttttgatatgtctatgctgttcagagtctggtctgtcacttttggtacctcaggaactaattcaagagttgaacaagtcctagaagctccattcatattaacccaactcaaagaccacaatgctccaagtagaaataaatcccaagagaccacagggttctagttaggctgatttaccacttaacaaagaaataaaagtcctactggtttcaaccctgatttgaaaaaattctttatataatgcatatttttcctatctcaagagggcagagtgctctaaacaggatgaaactctctgacaatgactcaaggggcattcttctgaacacagaatcacagacatcttccacgctacagtccagccctcttgttttacagaagcagattaggacaagtgacaaatgtgtccaaagtcatatcagcacttacattcctatactcgatcattaattgacaccaccaatcccccaagtatcccaatctcagaacttggaatatagcctggataatgagtaaactccatgcttctctgaataggcttcaacagtatgagccaaagaaaaaaataaattagttccccccgcttctgatctaaacccctagaagacaggccagtaggtagcaggtcttgccctcatttgtgaggaatgaggggctgcaagtggggaagtgtgagaatgtcagaaggtaacttcaccatgagtttccttgtagacccagtaagagacacatggtacaactggtcattagcaagacagcattgcctgccacatccatcctatgggaagataccaggactatgatattctataggcaataacactttcttccttgccagctgcacccattaacagaccacagtttgtttttaagtgatctagtacttacatttcacaatccagttgaaccatgggaattcactgggtaggatttttgataaggtatctcacccggctcaaatatattaagctaactcagaaaggtctcctaaaataatcggtagattcctgaagggtcaggatgctgtcctgattctagggccaaccactttacttaacatatagtagatattcaatagttatttgtcaaactgaactggacatatgttgggtatgttaatattgggactaaatatgcaaaaaaaaaaagagagaacttcagaagtctgggttttattattacaatttgtaatgatgtagcatatgtactgaaaatatccccagagaatatctagtcaagtcctttatattcatacagcagaaaattgaggctcaggacagataagtgaatgcttccatacttacctgttatatggggtactgaaccagatcttacacacacacacacacaccccatgaccacaccgttttttcgggagggtgggggtcacttgctcttatcatctaggaatgaacaagcgaaaattccaatgacaggctggtaaccttggttctcatcaaattgaagtttcacattaatgtgttccagaggataatgtgctaagttaaattaatcatccaattatttagttaatagactaagtttatctgggataatgtatgttttcaatataagaccttttctaaaaatcattaaatcaatggaaaaatatgaacatttgaaataaatactcacatgtaagttaagggccatttctcggaaggatctggtatctcaacctctctcatttaagaagtctattttcctaacctttctgtatataaaacatcaccctcccacacacaatcctagattaaaatatatattcctgtctctcaacaacattttcatccccaagatccaagccaccatgtaaacctctggtttcaatgatgctttatagccaagactggactcttaagaagcagaattgggagcagaatagtgagaatttcattcaaactcaatgtttttcagaagagaaggcccagattataaaatattttaccccaggtcattcaattaaacagcagggcctgaatcagaacgtgcctttgtgatccacaaaactgtctgcctttatggaagtgattttgagactctcaaagaacctattactgaaaaactgcctcttccctaaaaaatggatcaaactccagttacctattttcattcctgttaataactatatttctacttcatattttatgtctagaggttgctagttttgttatttcttcttcttgtagctaataattattgtctcctatctctattaagtaaaataatggcaaagtatactgatccttttgccaagcagagctgagagccccttcttgtactcctcatatgatctcattaaaataaataattttcatgttccaaacttttaaaagttttatttaatttctaaattcacttattttttccccacaaaaaatttccatttgtctttctttcgtattaaaggtttagacaggaaaccagataatgaaattcagtggaatgaacaggcactttaattctgtttgccgggcactggcaacaaaaagtatttgggaacataataggcacaaagggagtcactgggcagtaaaacttctggcttatcttctcatccaggttgaattcatttggatggggtgggaaagtaggataacaatatggcaaattttccactttgttgccaccattggtgggaaaatgttaaggcagagactgcaagccctgtggcatggtacaatattttagagtttttttctttatggcacaatattttagttttttttttaaagtataatcacaggctgaagtgaattatgcatttataaaaactagaaatgcaaaaaaggaattctaatatcattagtggttttgtaataacacaactgtaattaataatttgcatcttgaacctgtgcagataaagctgaagtcaaatggcagttcgaatctcccagttaaccactgtcactgttaacaaataaaaaaagattagataaaagtaagacacaatgaagcaacttttgtttaaagatttttctacccctacagtgcagagagaaaaacaaaagggaatcacataatttaaaaagataagggtgaaggggaaagggagcattttaatcacagagtgtaaaataataaggaagatgcatgtatgtatgcttcccagcccattattgtctataaccctatggttccacgaagaaaggaaacaggaaactggagcaagccatctaatgaaccaatgaggccaaaagggtaaaacagcaaccctctccatttggatgacttccaaaattgcatccatccatctgagaaatgatcattgaatgcttactttgagtgaggcaatattctgagcaacagggatagagcagtgaaccaagcagagagcaaccccatccatacaacccccatttctaatactgcttttaggctgcaaaaatgtatttccaacatggcacctccaactcacacatctagttgcaagatcatcttctttgctccccaaattactccttctatgtgtcccctgtctcagttaaaagcattaccatccactcatttcttctgaccaccaaattgttgtcatgttaaactccaacctctccatttttacctctaccaactccttcagtatatcacagaatacctgattgctgaatatctacaaagtttcttgactctgtctccaccttttcattccctgtaccattagggacctaatcatcttttgcctagattactgcacaagcctcctgaggattttaggtcttccctctgaaagctgctcaatacatcctccatttcacttgatgaaaatcatatcctttctcctccctaaaaaacccccatatgaatccttgactcctctcttcattcttccgcacatccactccatgagaaaattctattgattcagtctccaaaatacatccatattctgaccacttgtcacctctccccttatcacactgttcaaaccaaattcatctctacaatgactataatacttcactggcctcccagctttaacattgccctaggttagcctattctcaaaacagcagcgagagtgatcctttaaaaatgcaagttagtcaatattgttccctactcaaaaccctatgaggtacccccacagtcactaagagtaaaagccaaagtccttaaaaaggcctgaaagccctagatgatctggcctcttatttcctaacctcatctcctctattctctcagtcactcaccctactctttctgcttcagccattggctcctaaaaattcctcaaacacagaattgctcctgtcttaggacctttgcataggctgttccttctgccaggaacattcttccctacatatccacatggctaactccctcactccttcaagacttttctcaaatctcacctcctccatgaagcctaccttgaccacctatttcataatgcaacttcctcctatatactcacaacccctttatcatgtgctattttttccccaaagcaattatcatctaacatacaatatgtagtttacttaccatctttattgtttactgtgtctctccccattagaatgtaaactctacaaggggagagattttgtctttgttcagggttttatgccaactgcctcaagtaccatgccatagttaaatgttcaacactgactgaatgaatggactgatcaccctggttgcaggatctttgccccaaggtcatctttttcaagcacagctcatgacatcaactccctgctgtaatttttttaaataaaagtataaatcagacttcccctaaaaaaacccaactctttttgctgatccctttcaacatttttgctttaatatcacttttaatgttcttagtacaattgttatattttacaaaatactctttctggaatgtagtggttgtttggccttctgtatgacattttaactcacctagtttcctttagaaagttactgactttaaaagaaaatctttttgagcacgagtgctgccactttaaagactacttacaggacattttaggggacataaaaacaatcctaaataatcacaaatattaaagtaagagcatggtacacttgcaaaaattctgccagagataaggttcagccgatggtaacatccatgagctgtattcaggcactttgcaattgaatgtatcatagtgattctttttaaattgaagagggactccgaattatttcagattttgcacttttatggtactttctatcatgccctttcaaatttatataaaaaatgttaactattgtagctaagtttgccaagaaaatttcagtgaaacaaaaggtttttagactcagattttctgtttatgtttacaagcacatctattccatatatttagaaatacttgtatttagacagacatacttaaagaaagccccttaacacattttataaaacactacaaactgactttgtgtatgagttttagaatgatggctgacacttacgaagcagttactatatatcaggttccatattaagcctcgtttaacctccaccacaaccctgtgaggttggaactattactattcgtatttacagatgagaaggcaggggttcagagatgttaagtgacttgcccaaagtcacagaactactaaatatccagttttttatttcagatccctgttctaaacggctccatgtcaggcttactgctttgcctcacacttaaaatgtatgaaagagaaacgactaacttcattaactgccagttgcagcaacatcttttgagcctaagcaccttcactagtcccagagtcatagcagccatatttgaacaacagaatcccacctcaactgactagaacagagttaggaaaatccacctcctcgggaattcagagttggaaatgagagcagacctctccccgtggctgtacataatagatgaccttgggaccagcttctgcctgctttgtaggcaaagtagcagaaaatgtcagtttgttgagaaagaagcagatgtgtagagaaaaatcacaaagtagagacaaaaatcccagagtcactaagacctcctgggtttggttccaagtcttcctgagtatgggtatgtccctgcttttggatttcatgagaaatcccagaaaccggaaaaatctattatctctctgtatttagtggtttaagtgggttcctgttacttcaactaaaagtttggttattcaatactcagatctgggtttatacatggggctgaaaaccaaataatcttcactgagcaaaaagaaaacagaacatagaaggatttgaaatgctggcatttagaaatatagtcaattaatctaaagaacaaagtatctttaaaataaaattgtgatagtctcaagacatcaggaaaatggttttatcttggagagttagaagatgaaatgaacttacaggaaaaccatgtgagatactaaaacacaatgagcagcagcaatagaagatgacccaaaaaaagcaagcttcttgccatcacattactaacaataaaatgcacacacacgtgagaagcaaaaaataattggctctattttcaggcagacaaaaagtaatttccatatattccctgtatctgtgttcaaagattttaggcagcagaatcatctggatatttattaaatggtggattcctgggtctcaacacagagctacagaatcactccctggggatggagctgtgtttttgtttttgtttgtttgttcgttttgaattggggtctcactctgtcacccaggctggagggcagtggcgggatctcagctcactgcaacctctgcctctcagattcaagcgattctcctgcctcagcctcctgagtagctgagactacaggcatgtgccaccacacccagctaattttttgtatttttagtagagacggggtttcacattgttagccaggacggtctcgatctcccgaccttgtgatctgcccacctcaacctcccaaagtgctgggattacaggcatgagccaccgcgcctggccagagctctgttttaaagcaatgatcctcgaaattgtttgtttcagcatcctctgcattaatattctgaagctatatacttatactcacttatccatttttaagttgacatctagtttgataagttgcataaggacataatttccaacttgttataaatatccagatttataaataaaactgttaatcattcccttacattgataaaaatctctctaggtatcacagagatttgaaaaacattactttttttaaaaaaaaaagaacaagcctggtggtgacaaaatctctcagcattagcttgtctgtaaagaattttatttctccttcacttatgaagcttagtttggctggatatgaaattctgggttgaaaattcttttctttaagaatgttgaatattggcccccactctcttctcgcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaatttggttccattctccccgtcactttcaggtacaccaatcagacgtagatttggtcttttcacatagtcccatatttctcggaggctttgttcgtttctttttattcttttttctctaaacttccttctcgcttcatttcattcatttcatcttccatcactgataccctttcttccagttgatcgcatcggctcctgaggcttctgcattcttcacgtagttctcgagccttggctttcagctccatcagctcctttaagcacttctctgtattggttattctaattatacattcgtctaaatttttttcaaagttttcaacttctttgcctttggtttgaatttccacctgtagctcggagtagtttgatcgtctgaagccttcttctctcaacttgtcaaagtcattctccgtccagctttgttccattgctggtgaggaattgcgttcctttggaggaggagaggcgctctgctttttagagtttccagtttttctgctctgttttttccccatctttgtggtttcatctacttttggtctttgatgatggtgatgtacagatgggtttcattgtggaagtcagtgtggtgattcctcagggatctagaactagaaataccatttgacccagccatcccattactgggtatatacccaaaggactataaatcatgctgctataaagacacatgcacacatatgtttatggcagcactattcacaatagcaaagacttggaaccaacccaaatgtccaacgatgatatattggattaagaaaatgtggcacatatataccatggaatactacgcagccataaaaaatgatgagttcatgtcctttctagggacatggatgaaattggaaatcatcattctcagtaaactatcgcaagaacaaaaaaccaaacaccgcatattctcactcataggtgggaattgaacaatgagaacacatggacacaggaaggggaacatcacactctgggaactgttgtggggtaggggtggggggtagggatagctttaggagatatacctaatgctaaatgacgagttaatgggtgcagcacaccagcatggcacatgtatacatatgtaaataacctgcacattgtgcacatgtaccctaaaacttaaagtataataagaataaaataaaataaaataaaataaaagaacaagctccttttcagtcatatatcctcttttaattttttcttgaattcatacatcttttccatatccccagcagaacttcaataacatatttttatgcttgtaaatcttttactgatcactctatcatgctccccacaaataaactgtgtacataattgcagtctcacattttacatttcctgtggccgtaagttttcaatatttttaaattttctcttatggactaagttcctaaaattattattggtccacaattgatcaaaattaatatataataaatgttgacaaatccataatgtataaaaagtaaaacttttcagtaatacatctcttaatgagatggataggttatatttttatttacacaacatagaggattttttaatttttttatttttaattttttttgagacggtgtctcgcactgtcgcctgggctggagtgcggtggcgcgatctcggcccactgcaacctccacctcccaggttcaagcgattcgcctgcctcagcctcctgattagctgggattacagatgcctgccaccacacccagctaattttttgtatttttaatagagacagggtgtcactatgttggccaggctggtctccaacgcctgacctcctgatccacctgcctcggtctcccaaagtgctgagattacaggcgtgagccaccacgcccggcctgaggattattatttatcactaggatgagatacagttcagcatcagttctattcctatttttcacattttttaatgtagatataaaatatacgaaacctgctctcataaataaaataggaatagaagtttagcgactgtaaaatcattcaattctttggacttcttcttaattatgtaacaaaaaattgcacatgaattatcaatatttttaaagatcagctgacaatttgagtatattttgttttattgaaagcaaagaactgaaaatggtttgttatctggtaatattagagtcattcactttctcaacactaacatcatattttgagtttttcctttggcttgtgccctggaggtttttatttccaaggccaatgcaccaagatttaggatgagagagtagcgcctttctctcctaactgaaaatagagtagtcgtgaaaggggaagcgataaaggagaatccacacaaatgaacaatgattttcttagactcctatcactgctacctaccataacttagaatgcccacgtatccccaggggcatgtgtatcctggtttcgacacactaattggagctctgttcattcatgcattcattccacaaacatgtattaagcacttgcaacatgccagacacttatctaggcactggagatacagcaatgaacaaaacaagaaatcccctgccctcatggcccttctaaaggaagcacacaatctgttaggtctgtgttgggtgctacggccacctgcctgagcctcctgtggcctgctcttctctctactctaaagaactgtattcccactgtaataatttgaaatgccaactagactggattaaggaatatctagaaacctgtaaggcattgttttggaatgtgtctgggatgatgtttccagaggagattggcatgtgagtctgagcggactaggtggggaagatccaccctcaatgtgggcaggcaccatccagtctggtggatggtggtgaagacagtaaagaaacaggaaaaaggtgaatgtgtcattctatctccaggatctggaatacactcatcccctgccttggacaacagaactccagggtcccaggcctttggactccaaggtttacatcagtggctccccgggttgcctggccttcagccttggactgaaagttacaacattggctttcctggttctgaggccttggggacttgaactgagccacactaccagcatcccatggtctccagcttgcagatggcctgttgtggaacttctcagactctataatcacataagctaattcccctaataaatcccctcttatagatctaaacagttgtacagttgtccctcagtatccaaggggaattggttccaggacctccttcaggtatcaaaatccacagattctcaaatctagatataaaatggtatcgtatttgcatataacctatgcacatcctcctacatactttaaatcatctctagataacttagagtatctgatacaatacaaatgctatgtaaatagttacattgtttgggaaatactgtttagggaatgacaaggaaaaatatctatacatgttgggtacgaatgcaaatttgttttcaaatattttcaatggtggttagttgaattcatggatatggaatctactgaccatatatatatcctttttattctctctggagaactctaatatgctaacttagtcaacagagagccaggaagtacttactacgtgccagaacattagctaaacccaaaagaatagagaggatgcagactggtcctccacagtatacaataagcataaaacctctcattcagattcaccttatataatacattaagtcactgtttaaataagtttatgttctacaaagcaaagaccaaatcatcaccagggtcaagcagattctcctctgcctatgtaatattaatctattggctgtgcttaacatttatttatttatttatttatttatttatttatttatttaaattggtttttttaagacacagggcctttctctgttgctccggctggaatgcagtggtgtaatcataacttggtgcagcctcaaactcctgggctcaagagatccttctgtctcagcttcctgaatagctaggcctataggtgtgtgccaccactcctggctttttttttttttttttttttttttttgaagactaggttttgttatgttccccaggctggtctcaaactcctggccttaaagcgatcctcctgccttggcttcccaaagttctgagattacaagcaggagccagcatgtccaaccttacagtttgaaacataattttgttcccaaactacggatatgagtaaaccacatccttggcagtgactgcgttctaggataatttttaatcattgacaaaacaaattattcttcctatcaagaaaaaagtactagttctgaggataaaacactacatgtttgtcaagaaaacaaagtcgaccatccatgaaaagaaagtgcacaaaaatgtacaattcctagggtggaaatttccatcaatcagatatactcttggtgaaaatcaagggtcaccatgtcacttaagttgcaaaattcaaagtattttaagttcctaagttaaataaccccaaatgtttcttatcaagaaaaaaagcctctccacctaaacacatagctacaatttataattaccaaaagaaacctcacaatggccctttgtaaaggatgatcctcatgtagctaaacaatttcccactccctcttctgtggtgccttttaaaattatcattataacatctacagtcagaaggtaaaaattgttttttcctatatgaagttaatatagaatacataattagaacttattttccacttgtggtaattaatatgcttgcaattatagccactattccataccattaatccctaaaagtaaaggcagctagcagagtaaggagacctctgagacacagaagaaagctggctggaccacatgaaagtggaactcttaaatctgccttcaaaagtgcaacagtctagccacaagaactacctagtatagaattaacattctaatccaaatgagaggaaaattctaaggttccatcttgatcaaaatattatgattataaaaacattccaaagttcagcaaaccgtactaaacttacatagtcccatatctacctctaaatatgctataaagatacaataaaaaatagattgtgtagtgaaaaataagagatatagtaggctctaaatagggtacagtccatgaatttggggtaaagccagaaattaccagcctctgaaatttaggttaattatgaacttaaaaaagcaacaccaatgatgggataaactggcaccctgtgctcctgctgagatgcactgagaaggatacagtgtcacctatggaatattcctgtccaaaatgtttaatcttaacctaatcacgaagaaacaattagacaaatctaaactgaaagaaattctgcaaaataactggcctggcctcttcaaaaatgtcaaggactaaaagacaaaaaaaagttgagaaattattccagattaaattcaataaattcatattgaatacctactgtctggataacggcagtgtgtggtggctaagaatgtatcaaattctgcctcaaaatcctatctctaccagatggaaaagacatctaaccatgccatgtcctggtctcctctcagtaaaatgaggatagtaatattacagtaccttcttcaaaagattataccgagttcaatgagttcatctataaaagccttagcacagacactgctcaacacttaataagtgctcggtaaatgtcagtggtgatcatgaccatgatgatggtgaagagccaccagatgctgggggaggggaacagagagactaacatcgtcacgtcctcactgtgcttacagtgagatgtgagttacagaaaaatgaccaggcaattctaagatagtgcaatagatgcactttggctgatgaaaggctctagagttcaaaggaggccgttaggtctttctaagcaaggaatgctggcattggaatccaggtaatgacagagaggtgaggcaactagggtagaagagatcaaacttgaggactgctaggatcgtgaggcaggggagtgctgtagattgagtctagttcctggcttggcagctgaacgggctgtggtgccagtcactgagaaaaaggagcccagggcatgagcaggtttaggggcagcaagagagtcggctgacgctgggtcagactcaaccagaagggccacccaaggggacttgtgctggactcacaaaggcatgtggcagagaagtcctgatcttgagagaaaaggatacattctgcattccccagaataaaacacctaaagcaaacagattttatcttgttcttgcctggactctaatttcaaaacatgataaagaaaaatacagcagtcctatcaatcttatgtatttcacagtgtaactattttactgtaaaaatagaaattaggagggacatttgtggctctcaataggttcattaaacctaaaattgtaaattcccctgccagaaaggtggtatgctagccagatgttctcactctaattgagaacattattttgcttactaaaggtaagaaagaaaacatttaggtcaggctcggcggctcatgcctgtaatcccagcactttgggagactgaggcgggtggatcatgaggtcaggagttcaagaccagcctgaccaacatggtgaaaccccgactctgctaaaaatacaaaaatacaggcatggtggcacacacctgtaatcccagctactcaggaggctgaggcaagagaactgcttgaacccgggaggcaggggttgcagtgagcccagattgcgccactacactccagtctggatgacagagcaagattctgtctcaaaaaaaacctttataaactctcatttcctaggttataaaacacataacccctcacttctacccacagaaataaaactgccaggaacaactctgtgtgcttatgtgcctatgggcaaaaatacataaactatattgatatcataaagaaaacactagattcaatcttggcccatagagtctcaattatcaatccaatcagaagctgaagctggatttgccacacaacacaaaaccagtcttgctgccacactatgtgctcattcagtgtgtgcctgacaatggctacgggcaacactgattctctgcctacacactgtctttgaggtacactgcaccgtctgttggcttaatctcagatcaaactgccttagctcatgtacttgtgaaaaagatgactgattgtccccaatatccattctatatgcccccttaggagtagaacccctagagtcttggaggcttactagagttcacctttccaagcttctttggtagtcaggtatcatcacgtaccttaagttctggcaactgggatgtgagggcaagtgatgtctgtgatttccagatcatgcccccagaaggaaactacttggcctccactttccctttcccacagaataaacaaacatacgggagtggtgaacctcctgcagcctgcacatgagcagaagcactgaggcaatggaagaacaacaagctagaaagagcctgagcgcctgactcatgaagcaaagagctagattccaaagtgactactggcttaaatttaaaattttatattattattattttatttatttttttttttgagacacagtctcactctgtcacccagactggagtgcaggggtgcaatctcggcttactgcaagctctgcctccccggttcacgctattctcctgcctcagcctcccgagtagctgggactacaggcacccgccaccacgcctggctaattttttttttttttttgtatttttgtagagatggggtttcaccatgttagccaggatggtctcgatctcctgacctcgtgatccgcccacctcggcctcccaaagagagacagattcttgctatgttgcccaggctggacttgaactcctgggctcagcctcctgagtagctgagactactggcacacaccatcatgcctggccagcttggatttttatatgagaaacttattctgcttaagctactattattttggtctttataaaaacagccaagccaacaccttaattcatttccactcaaatcattaaaatgtgtgattatgcagaatttatgtaattaaggtgtgtctcactttgttttagagttttgcattcctttataatgactgcagacatctcagcatcccacacagttgacaataaatgcttatgttggaatctccaaggggcataataaacaggtacagttaataccactcttctccaaatggtcatatattaaatctgctctttaatttgttgctagaaccagtatttgcagagtgcaagacttccgatctatctgacaaatttttaaccttggttttatatatgatgacaacattctacacccagcattaggactaggctacactggttttcttttttctctagaagaggacagattgtactaaggcctaagatcgtactaaggtgcttatggtaggcagaataatgtctcccatagagtcaattaccatcacaacccaacacgttcatttcctaatcccaggaaactgtgaatatgttatcttacatggcaaaaggaactttgcagatatgattaaggatcatgagatggggagattcttctggattattcatgtaggcccaacttcatcacaagcgtccttataaagagggagacatgagtgtcagagtcatagaggagatgtgataatggaagcaaaagctagaagtatgccattgccagaaggggccatgagctgaggaatacagatagctgctagaagcacaaaggggcaaaaaatggattcctacccagaacgtccagaaagaacacagctctgccaacaccttgattttaggccagtgaaacccacttcaggcttctgacctccagaattacaagagaatctatgttgttttaagccacaaagtttgtgataatttgttacagcatccataggaaatacagtgtccttacatgtagcactgtatattgtaataacccaattgaattagggtaggatttgtccagacctaaagagctaaatgaaaataagcaattttaataatatataatcttattaataatattgttactaatattatcagtagtaataccaatagtaacatacaattgttttgcctttttactgtaatcacaaaggtagctctccctgcctccctccccccgcaaaaaagaaaaagaagtcacagaaattgaatataagtaggtacaagcaaatcttgtaactagataaaaggatgatttctacccactagcaaatgactcttcatctcaagatgaaattgaatgccatttttactgctattgttttgaaggatgaatgctttctctgctagtaaaacgcgttcaataatttctgcaggccgggcatggtggctcatgcctgtaatcccagcactttgggaggccgaggcgggcggatcacgaggtcaggagattgagaccatcctagctaacatggtgaaaccacgtctctactaaaaatacaaaaaaattagccgggcgtggtggcgggcgcctgtagtcccagctactcgggaggctgaggcaggagaatggcgtgaacccgggaggcagagcttgcagtgagccgagatcgtgccactgcactccaggctgggtgacagagtgagacttcgtctcaaaaaaaaaaagagaaaagaataatttctgcaaaggccaaagaagaatttaaagagtttttaaagctcttcttgataaccaaaatctgtaaccatgcaggacattcccctggtattatttagttcaaatctccatcacttgtttcagttttacgcagctgttgggtacagaaaaccaaacagtcacccctgtggcttccgtatgcttcaaacagtaccattcctggagaagggcaagattcactggccctagcttcattcatctgggccgttcaatgttggccaaaagggtccacaacccacaggaaggtcactagaagctaaaattatcactgctcccttaacctgcttcttgtcagcaccagctaattgcccaccattgtgcttctggctccatgatggtgttattatagttcccaacgcagggaagtctcagcacaacacctttggaaaatgcttaccctgacattcctaagagcattccaaagcaatgcccttgtgtgcctctctggcctggagctcaaccatgcctgatggtagaaggttcacttcaagatcacattcttaagcatggcctgttttcactgccaggatttcataaaatcatagaaccacaattgtactataaactcttggcctaaatttacgtcccctccttcctcctgaacagaaccaaatgaatgttgcttaagatccaaaacagatccatataacaggactccttttgtttcagaaactaaattacttctttgtgatacatccctacattacattagaataacactatctcctgtgctgtactcataggaagtggagttatctccttggaccagatgcttggttttaaagattgttttgtttgtttgtttgttttttatctgcttccctctgtctcaatttgttctgggctttggaagccttcatatctccaccactgataatgtctaagtttttctacctataccttaagtttcctgccacatcttcctgagttaaggccctttaaataagcatcactgcttttcagggtctggagaaaggtctgtctactccaaacctcagtgggaaaggtggacggcatgcactggataccctttgttgtctctgagtaatgatctttattaaaccttttaatggaggcatacatttacctgtatatcacacacttaacctaggaagctttctgtcctatatatgttccaatttggtcttgctcacttcagatatggattcctaatatgtaaaatataaggctttttgctccttaacttctaagtattttaactcactgctatttggcagtaacattaaaagcaccaaaaaaaacaactcagctcaacaatctaacactatttctcatcccaaaagctaacccataatctttttaggtttcctcttctactttttgttttactcataactcagcatttctttgcaacaggagctaataagagtttgtttttgtttttttttttctggtttatgttatctgcaatttacaagaattttttttttctcctccctgtgttaatctgccaaaacaaaataccttagactgggtggcttaaacaacagaaatttattttctcacaggtctagagcctggaagtcccagatcagggtgccggcatggtcagtttctgttgagggatctcttcctggcttaaagatgtccaccttcttatgtcctcacatggcagacagagagagagagaaagcaagcccttcggtgtctcttcttataagagtgctaatcccatcaggagggccccaccctcatgacctcatctaaacctaattatctcccaaaggccccatccccaaacatcatcacattcggagtcagggcttcaacacatgagttttgtgtgggacacaattaagatcatcacactctctccttttagggccgatttttatctgccttggaatgaatccatgaccagcctttcttcattaaataagcagggacagagactgaacacctgttaggtctcaggcccaggctcagtgctaggtattcaaagaggaatacatacaatttctgatatcagcagttccaatattcccaagttctagatggaaataccttattgtgctggcttactgcagcagccatggaaatatgccagtcagagctccctttctggagaagcacaactaactgccggcctcttgctgccacagcttcaggtctaccatggcattcgtgcagaaattgtgtttctactgggctgcgagccagcgcccaagtgtgcagaggtactggaatcactgctgttgttgcccagtgcgaaactccagcaacaggcaactttgcttagggaagccccatccatccagccaagacttctcaggaatacatggcattgtaaaattcttccccatccctccttccttcccactcttccttcacagatgtcagacctacagcatggtctgaaggctctctctaccttttgtggtttcctccctctttccacttcatagacattccccaacttgcattcaaatcccagcttggcaactgcttctcagaggatctgggaaaacagactcaggaattaacttcacttaaaataactaaaaaacatgtttagctttcaagtaacctgttcatctaaccggggacaaatactcatctgagacagctaaagcaaaaggtgatagaagaaataaagaaaatctgctttttcttacattcaaataaaggcaaaacagaaaattattctcactataacttaatataattgggcatacagctatggagcatttgccaagtaccagacgttgtgcaaggtattgtaaaggctataaagacaaacacaagatagactccctgccctcaaggaacttacaagctgcactcctatcttttattcagaatttttacatcattcattttaaacaaattccttaagcattttgtacacacatacatatgttcttctgtacgaagcagatgagtaaacaagattacttcatgtaaatatttttaagtccttacttagaaaataatttggtctttaaaagtaagtatcactatatttccatctagagtctccaaatccccaccctaggcctctaaagggaaaatgtcaagacattttatcacttaatctgattagaaaagtccttcatgctcatctacatagatacatctccaaaatcccaagttaagaaatgagctcaaggcatttgggtcaactgacacaggctggtggaaaaaaaaaaaaaacctcaaacatcttaaaatattcatttttgttgttgttgtattgtgaaatatttacatacaaaaagtatataaagtaaatatgtagtttaaagaataacataaaaaaacactgtgcgctcaccattcaagttaaaacccagaatattactataacttttttttgtttttgagaccgagtttcgctcttgtcacccaagctggagtgcagtggtacgatctcggctcactgcaacctccacttcctgggttcaagcgattctcctgcctcagcctcccaagtagctgggattacaggcgcccgccaccacgcccagctaattcttgtatttttggtagagacagggtttcaccacattggccaggctggtctcaaactcctgacctcaggtgatctgccttaagtgctgggattacaggcgtgagccaccaggcctggcctactataacttttaaagcactttttcttccctccactgctttagaacagtttctcaacctcacgctattgacattttgggcagataattcttaaccagaacattttggatgcttagcaatacccctggcctcaacccataagatgacagtagcatatcaccaccatcaccaccagttgtgacaaccggaaacgtctccaaacacttccatatatcccctggagggcaaagtcaccccttgttgagaactactgccctagaggtaatcacaatatgaatttttgcttttatttatagtatatcaacatatgtaaccctaaaacaatgtattgcttagttctactgtatttgaactccatagaaatgaaattgtactccatgtattttcccgtgacttgtttcttacattcaacattgtttgtgagatacatccacggtgtattattacaagctgtaattcacacaatcattttttcatatatttttgctgctgtattgtaatccgttaaattaaaactccataattgtttaatccaatctattattgatggacattcgtattgcatctaacattttgcttttatgaatatttctactaggaacctttcctacacaggtcttctggtaattacacaacaatttctctgagctatatacctaggagtagaattactcagtcacaagatatgctcatgttcagctttattgctttctaaagtggttgtatatatttatacccccatcagcagtagaggataattgccatcactccacatgatttccaacactagggtcttcacttatttttcacaacatgtggtaccacaaaaatatacattgcttaccgtgtaaatcccaattctacaaacagcaaatgagatctggatgcattcagacattctctataagattaaaataagaataagagaataagaaatgtttgtaccaaagaactgtcttcattccccttgctcttgtttccctctttaaagaaaatctgctgtattccaacatctgttttatgaggaagtggctgaatttcttccgtctgttttctaggctagctcaaagacagggataataaagtctggggcatgtggctttatcttgggactgtaaggcagatactttgtcctctaatacaagagcatcatttaaggagtgtaacttattgtaatggtttaattttacttctttcaaatcttgctctaatatcccattttaataataaatatttggctgctataagtagctttttaagcattctttttcagttcaattcttattagatcataaaagtctataatccttataatggatagaaaaaaatctctataaaagggaaatgctcatagttaaatgctgaaagttatgaatgggctaaattttgacagaagactgagatccttggtctcagaatatcaatggcagtactcaacttagaattcacaacttctaactcccaaatcaaattcagattcctaaaacacatgcccactcacaaaaccatgcataccaaacatgactactggtttcttttcctttctttagctggagaaatatttttagcacattaaattagcatgtagtcaaaataaccctaactttatacagtcgaacactgttattatggtttattgttgacaagttaaagcttctccctaaagtttataatgtcataaatctcagcaatcacggttttatccattgtggcaaggaggcaaagacataggatccctggctttctgtggtagccaaaaggcttccagagatgcagtccttgaggaagaccaagaagtcgcatcagacccattctgccaaaggctcttgcccctttagacaatatccacaagaaactgaattctgtatgattgaaggaatttggtaaataaaagattggaaagccaaaggctatatgcgtggacattaaaaataaaaattacagcaatggaaaatcaaactcttaggacactctgttgagtgaagtacttaaactcaatctaaactttcaaatatcaacggtgctattgttcaaaacaaatggctgataatttcatactggggatcatgatcacatctattattaagttattactatcatgactgtaacattattgggtttattttgaatgaaatacactactgaaaacaaaccaggggccatgccctggcatcctcagagcccaagactaagaacgctcattgccttgtccaagatcattcttcccatctacctttggaaattaccccaagttgtacctttgtaacataatagtgaatgactgaacaactctctgagtaagctggaaaagttatcttccccaactgaaagataactcttattttatgccacctggaataaaagatttaccagcctttcttggggttaagtgttgtcctgtgactaagttctccaaaatgagatgtaactgaaaggtgcttaaagggaactgactctgagaagagcccttttttgctcttctgcctttcctacttcttttccaggctgtaacggagacttaatgtagctccagtgacaatcttgggttgtgacggcacaatgagaacagtggacacatgaagtagaccatacagataagagaacccaaagatgcaaatgacagcagagttgccattccctcctcttccagactttgtacatgaaatagaaatcaacctgtaactttttgttttctgagacagggtctcacttggttgcccaggctggagtacagtggtgcaatctggaattactgtatcctcaatatcctgggctcaagtgatcctcccacctgagcctcccaagtagctgggattacaggagcatgccaccatgcccagcaaatattttaatttctttgtagagacagggttttgccatgtttcccaggctggtctcgaactcctgagctcaagtaatccacctccctcggcctcccaaaatgctgggattataggcatgagccatcacacccagccctctaacttgtttaaaaattgttgtgtgtctctcacagcctaacctaatcctaaccagtacagagcaacgtttgtttttaaaaagtaggtattcccagtgccatatgaaagggctctagcacctatcatgagagaattaactctttttatgagctttatcttttaaggagggagaaatatttactctttagttactaaaaacctactttccactccttttcatattctcaaaatgtacaagtattgttgttgggattgctaaaattattaccctgaaaaccctcaatttattttgtgtaactttttttctgactaaccatattacctcattctctctaatctctaatccttacaaatactgccttatccttgaacatccgacctcaggccaggtggcatgtctattgccccagcttgtaaattcattctaacaataatattctcaacaatggcctcttccctctaattactaggagtcggatacatatatttaaaaacataaccaaacttcctttgatcacagtatatgaactggtaataaattttaaataattatattatttccctatatagatgctatatttgcaagaaactattttaactgtaaacccatgagacataaggcataacttggaatgaaggataagtagttaactatttccaataaaagaatgagtttctatctcagataaactctgacccggtagcctctacagtaatattcataaatctacatctagacttccctgaggaagaactaaagaatattatttcaaagatgaatctcatcttctttgctgcctcatctaataaaacagcaaaaaagatgtcaaaaacaagacagattggttacaatctgtttaagagaggtctatagaaaaagaatgcctaagacagaaaaagaatactaaatttgaaattaatgtgattacttacagtttattgttgttttccctaagaaatttcaaaggtaagcatgaaaataaaggagaaaacaaaacttcaacaagatggcagaaaataaacgttatttactatacagtccaaaaaatggtatcaaggtataatttgagttccatcagagggctaataaacacaatattcttttagagagctattttttatacttaacataattgacagttctaattttgatgtcctgtgcaatccctcatcctgatacaaagcaagatgacagttatattatcttctcctctataattctgcttgatgaaaattaaaaagttaaaacagccaagccagttcttcagagtcctgcaagcagtatgttaaaactggtaaaacaagaaagggcatacgggagcagtaaaaccccttcgaatgaggccctagcttgggtcctctatttccaaataaggttaacaaagatccagcatttcctctcaatagcagacaaatgggctgaaggcaaagatgcaataaatggaggatacagagagtgacgacccgttccaaggtacatgggaacgctaaagtgccgcgtgggtcgaatcctttctgagtaaaggtcgcgtctgtcaattatgctttagtcactcctccagagtggaaataaacacttgggaatgccacctacttcagaactggcatctccttctgttagtattgtcactgaaaacattaacagtgcattatttcacaactcccttagtacacttgaaagtaattttccccaaatgggaaaaaagtaagttttttttttaactaattacaaaataaaattaggatttgtttacaaaatgtagagcattttgctcctcagcatatattttatagcttcttcaaattaggagaaaggatgatgataatctacccaaagagaaacatttgcaatctaaagcaaagctaataaaattggcctctcaacattttctaaaaatgttttcagtggtaacagtgccaacagcacgccaagagcatctatacttccaagcaatctaccaatgtccatggatggaatatgtaagagttcaatcagtattcaaaaaggaatcaaccctctccctattaaaaaataacaatcatcatgattagcacatgatctctgtgaaattcaatcacaaagatttgaaaagccatctagcagaaataacctgagatttgaaaagtcatctagcaaaaataaccaaatgaaagcataaatcatcatatcagaagttacagatttcatccagcaaaatgttagcccatcttctataaaacatcactaaaaatcacacgtaatatccaggcagattttggctgaaatggtgaaggtaagaatagttctcgttctgaaaattctgattaaaaagtatggagggagagaaatccccttctaacttagagtaaaataatgagtaccacttatcttggaggatttattccttcacttttgaccaggcactgggaattttaaaactcagttcaaagaaagaaaacgaaaaaaacatttgcagggctttttttttttttttttaatgagacagggtcttactgtgtcactcaggttggagtgcagtggcgcagtcttggctcactgctgcctggacctcctgtccaggattgcctcaagcaatcctcccacctcagcctcccaaatagctaggactacaggcgcacgccaccatacccagctaattttgtttatttttttgtagagatgagttctcactatgttggccaggttggtctcaaactcctgggctccagtgatcctcccacctcggcctgccaaagtgctgggattgcaggaatgagccactgtacctggcccagagcatccttaatgtggcaagcacttctaggtaagtgttaagtatagaaacataaagaagaccaaaccctagcatcagtgatcttccagttcaggagaaagcggtaattaaacatacctgtgccagacaagtgcaatgtaaatgtgttcagcacaatcaggggtatgcacaatgggctttagggaaacagagtagaggcatcaaagtcattcttataggcatgtcaggaaagacttggaagcatctcctgaattttgagtctcaaaagattgagaggtatccaagttcaaaggagcacagaagaaaacggcattccagataaaagtgaaagcaagaaacatcccataatgcgcaagcatctgagggctgctaatgcatgccctagacaccttcctagtctttgcaaataattgcttctcagtccgatatcaattattgataactattaactgacaatctacatactaattaaaatgcattcatatgaatatacaaaacatcctcattttaagacttatctctaactccctgccaaaggaatttccatttgtcagggacttagcatggtcacatcatagagtctgttttgcctccccacccttttagatgcaaaggcccacaagcaagatgccacagctgattgaactagcaggcagtttagccttagtagctgaccaacaaccatggtgtggcctagcaggaagggccaggctaacctaatcatattctttttctcccaaatttgagttgaaaaatactgaaaagatgaagcagttcatagtgcaaaataaaactgagggaatacaaaaagcaaagctattaaataacttcataaccatgaagaatcacagcaatctaaatttacaaagctactagtatgaataacaagaaactatacaaaaaagaaaagctacacaaagcagaggagaataacaaccctgctaataaccccaggagaagtagacccagagagaaatcagtatgtgaagaatggctgagtgcagttgcagacaagtctgtttcttagttaaaaaactatattcctcagtttcttgcagctaggaatggcagcatgatcaaattctagtaaatgagatataattagtaagtcttacaagtcttccaggagggaagcacactcttcttctgccctttcaccatccagctatctggaatgcagaagtgatggcaggagctctggcactaattttggaccataagcttaaagtctacatatagtgggcagaagcttcttggggccctaatgacttctggacttacttgcctgagcaaaaaatgaaactgtcaaagccactatattccaaccaattccagtcctaattgatacagtggttgagagaatgtgacagaaccacaatttgaactcaagtcttttggacgtgggggccaaactcaatcattatgagcaagtgcaaatgaagtcaaacaaactgagtaaagcaggtttacagtttacatgtattttataattcaacaaatcataaaagtctgactaccaaaggccaataaaaaagaaaaacacgcagatgcagtgtcactcacctactacaaataacactttggacaagcctctttgactctgtagcctacctggacatataaggtttttccctcaatacaagtacctacaataaggcatatgggcaataaaaactgaatataggcaccagcttctcatgcatggcagaaacctatcaaattcagatttgtaaggagtagatgagacttgcaagagcacacgggattctggaaagcctacagcatattttgcaaggaagtaagaggcctgtctcattaacttcaagcaaaagaattttccatacgtcattaacaactagaagaactcagcccaggcattgtaactccctaaaccactgatgccccagggtggcaagtgtagcatagatcggcaattcctttgaaaggctcaaggattttagatgcccaagctgaagcaccaatgaactttgtattaattctcttcattaattaaacaatttcatatttgcattgaccacacattttgtgcccagccatgtcccatgctggggacggaacagtgagagcaaagtccctgctcttatggagcctacactccagtggtagtggcacacaaaacaacaaataaaatcaacttagatggtgacaagtcctatgaagaaaaaaaaaaaaaagagagaatgtgcaggagagggtggatttccggtactgctatttttaagagcagacgtggtcattctaacaatattatagacaataaaagagatgccaaaaaagctttcaacagctttgcttcccaaaccccttgcataggcaaacacagtatttctaccgtaaaaagtcacagcattagacactcaattcaataatccacaaatatttattgagaagcagttctgggagacattaagagcaaatctaacagctttcagtgttaagactttctggaatcaaatcccagccatacaacttactatttgtaggagcttgggcaagttgcttaacctctgtgcatcttaatttgtcatttgtaaaatgaggatcatagtagtacctatttcattgggtactaagaggattcaatgagttataaaaggaaatacagtaagcttcagatttgtattttgttttatatattttgtaattgacatataatgtatattttaattgaatatctgctatgttccaggcacacaacttcctctaagcatttgcataatggggccccacacaccaggaagccccaggggctgcagtctgccatcagcttctacagatgccttgcattcaggccttgtctgtactcttggtgtctccgcctgctgtcacctgcattaccaggactaactcctgtgacttcttactgcaaatactgtaacccagaatggtaactctgagattccccaaaggagtaaacattccaaatccaagtttctctcttaccactctgtctcaacagagccagcaactgatgcaaaacaataaacaacatccattttttagccaggcctcacaatattgtccagattggcaatgcgacatgtttaaactgaagaagttttagtctacattatataagattatatcaactatcactcaacctttttttttttttttttgaggtagagtctcactctgtcatgaggctggagggcagtggcacgatctcggctcgctgcaacctctgcccacctcctgggttcaagcgattctcctgcctcagcctcctgagtagcttgggattacaggtgagtgccaccacgtccagctaattttcctatttttagtagagacggggtttcaccatgttggccaggatggtctcgatctcctgatctcatgatccgccctccttggcctctcaaagtgctgggattacaggcatgagccaccgtgtccagcatcactcaatattttaatattcaataatatttaatatttttaatgctattataatgataggcatctactttgccatgcattgtccattaggcacttggaagcaaaattaattagaatcataaggaaaattatatttattcaattatccagagtatgaattcatcttccattccctacgtcccattcgtttttaatataattaaatgaacacaacttttcagcactgtccttctactaaaaccttagaaatcattgtttaggggttctttccttgaatttatctttttaagccacttctttgggcatgatacctacactgtcaaatctatatttaaagtcctcaaaatattcaaatggccaaccccttttactgaatcagtacttctatattaacttacaaaaattattgtactgccaggaaaaggctgactacaggagaacgtggtctaacaaccacttaaaggttcaaaaaaatttctatttgcctattaattagacaatctcaacttttcttcttgtttttctaactgtggagggaaaagaaaggtaagctttgaggttagacaaacctgggtttgaaccattcaataagttactttagaaaactcatccaccctgaacttcaataagtggtcctcagatgagaaaagagaacagataatccttggtttccatgggggattggctccaggaccctctgcagatactaaaatctgtggatgctcaagttcctatatgaaatgctgtaatatttgcatgtaacctacacatatccacctgtatactttacatcatctctagattacttatacctaatacaatgacaatgttgtgtaattattagactgtattttttattttgtattattttttatattttttgttcaaatatttacaatttgcagttcattgaatctgcagatctagaacccgcagatacagaaggctaactataataatactaaagctactaactctactgaattaaataagcaagcatcaggtgcttagcaaagggaagatattttctcacacctagtgaatccaaagccaagccgcccacatctactactggaatgtggatgagtctcctgaacaggccccactagttcccatctgatccctgtataatccatcttccattcaacagccagagcaagttttcaacatgtaaatctggtgctatcacctcctgcttaaaactatttaatagtttaagagtaatcttaacagaaacccaactcccagccacaactgccagaccctacggaatcttaactgggctcccctggggcttgggttcacagccaatttctttgagccactcttcagcatctgataccccaacctctgagattcctatgagcagctataccactgtctcatacttgctgaagacaaatagccccaatctatatgctcagggaactacttggggttttctgtaagtcccagggatccctgtgcccaactcaggtggtagtatctacctacttttgtccccagggactcaccctatttcccttttctttttcaagggataccactttttcctaagtcttgtagattttctccttaccccatccctaaagcctggctgccaagtggcaggagccctcccctccctcccttgctgttgatgttcttgcttctccaaagatgtgcacactggcccttctttatgaatgggttttagtgctaaggactaaagggaacagatatgtggaggttgatataaaaatctaacaactaaaggcagtatagtcattgcctatgtttctgacatgtcgtgtggataagcaagccactgaaactcctgccctccacctgttatcagcaagcggatctctccaaagtcctcccttcactctcaaaccagaaggcagaatcacaacccatgaaccaggtgagctatagaccctcgtaagcccactcctttcagatgaacagtttgcatttctgagggcagagttcctattcaagcgtttcattaagatagtgaataatgtctagtaactatacctatagaaattgagtagaaccacgcacaattcaatttaaaaggatggccttatcttacaagtcacaagagaaggaaaaaaaggcatttactaaggttctactatgcgctaggtatttttatactgtcgtctcactcagcgctcacaattagagcaacgtgggtatttccaggcctgtttctcatattaaaaaaacaaaaggatactagcccgaggctagcaagtggcagaaggtagactactgcccaggtctaattctaagccagtccttttccaactctgcaacctcacacggtgttgcaaagagacagttggatattcaagaaatacttttaagtagaaattgaattttaattagagactgaaatgagaaacaacatgttcaaatgtactgtatataaaattttaacacacaccacccacacataactcatgctgccagagtaacttggggtggggggaaagatcaagtttcatgataaaacctatgttctgccttctcactgaagatcagctcaacattgcacagtgagctactttccaatctgtaacatttgcaactatgattctgttggaatcctgtttttcctcaatgctacaccaaaaagagaacaaaatgcagaaccaaataaactatttgataagccttcagttctcaaccatgtctaaaggcagtttttgtgttcatcagaacagcttcattgtcctcactgattaatatataataataataaacgtgtaagtaaatatcataaatataggcttgtaaaaagtcaaatatagtaaaatatcacttgtttaatagttctgcataaaattagttggaaaaaactccactgcctaaatgaaaagaaacatgttagttcctcccctataccacaatgttttcttaaataactcatagtaaagtgaagagagattggctgatacattaggatcaacctagaagcaaggaaaaagttgaaaggaactttgcatctattccaacctctcactcagtgcatgaacccctttctgtgatgtccctaacaggcagggacccagcttctgttctgtcatttcctactcaaggaagatgaacaaatcttaagagaattcttctttacctgaaccaatacctggccttcctatgatcatgacctgctcagattcatagaagactttatgcccttcaaacaactaaagccactcatcatatcatcctttttttttttattgttttgagacgaagtctcactctgtcgccaggctggaatgcagtggcacgatctcagctcactgcaacctccgcctcctgggttcaagcaattctgcctcagcctcccaagcagctgggactacaggcacgtgccacccacacccagctaatttttgtattttagtttcaccatgttggccaggctggtcttgaactcctgacctcatgtgatccgcctgcctcggcctcccaaactgtcttgctcttctttaaaggttctccccaagtccaaaagccaaaactccaatgccaacgaaaagtatcatgcaatactgcctctcttctttgaggaggtaggtaaatcctattctactaacccagcggctggcaaattccaatctgtgggaaaatccagtccactgcctggttttgccaataaagttctgttgaaacacaaccacagccatctgcctatctattatctacagctgctttcaaactactaaggtggagttcagtagttgaaagaaagacatatgtatattacgttcagtgttacaggctaccgtctcagtagttacaagggtcatccctgtattatttaggatgcccaaatgcctgccaaacattaagctcacaataagtatttgctgagtaaggaaggtcagaaaaggaaagagggagattagaaagaagggaaggtagggcttttcttctcccaaaactaacctgaaatccagccttatagaatactttaaaacctgacagatccttgtcttgctgcaagatcttttaacacagggctacacagcagaattaaaattgaggacctaaagcgactatgttttatttcaggcacataaacactgattaaaatatcatttaataaaacaaaagtccttgttaattttgaatgcacaggaaaatactactcatagtgttagaagcatatgtatttgttactgttgctactgcttattgtcttaatatcactcactgcagttatataaagcaattgggataaataatctttccctcagatgaactcttaagcactctggatttggggaaatagaaaagaactgctttaagacagatgaggaaaagactgaatcatcaatgagcttactataactcttgattcttcatctccttcatggtttaataatcactcacttttacgatggtttattcaagacaacctttgtagaaagtattaaaatatgcatcacatcttgcacagcttttcaactttttaagcaacttgtttcattatacttgtgttctcttacaaagaatctgatgtgaagaattttagaattagcaatgcaagatctttctcaacatggaatcgaaatttttactgagtccattttatgaaactatttcacgtgaatattaagtacacataattatttatgataaaacaggaagaactcagaagacatgaaatggaaaatagtcacctatgggtattaacaaagatccccagtatagttaggtattctccccaaataatgacataatgaaactaaaacatcactagcacaggaatctcaggatgcacaaaaattgcagcctacatccacagaaataataaataggggctgcactccaggctcaaaaagtgatgctacccacagcccaaggccaggtcagtagggaccctgaaagagtcaggaaatgcaaaggaaacctaggagcaatcgcgtgatcacatctaaatgacccaacctttaaaacacacatagaaatcccaaaaaattataggaaaaagtatgttacactgaaaaaaacattactggtgaacaatataaaatatacatttctatacaaaatgaaacaaagagagaaatccaataatccaaagaggttttctactttagcccagtgacttgaaaagagaaccagcctcattcaggaaacattcgaaatgaccaagaacggcaacattacccaataaatcgtcccaatgctccttcctctaccataccctgcctctcaggaaacattcatacaggaagaagggataaaagagctggccaataaatcacatgctctgcttctcaaaagcagaaacttgactttcaaattgtttgactccaatgaaataggaactgaaggctccaaacaatcacagaattccagagtagcacctcagaaaactcatctactgagtcggctcgtgtggccgaacttaggtaacagctgtaagcataactggcctgaggagagatgtgggccaccctcttccctgccaggacctttcaccctgtgaatcagaaatagctgccacttaaaacaccagcaagcagttgaagtgtctttaacccagttaccctacactatgcgtattaggcagaggcagggagatttttggaaggctggtagggggaaaatgaatcgaaatggagcaaaatctttttggtgacaacagtaccataagtccttgttttatatacacttttgtagtacttacagaattaggctctcttttaaatgctttatacacacattaactcaattctgcgaggtaggtatttaatactatcattacacccactttgcatacaaggaaacaggcacggaggctgcagagcaggtaagtcacagagctagaatgcaaatgcaggcagtctggctctgcccctgaccattattatgtgcagcatctcagtccaatcaaatatttactcagcacctgtcaggtgtacttgtgccaggttctgggcatattaagaggcctgcaacccagccctgcactgtgccacaatgtgctctgtcctataacacagacaggaacaaaggcccgaggctgggttatggctagcacattaggcacctctgtgccagttcacaatggggatctgggcaagccaagcaggggctggatttcagccccacttgcccccttggccaggcacttctgtgcagtgtctaacaggcctcactgtctgaggcagccctgcagtggccctggaaggaccctcaattctgttttggtagtgaaaggttgggagaagagaagccctctttcctaacgagttctgcagagttaatgcaccaccaccactgtggcagagggttgtatggaaaggctggagagggcaggtactagtgtgagatgggcttattggaaaggaggcacagagcagtgtacagtaaggatgaccttaatatgaaagatgctatttcatctagcatttccctggtttaggtagttgggagaagattaggcccaggtttattgtgctacagagggtcctcattcagattactaaactcacagctcaattactggattcgtaagactctcggcctatttttttctactaagaggggttgcactaccaggggagttctagttcctgatgaatgggcagactggacccccctcaagggactcagttgctgtctggatctatcactaggctggatttctttggaggggtccctgggattgagtcctgccagcttcaggttcctggggcagagaattggtagtttgaagtgctgagtccagaagctaatgaagatggcccaggccaaggcctttccaacaggactgaaatctggttgcaggcagttgttggagcctggagtttgttttgttgtgggcagcctgcttagggctgttttgttagggcagtttgtgaggttagccctcttatgttatgtctggaacaattgtatagtaatctggatgcattgtcagtaaagctaaaatgggctctgtgatcatgacttctatctaattaaaattataaggagcatagtattgtggaaataatttttagttttccctccccttggagagtctacctctgacctctgcagtcttcaattcacacccctattgtctgaccacattgaactttctttccctccagttttctgacttgttactccatacaacatttatggttcagcctcatcaagaccaccaggcccttccatcttctactttctttttttttgagacggagtctcgctctgtcgcccaggctggagtgcagtggcacaatctcagctcactgcaagctccacctcccaggttcacgccatcctcctgcctcagcctccccagcagctgggactacaggtgcacgctgccacgcccggctaatttttgtatttttagtagagacggggtttcaccgtgttagccaggatggtctcgatctcctgacctcgtgatccgcccgcctcggcctcccaaagtgctgggattacaggcgtgagaaagtagaagaaagtagaaatcttctactttctatgtgcccttccttcctttcctataactcagatctcagtctataatttcaaatattttcttaccagtgtactaagttcccgcaccccattgtctacctatggattcaccttagattaggaaaaaccctaacccttaccaatctaacggcccaccttcttaaaactacatctagatggctacaaaggctacacaaggaaagaaaaaagaaatcacacaaccatctaaatgtgtgccaagacggtctgcaacttcagcacgacacaactaccaaccctctgtgtctctggtcatcctcggccctccgtcctcactgcagcttcttctatcctcctcagttaaaaccgctacctgaccacatttcagtcacacttggcaaaatgacctcacgttctactgcaccagcactgcgccatctctagtcccatttaaggaaagccaccccccaaccttcctgcccctccagttccagccctttctcttctctttcctggtgaatgtctcataaaacattcattggagcagcatcatttcctcattccccactcctccactaatcggcaccgcaacaaggcccatgacagccctctggccaaggtcaccactgacacgaattcagtggtcattttccagtcattatcttccatgatctctggtcaacatttaacaaaattggccactttttcctggaaagtctctatcctcacctgcttgacatcacactctccaggtttccttccaacctctcagttctctttctcccagactcctctttctggttgctgttggttttttggtttttttttcctttgcattttttgttttgagatgaggtcttgttctgtcacccaggctggagtgcagtggcacaatcacggctcattgcagactcaacatcccaggctcaggtgatcctcctgcctcagcctcccaggtaattggggccaccggtgcatgccaccatgcttggctatcttatttttttgtagagacaggggtctcactatgttgcccagtctagtctcaaacacctggccccaagtgatcctcccgccttggcctccaaaagtgctgagattacaggcacaagccaccatgactggctgccaagttcctctttggttcctttacttttggtgatcccataaaagctgcatgtatactacacgccagcagtggctgaggccgtaggcatcctcaagtattttcctttcccacacaactgaaccctcatgcatggctatggcttcagctaccatctaagtggttgcaaatgtgagctcaaacattagccagacctaggttcaaattctggctccaccatgtcttaggcacaacatttaatttctctaagcttcagttttctaatctctaaaacgataatagtaaatgtatagcatataaaaaatactgagcactgtgcctcctgcaaaatattaataatatagtatagtatacagtatgtaacaataaatgttagctattagcttttttttttttttttttttttttgagatggagtctcgctctgtcgccaggctggaatgcagtggcgcaatctcggctcactgcaatctccacctcctgggttcaagtgattctcctgcctcagcttcccaagtagctgggactataggtgtgcaccactacgcctggctaattttttgtattttagtagagatggggtttcatcatgttggccagatggtctggatctcctgatctcgggatacatacacctcggcctctcaaagtgctgggattataggcgtgagccaccgcacctggccctaggtattagttttaactacatctccaaacctcacctctgagtttccatttacctatgtgaaatctcaagttgaattactgcacaagcagttcaaactcagtcactctaaagtcaaacttctccctttcccaccaaacctgctatttcttcagggttacagatcatagtgcatgaccccattacccacctcaatacctacagtggttttaaaacatgcccaaaaattcttcaaccttcctcccaccaagagatatctcccttctgcccttgaacctagcaatgccttttttactgccttgatgaaaagaacacagtaaaagtgacactgaatcactgttgaggattgggtagaaaagaccaggcagtttctgccagtttctcttggtacgtttgctctgtaagccttcggcctcaatatgagaagtccagctatcttgaggccatcacatagaaagaccacatgaagagagatgccccagggggccacccttgtccagcacccagctgttgcaatgtacccagctcagatgccaggcatgtgtatgaagccttgaggtgaccccaccctccatctgattacaacttcatgagggatcctgaacaataactgcctagttgaacccagtcaaaccccgattcacgagtaaaatacattgttattgtgttaaactattgttttaaggtggttcattactcagataaccaaaacaatgctcaaaccaaaaacctaagaattatccctgagatctattctgttgtcatcttccacatccaattacaaaattctggcaattcttaaatgttgttaaatccatctacatttatgcatccctcctgccccttcctggttgtgaacaccatcatctcatttctggatcaggacatcttcctaactagtcttgctccagtcttccctccctttccaatccttctctgcactgcagacagatctgaccatgtcattgcaggcaaactttcagagtttccatgaccctagctgggctctgcagcttcatttctagcactgctccaaaccctgctccaaaaacacagaacccctgaagtcccttgaagtcatggggttactcacccccaaatttccgcacagctattccttttgcctggccctggccctgcctgtcactgggccaactttactcagctttaatgttgcagatgttaaaagactcctctgggaagttctctttggccctgaaatctaggttaggttgcctttcatgtgctactctagccgtctttatttccctccagatagactatgctactccaaaatgtaattgtttatttttcatcgtacaggagcataagtaccttgagggcagactaatgtcttattcactcaacatttttttttagggaaaaaagcaaatttagaaagatagagcattatgttacaattttggtaaaattcttaaagcacacacaatgatactatatatggtttacacccacatgcatatatgataaaaagccaaaaacatgcatgagactgttactcactaacctcgggatagtggtcaccactgagaagggtggaggaggaagcgtgcagggaacaggagtctttagtttcatttaaagatcaccagaattttgaagtcaaaatggcaaaatgttcaatcaggaaggcaggtacacagaagtctgttatattattttctgtacttttctgaatgcttaaaataattcataattagaaataaaactctgaaagaattatatttctgtttagctcctgactccatgtctatactgattaggaacgggtatagacctccaatgcctcaatcagtggtcctggagtgcctccagattgtcattcccttccccaagagaaagagagagagaggccagagcagcagctctcctgttgaaaaaagaacccaagggaatccctcttggagagacatggacataattagtgggataagtcctcaactctgaaagcagcagtccagaggttaaaacagttcccagcaaatctaggtacagaggaacttgataaatgagattggcttgcaaatgcaacttttcagatggtgagctactatcaaaatcatgtaggagtgcttggctctatgagccaaagggcagaacacctacctttatgcacactgaaggagagagtgggtaatcaatgaaagcaaaatcagtgagcagactcccgcctcaaacacaaacccacacaactttcccagtgggagctgcactgtcactgagttcccagagggcctctcacaggcaaccaggtgacagaaacaatcaagtgacccctcaatttccagaattgttatctatggttcacacagtctctctcactcatcctctcaacaattattaattataatagttaagcagcaccgaagaatgctcatggccatgggcttagaatcagacaagctcatacactgatcctgaccctgaccctccactggttatgcaattctgggcaacactcaacctttcagagtctcaagtttcctcttttctaagttgctatgtctttgtggttaacagcactgttgggaggattaaattaggtgatccaaggaaaacactcagcactgtaaatggtacacagtcctgtatttaccagacactagactagattccagtgataaaatggtgattaagacggtcagggaaccagcaatgatgcaggttacagactcagatgccagccatgtatttagcgctagaaatctgaactggccttataaattgtgcggcccagtgcaaaatgaaaacgcaaagcacctgttctaaaattaagatttttttttttttttttttttttttttttccaggatggggaccaaagagcagtaaaccaggcatggggctcttctgaacccagcggttgcatggctgggaagccagccctgctaaaagtagatgtgacttggtactttacagacactcggaaaatgagggtcaaccagaactgggcttcttagactcatccaaacacctgggacattgggacatttggggagatgacaggggagagccacaacataacacagggggctgcaggatccaaaacaaaagcccctcaataatttaatttgtgggaagtatcagaggaaattcccacttcttgtcacctacaatagttatgagaccttccctaacaagctttccttctctttagtctaccttagaaataaatccttttataaagttaataccatcaggagattttgcccagctgaagtccataagcaacaggctgcttatggcctagtatctattgggaacagctgacttcccaggcagtgcgtggcaaaagaacatagcacagtctcagtacctcttcaaaagaaatggggctgggcacagtggctcacgcctgtgatcctagcactttgggaagctgaggtaggtggatcatttgaggtcaggagattgagaccagcctgggcaacatggtgaaaccccgtctctaccaaaaaatacaaaaactaaccatacgcctgtagtcccagctactcaggaggcttaggtgggataattgcttgaacccgggaggcagaggttgcagtgagctgagatcaagccactgcactccagcttggatgacagagtgagaccctgtcaagcaagcaaccaagaaaagcaagaaacaaacaaacaaactgggacttggggcaggtaggaatgtgcccctgaaagtgacactaggggactgagtaaggagatcgcaccactgcactccagcctggatgacagagtgagaccctgtcaaaaaaaaaaaaaaaagaagaagaagaggagaggaaaaaaagaagaaagaggaggagaggaaaaaaagaagaaaaaggagaggggaggggaggggaaaggaggggaagggagggaagaaaaacgaaacaaaacaaaactggggcttggggcaggtaggaatgtgcccccaaaagtgacactagggggctgagtaaggaggttgcctgaaaatctatatgtggtcacctggtggaacactagatgctgaagatcacctcagtggctatgaccagggtatggagactgtaaggcaggagttcccagcacacaacatagttctcttcctagccagccttctctgtaacaatcacctgccagagtccttggggacaagggcgcatcagcctgcctgctcatggccactgctttctttaacatagtagtggtcaaggaccacttttctgtacctgtttacttaagaagcaatatactaaaaattttgagtgcatcccaactgccttaacaccaagctgcctgagcctctgcctagcacaagggaactacttgtaggtggaaggcaatgaagagggagggccctggggccacaagcgcagttcaactacttgctagctgtgtgaacttgaggaaattacacaacctccctgagcctcagtttaatgctattacacatgcaaagcacttagaacactggcacagagtaagtgttcaataaatgttaactgattttgccctcctgattataactcatatacttatctcctctcacccccgacctgagcactgcccacatgccaacaagcatgtggctttggcatctttcagaatgcaagcccctggagggcatgaatcaaggtccctatgtgtcctctcctagggctcatactgttagactggagccacagaagtttgggaaccagacttaacacctttgtagaaaagttcctacctaatggtacggatttgctcaaaacatttttgctatatgaactccatatatggtagatctgtttattgtgctcagataatttttatcttataaattattaagaaaggaatatttaatatgactgcctaatccactcgacatttagactaaaaagtgacctacattatcactttaaagttagtcacaataaatacaacttacaatgttcatagatattcagggttaaaaacaacgaaacaatgtacttttttttttatcaataaagaagttcagttcacagataactgaacataatatgaaatcacaaatgtaccttcactcctcttttcaagtaggatcctttacaatttcatagtgcctgtgggctctaccctttgtagcacatcatgggtttctattgttggttagttagctggtttttatcctgcaaatggtgacagatttgtgatgatcaacccaattctctcaccacatcttccccactgagacatacatttttatgatggcagatacagcctataaccaagaaactaaataggtcaagtccaccagtctatacaaagaaatcttattaaactaacctatcaaatctaatcttattaaatcccaaacactggcagggcacggtggctcactcctgtaatcccagcactttgggaggtcgaggcaggtggatcacctgaggtcaggagtttgagaccagcctggccaacatggtgaaaccccgtctctactaaacatacaaaaattagctgggcatggtggtgggcacctgtaatcccagctacttaggaggctgagacaggagaatcaccccattgcactccagcctgcatgacaagagcaaaactctgtcacaaaaaaaaaataaataaataaaaaatccccaacacggtacagtagtttcccctcatccatgggggatatattccaagtcccagtggatacctaaaaccacagatagtactgagctatcatagaactaactaacatagcacagagcacactatattttttcctatacacacacacctatgataaagtttaatgtgtaaattaggcatagtaagtgattaataataactaataataaaagtgaacaatgataacaatatacagtaataaaagttatatgaatgtggtctctctctctcttaaaatatcttattgtactttactcacttattttgagacctcggtggaccatggttaactgaaaccttgaaaagtaaaaccgtggatgggagggtggaggctactataaacaaatgcaatgaatattaattgacaattagcatccaagactaatcaaccatttttacttgtcacattttcaagtctaagtttatattttagttcacaataaaacacacaaaatgagagaaatgtactagaaagcaaagaagcacatcagaagctaccccctcccctatgtgccttacttaacctgtcctgccacaggttcctctagagccacacgactgccagtcctgcagtcaaggaggatattacagctgagggttcatcccgcatgactttcagggccatgcagaaagtaagggctccataaatatttgttgaatagataaattattcaaatgggttttattttcgtagcttttaaaagattcttaaaagagtcttgtgacttcctgcttgttgattacaactcccagtatttccataaattgagactagtttaaaaggtatttcaataccactaagcagtaacagtcattctacaggaggtataaaagtaacatcagcaacataatcacaatacgttaactttttttttttttttttgtcttgagacggagtctcactctgtcgcccaggctggagtgcagttgtgcgatctcactgcaacctctgcctcctgggttcaagcgattctcctgcctcagcctcccaagtagctgagattacaggcatgcgccacgacacccagctaatttttctattttaagtggagatggggtttctccatgtcagccaggctggtctcaaactcctgacctcaagtgatccgcctgtcttgccctcccaaagtcctgggattacgggcgtgagccacctcgcccagccacacaatacgttaacattttatatttgaaaagcaacgtactgtttacaaatggctttccctccactatctcatttaatcatcataggtattacacagagtacaaccaattctaccactgttgttttgatggcgcagagggaaaaaaggttaattccagatcaatcatcacatgagtcaagacagaaaattttgaactgaaaggaatctagaagttgatcttgtccaacctcccaggaaaactcgagaaatgtgtttttctctttcattttaacctgactattttctcctaccttatccaaaaagctctgcacattgtgttactagttctacctatgagaagaaagagtaagatgctggtactgcctgttgggacagcagctaaatgtttacccagagacttggcagatgtaaacatggcctttaaaccccatcatggaaaggggaaaagttgtgtgcccttctaggaagattcactcatcaactggaaaacagagatttttatgtttaaattgccaccctggctaaaaggattatatcttgatcatcttcaagttaagagtaaaggatacattctgcattcccctgaacaaaacacctaatccaaacagattttatcttgtctcagtttaaaaactggtgaaaaaaagcagaattttcctttccatttcatattcatctgattcaacaaataaaatatcgggccctaactattaatacatgccagaaaccaagtcaggcaccgcaccaggtgatacatctaattgattaggattagcaaatttctattctttctctcgactgaaatcaataaaaccctgtcttaaatattaaagtactatccctgtccctcaccttgactgtcacttctgagaacatttgttttaagaaatcaacagcgacccgaagatcagtagagcttcttcatctgttttaatatctcaatcttattaaaaggattaatcctgttaagacaaaatagcacctccacctttctctcccttcttcctttccactctcctccaaataaaaaggttaagtgacgacatccagcccaaagaacaatgaacaatagatacatacacacacacagctctctcttccagtttccaacaggaacaacacaagaaagtcaaatactgattaaaaagaaatgacacacaccatcattcttgtcagtgcatggaaagggaacttactctaatccattcagcaaaatctggagtcaaacttggaatgaaaggagcattttttttccctgcaaggtaagtaaaagaactcaggaattttttaaaaataaaataagataccagatgcaaataaattgatttctattcctcagaaatagggcttttaataaacgccacacagagtatgcataagcaagcaagtcaatccgaaagacaggaagagaaaaataatgtgtggcacatcattttctctgaaagtcgacaagcaaaaggtgaacacaaaaaggctacctcgggagggctagttttttgttttgagatggtttttctgtttgtttccatccagtttaatgctaaagaattttctgaaatcttttcacaggggacacttggcacactcacaaaaactaaactgtttcctttaagatttcttttctcacctccaaagagtagccactggcttttatggggttggtcactgcacttgtgaattttagatggataaagtggcaaaataatgattttttttaaatataaaagtaaaactaagatgtatggcaagtaaagctttttaaaaagccaagtcaaatttgaggcctgctgattttgacacaaagctgttagtaaattggcaaagaaattaatctgcttttagggtaaacttgagcccaggtaaaacaaaaaggccaagtcaaatttgtgacctgttgattttgacacaaagctgttagtaaattggcaaataaattaatctgcttttaaggtaaccttgggcccacaaacattcatccactcacctttagactatgcctatctagaggttagcctgagtaattaaccagagttatcaattttgttttcactaagcattttgataggtttggcacctcaaagacagctttgtgatgcaatttataaatttaaaacacatccggtaaataaagaaaataataaaatgtcagaaccacctgattttcttttttaagaactatttaagtattcaaaattagcttttagtagtacaggcaatgtcaccctttcctacttggtaattatcccaacaaactttcgctttaatttaggcagactgcaagacaaaaaccatgtattgtattttataagataaattacaaattaaatcagttatttaacttagaaaataatcttctggcagctctcttaacttacagggcaccttgtattgtgaagaatgttcataatcagataatccccgtaaccagctacagtactgggtgaataatatccctttatcacaaagataaaggaagttactgccatcaacaaatgaacaacaaaacagaacttgaattcagaattttagatccagctccattcacaaggctatgcattaactgcagtcaccatcctttcccacaagaccatcaagctctgaagcattaggagaaacattttctttatgtacactaaaataagcccaaatacacagataacagcacaaagccggtccggcgtttcttggccatcaaagcatgcacagactttctcagtacagccttaagtgtaattcctagaaggcactggcaaatctctgccaggccaatctgcagtcgaaaaccgagtgcatgtgtccaacaagatgacaggagggtcaatgtttctaaccgtctacttcaactctgcatggcaatagcggttctgcccaacatggtaaacacaataatcgtataggatcgaacacaagtctctgtaaatgaggatccccttaaacgcaaacaagcaactctggggaaatataatttctggaacaaaacatggtgctcgcataattccacaaagacacatagaagtccatttttaaaatgatgttcggtcccagcactgtgctgacacttttcccacctaaacttctcagcacaagcctggcctaaacagccgggttccaatccgtgcacagtggaaccgcggcacgcacccaagaccggaatggtggggctatacctgtccctactcagtcctgttcgtgccagcctgcgaggtagtttagacccgtctgctttatggtaatgtgcttttaaaaccccgccacgaccgaggtcatagctttagagatttaataacaatcaaatgaccagggctgctgggcacttagtgagccattctggttatggctctttaatagcacctggagttctgctccagggagagaggaaaactcctgctcccccggaaagaaagtcctctgcggagagcgcagagggaagccaggaagccgatcgcgggcaggggacgcgccgccgcggccgccccatctctcaagcagccccagcgcgaccctcgccctgcagccgtgctggcccaggccgcacctttacctgtcagctccaccacccacccgccctggaggctgcccctccgagtccagggaaaggcttaccagccggctgcgggagaaagaaccccagaggcatcctatcccaaagaaagaaagcaaaaaggctgctcctcaaggcagggggccatcgggcacgccgagatccgagaggcgacatgccacccctgccctgcacctaccagataatccatgtacagaaacgcctcagttattcggagatcagacatccggcagcctaaagcatccggaacggctccgaacccggaaaaaaaaagcagcgtctctggctgcgagcgagcagctcctgaaaaagccagcaac

SEQ ID NO: 555 - DNA, 208252 bp, Homo sapiens
gcggcagtgcgagaaagccgaagatggcggtccccgcggcgctgatcctacgggagagccccaggtagctgatccgttaagctcttgcggtagccgcgcccaggaaggcccagatcgggctcgcacaaggctgtccttgctgcctgccgcctgggcgccgcggcgggcccggttgagtggggtggggtggggtgggctgccgaggttgcgacgctgcgtctgcggagtgcgtggggccgtgtagcgcctctacagtcacggtggtccacctgtggggctcacagtgcgcctggcagctgaggtctgtacggaagcgtgtggtctgcaagcgtggggtctgcgtcactgttcgcggagtttggtatcagaagttcccgggtgctgccttcagtgctgccgaatcacgtggaacggtattccgtttccgatttcagttccggttcagacactctggtgggaaaggctcacgctgctgctggagggtctttaatagccaacatgtgttaataccccttttaaatcagtatcgaataggggaccgaatttttggttggtagaagaatctagcctggctttggtagcatttgcttttatttgcattttaaacagatttttagttaatttctacttatggtagataaagttggttgtccatggtagtgatataaagctcccctttaacattatttaagtaaaaaaagactcaatttgtgaaaaaataagcaatagtgcaggtagcgtgtggatacagaaaaagtactgaagtatataggcaaaatagtgttcggaagtaatttctttgtgcttggattgggtagaaatctttcagaagaaaagagttattttaaagtttttccttctttctggattccttttgttaccagtggagggtgtccaggttcttggcgtcttgaacaaagaactggagaagacgcacaaagaaagcgaggaaagaatgaagaagacatttattgaaaatgaaactaccctccacagtgtgggagctgcttgagcataggggctgaagggcccctacagaatttttgggaatttaaataccctctagaggattccattggttacttggtgtactccctatgtaaatgaagaggatgaagtaaagttacaaagtcattttctccgcctatgccatatggagaggacatttcttgtcatagctgaagtgggaatcagctttatgttcccagcctcctgaccctattttcctgcctcactttggttctgatcgccagtttctttcctcataccagtgtcttggggaacaccgctacatcagtaaactgtatccaatatggtgcagtatagaattgttctcatcacatcatttaaagttgattattacaggaaaggtgctgtggctcatgcctgtaattccagcactttgggaggctgaggcgggctaatctctctctcttttttttccctgagagggcgtttccctcttgttgcgcaggctggagtgcaatggcgccatctcggctcactgcagcctccgcctcctgtgttcaagcgattctcctccctgagcctcctgagtagctgggattacaggcacccgccaccacgcccagctaattttttgtatttttagtaaagatggggtttcaccatgttggctaggctggtctggaactcctggcttcgggtgatctgtcctccctggccttgcaaagtgctgggattataggggtgagccactgcaggactgattgagctcaggagttcaagaccagcctgggcaacagggcaaaactctgtctctacaaaaaatacaaaaattagccagcgctgtggcccgcgcatgtagttctagctacttgggaggctgaggcacaaggattcttagaacccaggaggcagaggctgtagtgagctgagatcgtgccactgcactccagcctgggtgacagagtaagaccctatctcaaaattgattactgttgtaataataaatttgattttacagttgaaacagggttttaaaataactgtgtgcttagtgaccccagatgattttgtacatagtatttgaaaagttatttgccttgcagtattcttttatgtttttggtgtaattgccataattgctattcctctcctcccacccctttcagagttccatttttgggttaagtgtttatataaacgctctactaaattaaggctcttccctgcgcagtacaaggtttccctagtagtttggtttgcccaaaagaaagagaaaatttgccaaatggaccttttcagcagaagtaattttgggggcatctttttggaaatgtacccgttgccctgccttttttgctggctgtcatctgtttttatttcactcagatttaccatatagcattcagagttgttggaatgaaaacttatagacaactatagaaagtgcagttcaacttggaaaactcatttcaaaactctgttttataattttgtttagcatgaagaaagcagtgtcactgataaatgcaatagatacaggaagatttccacggttgctcactcggattcttcaaaaacttcacctgaaggtttgtatttgtgtgtttccatgccttgtaatcttccttctgatttaattgaaagtctgattatttggagaactttttgcaaagcatagtgttctccaatatgttcttagagacactggttctgtggaagatttggtaatgtttcatggtcagaagtttgagaaactctgtcttcaataaagttaaatgttttaaattatggaacttttcagagtattttatatgctagtgtttgtggtatgtattcgagggtgattatggcaggtaacattttccaaatgtgtttgaccttggatctgttttattatggtatatattttgggactaaagttctaaaaatatactttagggaaaaattctgatgtcttggttttatttttccgcttaaaaataattctgtggtattttctatcaactggtatttaatctttcacttaattttgtttctctttcacttttattttaaggatatggttgttttggacatgtggatgctttgtaattctctacctggcccaatccaagttaatttagttaatttctttatcaggttataaaaatttgattccatctcatatttatggagcacccactaactgctctgtgcagtgccatgtatcaccatccattgagaaccaagactcttactctgtcatcttgtttttcttggccaagagccagcctcaaaactgtgcctttcccctttgaagtgtctttcaaatccaagttctcacaattctaggtcaaatctttagtacctcttttttagatgacaatagttaccttcaagctggtttccctgcctatagtcttcttgctttctactgcttcataatactatgtaaattactttctaaattttttttcctgaaacaaagatgtattatattttttacagtgttcaaagccatcagtgactgtccattgccctatggagaaaagttagaaatccttaacattgcgtacaagtcccattgtagtatggctgcagtctacattctcctcattttgtaagtgctgcagttacactggatggtacccatttactacaacttgccatgaactttttcagcaatgtgtctatgcatatactctttcccttgcctataaatgtccttcttcccctttactgagtaacttgttcatccttcaaggatttcacaatctcagtctcagcagtttgttctttcttctgtgctcctagttcattctcacctgattttagtactgcatcataagtatttgtttcatgattagcaggcaaccaaatccccaaacctattaatgtgtcttcctctggttttaaatatcttgaggattatgtcttactcatctttatgtttcccattcctaatacattgctactagtatagttggcactcagtaaatgttcttgaagttaattattttccttgctgtggaaaacacaaaacaaacctaagtcttctataatatattcctttttctaaggaatttgtgaggtggatggagagaaaggagaaactgcaatgatagcggcaacattctgtggtatttgctgttcataaagttacattggcttgtttttgactgttgtggtgctaatggctttgtgttactaactcatctaatccgtatggcaacttgaaaacataggtactgtggtcatctctggtcatcttcattttatctatgaggtaaccaagatagagatagagatcagttaagtaactttcccaaggtaacacagctagctagttgggcaacttggctccgtaactctctcccttattacacgaaacctcaggaaagagtatggaacatttcataaattggcccaaaagtgaatgatgtgggtaatacagatattctgctttatttcttcagctggtgggtgcttgcttatgtataaaaatatgggacaagaaactcttatacatgtcttttgttcttcacactgagggagtggagaacttgcacagaaaattgtgatgtttagtttgtctttgacactctcagtcatgtatggagttgagaatagttagtatctatcttagagttaactgagtggctaaagcattccatggaggagcttgaatgctttgccatcagaggtaggggagtggagaggagaagaggtgcttgttgaaaagtgaagttacccgtcctgctggcatttaatgtccagggacttttaaataaagaaacatatgtatgtgaatacttgcctgctaagaagacgtcaggaaaggtctaattgtttttttcctgtacagtttcaggggatcttcttttagaggggctcctattttgataagggcttttcagtcaagtttgcagtgcatttcaggatctgcctactttcatttatgtatcccgactccatcgagttggcctttaccttgagacagaattcttagaatagtgaaactgaggcaggcagattggtgaagaggtttagggattttgttgcccctctactggtacttttattttattaagtttgacctgtttatgggcagaagagatgtatttgtccagactggttccttggaatcccaagggggaatcaatatgagggactaagacaacttaggtatagaatgtgggcatgccagattatggatctgggagtcctctttggccatcttcttggctcatcctggcatatacaaatacatggagattttgtttctttgtttgttacaatgtgtggagggtgcttctggtatttaacgtccagggactttaaaaatattttacagtgtttagggcagtcctgcacaaagacttgtctcatccagcgtgccagcggtttgcattgggaaatgctgatggaagtcaggtgaacttgcatagctgggaacttagaaataaacatttgtggcctttgcacttcaaaaataactgtcacaactcatgcaataaaaaaactcatgtacttggctccataggagagattttgaggccctcacacaaagcctgttgagataacagtgctgtatatctagttttgagaggtcagctctctgggttcctgaccatggcagactaaaaatagcaaactgggggttgaaggtactgtcatggggcatgtaggcagcttcaagaaatgactgctgatcatgaaatgaaatgggagaattatgaaaatcacacccaagaaacataaaaggacagaagtctgagatttctgtttgctctggttaaaaattatccatgtatctcagcagttctttaggatagatgagccccttagcacagggctctgatgcttgtaattatgacctgcgtcaccacaagatatttgtttaatctaatttattttgtttacaaaggtctagaaatgagcatcatatgttttataaatttacatgcacatcagtttcttttcaccatgtatttttctttaaagttctcatctcatatacgaataaatgaatcttctgtcaagtatgaattttgaatgcctgaatatgtgctaatataatagattgctatttgtattataggctgagagcagtttcagtgaagaagaggaagaaaaacttcaagcggcattttctctagagaaacaagatcttcacctagttcttgaaacaatatcatttattttagaacaggtatttttattgcatcaaattttctagccatgatttgtttactacatatttgtattgttatgatatctatgacattctgttttttttaattaaaaagtatgcaagatggaagctgtgaatgtattttagttaagaatttcagtgtaaaaatatttgaatattgtaaagtatttaaatatgaattgagacttcattgatttgagacagttatacaagattttaattcattggtacttggtataatggaaaaatggacatattttacttaagatattaaatgatttgggggatatattgactaggatggtaagtaagacatttagaaaagaagtattgtcatattatgtgccactaagctgccttctgcatccctttttctcatctaaattcacttcctgatttaagctcctattcaaggctcatctcctttacttgagctgtgaccccttatacttcctttatttggatttttaaaaatccttggctcatcacagtagagcacattgttagtctttcagcagttcatatgcgttagttatacctccttcaccagattctaatttgtggggagcaggatcatattttttgtgtatcttatataagcctaccacattggtgtgcttaaaatagatcctcataaattcctgttgattaaaaataatacttgtgaaataaaagtttaaatagttttgtaacttcatgagcattttaatgaacatattaggaggacaagctaccagttatctactacagccttacatacattatagatcacaaagataaatgtggttctaatttttggtgggtgttcagtagaagaaaaggatcattgagtaggacagcatagcatggtgttccagaataatgtaagaaacagaacaggtatcagtgttaaaattttttacaacttttaatcatatattatgtaggaaattggtagataaggtaattttgagaaagtgcttctgggaaaaaatttgttagttgggaaacaaaactattgtatacttatttgaaattattaagtgaaataaatgaaattttaattagggtaccatttacatagccaaagcaaagaagaagttttttggtttttaagtggatttaggattacttaaagcataggtaagagtgagaaaaaaattcatcttgaataatttaggccatttaatcctgaatcttccagcccttggtcgtgtattttattatgtgtaaaataaccaaaaatgttggtaataggactatgaagttttcttttgacttaagtcatttaaaaatagttttgtatttagtatagtttaaagtttcagtatgaagatgagggacatatgtaattttttgtttctttttaataggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaaggtatagaacatactgtcttaaatatgtttttcaataacatatggcataaattattatacctgaagagtttttaaagtgataatattttgttgagaggtagagtcaggcaaaagaaacacagatgctcctcaacttacaatggccttacatcctgatagacctgtcacaaattgaaaatatcgttaagtcaaaaacagagtacactctagagaatcagttgtttacccttgtgatcacatggctgactggaaactatcgctcgctgccattgcccagcatcatgagagaatatcatacatattgctagcccaggaaaatacagaattcaaaatatgaagtatagtttttgctgaatacatattggtttcatgccattataaagtaaaaaaattgtctggtatgggccctgacttaagtttagattttacagtagtgcaaaactatcgcaatttcgatatacttttacttttgatctcttcttcggctagtggtgtggtacataagatattcctgtttttggaggcttttcaagatggctgactagaggcacaggacacttctccacaaagaagaaccaaaatagtgagtaggtaatcacactgtaaataaaacatctaaaagagaatgctagagttcagtagagaagtgaccggaaacacctgaggagagggaggagaggtggacagccttgctgggatcaaccagaagcctggagaggctcctcagtgtggagttggggtaagtgagagatccctagctgtccacattcttgctgcagactcctgtaatcctaactgtgggagagttcttgaaccccatgggccccgagactggcatagggagctccctgaagttcatgcaatggtattgctctagaaagggtgctcttgctgggttccatgctccccctgagtcttaggtagctggagcacggctccattttaagagtctaatccctgttagaaacagaataatcttaaaatttgtatgaaaccaaaagagaacccaaatagccaaagcaatcctaagcaaaaagaacaaagctggaggcatcatattccctgatttcaacttgtattacaaggctatagtaaccaaaacagcatggtgttggtagaaaagcagacatatataccaatggaacagcataaaatacccagaagtaaacccatgtatttatagccaactgatttattacaaagttgccaagagcatacaactggggaaagggcaccctctttaataaatggtgctaggaaaactggataactatgcagaagaatgtaatggcccttctctctcaccatgtaaaaaatcaactcaaaattgattaaagacttaaacataagacccacaactgttaaaatactagaagaaaacaggagaaatactccaggacatttgtctaggcaaaaattttatggctgaccttcctaaaacatggacaaaaaaccccaaaatagacaaatggaactatattaaactaaaaatcttctgtacattagaggaaacaatcaacaaaatgaagacacaacctgacaaatgggataaaatatttacaaactattgacttagcaaatgattaatatccagaatatacaaggaactcaaacatctcaactgcaaagtaactaatcccatttaatgtggacaaaggatctaaacaaatgcttcttgaaagacgatatataaatggctaacaggtatatgaaaaaatgcttaaaatcactaattatcagagaaatgcaagtcaaaaccaaacatgccatatcatcttaccccagttagaatggctattattaaaaagagaaaaaaataatggatgcaggtgaggatgtggagaaaagggaactctcatatgcttttggtggcaatgtatattagtacagccattagggaaaagcagtgtggagatttctcaaaaaactaaaattagaactaccacacagtccagtaattccactacttggtatatattcaaaggaaaggaaatcggtatattaaagaaatatttgtacccctgtgtttgttgcaacactgttcacaatagcaaagataagaaatcaacctaagtgtccattagtggatggatgaataaagggaatttggtataattacacactggaataatattcaaccataaaagagagtgaaatgttgtttgcagcaacatggatagaactagaggtctttatgttacgtgaaataagctagacacagacaaatataacaggcactcactcctatgtgggagctaaacaagttgatgtcatggaggtagagagtagaatggtagtcaccagaggctgagaagaatgcatgggatgtggggtcggagggtggatgagtagaagttggttaatgggtacaaacatataatcagaagtaataagtttaatgtttgatagtttagtatggtgcttatagttgacatcaatatattggtcatttcaaaatagctagaattaaggaagtgaactgttctgaacacacacaaatgataaatgctcagggtggtgaatatcttaaataccctgacatgatcattacacagtctatgcatataagaaaatataacacatatctcataaatatgcaaaaatattatgtattgattaacaaataggctttgtgttagatgattttgctcaaccacaggctaatgtaagtatactgaacatgtctaaggttagctaagctaagctgtgatgtttggtagattaagtgtattaaatacatttgtgaattattgtattttaacttaacgatagattaattgaggcataagcccattgtaagtcaaggagcatctgtatattctctagaagtcctctgtgagatatatgatttgcacgtattttctcctaatctgtagctttccttttcattctcttaacagtatctttcccagaacagaaccattaactttgatgaaatctgttgtattttttttttctcttttcatgaacctacttctggttttctaggaatttgcagcctaatcatgacataaatatttactgttttcttctaaatgttttacatatttatattttatgtttagatctaaaatccatttactgttaattttgtatgatacataaagtgcaggtcaaagttcattttttctatgtatggatgttcatttgctccaatgtgatttgttgttaaaattatcattttgtcattgaattaccatgtgtttgtctaaaatcatttgatatttttgtgagtctttttctggaatctctctttgatttcattgacttatttgtctatgccaatatcacactgccttaattattatagcttaatagtaagtgttaaaatcaggtattgtgaacccactgacttttttcttcttttttataattgttttggcaatcctagtttctttgccttttcatatgtttgaaaatcagcttttgtatttctgtaaaaaatcctgcttggggtattgattggggttgtgtttaatttgtaaataactttattgagaaatgactccttaataagtattgagtatatctatttatttaggtcttctttgatttcttttatcagtgtcttttgttttcagcttatcaatcctgcccttattttgttaggtttgtaccttaagtactttttctttctttttttttttgttgttgaactattggtagtatttttcaaattttgttttccaatggcttattgatagtatatggaaatacagtagacttttctatactgatctctatcctgtaacttggtaaattcactaattagttttagcagctttcttataggttttttgtgatttcctttgaaggcagtcacgttgtctgtgaataaagacagttttatttcttccttttcaatctgtagagcttttatttttcttgctttattttactgacaaggacttccaacgtgatgctgaataggagtggtaagtctgaatatccttgccttgttcccaattttagggtgaaagcattcaggctcttatcattaagtaggatgttagaaaatgcccctttattgttttcacttctctacttccctttttaaaaattctgtattcttactactctcaagtgtcttctatgtcattgcttcattttttatcattttaaagtctactttttcctatatcctctatagattttaagctttccatttgtttccctgcaattctttttttaagccattttcatttttaaaaaaaattcttggctttttaatagtagcctgttttctgtttatatttttcctatattttatacagtccgtttttttccttgcactttagtagtcataacaattaaaaatatttttgttttctgcttctaatagtaaattactttttagtgtcttcatgatgaaagtttgtttttttaaaggtaatatttttcccatagttggattacagaagcttctctttaagaaattaattaatcatttgtcatataaaatatgcaaataaagaagttggaatgatctgattaattgtacattgtcccattgagaatgctggaaattatcttttggtaattctgggtatatcataggattgctaatatactattttaaagtctgaaatgcttaaataatataatgataacaagcatttattgtgcttattgtgggtcagatgttataatgagttctttgtatgttacaaaacccattaatagttctagtttatacatgtacttataaaattgaggcttagagaggtttaaaaagttgcccatgattgtacagctaagtaagtggctgagttgggatttgacaagaatagtcacattcctaagctattatgctatcctaacacatagatgttagctgcggaatttttctgcgtcaggcattatgcagggtgatttatatagttgtttgtatgtacttcatattagtccattctcacattgctataaataacctgaaatagggtaattatataaagaaaagaggtgtaatttgcccacggttctgcaggctgtacgggaagcatgatgtgctggcatctgcttggcttctggggaggcctcaggaaacttacagtcatggtggaaggtgaatggggagcaggtgtctttcatggcaggagcaggaacaagagagagagggaggagggaggggctacatacttttgaacaagcaggtcttgcgagaactcaactatcacaagaatagcactgaagggatggtgctaaagcattcatgagaagcctgcccccatgatccagtcacctcccaccgggcccacctccaacactggagattacaattgcacatgagatttgttgtggtcacagatccaaaccatgtcacataccttttaaaagtgaggaaataaaactttagaaaatattagtcactttatcatattatcccaagtggtccatgatgaaactgaaatgaggattggatctgtctgtctctaagtcttattccttttatatcatgctacctctggcagctgtaatgctatctttctttttcattctgagaactgtttaggatactgtggccaaaatagccagatgtgaaaacagatcatgccatttaaattgtaacaaaaatatattacactgacttatatgatgaaaaaaggtgtacatgcaatgactttaactgttttatggtaacttagggtcctacccacataaactgtggggtgcttgcagcagaacacatgttggtagtacagtcagccctctgtatccctggatttcgtattcatggattaaactcgcagcagatcaagaatatttgggaaacaaaaaattccaaaaagtgaaacttgaatttgccatgtgctgagtactatgttaaatccacagaaatgatgtgttgtcattgtattagttattataaataatctagagatgatttaaagtataaaggaggatatgtgtagattatatttaaatactgtgtcattttatatgagggacttgagtatctgcagttttgggtgtctgtagggggtcctggaaccagccctcgctagatactgaggaaagactgtgattctgaattcaaagagggtaagatcaatgaaataatgttaaaaaatcaaaaggtgtttatttttattccattttaaaaacttcttttttaagctttatcgaggtataattgataaacaaaaattatgcgtattcagggtgtgcaatgtgatgatttgatagctgtatacattgtgtaatgattaccataatcaaattaatcaacatatctgtcaccacacagttaccaccttttatgtgtgggtgagtgtgtgcgtgaggacatttaagatctactgtctttgaaaacttaaagtaaacaacgtggtattattaactatagtcaccatgccatacattagattcccagaacttaatttgttttatagctaaaagttgtaccctctgaccagcatctcctcatttccctcataccccatccccaggcaactaccattctactctctgcttcagtgagttaaacttttagagtatgcgtataaattagctcatacagtgttttgtctttctgtgcctggcttatttcacttagcataacaccctccaggttcatccattttgtcacaaatggcagtgttttctttttaaaggttgaataatattccattcattatctgttcatttgttgacagacacttaggttgtttccttatcttggccattgtgaataatactgcagtgaacatgagggtgcagatatctcttcaactgatttcatttcctttgcgtataaaccaggagtgggattgttggattgtatgatagttttatttttaatgttttaaggaacctccatactgtttttcataaaggctgtaccaatttacattcccaccaacactgtacaatggtttctttttctctgctgtcttcctaacacttgctgtctcttgtctttttgataataggtattttaacgatgtaacgtcatgttgtattatgcttttgatttgcatttctttgatgattaatgatattgaccactcttttatatacctgttgatcatttttatgcctttttttggtggggagaatgtctgttcagttcctttgtccagtttttaaatgggttattagttttcctgctattgagtttgtgagttccttatgtattttgtatgttaacctcttatacatggtttacaaatacaggttgggtatcacgtatctgaaatgcttgggaccagaagtgttttggattttggattttttgaattttggaatatttgcatatacataatgagatgtcttggggatggtaagcaagtctaaacactgaattcatttatgtttcaaatacaccttatatacatagcctgaaggtaatcttacacaatattttaaataattttgtgtatgaaacaaagttttgactgtgacctgtcatatgagatcaggtgggaaattttctgtttatggtatcatgttggagttcaaagagtttcagattttggagtattttagattttggatttttggattagggatgccgaacctctgttttctcacattctataggttgccttttcattttgttaagtttcctttgttgtgtagaagctttttagtttgatataatcacacttgtttgtttttgcttttgttatgtatttcatatccaaaaagtgatacgcttttggtgtcctatccaaaaaatcattgcaaaggccagtgctaaggagctatttttcctgtatttttttctagaaattttatagtctcagatctttcatttaagtctttaattcatttttagttaatttttgtgcatggtataagataaaggtccagttccttttttttttttttgcatgtagattttcagttttctcagtaccattagttgaaaaggctttttcccatggtgtatccttggtgcccttgtcaaagactggttgaaagacacttctttttatctcttattgtttagatttaataaatgagagggccaattgaaaaaaaaacttgacattaatagctttttgcagaatatgattgaagggattttaaaatttcatctcatctcactttaatacgtctgttttttgccatttatttatttttctttgtataaattcatggtgtacaactgaaattttgttacatgcatagatttcataatggtgaattcaggacttttaggtaatttctcattatccaccctcgcagcacctcctctcccttctgagtctccattgtctgtcattccactttttacatccatgtgtacacattatttagctcccacttatgagtaagaatatgcagtatttgtctttctgtgtctgacttgtttcacttaagataatggcctccagtttcatccaagttgctgcaaaagatatgattctgttcttttttatggctcaatagtgttccattgtctatatatacacaccatattttctttatccagtcatccaatgatggacacttaggttgatcccatattgttgttattatgaatactgtgataaacaggagtgcaagtacctttttagtacactgatttcttttcctctgggtagatgccccattgagggattgctagattgaatgttagttctagttttagttatttgagcaatctctatactgttttccatagagttcccttttctatactattttccataagagttctcttttctccacatccttgttaacatctattattttttaacttttttattttttatttatttatttatttattattttgagacggagtcttgctctgtcacccaggctggattgcaatggtgtgacctcggctcactgcaacctccgcctcccaggttcaagagtttctcccacctcagcctcctgagtagctgggattacaggcgcacaccaccacgcccggctaatttttgtatttttagtagagatggggtttcaccatgttggtcaggctggtctcgaactcctgaccttgtgatccgcttgcctcagcctcccaaagtgtgggcttacaggcgtgagccactgcgcccggactttcttcactttttaatagccattctgactagggtaagatgatagctcattgtggctttgatttgcatttctctgatcagtgatgttgagcatttttaaatgtatctgttggccatttttatgtcttcttttgaaaaatgtctattcatgtcctttgccctgtgcccactttttaatgggattatttttgttgttgttgttcagttgtttgggttttttgtacattctggatattggtcctctgtcaggtgcatagtttgcaaatattttctcccattttgcaggttttctatgtactatgttgattatttcttttcctgggcaaatcttcttagtttaactaagttccatttgtctatttttatttttgttttctgtccttttaagatcttagtcatgaattctttgcttagaacaaggtccaaaagagttttcgctaggtttcttctagtattttaaatttcaagtattccattgaagtctcttaattcatcttgagattttttttatatgatcagagacaggggtctagtctcattcttctgcttttggcaatgcagttttctcagcaccatttattgaaaacgttgtcttttcctcaatttatgttcttgttgactttgtcaaagaacacttaaatgtaaatatgtagctttatttctgggttttctagtctgttctcttgatctatgtgtctatctttatactagtaccatgctgttttggttattatagccttgcagtttaatttgaagtcagagagtgtaaggcctccaggtttgttctttttgcttaggactgctttggccattcaggttcttcattgcttccatatgaattttaggattgtttttcctaatttagtgaaaaatgacaatggtattttgataaggattgcattgaatctgtagattgctttgggcagtatagtcattttaataataattctttttattattatgttttaagttctggggtacatgtgcagaatgtgcaggtttgttacataggtatacacgtgccatagtggtttgctgcacccatcaacccgtcatctacattaggtatttctcctaatgctatccctccaccagccccccacaccctgacaggccccagtgtgtgattcccccaccccttatgtccatgtgttctcattgttcagcacccccttatgagtgagaacatgcggtgtttggttttctgttcttgtgttagtttgctgagaatgatggtttccggcttcatccatgtccctgcaaaggacatgaactcatccttttttatgcctgcatagtattccatggtgtatatgtgccacatttttttttaatccagtctttcattgatgggcatttgggttggttccaagtctttgctgttgtgaacagtgctgcaataaacatacatgtgcatgtgtctttatagtagaatgatttataatcctttgggtatatacccagtaatgggatggctgggtcaaatggtatttatagttctagatccttgaggaattgccacactgtcttccacaatggttgaactaatttacactcccaccaacagtataaaagcattcctatttctccacatcctcttcagcatctgttgtttcctgactttttaatgatcacattctaactggcatgagatggtatctcattgtggttttgatttgcatttctctaatgaccagtggtgatgagctttttttcatgtgtttttggctgcataaatgtcttcttttgagaagtgtctgttcatatcctttgcccactttttgatgggtttttttcttgtaaatttgtttaagttccttgtagattctggatattagccctttgtcagatggatagattgcaaaaattttctcccattctgtaggttgcctattcactctgatggtagtttcttttgctgggcagaagcccttcagtttaattagatcccatttgtccattttggcttttgttaccattgcttttggtgttttagtcatgaagtctttgcccatgcctatgacctgaatggtattgcataggttttcttttagggtttttatgatttttaagtctttaatctatcttgacttaatttttgtataaggtgtaaggaaggggtccattttcacttttccacacagggctagctagttttcccagcaccatttattacatagggaatcccttccccatttcttgtttttgtcaggtttgtcaaaggtcagatggttgtagatgtgtggtgttatttctgaggcctctgttatgttccattggtctatatgtctgtatggtaccagtactacactgttttggttactgtagcctcgtagtgtagtttgaagtcaggtagcatgatgcctccagctttgttcttttgcttaggattgtcttggctatgtgggctccttttggttccatgtgaaatttaaagtagtttttttccaatgctgtgaggaaagtcaatggtagcttgatggggatagcattgaatctataaattactttggacagtatagccattttcacgatattgattcttcctatccatgagcatggaatgttttttcatttgtttgtgtcctctcttattttcttgagcagtgatttgtagttctccttgaagaggaccttcaaatcccttgtaagttggattcctaggtattgtatcctttttgtagcaattgtgaatgggagttcactcatgatttgtctttctgtgtctgttattggtgtatagggatgcttgtgatttttgcacattgattttgtatcctgagactttgctgaagttgctcatcatcttaaggagatttttggttgagatgatggggttttctaaatatacaatcatgtcatctgtaaacacagacaatttgacttcctcttttcttttttttctttttttttttgagacggagtctcactctgtcacccaggctggagtgcagtggcacgatgtcggctcactgtaagctcctcctcccgagttcatgccattctcctgcctcagcctccctagtagctgggactacaggtgcttgccaccaagcccagctaattttttgtatttttagtagagacggggtttcactgtcttagccaggatggtctagatcccctgacctcgtgatccgtccgccttggcctcccaaagtgctgggattacaggcgtgagccaccgcacccagcctcctcttttcctaattgaatatcctttctttctttctcttgcctgattgccgtggctagaacttccaatactgtgttgaataggagtggtgagagagggcatccttgtcttgtgctggttttcaaagggaattcttccagtttttgcccatacagtatgatattggttgtgggttgtcatgaatagctcttattattttgagatatgttccatcaatgcctagtttattgagagttttttttagcacaaagggctgttgaattttatcaaaggtcttttctgcatctgttgagataatcttgttgttttttcattggttctgtttatgtgatggattacttttattgacttgcatatcttgaaccagccttgcatcccagggatgaagccgacttgatcatggtggataagctatttgatgtgctgctggatttggtttgctggtattttattgaggatttttgcattgatgttcatcagggatactggcttgaaattttctttttttgttgtgtctctgccaggttttggtattaggatgatgttggcctcgtaaaatgaattaggaaggattccctctttttctgttgtttggaatagttttagaaggaatggtaccagcttctctttgtacctctggtagaatttggctgtcattctgtctagtctgggactttttttggttggtaggctattaactactgcctcagtttcagaacttcttattgctgtattcagggattcaaattcttcctggtttagtgttgggcaggtgtatgtgtccaggagtttatccatttcttctagattttctagtttatttgcgtagatgtgtttctagtattctctgatggtagtttgtatttctgtgggatcagtggtgaagtcccctttatcattttctattgtgtgtatttgattcttctctcttttcttctttattagtctggctaagggtctgtgtattttgttgagcttttcaaaaaaccagctcctggattcattgatttttttgaaggacttttcatgtctctatctccttcagttctgctctgatcttagttatttcttgtcttctggtagcttttgaatttgtttgctcttgcttctctagttcttttaattgtgatgttagggtgtcgattttagatctttcctgtttttgttgagttttgttttatttttttttttgtgtgggcatttagtgctataaatttccctctgcacactgctttaaatgtgtcccacagattctggtaccttgtgtctttgttctcattggtttctaagaacaactttatttttgcttttatttcgttttctacccagtagtcattcagcggcaggttgttcagtttccatgtgttgtgaggttttgagtgagtttcttaatcttgagtctaatttgattgcagtgtggtccgacagagtgtttattaatgatttctgttcttttgcatttgctgaggagtgttttacttccaattatgtggtcaattttagaataagtgcgttatggtgctgagaataatgtatattctgttgatttggtgtggagagttctgtagatgtctattaagtccacttggtccagagctgagttcaagtcctggatatccttgttgattttctgtctttttgatctgtctaatattgatagtggggtgttaaagtctctcactattattgtgtggtagtctaagtctctttgtaggtctctaagaacttgctttatgaattggggtgctcctgtattgggtgcatatatacttagaatagatagctcttgttgcattgatccccttgccattatgtaatgcccttgtctcttttgatctttgttggtttaaagtctgttttatcagagactaggattgcaacccctccttttttttgctttccatttgctttgtagatcttcctccatccctttattttgagcctatgtgtgtctttgcatgtgagatgggtctcctgaatacagcacaccaatgagtcttgactctttatccaatttgccagtctgtgtcttttaattggggcatttagctcagtcacattaaagattaatattgtcatgtgtgagtttgatcctgtcattatgatggtagctggttattttgcccattagggtttctgctgagagatctgctgtgggtaacctgacctttccctctggctgcccttaacattttttcctttatttccaccttggtgaatctgacgattatgtgtctcggggttgctcttctcgaggagtatctttgcggtgttccctctatttcctgaatttgaatgttggcctgccttgctaggttggggaagttctcctggataataccctgaagagtgttttccaacttggttccattctccccatcactttgaggtacaccaatcaaacatagatttggtcttttcacatagtcccatatttcttggaggctttgttcatttcttttcactgtttcttctctgatcttgtcttctcactttatttcattgagttgatcttcaatatctgatatcctttcttttgctttatcgattcggctattgatacttgtgtatgcttcatgaagttctcgtgctgtgtttttcagctccaagaggtcatttatgttcttctctaatctggttattctagttagcagtttgttttacctttttttcaaggttcttagctttcttgcattgggttagaacatgcgcctttagcttggaggagtttgttattacccagcttctgaagcctacttctgtcagttcgtcaaactcgttctccgtccagttttgttcccttgctggcgaggagttgtgatcctttggaggagaagagctgttctggtttttggaattttcagcctttttgtgctggtttctccctatctttgtggatttatctacctttgttctttgatgttggtgacctttggaagaggtctctgagtggccgtactttttgttgatgttgatactattcctttctgtttattagttttccttctaactgtcaggcccttctgctggagtttgctggatgtccactccagaccctgtttgcctgggtatcaccagtgcaggctgcagaacagcaaagattgctgcctcttgcttcttcctgaagcttctttccagaggggcacccacaagatgccagccccagctctcctgtatgaggtgtctttcggctcccactgtggggtttctcccagtcaggatacacaggggtcagggacccacttgaggaggcagtctgtcactggatcagagcttgaatgctatgctgggagatccactgctctctccagagctgccaggcaggggcgtttaagtctgctgaagctgcacccacagccacccctttccccaggtgctctgtcccagggagatgggggttttatctataagtccctgactgaggctactgcctttttttcagagatgccctgcccagagaggaggaatctagactggcagtctggctgcagtggctttttgagctgcagtggctttttgagctgcagtgggctctgcccagttcgaactctctggtggctttgttacactgtgagggtaaaaccgcctactcaagcctcagcaatggcggacgcctgtccctccaccaagctcgagcttctaggtcaactcagactgctgtgctagcagcgagaatttcacgtcggtggatcttagcttgctgtactctggggttgggacctgctgagccagaccactttgctccctggcttcagccccctttccaggagagtgaacggtgattcactggcattccaggtgccattggggtatgaaaaaaacaaacaaacaaactcctgcagctagcctggtgtctgcccaaacggccacccagttttatgcttgaaacccagggcctaggtggcataggcacccgagggaatctcctggtctgcaggttgtgaagaccgtgggaaaagcacagtttctgggccggagtgcaccgttcctctcggtacagtctcttacggcttcccttggctggggaagggggatctcctgacccgttgtgcttcccgggtgaggcaatgccccaccctgcttctgctcaccatccgtgggctgcatccactgtcctatcagtcccagtgagatgaactgggtacctcagttggaagtgcagaaatcacctgccttctgcatcgattttgctgggagctacagaccggagctgtttctttttggccgtcttgccagcatatcatcataatagttcttttgacccatgagcatgggatgtttttccatttgtttgtgtcgtgttcagttttctttcgtcagtattttgtagttctccttgtgaagattgtgcatcttggttaaaaaaatattcctatgtatttggctgagcactatgggctcatgcctgtcatttcagcactttgagaggctgaggtgggtggatcaccactcctgggtgatccccaagagtttgagaccagcctggccaatatggtgaaacaccatctctactaaaaatacaaaaattagccaggcgtgctggtgcgtgcctgtaatcccagctacttgggaggctgaggcctgagaattgcttgaacctgggagggacaggttgcagtgagccgagatagtgccactgcactccagcctgggcgacagagtgagactctgtctcaaaaacaaacaaacaaaaaattcctatgtattgtatttttcttgtagccattgtaaatgggattgttttcttgattttgttctcaactagattgttactggtgtaagaaatgctactgatttttcatgttgattttgtgttgtgcagctttactacattcatttattaaatctaagaatttttcatgaatctttaggttttcctagatataagttatatcttcagcaaacagtaataattttactttctcttttcccatttagaagccttttatctcttgcctgatggctgtggctaggacttccagtactatgttaaataggagtagtgaaaatgggcatccttgtcttgtccaacgtttttgaggaaatgtttttaacttttccctgttcagtgtgatgttgtctgtgggcttgtcatatatggcatttaatattatgatgcatatttcttctatgcccagtttgttgagagtttgtatcatgaaggggtactgcattttatcaaatgctatttctcagtctattggtttgatcataaagtttttctccttcattctttttatgtgatgaatcacatttattgacttgtgtattttgaaccactcttagatcccttgactaaaacccacttgattgtggtgtattatctttttaatatgctgttggattctgtttcctagtattttgtttaggactgttgtgtctatgttcatcagggtattggtctttagttttctttattcgttgtgtccttgtctggttttggtattgggatgatactggagaatgagttagggagaattcctttcccctgttccaactttttggaacagttttacaagaattggtattagttctttgtatgtttggcagaattcagctgtgaatccgtctggtcctgcgtttttggggggaagattttattactgatttaatctcactacccattattggtctattcaggctttctgtttcttctttgttcaatcttgggaggttgtgtattagtctgttcttacattgctacacagaaatacctgtgactgggtaacttataaagaaaagaggtttaattggcttatggttctgcaggctgtactggaagcatgatgctagcacctggggaggccttgagaaacaaaacaatcatagcaaaaggtgaagggggagcaaacccatcacatggtcagagcaggaacaagagaggaaggggggaggtgctacacacttttaaaccaccagatctcaagagaattcactattgtgaggacaataccaagaggggtggtgctaaatcattcctgagaaacctgcctccatcatccaatcacctcccatcaggccccacctccaacattgggtattacatttcaatatgagatttggatgggaacatacatccaaactatatcaggttatatgtttccagaaatttacctattttctgcaagttttctagtttatgaacatgtagttgttcataatagtctctgatgatcttttgaatttttctcatatcatttgtaacgtctccattttgatttcttattatatttggatcttctttcctctggttagtcttgctagcacttgatcaattttgcttatctttttaaagaacgagctttttgtttcattaattttttaatttttttttggtctctgttttatttagttttgctctgatccatgttacttctttacttctgctaattttgtgtttggttcgttcttgcttttctagttcctttagatgtattgttaggttgttaatttgcaatctttctacttttttgatgcaggtatttattgctgcaaaattccttcttagcactggttttgctgtgtcctacaggtttttgtatgttgtatttccagtttcatttgtttcataaaattttttaattctccttaattttttcattgatccaaaggtcattcaggggcatattgtttaatttttctgtatttgtatagtttccagagtttttcttgatattgatttcttggtattggttttattctactgtggtctgagaagttacttggtatgatttgatttttaaaaatttgttgaggcttgttttgtggcataacatatggtctatattggagaatatcccatgtgttgatgagaagagtatttattctgcagttgttggatagaatgttctataaatgtgtgttaggtacattttgtctgaagtccaatttaagtctgatgtttgttgattttatgtctcagtgagctgtctaatgctgtgagtgagatggtgacgtcccctattattgtttttctgtctaactctctttaggtctagtaatatttgttttatgaatttgggtgctcaaatgttgggtgcatgtatgtttagaattgttatgtcctcttgtagaactgacacctttaatatcaggttttatacttttgtgttttcttgatggggttgccctgtctctttcaagtttaggactcctttgaacatttcttgtagagctggtctacttttgacaaattctcttagtattctgttaataatctgtctgggaaagaagattatttctacttcatttatggagcttgatatttctcgatgtagaactcttgactgataatgacttcattattttttactatttttattttaaagtatgctttatctgataaaaatatagctacctctgcttgctttagattttcgttggcccataatatcaatcaatatctttttccacccctttacttttagtctatgtgtcttcacagataaggtgggtttcttgtaaatagcatatagttgattttttttctttttttttgagatggagtcgcgtgctgtcgccaagctggagtgcagtggcgggatctcagctcactgcaacctccgtctcccaggttcaagcaattctcctgcctcagcctcctgagtagctgtgactgtatataggtgcgcgccaccatgcacagctaatttttgtactttaagtagagactgtcaccatgttgacagaatgttctctatctcttcacctcattatccgcctgtgttggcctcccaaagtgctgggattacaggcatgagccaccgctatatggcctatagttgattttttttattcatttagccaacgtgtattttttagtaggacatttaatccatttatgtttgaggtggtatatgagattttgttcctgtcatattgtttttttcatcattttgtaaacttttgggttttttgtctgtctaaatttatggtttgttggaattctgtaatggtttcatttgattcttcttctttgtatgatatctttactagtgtattttatatttttgtgtgttttcacaatgataaatattgtcctgtctcttccaagtttaggacttctttgagcatttcctgtaggactggtctagttttcatgaattccctcagtatttgattgtctgggaaagactatttctcctttatttatgaagcttaatactacctggatatacaattcttggctgacagttgttttctttcacactttgattatgtcgtcacattttttcctgccttgtaaggtttctgctgggtagtctgctgttagtttgatggactttcctttatagatgacacttttctcttgattgtagaatttgttctttcactttgacattagacactcattataatatgttgtattgaagtcccttttatgttgtatttgcctgcagatcatggagcctcctgtatctattatgtctgtatctcttgctagccttgggagtttttcaatctattattttgttaaagatttttgatgtttctgtccctttgggaataccagtaattcataagttcaatgctgtatgcagtcctaaacacttggaaagctttgttcatttttttcttatttttaaaatttttatcagactgcactgtttgaaaagacctgtcttcatgttctgaaatcttttcttctgcttggcctagtctattattggagtttccatgtattttatatctccttcagtgaattttttagttccaggatttttttaaagacgtctatctccttggtaaatttctcattcatatcctgaattgattttctgattactttgtattagttttcagatttctcttgtatctcattgaacttaattgaaatcaaaatattgaattctttggggttgtaaggttttctttttggttctgctctattgttggagaattattgtgttcctttgatggtgtcatattgccatgcgttttcatgtttcttgtgtttttatgttcattctagcacatctggaacaattgctttttttttcaatttaacttttgtttggagtagactttgctcctttatatgtgacttcgatgttggttgagtagggccacttgtttttatttctgggtgtgcgcattggtgaatactttatgatattcttggctataaatattgttattggtatctgtggattcctttgtgtgttagggtgtgggttttgatggaggatgtggtgaaattatgctagggactggaatgcttgataggtccttcttcaggtttcagtggtagcagtggttgtctaagcaggtctatatctagggcagtgtgtgctggcacatgagttggcagttccatgcaggctgattattgggggctctgggtggctcttttggataccagttgtggtagcagtgtactgggcaagtgagtgggctcatgagctcttgggtagctgggtggcctcagtaatggtggcagcagtagtggtaagatgctctccccagtgcccttgtgttgggagtgattgcaattggctgtgtgggctgacctccaggctgggtggcacttgcagatagaaaccaaccgagagagtaatggcagggtttttatgcccaaactctgtcccctgggagaagtgcttgggtgtctcaggcagtgggctggactgtgggacctccagaagtccagatcctgcattgtgtctcagagagtagggcaaagctgggtaaatctggattgggaaagcctgggcttgtcctatgaaatgcttgcatgaggggtgacaacacctttgctgaagtactgccatgatgggagagtggggctactggtcccagtggtttcagcattggctggcaagtggggaatctgtgtccctctcatgtctcagtcctggtggggcttcctcccttatcccgactcttgcagctgatcctgtagtttagtcggactgggtagttgtcacctatctcataactcagccctgcccaggtcaggaccagactgctttggcggctcttattctgctcacatcttgggggttgcctagctcccaagctgggggctggagtttatgtcacgcttgcttttcagtcctggttgcagaatcccatttcctacacaggccccagttcagcaaaccacagattgagttactctgatacttaggactggtgctataggttcccaggtcacacaatttgttaaaccctaggattgagaatggcatcttactgtagctgcttaggtctcagggaaggtgtggaacccagggtgtgttatttccctatagcagttcctttatacagtctcctggttgcttcccaagtcaaattcaaggtttgggagggtcaagatacactcccatggcctggattatacaattgattctccagtaggaaagtgaaccacagaaagacactcagttaccttctcccacgttgcagactcccttttggttgccagcctgccctgtccacattagctgtttgttgtcctctctttttggagtttctgtttgcttttctgttaaatgcctgtgttctgtcttggaacacttacattataagtgtgactttaacactttatcttaacctctttggagacttgagactgaaatgtcactaccacttattagaatttgtattcttccctcttgaatctgtgttgactgttagcagtgttcttctaacagggttttctgtttgattttgttgttgtaatacctatgtgttcataacatttattaaatcatgaattcttttcagacagaaattgaatgctatgtttaattttattcctgaaattctatttggagctcttttacgtgtattcctgccatactaaatgtaaaaactgacatgtcaaatgtttttgacatcaatgtatcttttctgggagatacctaaaggaaacgacttgagttcttttatatatattttctaaaatatttttacaaataagattatgagacttgtaaataatattttaagcacttctgagtatcttgctctttaaagcatgcatttattgactccttaaaatgcacttatggttttgtcagggagttttaaaatataaattcaacagttctgtctagtttgaatgtttagaatgtgtttaatgtgattttctcctgctaagaatgttctttatttcgccaagtacatggcagattttccataatataaactattatatagtgaaactttgtattttcttacaggttcttgagaaatctacatgaaaaaatggatagacaatagtcctaagataataatgttcctataacattaaaaaaatcccctttaagccattgtaagatttactttattgttaacaactagttgtttcattaattattgaatacctatcttttatatggagtataagaaattataaattgttactttaaaaacttatgttctcttgttttattattttctttaatttgatttcatttcttttggcattctatggatggtcgaatggctttgtcctaaagaggacagaaaaagcatactttatgcagctaaagcttgaaacacaatatgtaactgtgaatacatatctgagagcttcttcaagatttaaatgcttctgaacattattgtctttgtttatagcaagggtattttgttgtaattatattcacatgcaattcaaatttctgccttttttgttactttagtttcggtatgttatgtaaaaggcataggttttctgtatgcttaaattcactgactatacgtggttgtgagctttaaatgctgctatgtattctctacctttactgaaatgtttatctgcagtaaaatgcagagattttttttttttttttttttttttttgagacggagtctcgctctgtcgcccaggccggactgtggactgcagtggcgcaatctcggctcactgcaagctccgcttcccgggttcacgccattctcctgcctcagcctcccaaaatgcagagattttaatttaattgttcagtctgatgggttttagaagttatatacacacatttaattatgatacctaacaaagtatagaaaattttcatcagcaggaaattactttcaacctcatcctcacttttttatttctgtcaccacagattagttttgtctgctcttggatttaacgtaatggactcatataatatgtatttgactgtcactcaaaataatttttttgattcattcatattattacatttattagtaattcttttattgctaagtgtcattccattatatgaaaatatcacaatttgtttatctgtatttctgttcatgtatgtttgggttttttacagtttctggctaatatgagtaagattgctatgaacatttgtgttcaagtcattttatggatattatatttttttcccttgcgtaaatatctagtaatggggattgctgatcccccaagccaaaaagtctgagacttcctatttaagttttagtctctccatgctacatggattgggaaaagtcatatatgtgtgaatctcaccttgagtggtttcctttaagagtcaaatttcctttaacttttgcctgattttagtcattcttttttgtttgtttgtttttgaggtagggtctcgctctgtggcccaggctggagtgtgcagtggcacgatatcggctcactgcaacctctgcctcctgggttcaagagattcttgtgtctcagcctcccgagtagttgggattacaggcacgcaccaccactcctggctaatttttttgtatttttagtagaggtggggtttcaccatgttggccaggctggtcttgaacccctgaacttaagtgatctgcccgccttggcctcccaaaatactaggattacaggtgtgagccaccacacctggcctgattttagtcattcttaatgcattcaaattgttgttttaaaaaaacgttttgtatagagattatatatttttatattcaaggaggttggtgtgatataggctatttcccaaccattactagactaagaactccaaaagtgattttttaaaaatgtgtcttattttatccaccccactccatttccattttagggtttccatgttactcattgtagaagttggagttcttacaattgtctttaaggaactacatgccctgttgtctcctcagcccacaacctacattgttgaccatctccttttaacatcctctatctggcttattgaatacctctaatctctttacttcaaaagttctgctggatgttcatagggctggcttggttcctttttccagctgattgtttaaatgtcacatttgtcagtgaatctttccctgatagtgccacctcctctgtggcattttattatcttatttttctccataatatttattttttttgtggcccactatatattttacttatttacttttttgtctgtctctaccaccagaatataagctcctcaatggcaataatttttgtctgtttgtttactgctgttattttcactacttttggtctttgggagatagtagagtgtcagtaaatatttgttgaatgaatgcatgtgcaatattccatccttacaaactgtgctatttttaagttcactttattcggtttccttatgaagagggatattttttttattgacagagaaaggacaataaaaggaggaggctatgaactgcattttgtatttcctaatattcttttgtgttttcatttttggttgtacttcaagcctttttgtggttcatttattttatggctcttgaattttgctagagtactagattctagtcatttaaaaaattttctctttaaaagtgaaaatatagaaagaattgctttaggttgaaacagatggaaattctccaggaaaaaaaaaaagtgatggacttagctgttgatgcagaaatcaatttaaaaatctttagatctaagagacccttaatcagtcttatttgaaacagaatgtatttctccactgcataagtaattggctgaaaccagaaccattaacaaattgaatgaagatttcgttaatgccagggaactgtgctgttagcaaaatcactcttattatgtcacagtattcaaagatgtgcatttgttaaatagagttgatgtactttttcagagtgttgccaattgtgagaacatttgttgaatgacatttcagtgtcctcaaacttgtgctattatcttcatatattcttggtatgcagaggtgacaaacaatttgaaaaaaaaatacattgatgatttccctcacttccctccaacttgaatatgaaggccagtcttatgatttggtactttggtcaagtctgtgggtcaagggatataattaagttccttgtcaccctaacagtgagactaggccgacttttgtggtgtctaaacttgagggtattggttagggaatatccctgaattgtgtttgtaataaggcatttgcacttcttattgtgatttgatgtagcagccaaattaaaagtacagagtgccaaaatgaatgtgttggcttagtcacttttggagttttgcagagggcaacagactcctgaggtcttctggaggctgcctaatgggtaaccctgttggagatttgtgcagtatgtcttatgaaagtaggcagtcacttggatatggtaatatattcacttctgtgttttataggttatatattgtataccagtcatctctgataccctggccctggcatcttattattttttttccagagacagggttttgctcagtcactcaggctgaagtgtgcagtggcttgtggtgtgatcatagctcactgcagccttaaactcctaggctcaagggatcctcctgcctcagcttcccaagtaactaggactacaggtgtatgctgtcatgcctagatactttttaaagaacattttcatagagacagtgtcttgccattttgcccaggctggtcttgaactcttggcctcaagcaattggtccccctgcctcagcctcccaaagtgctaggattacgggtgtgagtcactgtgcctgccttgtatctttaaaaaataatgttttataattataatttgtatagtatatactgtattcttttgaattgtatggttccatgaattttgatagctgtatttccatgagatcaccatggtaatcaagatacagagcattatgtttatagcggcacaatttgcaattgcaacaatatggaaccaacctaagtgcccatcaaccaacaaatgaataaagaaaatatggtatatatacactatggagtactactcagccataaaaaggaatgaagtagcgttttttgcagcaacttgggtgacactggaggccagttttctaaatgaagtaattcaggaatggaaaaccaaatatcttacgttctcccttattgggagctaagctatgaggttgtggtggcatgagaatgatataatggactttggggatttgtggggcaaggttgggaggaagatgagggataaaagactacacattgggtacagtgtacactgcttcggtgacggttgcactaaaatctcagaaatcactgctacagaacttacccatgtaagcaaataccacctgtaccccaaaaactattgaaataaaattaaaaaaaattttttttaaagatagagtattttcattaccctcaaaagtttcattttcctttgcagtcccttactgccctaacctagccccaagcaacccctgctctacattctgtcactatagatggcattctctagtattttatataaatggacttacagatatactttttgtatgtgtctggcttcatacactgattataatgattttgagactgatcattttgttacttgtattagtactttttttttttttattacagagtagtattctaccatttggatatacctcagtttgcttatctgttcacctgtttgtggatatctgggctatttctaggttttggctattatgaataaacctaattaatgtttatctgtgattaacatttatgtatatgttttgtatgtttttgtatatgtttatgtatatgttttgtatgtgtatatgtatatgtttttgtataggcctatattttcttttttttaattatactttaagttctaggatacatatgcacaacgtgcaggtttgttacatagatatacatgtgccatgttgttatgccgcacccattaactcatcatttacattagatatttctcctaatgctctccttccccctgccccccaccacatgacaggccccgtgtgtgatgttccccttcctctgtccaagtgttctcattgttcagttcccacctatgagtgagaacatgcggtgtttggttttctgtccttgtgatagtttgctgagaatgatggtttctggcttcattcatgttcctgcaaaggacatgaactaatccttttttatggctgcatagtattccgtggtgtatatgtgccacattttcaaaatccagtctatcattgctggacattcgggttggttccaagtatttgcttttgagaatagtgccgcagtaaacatacatgtgcatgtgtctttatagtagcatgatttataatcctttgggtatatacccagtaatgggatggctgggtcacatggtatttctagttctagatccttgaggaatcgccacactgtcttccacgatggttgaactagtttacactcccaccaacagtgtaaaagcattcctatttctccacatcctcttcagcatctgttgtttcctgactttttaatgatcgccattctaactggcatgagatggtatctcattgtggttttgatttgcattctctgatggccagtgatgatgagcattttttcatgtgtctgttggctgtgtagatgtcttcttttgagaagtgtctgttcatatcctttgcccactttttgaatggggttatttgtttttttcttgtaaatttgttggagttctttgtagattctggatgctagcccgttttcagatgggtagattgcacaaattttctcccattctgtaggttgcctgttcactctgatggtagtttcttttgtcatgcagaagctctttagtttaattagattccatttgactattttggcttttgttgccattgcttttggtgttttagacatgaagtccttgcccatgcctatgtcctgaatggtattgcctaggttttcttctagggtttttatgttttaggtctaacatgtaagtctgtaagccatcttgaattaatttttgtataaggtgtaaggaagggatccagttttagttttctacatatggctagcctgttttcccagcaccatttattaaatagggaatcctttccccatttcttgtttttgtcaggtttgtcaaagatcagatggttgtagatgtgtggtgttatttctgaggcctctgttctgttccattggtctgtatctctgttttggtaccagtaccatgctgttttggttactgtagccttgtagtatagtttgaagtccggtaacgtgatgcctccagctttgttctttttgctcaggattgacttggcaatgagggctcttttttggttccatatgaactttaaagtagtttttccaattctgtgaagaaagtcattggtagtttgatggggatggcattgaatctataaattaccttgggcagtatggccattttcatgatattgatttttcctatccatgagcatggaatgctcttccatttgtttgtgtcctcttttatttcattgagcagtggtttgtagttctccttgaagaggtccttcacatcccttgtaagctggattcctaggtattttattctctttgaagcaattgtgaatgggagttcactcatgatttggctctctgtctgttattggcatatagaaatgcttgtggtttttgcatattgattttgtatcctgagactttgctgaaattgcttatcagcttaaggagattttgggctgagacgatggggttttctaaatatacagtcatgtcatctgcaaacggggacagtttgacttcctcttttcctaactgaataccctttatttctttctcttgcctgcttgccctggccagaacttccaacactatgttgaataggagtggtgagaaagggcatccctgtcttgtgctagttttcaaagggaatgcttctagtttttgcccatttgatatgatattggctgtgggtttgtcataaatagctcttattattttgagataatcaatacttagtttattggaataccatcaatacctagtttattccaacaaaagccaatggaaactaatacaaatggaatctaatacctctaataccatcgatacctaatttattgagtgattttagcatgaagggctgttgaattttgtcgaaggcctttcctgcatctactgagataatcatgtggtttttgttgttgtttctatttatgtgatggattacgtttattgattggcgtatgttgaaccagccttgtatcccagggatgaagccgacttgattgtggtggataaactttttgacgtgctgctggattcggtttgccagtattttattgaggatttttgcatcaatgttcatcagggatattggtctaaagttctctttttttgtcgtgtctctgtcaggctttggtatcaagatgatgctggcctcataaaatgagttagggaggattccctctttttctgttgtttggaatagtttcagaaggaatggtaccagctcctccttgtacctctggtagatttcagctatgaatctgtctggtccttggctttttttggttggcaggctattaattatttccttaatttcagagcctgttattggtctattcagagattcaacttctttctggtgtagtcttgggagggtgtatgtgtccaggaatttatccatttcttctagattttctagtttatttgcatagaggtgtttatagtattctctgatggtagtttgcatttctgtgggattggtggtgatatcccctttatcatttttttttatctatttgattcttctcgcttttcttctttattaatcttgccagcagtctatcaattttgttgatcttttcaaaaaactggtttctggattcattgatgttttgaagggtttttttctgtctctgtctccttcagttttgctctgatcttagttatttcttgccttctgctagcttttgaatttgtttgcttttgcttctctagttcctttaaatgtgatgttagggtgtcagttttagatctgtccatctttctcttgtgggcatttagtgctataaatttccttctacatactgctataattgtgtcccagagattctggtacattgtgtctttgttcttattggattcaaagaacatctttatttctgccttcatttcgttacttacccagtagtcattcaggagcagattgttcagtttccatgtacttatgcagttttaagtgagtttcttaatcctgagttctagtttgattgcactgtggtctgagagacagtttgttgtgatttctgttcttttacattggctgaggagtgctttacttccaactatgtggtcaattctggaataattgcgatgcggtgctgagaagaatgtatattctgttgatttggggtggagagttctgtagatgtctattaggtctgcttgatgcagagctgagttgaagtcctggatatgcttgttaaccttctgtctcattgatctgtctaattttaacagtggggtgttaaagtctcccattgttattgtatgggagtctaagtctctttgtaggtctataaggacttgctttatgaatctgggtgctcctgtattgggtacatatatatttaggatagttagctcttcttgttgaattgatccctttaccattatgcaatggccttctttgtctcttttgatctttgtttaaagtctgttttatcagagactaggattgcaacccctcctttatttttgctttccatttgcttggtagatcttcctctatccctttattttgaacctatgtgtgtctctgcacgtgaagtggttctcctgaatacagcacactgttgagtgtcttgtgtcagtctgtgtctcttaattggaacatttagcccatttacatttaacgttaatattgttatgtgtgaatttgatcctgtcgttatgatgttacctggttattttcctcgttagttgatgcagtttcttcctagcattgatggtctttacaatctggcatgtttttgcagtggctggtaccagttgttcctttccatgtttagtgcttccttcaggagctcttgtaaggcaggcctggtagtgacaaagtctgtcagcatttgtctgtaaatgattttatttctccttcacatatgaagtttattttggctggatatgaaattctgggttgaaaattcttttctttaagaatgttgaacattggcccccactctcttctggcttgtagagtttctactgagagatgcgctgttagtctggtgggtttccctttgtgggtaacccgacctttgtctctggctgcccttaacattttttcctttgtttcaactctggtgaatctgacaattatgtgacttggagttgctcttctccaggagtatctttgtggcgttctctgtattacctgaatttgaatgttggtctgccttgctagcttggggaagttctcctggataatatcctgcagagtgttttccaacttggttccattctccctgtcactttcaggtgcaccaatcagatatagatttggtcttttcacatagtcccatattttttgaaggctttgttcgtttctttttattcttttttctctaaacttctcgcttcatttcattcatttgatcgtcagtcactgataccctttcatactgaatgggcaaaaactggaagcattctctttgaaaactggcacaagacagggatgccctctctcaccactcctgttcagcatagtgttggaagttctggccaggccaagcaggaaagagaaagaaataaagggtattcagttaggaaaagaagaagtcaaattttccctgtttgcagatgagatgattgtatatttagaaaaccccattgtctcagcccaaaatctccttaagctgataagcaacttcagcaaagtcttaggatacaaaatcagtgtgcaaaaatcacaggcattcctatacgccaataacaaacagagatccaaatgacgagtgaactcccattcacaattgcttcaaagagaataaaatacctaggaatccagcttacaagggatgtgaaggacctcttcaaggagaactacaaaccactgctcaacgaaatgaaagaggacacaaacaaatggaagaacattccatgctcatgaataggaagaatcgatatcatgaaaatggccatactgcccaaggtaatttatagattcaatgccatccccatcaaactaccaatgactttcttcacagaattggaaaaaactactttaaagttcatatggaaccaaaaaagagccctcattgccaagtcaatcctaagcaaaaagaacaaagctggaagcatcacattaccggacttcaaactatactacaaggctacagtaaccaaaacagcatggtactggtaccaaaacagagatatagaccaatggaacagagtacagcccttggaaataataccacacatctacaaccatctgatctttgacaaacctgacaaaaacaagaaatggggaaaggattccctatttaataaatgttgctgggaaaacaggctagccatatgtagaaagctgaaactggatcccttccttacaccttatacaaaaattaattcaagatagtttaaagacttaaaaattagacctaaaaccataaaaaccctaggaggaaacctaggcaataccattcaggccataggcatgggcaaggacttcatgtctaaaacaccaaaagcaatggcaacaaaagccaaaattgactgatgggatctaattaaactaaagagcttctgcacagcaaaagaaactaccatcagagtgaacaggcaacctacagaataggagaaaatttttacaatctacccaactgacaaagggctaatatccagaatctacaaagaacttgaacaaatttacaagagaaaatcaaacaaccccatcaaaaagtgggcaaaggatatgaacagacacttctcaaaagaagacatttatgcagccaacagacacatgaaaaaatgttcatcatcactggccatcagagaaatgcaaatcaaaaccacaatgagataccacctcacaccagttagaatggcgatcattaaaaagtcaggaaacaacaggtgctgaagaggatgtggagaaatagcaatgcttttacacctttggtgggagtgtaaactagttcaaccatcgtggaagacagtgtggcgattcctcaaagatctagaactagaaataccatgtgacccagccatcccattactaggtatatacccaaaggattataaatcatgctgctataaagacacatgcacacgcatgtttatagtggcactattctcaatagcaaagacttggaagcaacccaaatttccgtcaatgatagactggattaagaaaatgtggcacatatacaccatggaatactatgcagccataaaaaaggatgagttcatgtcctttgtagagacatggatgaagctagaaaccatcattctgagcaaattatcgcaaggacagaaaaccaaacactgcatgttctcactcataggtgggagttgaacaatgagaacacttggacacagggtggagaacatcacacactggggcctgtcttgtggtggggggaaggaggagggatagcagtaggagatatacctagtgtaaatgacatgttaacgggtgcagcacaccaacatggcacatgtatacatatgtcacaaacctgcacgttgtgcacatgtaccctagaacttaaagtataataataataataataaaaaaggtgggaaacataacagattatcagagaagactgctctggataaaaattgttttgtgaaacctttgtgtatgtgtgtcagttcgcagcataaaaagtattcttgctgtgggacatagtcgaaaaaactttaatgctgctgtttttagagagcttctagtaaaaatttagctggtaaatttacattttcttttcctattttgaggagttaatgtagtaattttgtctaatttgagatgtgcttagaattttggtttacagagtaattgtaagaatttaagattatattgaagttataatattttgaggtgacattttagtaacattctcaggtaaaaggtaatgtaagtgagatgcctaactactgtgttaacagttttggcatgggttgaaaaccattataaatattagtggcttattttcctgtgttttatattattttgatcatatttaaacctaggacattaaagtgtaaggaccctcagatttaaatttgaatatgaaataataaagaaattacattaatataattcattgatatgatgtacacaggatagttttattttaaatagaagcaaatataattagctaacttaaggcaaaactctatactgggttttatttcacatgtaactaaaatattggtgattgtcttatttgcttagttatgagtctcaggaataattaaatggtatgagatttttcatctttgtatagtaactgtatcttgtttatgtcagcaatgcctactataggtctggcaaataatataagaatatattctaaacaatgtaaggaattatttattccctttgcttttaggacattgatatttctgaagtatacgtgccacttattttatggcgtatccctcaatttttatttttctgttgttaattcatgatcagatttagattgtgattttttggttagaatactgtgtaagtgacgttgtgacttttgcagaatatcacacctacaggtgcttgatgttcattagccactttttgataatgttaattttgatcccttgggtaaggtgaggttctccactgtatcactactcttttcttttataaataaagagcagtcgtgggtagatactttgtgactatgtaaacatacaattccacgtgagactttctccactttgattcagtatctactgatgattcttacttgattgaacttcttgtaacttttgattttgatataatttatataattttaaacttacagagaagttgccataatgatgtaaggaagccccatatattctttatcctgattcaccaattgtttacatttgttttacgtttttaatctgtaaaatgggggtaataagcgttacctgtctcacagggttgttagttttctttgtcttcttttttgtatatatagtatagtatatatatgctatatactatagtattttatatatattagtatatatacactatatactatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactatgtaatatacattagtgtatatatatactatatactatgtgatatacagtatatatatatactatatactatataatatacattagtatatatatactatatactatataatatatattagtatatatagtatagtatatatactgtgctatgtagtatagtattatatagctattaagtattagtttgtaataatagttatcctttctatattttctattcatttaagctttctgaatactgattattctctgtgaagctgtgtgtgtgggtgtttgcatgcacaaacacatatgaggtcagcaattttatttactttttttattactctgtcatatggccatggaacaaatatttttcaatgacaaagtttaatagaaaaggctctggaaattaagaaagccaatccatgaatacttttagtcatgactcttttaaaaattactttccttgtgcatactctttaatttatttcaattcaattctacagatagatgtagaatgtgcttactgtatgcgggacattattttaagtgctccgggtatagcactgataaaaagggcaaaatcctttgttctcaaggagtttagaatcttaggtggtagtcagcaagcaaataaatactatatgttatgatagatggcaaaaagccctaagaaaataaagtgaggcaagtagtgacacagttcacttattagttttctgttatccggggactgagaatacagtttgttaatttattgaccctgcttctccgtcttctggacgtttgttatgtcagtcattcttactgttagttgaggccaaagaaactgtaatctagaagttatttagtcctctacttagggagtgggtagtgaatgagtctttcaaaatttgatgcaattatccaaaattagtgaatgtgtatgcgtttttctgagacaagtttctatacttttcattcagttatcaaatagtctgtgacccaaaatatttaagtggcgactctaatttgtcctttcttctagccacatggctaaggagttttgtgaatgagtaacacagtcttgattaacatgaggtttgcaggctagcctttgtgtacctatctctagttagtaacttttaaaattagagttgtatccttttgtcagatggctttctaataattttctaaaatgaacataataagtataacattgtaaatatttaaaatatgcaattttgtttgtagttttaaaatcaaaatacttgatagtttcttgtgtgatgatatatattttgagtagtattttccaaagacaatttataatatcaacaaagaaggctaactcatggcaatattacaaatatacacgtatctagttggggaaagaatatactgattggacagaacacttaattggagaaattgggaaaggaggtgccactaactcaatatttgacaatgtatcatttaaccctttacaacttagtgaggcaggtcttattgtgtccattttgcagatgagaatatcgaggcccaaagaggtgaatagaatatgtaacttgcttaaggtcaattagtatggaacttcacagcccacactcagctgctactttagcaaaccaaatgaaagctagggtaatgtttactcattataaaaaggatttctggacatgctttggcctgcagataatattgtatgtgtgacaggtgggaggggtatgtgtgtgtgtgtgtatgtgtgtatgtatgtatgtatgtatgtatgtgtatgtgaagaaccaaccaaatattagctctataggttgcagtcctgcctcctaccaaagccatagccaagtggaaatacaactttttttcttcctctttcatacattcattttcatgtgaatacttctccttgaaagtttgtatatgttatgtgattgatcacttgtctgagaggaatctttagtgttgactctgtcagaggctgttgtaggtcacaaggatataaaggtgaataagactccagctgtctcctaatggagattgcactctactctgaggagatagacatgtagacaaattattgcaatacactgatctaaatgttaatagagaaagatgcagagtgctgagggaacagagtagcagactacagagggaagggaaaggaaaaaataacagaggaggtgacactggagtcaaagaagaggcatgtgaaacagcatagtatgttttgggaatcttatttgtttcactgtggctaaattatagataattagtaatatgttttagaacgtaggagtggaaaggttgttatcccatcctgaggggttttgtatatagagtttggattttattttgtaggtagtaaggagctattggagaattttaagaagggaagtgggatgatgggacgaggttctataggaggcaggtagcccagttagaagactattgtgatagtctgggaatatgtggatgatgagaatctgaaatgagtcatgaattttggaaaatatttgaaaaatatttagaagatactgtagaacaaattaggtgaccaaaatgccttatatttataatactttatagtttccaaaatcctttaggtgtgcatgttattggatattatcagtaacccagaaaagtaggtagttcagatggatttatttccattttatatgaggaaattgagatcttgaaagattgtggcttagccacggtcacatagctggtgatagtttaagcatgaaccaaatcataaacttcaaatatagggttctttttaatttgtctgcatcatctctatgcagtgcctaagcatacattagttaatatcaaggcctgatcacagtggggtgtgagttttaatttattcacttgatatctctcttcattagttatgttaagtgcctaatggagagggataggatcaattaaataaggtaaatgcaacattttacaggtctatataaatacctagaaagtgcttttcaattaagacggcatgtatgccagtgcttttttatatatgagaatggttatgacatttattcctattttattggagagtctattgcatgggacttgataatagtggcaggctggtatcagagactatgcttgctgtaatcagtgttaaagatcagtatgtaaagaatccttacttaacatgtaccatgaaattgattttttattagttattatagagatattatagattatatctctacaacatcttccttctttttacccataacctctaaaaggcttagtgccagaaggaacagaactgtatctttattttctcatcacatcctctctcaaatagataatacttccattgctgtctttccaacttggctttgagtcactgctgtgattctagctgttgaacagtctttcaaattaagtgattagtattctagtcaaggaaaaattgtgagcctgccattcttacccagtattgctaaggtagttttactaaatctattattagggtcatgttctcagaggcatatgacaattgcatttcacaaaacttccctaaatattgatacttgagatttacaggaaattaaatctaaaaccttacacttctgaagctggaggcaccatagagctgtgaagttcagtataaagtcacatctgtgctcaatactttataagaaaagttactctgccttagtcttcctttactatttttgtcttacttgattaaaattttgctgttgtattaactaataaattcaaaggaaatgttctgattagtttctgtcataactgggaacgatagtaagagtaccttggaaagtatgatagtctgttgcgtaacacttgctgggtagtagatatcaattctctgcctgtttcaatctcattgtgtctaaaggtgtgaacctcttaccatctggatactttagtttccctctaaattaaaaagaaaaaaagcaaatcttacctgtatagtacctacgcaaagattttggaagatagtgggaagtcattaaagtgcttttcaccaatttatgcaatttactagttgaaatttgtaactatttaaaaatcattagttttaaaaaatactattttaaaatagtaatttactatttaatatttaaaaaccattggctcttttaatatatttcattgcttggtattagaattttttatttttagaatagagtatatttaaagatgacttttgctgttaaatttgacaggcgtggcaggaggccaatctaataagcccaaagggagaattcgcagagtatgcaggttaaaagagccctggaactgactttctgtgaagcctaggctatccatatacattcctgctgagtggagatttgcttaaagttgactgttttcttccttctgtaccatctgattccaatctgcacctgtcttttatagctagagaccgttggatggcagcttaaccttcagatggctcactctgctcaagcaaaactaaaatctcctcaagctgtgttacaactcggagtgaacaatgaagattcaaaggtaagaaatggtatcccattaaaaggatgtattttgtttgttaggacttaaactttttattcttagcagtctttgctctctggatttagaatttaaacataattcagttaaacagttattaataagtggatcttttttgacagaaatagcttatcttgcaaggtgcctttcttacaaaaacatttcataatgtcttcttttaaattctgcagtgaaaaaaaattgttgaagaccatataaaattatgattttaatgttttaggtatttgcagatattcctgagtgtttcatgttttaagctgaatatatgtggtagagagaatattgtttgttgtccagctagagcctggaacaataaatatgatggtgacctgaattgtgtttttgtgtgtgtagtagtatagtatgcctgcatgtgtttaaatcccagcttttgagaaatacaatttatttattttttttgagacggtgtcttgctgtcgcccaggttggagtgcagtggcgcgatctcggctcactgcaggctccgccccctggggttcacgccattctcctgcctcagcctcccgagtagctgggactacaggcgcctgccaccttgtccggctaattttttgtatttttagtagagatggggtttcaccgtgttagccaggatggtctcgatcccctgaccttgtgatccacccccctcagcctcccaaagtgctgggattacaggcgtgagccaccgcgcccggcctacaattttttttataccacaggattttactttattattaatttcagaacaacttgaacgtgattattaaagatcaaagcattgctatgaaatactttttgttactgcggcatatagggaaatatatctttcagatatgataagagctttttatcatattttatactgtaatggattatcttttaaggtagaaaagggggagtgactttttcctcctaagtagataagactatctcatcttaagacaaaatagaattgagaatgaggtattagagaagatctgaggcaggagattacagtgactgaatgataatagaataatggaagaaatgttattatttataacaggaattgaaggatgggaatattattacttttttgttaaaactttcgctattcattctattatgcaggtttctggcttctttaagaagtatctagcccagattatatgactataaaattctgtggaattgacttgagtcttacatataatgtattagtttattacagtgtttcaaaagtatcattttatttcacacattttcactggaacgtaatatgaacttagtggttagagtcaagctattagagtatgtctggtggtttccctttatgtgcagtttcactttccatagtttcagttacccgcggtcaactgccgtttgaaataggtgagtacagtacagtaagatgagagaaagagaccacgtccacataactttattacactatgttgttgtagttgttctattttattattattgttgttaatctcttacagtgcctaatttataaattaaactttatcataggtttgtatatatgggaaaaaacagtatatattgggtttagtactatccatggtttcaggcctccactgggagttttggaatgcatccccccacagtgggcagggggactactgtgtgctctgcagtttagtgtagtgtaacctcaggcaaattacttaatctttgattctcagtttctttatctgtaaaatataggtaatagtatctatctacacaatttttatgaagactaaatacctagtatatgtaaagtgtttagtccagtgcccagtattacagcgtgtgctcaataaatgctggctactaccatcatcatcaataaaacttttttgtttttggctaaaataaagaaatcaatccatttgttttaattcagagctctcactaaatttatttcctgatgaagttattacctcttcccttgttccttgcattccctctcccttttttcttgattatatttttcacatgtatccttactggaaattaggaggggaaaaagagcctgaaaagtcccttttgtttcttctgtgaactgagtaagttattcctttaggtgtaggatgatgatctggaactcactagcatagactggagctattccatgagtgaaaatacatacatacatgcacattccaagtagctatatacttcctttgttttatttttcgtgactacctaatgttaagtctgcgtagctaaaagcattttgtatgttggaagtgtactattttgaccacatacattggatatgctttaagcatcatgagttcagcaatgcttgtctttgggattctcaagtccttctagcttctttgttacatcttcaaagtatgcctatgtgtctgttatatttttaggcagtaggaataaaagagtaatgcttctagtaagacagccatgttaataagacattcagattattcaggaagatgtgaatatctagatgtgaaatctaactcatttgaaatatgagcttgagtacatttatgtttttctgtgtttgtattttgagattttggatagatgcatatatgcacattgattaatcttataacttgcagagctagagcaccattttcattaacaaatatgctgaggaagaagaggagaagcacacatacataaaagatatttctctttcatcttgtatgtagacttaagtgacttctttgtattgtctttctcttctatggcattgtacacattttgtgcctgtgtcttatatctcctaaacaatagacagacacataatgaggtatagagctaccatcacctaggcagaagcatgccatctccaagtgttatggtgtgccctagctgtaaaggaacagttaactactatacctcttttcctcaatgaactgctgcctggaattactgctctttctcttgtttaccttctccttgattttatgatttggtattctattctttgtactcttcatcttattccttatgttaatttttatgtgactcctgttattaaggaccacaaactacttttctttcaaatatttacaaatatgaaatgagaattcttcacaggttggaatattaagtaaaaaggaatgagggtatagagcatgttttaaaaaacaagtttattaaaggaaaggaaagcttttacaaaaagggagattaaaagttaccactgcttagtttatgatataaagtatcttaaagtacaaaactgtcatacttatgaagttggtgttggtttaaaacaggaagcattgggtacagttctcataaatgtgtattttatagggtagttatcctgaaaatatacatatattaaactactgggaggattagaatcactgtaaattgtgagggattattttggttgtatttacttttgagctgttgtactgaaaacttactgtaattcactgaagagtacggtttataaggagctccttatcttctttttcacttctaacatacaaatgaaaaatgcagcctgcagtgaagttttaattgctatcacactggataacactgtttgactgtggtctcctttcttagaacacttctgtctcgaggctttcctgttttgctattaattttatcacaaaaactaggtgattgtagctttcctgcagtattttgatatgtattctagttgtttttggttaattgtcttagtgtttgtctactgtgtttagcaaagtgagattattttcctgttccacagatacctcaaatcgagttttctgacttaaagtttttttcgttagggggcagtagagtgctttgcttacctagccttttctggcattcacagtgttatttgaaataacattcaaaataatttgtgaagtcagtagttgaaggaaatgctaagtgtttacatttcaaatctttatagaacaatagagttctcttatttatttccataaacaaaattaatgcttattaatcatatacatatagaacaaataaatgaaatcatcatgatttggcttttgaaatttgtatatgatcatttgccaaaatgaaatatattaaaagctttctacattattgacttttttgttacattctgtcacttgtattaatttcttcatgagaaaaaagaataaaatagtccataagataattgaatggctctattaggttatgatgtaactagttctaggcccattgtagtcagctgaaaattctttatttctagagagtaatgtcatttgtaacaaatgttgataattttgactgacaccaacactttaactttgaatatcttaaaatacttaaattttgctattaatcttagtacatttttttccccagtaaatttcctgttaaagacaaacctgttttgttaatacagggattccaaattttatttgtgcatcttttgaggaaggatccttgtgtttcatttttttttcttttacagtaactgtggtaaaatcaccctgacagtagaatttttatttatcttaatgttaaattagattataatcagattgcagaaagtactttatgtagaagtaattatgattttgaatgaatttggggcttctaatactagttttctgacttagagctcttcattcttatttccaaaatatatgacaaattctgtttagtgtgagaaaatgggcaaaagttcttttttaaagtgtttactctgtgctacacatagtatcacttctttttgtggttaaaacctctcttccaggcatgatttcttattattcttattttattgataaatggagacacggaagcacagagaagttaaataatattcccatgttatacagatagtaaacagtagacctaggatttgaatccaggcaattttatttgagttccagtttatcagtaggatgctgtatcaccttgttaatttaataacttagcagttgaaattgtaatatgtgtatatgtttcaaggtgttgaaagctgttgtaaaatgtaaggttgttcataggattatcgttacatggactctagatttaatttttctttcccctttatttgactaagttgaaacaattttacatttttagtcaattagaaacaccatttattcttatgtagtaagtaaagtataaatgatgtcagttcaacagaggctgccttttattaacaaatattattgtaagggctacatgacatcaatgatgttgatgtgagcaaataactgcatcagttaaaaagaaaagatgtcctcagatctatttaggatagatttctcagagaaaaatatgtatgctattcaaatcatgaattcttgttatagaaatttaaatcttttcatcttaaaggtggtgttagtattgactgatttggaatgaccttcacattttttagctacttatgtgagttcgtctgcattttccttttttttttcattgaagtatcacgtatcatatctttattagaataaatcacactaaagcatactttctcacccttaattacacatacaaatgagataattcaactgataggacataattcaaatataaataaaatcattctctcacatatttaacattgttgagtggattttaaattgtatatatttaaggtatacggcatgctgttttgatataaatatacatagtaaaatgattgctactattaagaaaattaacccacccatcacctgccattattaccttttttgtgtttgtggttaaagcacgtaaaatctattttcctagcaaaatttcagtttacgatacaatatcattaattatagtcctgatgctgtacatcagatctccagacttatttatcctacataactgcaagtttatatgctttaacctgcttctccccattttttccctttccttgtctctgataatctctgttctaataggcatttttaaaaaattccacatataagtgagatcatgcagtatttttctttctacgtctggcttatttcacttaccataatgtcctccagattcatccatgttgttgcaaatggcactatatcctttttcaaggctgactcatactactatgtgtgtgtgtgtgtgtgtgtgtgtatgtgtctgtctgtatatatgtctatgcgtatatatatgtacacatatggacacatacacataccacaatttatccattgatagatagttacgttgtttccatatcttggctgttatgaataatgctgcaacaaacatgggggtgcagatatctctttaacatactggattcatcttctttgaatatataccaagcaggagattcctggtagttctaatttgaatttttggaggaaccttcaaactgttgtccttaatggctataccaatttacatttccaccatcagtgtacggggttcccttttctccacattctcaccagcgtttgttgtctcttgtctttttgataatagtcattctaacagttgtgagataatatttcattttggttttgtttgcatttccctaatggttagtgatatggaacatcttttcatgtatctgttggccatttttatgtcttctttggagaaatttctatttaggttctttgccccttttaaaatcaattaatcttagtacattattattattttgctattgaattgtgtgagttccttatacatgttgtatattaaccccttatcagatatgtggtttgcaaatttttcttccagtctgtaggctgtgttttttgttgatggtttccttttctgtacaggagcttttagtttgatgtagttctacttgtttattttttgcttttgttcctcaagcttttggtgtgataattcaaaatatcagactaggatgaacatcaaggagctttttctctgtgctttcttctaggagttttatggtttcagatcttatgtttaggtcttttatctcttttgagtttgatttttgtgtatggtgtaaaggtccaatttcattgttttcacatggatattcagttttcccagcaccatttattaaagagacaattctttcgttattgcatcttctcggtagccttgagaaaaattaattgaacatgtatgcttgggttatttctgggctctctatagtattccttttgtctgtgtatctggctttatgccagtaccatactattttggttactataactttataatgtaatttaaaattaggaagtgtgatacatctaactttgttttactttctcaagattattttggttattccatgcgaattttagaattttttttctctatttctgtgaaaaaatgccattggaattttgatggaattgcattgaatccatatattgctatgggtagtatggacattttaacaatgttaattcttccaattcatgaacgtgggatatcttgctatttaattatgtcatcttcaatttctttaatcagtgtgttatagttttcagagctttcacttctttagctatatttatttataggcattttattctttttgctctcctagcaatggtatagtagcggggggctgggaagaggggtggtggctgggaaagtgggagcacataaataagattgttttcttgatttctttttaagctaggtcattatttttgtgaagaaatgcatctgatttttgtatggtgattttgtaaggtgtatgctactttactgaatttatttgttcatttaacttttttgtggcgttttaagggttctttttctttaaatgtaggataatgtcatctgcaaacaggaataattttattgtcctctctcaagtgaaatgattttttaatattgcctgcctttttttaaaaatcatgattcatttttctgttaccaaagctgtatgtgcttactgtagaaaacttagaaattatagaaacgtgaaaggaaaaactgttaaacttaccacaaagatgcaggtaatccatttgttttattttatttagtgtttattcaacataaactttttctccagtctgattataggacttgtttaattttatattctaccttttttcacttaatgctgtaacaaatcattttttatatcatttcaaactcatcattaatatattctaaatgactgcattatgttatggctatgacagacatattaggatttcttaataattcttaccctgtcaaatactgggtttgtttctagtattttcctgttacattgtaataaacatctttgtgaatatatacttagatgctcagtaaacctttatgcattatgaatgaattagagaagccttcttaggatttagggttattcctcaagaggatgattactaggtgaaagggtataaaccaaaataaaacaaaacatcttatttagtttgataaatggctttctgaaatcattttggggaatatacacagaaacgcaaacgttgcattcagaagatttcttagcttctagagaaagatataacactatttcaaaaataggttctttaataactaggtaattaattactttggattttaggaggccagtaaaaagcccagatatttttgtaatattatagcgccccctcttttaaacttttgtattactttagtgcacaaattaaacaagcttttgttatgtgtattttgttttattatagaacatgtagaaggaatctgatcaaatactcaagcagttagagaaaatagaaataactcttatgtgttagataattgccaagatactttgaaaacaaagcctgcttctttggaatcaaatttatttaaatatttttaaggctttgtgactctggtttcctgattctttgttttgtatcctttttcattgtgatcaatttctcaatgaaattatccttcaaggttttacgttttctaaataacagcaatacagaaatgttttccctcaatttaatgtgtgtttttggtttttttttttttttttggttttgtggtcaacatgactttttaaaagacaatattatgtagtcaggtatattgatacaaatcatatgtatataatttctgcataacgcaatgcaaacttcctccatatatgtgggtgtgtgtgtaagattttttcatatttcaggctgtcaagtggaaagtctacatttatccataataagattttataagctaacaaaaatactgtttcagatgctacttacctttgaagagtgaaaatacacaatattaatacaccattagaggttagtatttatgtggagaaaatgataatagagacttggaggagaaaatctctgttaaaaatactccaaacattttaggcaatttagaattaaaatattgttttactaaaattcttttaaaaattttgtgggattccatagtaaagaaacaaatactgtcttcacttgtcttttctagcttctgaatcgtgtagtctctgaaacccagaggcagttgataaatacagaatttttaaaacagaatatgtttagaagtacctttaaatttcattagataccttttcatgtattagaaatgacagtaatgtaaatgaataatataaatattttgacataaaagtattaacaatgaattagacatctggacaagtaaaatgctcaattcaataaagtaaatatgcactaactttttaaacatcttgaattcagttccagaaatagtttttaagcatttactacatgtgagttactaggcaaggtattcgtgatataggcaggttttattttctgtcatggagcttatgggctagcaggaaatacatatgttaagccagtaaatataagtttgatgactagtacaaaggaggaagtacatggaaaccaatagcaaggaattagaaactgtgacaggcagagaagttttcagatggaggaaaaagcacctgaaagacgacaggtttattttttgagcatttcaaatatggaggtacctgagatatccaggtggagattgtcaggtttgtagtctgagacatgggagcaaattgtaaactagaaattgaggtttggaaatcattgagtttataatttcagtcatgagaatggaagagatcacttagaggatatattagaactaacatttaaatgacaagtagaattgaaggagcttatgacagtgattgggaaggaacagccaaataccaaaggaagagagcatttcttaggggtgaatcatgtcacatgttgctactaagtaaagttagagggaagcagggtcagagagagaagataataattctcacagccatgaagtaggtgctagtattttcctattaactagatgaagaaacccagactcagtggttaagtatctttctctaaattggatactagaaagtgatggtgctataatttgaacccaggtctgtctgactccatagtctgagcttataatcactacatagtgttaaaaaatgaatttagtgacatggagatcattggtgatcagtttgtgggacaggagaaggaaatatttcaagatggagggcagtattggatgctatttgagaggtcagaaaagagaagaatggacatgtgactgttggattttgtaaaatggacttctctgataacctagacaattatgatttcaataacaattgagaggagaagaaagaaacctaattgggataaactgacgaaagaatatgaggtgagagtggaagtagtgatacaggtaactttcggaaataggacagtttatgtaggggaatgtggattcagtaaatggagatactagaggaggtttgtatgcagatgccacagatccattgggggagaaaatgatgcagaatggagagggatatattaatacatttcttgagaaagtgagatgtgagattcagagcacaaacggaaaggtaggattcaatcagagtgggaacatttcacttgtcttcatagagaagagtatgggtcaggtgagtggttttgatggtggaaagagaaagttgcaatgatctgattgcttctgttttctcaatgctgctgtcatgaggttgggagaatggggcggttctagtaggtttgagaacagaggacaaagtgtgaaatggttattttggatattggacaattgaacaaactgggtattttagggtatttttactattactacacagtgctgattgcccaattgtgatttgtgatcacgactttgagaggagaactgttggcaggttgtgtagttttcttcatctatttttaattgctcaggtgcacatgtggagtaggtggataattgggtttaatcatgcttttatctttgccgggtgttgtcagtggagggtgaaaaggacaaagggtttgtctgtgtctatgaaagagtaaattttagtaactgaccctggagtctaaattgggccaggtggaaagtgaggatattgtgtatgtgtgttcggggcagggtggtaagtgatgagagggagaaactatctagaaatatgctggaacctagccatactctctgatgtggttaggctttgtgtctgcacccagatctcatcttgaattgcaatcctcacaatccccacaatccccacgtgtcaagggagagaccaggtggaggtagttgaatcatgagggtggttcccccatgctgttctcctgatagtgagtgagttctcacgagatgtgattgttttataaggggctcttacccctttgctcagcacttctccttcctgccaacttaagaagaaggtgtcttgcttcctcttcgccttctgccatgattgtaagtttcttgaggccttcccagccatgctgaactaaactgtgagtcaattaaacctctttcttttataaattaccctttcttgggcagttcttaatagcagtatgaaaatgcagtaatacagctttcctagaggtttatagaggagcctcaaatagatgcattattttccaggatcactcagtgacttttaatttgagtcttgagatgtctgtggcttgacctggtgtacagtttatctgttaagacaaagaagtggatacatgtaaaacttgaaagctggtcttttgcgaacctttaccctgcatcaccttggaaacaagtggtctaattatatgaagatttattctgtatcctaggagttcccaatgtgtgtccagtggctactcgttgatctcttgcttccttggttgataatatacccagcatctgctggagatagtagagtattaatttcataatgagcccattaccccagtgatactatatccagaaatcaattaaaatgtgagaattttgtatgttgtttgaattatattagcttttgaacatcagtggtgatttttggaattgtttttctgaatctggtattcttattttgagggtattattgtaaattttacttcaagacagagtaaagatgtctagattaagttttcttatgagtaatttgcattattggatactgaatccagtcccaattattttggcaataaaaggagttgacaaacacttctttcctggcatagtttaaataagattttaagcatgtttacggtgttagttactatgtgaatacttaaatatgtctttaatggattgtggggattttagtcttttcagattttttctttcctttatatgagaattatttagaggaagttaaacttatatgaagaggaagaatacttgtaactatatatttctcagaagaaattattgggcacttttggctgttttgatggtattgggagaagggaagattattctattaagttttcatataaaatctctttatttttgtttttcaaagtttctcagctgtccttaatacttatgatccaaagctgcaacctttcagaaatgccatgtccatattttaaaaaactaaaatgctttaaggatttaatcagatcctcgagtcttatatcacaggacttatttggaaatgtggccatcccgagatagctaatgatgatgagtctggtttgggtgttttctttttgcatatttagcatcaacccagcaccatcggttctgtgtttttggtgtgtatctggatgatgtatttgagaatctgctgaagacagctgttcggttagtgcacaaggaacagtcaattttagttactttatcatatgctggagattgatattcataaagcagtgggaatataccgtaactagggtcattgatgaacaaagggatagaaatggggttgatgaagcagtattattctttatctcacgaattatcctaacctttgctaccagcacaaagaagagacagataggattaatataatcgaatttttacaaactcattttaacttgcttgtttcgtaaatgtttgattcctaagtataatcaatgaatagcaaattatacagtattttaaaaaatatatcatattttaagcttttaaaaattggttgactatctgaaattgacataaattttgcttatagtcagtaactgctattatgacatcagtgaaactgtatgttgtgattgttgcggctggttaaccaaaacatgtatttcacaaatgacatgtaatgggtgaagatgaaatgtaatggaaaatgaatgtgtagaaagaaattcttgtttatttcatgtttaaagaaccttgattttgtcttttaaaaaattattttatactttttaaaaattacacaagtaatttacattgaggaaaaataaaaaaatgtaagaaaataaaattcacctagaatcctacctagaggtaatcactttgagtgacgtatttaattggcatatatctttccaagtctgtccattgtaaactagttgtctttccccataaagcattatattgtaaacaacatcttttattgtcagtacatgagcttctactcagcaacatcattttaaatgactacataggattctgttgtttgtatgttccatttcttatttctttttttggtaaatataatttatttattcaaatagtccttcagcagtacatttgcctttaaagccatatttaaaatactatatactaacatgttgactaaagtgatcaagaagattttagaaattctattcatgtaaattctgttggaattctagtaattgctaaaatattagatttttattgctgagagacttcctttttcagggattaacatgtttagacatatagtttagaatgtcttttaaaactatatgtgtgtttgttaattcatgaggtttctaaaccatgagattttgctccttccctttcttcctctctttctctttccccctcttggcttcttctttatgatagagtagatacgaagtttctttcagacataaagaagttctaccctatccattataaaggggtaattttacccatatttaatgtgctgctacctccttggtgagagcagtaccataaatatcccaggataacacctttgttgttgtcaacagtaaaatgaccagaattgtctaggtacaacttcatttatggaatcagcaaaggctggtggaattttctagccgaaagggatcttaagtggatttgtcaatggattcttttttttttcttttctgacaatggattcttaatatgacaccaaaagcatgagcaatcaaagagaaaagataaattgaacttcattaaaattgaaaacttttgtgtatcaaagaacattgtcaagaaattgaaaggacaacctgaagaatgggagaacacattttaaaattacatatattatgggatttgtatttgtttttttgtattttattattattatactttaagttttaagttttagggtacatgtgcacaatgcgcaggttagttacatatgtatacatgtgccatgctgatgtgttgcacccaataactcatcatgtagcattaggtatatctcctaaagctatccctcccccctccccccaccccacagcagtccccagagtgtgatattccccttcctgtgtccatgtgttctcattgttcaattcccacctatgacatagtgagaatatgcggtgtttggttttttgttcttgcgatagtttactgagaatgatgatatccaatttcatccatgtccctacaaaggacatgaactcatcattttttatggctgcgtagtattccatggtatatatgtgacacattttcttaatccagtctatcattgttggacatttgggttggttctaagtctttgctattgtgaatagtgccgcaataaacatacgtgtgtgtgtgtctttatagtagcatgatttatagtcctttgggtatataccgagtagtgggatggctgggtcaaatggtatttctagttctagatccctgaggaatcgccacacagacttccacaatggttgaactagtttacagtcccaccaacagtgtaaaagtgttcctatttctccacatgctctccagcacctgttgtttcctgactttttaatgattgccattctaaccggtgtgagatggtatctcattgtggttttgatttgcatttgtctgatggccagtgatggtgagcattttttcatgtgtgttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtcgttgcccatgcctatgtcctgaatggtattgcctaggttttcttctaaggtttttatggttttaggtctaacgtttaagtctttaatccatcttgaattaatttttgtataaggtgtaaggaagggatccattttcagctttctacatatggctagccagtttccccagcaccatttattaaatagggaatactttccccatttcttgtttttgtcaggtttgtcaaagatcagatagttgtagctatgcagtgttacttctgagggctctgttctgttccattgatctatatctctgttttggtaccagtaccatgctgttttggttactgtagccttgtagtatagtttgaagtcaggtagtgtgatgcctccagcttttttctttttgcttaggattgacttggcaatgcgggctcttttttggttccatatgaactttaaagtagttttttccaattctgtgaagaaagtcactggtagcttgatggggatggcattgaatgtataaattaccttgggaagtatggctattttcatgatattgattcttcctacccatgagcatggaatgttcttccatttgtttgtatcctcttttatttcgttgagcagtggtttgtagttctccttgaagaggtccttcacatcccttgtaagttgcattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgctagtgttcaaagtgaaagcttccagtttttgcccattcaggtatgatattggctgtgggtttgtcatagatagctcttattattttgaaatacgtcccatcaatacctaatttattgagagtttttggcatgaagcgttgttgaattttgtcaaaggccttttctgcatctattgagataatcatgtggtttttgtttttgcttctgtttatatgctggattacatttattgatttgcgtatattgaaccagccttgcatcccagggatgaagcccacttgttcatggtggataagctttttgatgtgctgctggatttggtttgccagtattttattgaggatttttgcatcaatgttcatcaagcatattggtctaaaattctcttttttggttgtgtctctgcccagctttggtatcaggatgatgctggcctcataaaatgagttagggaggattccctctttttctattgattggaatagtttcagaaggagtggtaccagttcctcctcgtacctctggtagaattcggctgtgaatccatctggtcctggactctttggttggtaagctattgattattgccacaatttcagagcctgttattggtctattcagagagtcaacttcttcctggtttaatcttgggagtgtatatgtgtcgaggaatttatccatttcttttacattttctagtttatttgcatagaggtgttcgtagtattctctgatggtactttgtatttctgtgggatcggtggtgatatcccctttatcatttttgttgtgtctatttgattcttctctcttttcttctttattagtcttgctaatggtctatcaattttgttgatcctttcaaaaaaccagttcctggattcattaattttttgaagggttttttgtgtctgtatttccttcagttctgctctgattttagttatttcttgccttctgctagctttggaatatgtttgctcttgcttttctagttgttttaattgtgatgttagggtgtcagtttttgatctttcctgctttctcttgtgggtatttagtgctataaatttccctctacacactgctttgaatgtgtcccagagattctggtatgttgtgtctttgttctcattggttcaaaagaacatctttatttctgccttcattttgttatgtacccagtagtcattcaggagcaagttgttcagtttccatgtagttgagtggttttgagtgagtttcttaatcctgagttctagtttgattgcactgtggtctgagagacagtttgttataatttgtgttcttttacatttgctgaggagagctttacttaaatgaatatagaagaagaataccacttccttaattactaatattctattgtaggctacttgaactctctccctgtgggattttttttcacagtgacctttcagagagtatgagctgtgaaagaagaaatccacagggatagtatggcagtgtgccaactgtaaatgtagataaaaaatctggctactatatcatcatcctcaattttaatactttgtatttacttagtagctttcagctataggactcaaaagtctacaaatagcctcaaaacaccccattgaggcaagcatagagtaatcattattttttgttaaaagaggaagtgaatggtgttatttaattgtcagttttagaataagagaataaaacatcttttaaaaatatgctgctagttacagcatggtctttttttaaaatgagaaaccagaagtttttctccttcatgttaagggatggtccaattttcatccccattttcctttggttatttttgccacttttttactgattgtaattatgtgttgacctcatttgattctaaagtataagaaaatatgagaattataagcataaactttaagtagtttcattgacctattttaatttgtgaaatctttttttgctataaacagatgagtacaataatttataggtagctttgtgagtgggtattttgtttccagctatacagaagttgcataatagctacccactcaggtattttagattggcatggtagtaactgtttaataataagactgctactacataatagcatatttgtgcatcttttcgacactacacatgaatgacctttatgaataaaatagtgctacctaattctatatattttggctatatgtttcctaaaagtgataatctttggagatggacagatcttacataggttaagatacaggataagtttaaaaatacaaattaaaatggagtctaattaatagtcgttcctgaaaaaatataagcctttcccatgaggacattttctgtcaagaggtaagtgtgggtcaggctcatttggaggctgagggggcatctgatttcttcataatattatataaaatttgtgagtggctaagctacctcattgtttcttctgtggataagggcctgctgccttgaattctagtcagcctggatgggtggggctgatctaagctgagggtcttgatagctgcagagcacacagtaatcatcatacctgataacaccatattgaaatgatcaagacaataatgataatagatagcatttattgaccaattaatatgtgccaggtattgttctgtgggcttttatgtttttttctcattggagctttgcaattaataagcagtgagttacttcttttattggcccagagggctgaaaataatttgcagcttaataaagtagctactttgcttctatagtgattggtttgccacctgttttaagtgtgggccatggcttctctaataaaccctattctttatcttgctcttaaacattttgttttgatagccatgaaaccctcctcagggtaggtgatttatttccatttgccaaatgtgaagagtgagagaatgaccttgataaagggttgggttgagaattgttcctgtttttttcctggtggggctttacgggtgatggagcacttagaatactagagaattagagaatttaggggcataaaatagaatccatactggattttattagagcttagccactcaaccacaataaaagtaggcaagaggtcagctgagatactgattgacttcatatgcccttggaacagacaggcagtgtctgaggggacctgagttcccagccacccagcctcaagctgcgttattacttaactgctttgtagagtgtaaacattatcattttctgtcagtgccagaatgtgagttaggcttgggaagcataatttcactcagaaatggaaagaagaagaaatgttattttgttacttttatttttaaactagttctctctcctattgtttaattgatgatgagatatataaatattcatattggatttaaaacttgaaatttgtactgggtagtttattgttagtgatgtcaaaagttatagcataaaagttacttgcataaaagtgtaaacatttcctgagcaatgcaatatgtggccaccagtcagttgtgttagttgacaaagggcaaacatgacctgttttctgagagtgctgttcacctgggttcttttcattttcagtactccttttggagaagtttggtttactagtagtttcaggtaatctttggagctctgatataaaaattctttcagatagtttaggtaagacttatacattaagtgatttatatggcaagttggcccaaagtcgtatacataggccacctttattcatcacacagttttccttaatcctcatctctgccagccttgaccacagaacttacttttctttttctttttctttttgcacatacattttaaagtgagtgatagcccttcatttttttttttttaatatacagtgggacctcgtttagggagggatggaatttagggtctcactttagtgcaaaaggtaataatctcagagacaaggctgttcttgagagggagcgggagtgctttgggaaagtaccacattggatcccagtataacatttctaaataagtccatgatagctatgctatttttctttagcagttttgttggaactgttgctgtttctttagttaagcactcagaatacatttatgtatcttttaacattggtatcatctttagcacacatgagatcctggaaacatatgagaccttggcatacattgactgagtaaacagcagattcaccttttccatctcacagtcactctagggcttacactttttcaggggaattgtggacttaattgtctgcattatttagttattctatttctggttgcagagtttatagttgaattaatacaagtgaatcatagttaaattcacataaatatgaagtttctattaactgatgacttgggttgtttgtgcattgtccttatgttttatttatatatgccatcagaatcttcagattctcatttctttgaatttaaaaacgctactattttcattaagaaagtctcctgtctgtttccattttctactgattttagcatcagaggctgttaggggagataaaagattcttaaatatatattctatatttgttagataaatgtatttttgtaaaaattttgtagataaacagacatcctgtgtattctggtaagaaaaagagaggatagtatagatgattgctgctaatttttaaattgacaaagtgaggaatgtgactatattggtttaatgagtgcctaatttgaagaattctaacatagttgttttttcccctccatatgtgttgattgtgattctattgctttcagccaaattattttaattagatttagattcaggaatgactgcctcccacagtttctactcttgtaggctttacttacactgctttaaacaataggggtttacctttatattaggagcattaattatctattaattttcctcatttagaaccattaaatttaatatatcacatttattaatataagagaaaattatagaagtcaattatcttaacaaattgaggtcctacaatttttgagaagtgttaagtttattatatttaaaaaagtctagctgaggattactatttgtggtttcttttttcttcatgttaataataatgtagagagtgcttagactttgttactaaatagctgtgtgccctgagaccaaaacatttcacctccctggccttcctgcatttatgtacaaaataaagggttaagctgtcctactatccagttccaaaataactctgtattatatttttgacaaataatagagaataaggtgaaggaccagtggtggcactggtatgtagtaaaaacagtacagggtttgttatcacactgtcttgacacttaggaagttgctagaggatgtcaagcagattacttaactgattgaggctcaaattctgatctgaaaattggaacaatagtaggtgcctcacaaggtttttctggaaattaaatatgacagcaaatataaaagcatctattacagtacagtttcattcattgatatcttcatttccttgaagaggtctttccagattggggctggagaattaaaatgctcaggttcttacaacaccattatttgagctggaaaatatgccctttaagcaacattttcgttctacttcatatctatagaaagttgggggcctgaaggccttttgaattttgaatactttccatctcttttagtctaggtggtatcactttggccagtacaactcttagaatttttgtaggcattctttaatctaattccataaccccctcaagttagaagaagttctttataattcttttagagacattaacaaagggttttgtagttactcttctgctttgatctgtcccagactatattgtatttggagactattttgccagcttatacactggagatgagaagagttgtattttccaaccctgcacagtccttgccccctttattttttctaaattctccttgtaactgatcagttgtttgtttagctcatctctttgttgccatattgccttatggtgtacagttaggaacaaccagttgattttcagttttctgcctagagatctcaggcaaatccaaatgtttattaagtaaatatttcatcctctgagttttatagggaacacaattttgccgattttttgttgctacatatcagaagttcctattttttcagccaccaataacaattttttaatgaatttctagtttttcctaatagattgctcactgtttttcaagctgaaggccactgtttaactccaaaaccaatactacatattttatttttatttttttaaattgtggcaggaccttacctttggtaacatcagttagctattgctaataacataccatttcaaaatgtagtggtttaaaacaataaccatttattattgttcacaagtctgtaggtgggcaaggcagttggctggctgggcttggctgatccaaggctgacttgctcatgtttcagcagtttgccgggtctagtttgggatgattttaatcagtgggatgagtggactttatgtcggttatcatttagcaggttaccctgggctgttcacttggttcagagacagcagaaaagatgtaggataggtctttggagatctggtacagaacaggcacaccgttattttcatcatattctgttggccaaaggaatttgaaagaataggccagatttaaggaatagggaagtagattctaattgttgatggaacatgctgcaaagtcacacttcaaaggttatgtttatagtgagaggtgaagaattggagtcatttttgcaatttaccaaaatatatgtgtttaattttaaagtagttgtacagtttatactcccaccagcagtgtatataagttgtgattgttctacatcatgtccagaactgctagtaacagtctttttagttttagctattttggtgggtgtctagtggtattttattgtggttttaatagtctcaattgctaagatggctttcctttactttttttttttttttagtcaaccatttgaatatctacttttgtgaaagggaaggggaggtgtgcctccaaagtctgtgttaccttttgggctgccatttcttctagatcctggcctgtaaatcatgacttgttaactctccaaggccttcaagcagatgcctgcctgcctgcagattccttcctccctccctcccttcccctccctcccttcccctccctccctcctctccctccgtctcccctctctccgtctcccctctctccgtctcccctctctccgtctcccctctctccgtctcccctctctccgtctcccctctctccgtctcccctctctccgtctcccctctcctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcctctctccccctcccccccctttctccctcaggctgaagtgcaatggcgtgatcatagctaacggcagccttgatctcttaggttcaagcgatcctctggcttaagcctctcaaagtgctgggattataggaatgggccgccatgcttggacagcaaaacttttaaaattttcattttaaattatgttttcttaagtgtttttacttaatccttagtgtgaaagtctcctattactgaaagactaattcattcctgtctttgtagttttgactttcattaatctaatggatttgaggatccacatctaaaactttaagaattaatgtacattatgtaatgtcatttgccttgcaaacagttgtttttttttttccccccctgaggtcagactaatttattgacagttttgttgtgcttgacaagtaacaggtgctaacatctttttcagtcttgtcacagggactagagggtctaggtcaccatgttcattaatgtagtccaggaaattttatttctcctgtggctaatcatttacatttgacatgaatctgtcatctgtgcctctagtctctctgcttccacctttgtcttctatagtgtgttgttctcataatagtcatacttttaaaatataattcagattatttctttgctctgtatattttacaggctttccttataactcaaagtgaaacccaaaggcctgtaagaacccacatgatctaaactcatgctgcctatttgatttcacctcttaccttgtttcccagcccctccactctgttatgaccatagaagttgccttgtttttcctgacactccaaaatgctcttgcctcatggcatttgcacttttcatttcctcctctagaatgcttcttccctagatatacacatggattgctgtttcccttctgttaggtctctactcaagtatcattggagagaggcctttcctgaacatacattgcaaatacttgcagtgtccctcctgtcactctttatccaagttctgagctaggtgctgagcagataaaaaggatattaaggttcctgctctggacaaagtcagtgatgtgagagaaaaaggcttgtatgcagtgcagttaattgggaaatgtgttaagcccctaaagtggtgccccaaacactagatgcttgtacatgataatgaactgtggaggtttattccaagtacaggctgagtgcagagatgcatggggttgatattgtctagatccatagagaagactccacagaggaaaacatctttgaattaggccttaaaaagtaagtgaaaaaaggaatgcatggtctgggtaaaaggaagagtatacacaatgactaaatttattaagattgaaacttaaatgtattgcctggaaaaatgcttaattctcctccctagtggcttaaaaaaatagttagaaaacatgtcatttacaatatgaatagattgttccaataacattgtattatgacttttcaggatggaatagttatggaccaggaattggaggcagtaaattacctaatgtgatgttgatatgcgagacacttataaatggtagtgaattatagaggtccatttcaagtgcagtgggatagcaaacaagaggttgttttctgcccatttgcctcctttactagacccttgaacctattttctgcctaaagagtaaatgaaactagaaatagagatatgggagagactgtaatgagtatttagatatacgtgttacagaattgttacaacttttgctgcaggttactgttttgaggacaaactatgagtttttaaaaaatataaatttactctgaaaatttagctcaaattcatttgttaatgaatttgttcctgcatttggcaatgagctaaatccattgtattctgaccttctcatagtaacttagcatcctaatatcaggtgctgtattaaaatgtgaagaagacaagatgctctttttaattaaatgtgattgataaagctagaaagacaggaatgcaactgaagttggatgagtctcttaggtacaaggtaatagatttatactctttaacagctggtttgattgcatcagatctaaagattttatttgaagaaaaagcctaaggaagaactgctatctgtgaaagtacaaagtaatgcctgtattgaaaatgaacaatctgctgatactagaaacttctttatttttaaagcctgtataattttcttggtcatcagaaccttggcatataaaaatttcagaaatctcatggctttaattaaggcaacatgcattctctgtaatgaaagtaggaagaggatgtaggagaatgtttcaggttctgttttctgcctctctgttacgggaagcagtgtgattcagtacaattgttctcccttgccagttggtgaacctgtgctattctgtgttgaaaatattggtatgaggcttttttccccagaaggcttttttcttaatttcaggtatttttttcatgttaatatcatttttaaaaaaataatactgatggtaaatagtagggctttgaaaaaatatctcatttcttgggaaataaaatatttatgggcccatgaagcctgccggttggttggtttgtttttggtatatgtgtatgtgcatgtgtatctgtgtatcgtactgatctgtgaaatctaaatgtctgaaaactactgattatgtagaaggatcatgggctttggattcagcaaacctggtttaaattctttctctgctttgttcttatcttcgtcatctttaaaatggggatgtgaatgcttatctcctagggtggttgtgagaattgactaagataatggatatataatggtttagtgccggctgtataatagaagctgaataaatgtatttcttcctttttcttataagttgttggggatagagagaatttcaggtgaagttacaagtgcagttgacccttgaacaataccgggtctaggggtaccagcccctgtgcagtgacaaatcagcatatgacttttgactccccgagacctttattactagttgcctactgttacccagaagccttaccaataacagtcaacacatattttatatattatatgcattatgtactatattttagcaatagagtaagttagagaaaagaaaatgttattaagaaaatcataaggaagagaaaatatattatttcttcataaagtgaaagtagaagcagatcttcataaagatcttcatcctcatcatcttcatgttgaataggaggaagaagagaaagggttgctcttgccatctcaggggtggcagagggagaatagacggaggaggtggaaggagaggcaggtgcacttcatataacttttatggaaaaaataaactcacgtataaatggacccctgcagtgcacacctatgttctgtgggcttttaaatcatcttctgaaaatatgctgctagttacagcatggtcttttttaaaatgagaaaccagaagtttttctccctcatgttaatgatggtccaattttcatcccatttaaattggttattttcgccactttttgactgattgtaatatatgttgacctcatttgattttaaagtacaagaaaatatgaaaattataagcatgccccttaagtagattcattgacctatttaaatttgtgaaatcttttttgctataaatagataagtacaataatttatagatagctttatgagtgtgggtattttgtttccagttatacagaagttgcataatagctacccactcaggtattttggattggcatggtaatgactgtttaataagactgcagtacaagaaaatatgaaaattacaagcatgcaccttaagtagtttcattgacctatttaaatttatgaaatcttttttgctataaacagatgagtacaataatttatagatagctttgtgagtgtgggtattttgtttccagttacacagaagttgcataatagctgcccactcaggtattttagattggcatggcagtgactgtttaataagactgctactacatagtagcacatatagataagtgatatatctatatatgtacataaatagattttctctttttatcatttatcattctctataactgagcttaccaatttagaaataatttggttgaaaacgttaaattgtagaaaacactataattagcaacaaaggtgtgtacttttctatccagagggacagtttgtatactgtttggtcaattttgtgagattaagttgagaaacctaagtgttttagagacatagtggtaaatgtctccatcagtgttgggttatcgcacagaacaccttctagggtctacttcagagtagtagttttggaactattttagatacaacacctttttaaaaaattatcagatattcagagccctaatatgtatctgacaaaaatggagcaactcttgttgggtgaatgggagtgaaggagccaggcattgttaagaatttgtcctgcttatactcctctctcagtttctagaaacctctctgccacctgtggggctccttaccacttctttagaggttcagataagaagagtcttgacttaaagactaagctaaaggaaatactaattattttaccagagtgagtaatttttagataattcagcattagatatatacaaataacttttaatatcaaaagatagaatgtatttcttagtgtctagtagctggatcttagatttttaaaagcatctttgtaattaaaaaaagtattggcgttttcttcttgaaaatgtcttataatttaaaaaaagataaaccagggccaggcatggtagctcactcctgtacttccagcactttgggaggccgaggcaggtggatcacccgaggtcaggagttggagactagcctggccaacatggtgaaaccccacctctacttaaaaaaaaaaaaaaaaaaaagccaggcttggtggcggatgcctgtaatcccagctactcaggaggctgaggcagggaatcacttgcacccgggaagtagaggtttcggtgagccaagattgcaccatcgcgctccagcctgggcaacaatagcaacactctgtctccaaaaaaataaaaataaaataaaataaaccaaaaactcaacacaaggaaactatcttgatgattttgtgaatagtttatagtatatagggttaattttatggtatggcattattgaattagtcagagattattcttttattataaagcactaagttatgtcttcttaaaccactttttgtttagaatactttctatgcttttgagtaaagatgaaattatatgtcttttttaattttttaaattgaatgatgttcaagggaaaagctacccagtttccatttgtgtgaaatttatgtatatttttggttttgtcttgtatatgagtaaataaacgtagtttctaccctttttctaccctttcccattgaagttacaggtttatctacaaaggggtgatggaaatactttgtgtaactattttccttagtcaatataacactctgaggccaggcctggtggctcacgtctgtaatcccagcattttgggaagctaaggagggcggatcacctgacgtcaggagttctggactagctctgcaaacatggtaaaaccctgcctctactaagaatacaaaagaaaattagctgggtatggtggcgcacgcctataatcccagctacccaggaggctgaggcaggagaactgcttgaacccaggaggaggagtttgcagtgagccgagattgggccactgcactccagcctgggcaacacagtgaaactcggtctcaaaaaaaataaaaataaaataaaaaaccactctggattaatttctattttgtatttctggttaatttttcccctacctccaaataagtgggggtaattgacagttgttcacacaaaggttaggtaattctataattaatttttcattggtttagagaagtcttctcagtgagcatgcctttgttgtcaaatgttcatgccattactgctaatgaaataaaaatgttaagcaagaacagtaactgtctattttagtaactgtctattttcagttactttttaaaaccctaattataaaagccaacttgtagtttacaaatgaccacatgtatctttatttcaaggaaattctggattacttcatgtatttactcataataatatctgaaatagtaaaaagagtgtggatctgggtatcaccacttaactaagagttagttgcaaaattttgggggaaaaatttataatgttcttaggggggttgtgttgcacagctcaaatatgatattttatgtactgccacttaataagctataatgtgcccttggcaaggaggatgaagaggaggtatagcctgagccctggaatttgtctgaagtccttgcagactaaagtacccatgaagacttggatttacacagaatgaatcatggccaagacatgaaaagtcagtgataaagtcagtattgatctcagtctgtagcttacagcttttctaattttttaaacttatttaagtaaagtgtatatccctctcaagtttctgacatatccttatgctgttgaggcctgaagagaatctctgagactaagatgagaattgtcattgagcaatgaaaaggaattaaaatgagaaaagtctgaattatctggttccattgatgagggagtgcctatggtgaaaagcatacctcaggctatttaaaatatccccttaatcgagttctcctggctttcatgctttgcttgaaacacagctctgataatgcatatttttggtaattgtatttaaggagtatttttggtaattgtaatttcttattacaaattaatagccactcacatacatcttatgtacttggtgtattagtctgctagggctgccaaaacaaaatatcacagggtgggtagtttgaaaaacagacatttatttctcacagttctggaagaaagtttaaaatcaaggtcttggcaaatttggtttctggtgagggctgtctttctagcttgtagatgcctgtctgccttgtcttcacatgatctttcctaagggtgtgtgtgtgtgtgggtgtatctgtgtgtgtgtttgtgcgcacacacacgcgtgtgcacagggctggtagagagtgagctctctggtgtctcttattgtttctttttcttttttcttaccttgttattttctaatctagtcttcagagagatggtgtctcttcttataaaggcactcatcctaacagatcagtgctgtacccttgtgacctaatttaaccttaaatacttccttagaggccccatctccaaatgcaactacactgctgtttagggctataacatgaattttggggtatacaagaattcagttaataatacttgattaccctttatctgcccctgagagggtggttcatcttacccttttttagtcaaatcacatttggtaacatgaattgaggtgggtcagctatggtggcagactcactaagagtgtcatcctcaactatcctgtattgcttgtggcatacctagacattctatggccgaaagagcttgcatgtttaaatatttctatagttttagtccttggcacatggacttgagtccatttctctgtcaaatggcgatagttgttcctcagagttgttactggtcataatttaagggaaaatatattttgaaccataagatgcaaagattgttttttataaaaatgtacaatgttcctttttctattatttgtagagcttaaggacttgaatccagatcttctaattacaagtataagactctaagtagccagacatacccatttttttcaggataattggaattctccatagacaagcactctaggggaagttctggcaagttttatttgcaccatgtaatgcattgaaataaattgtaccatctaataaattgaaatgctgtgcgtttagccctcaagctctgttaagggacagactgcctcctcaagtgggtccccggcccccgtgcctcctgatggggtgacacctcccagcaggggttgacaggcatctcatacaggagagctccagctgacatctggcgggtgctcctctgagacgaaacttccagaggaaggaacaggcagcaatctttgctgttttgcagcctcctctggtgatacccaggcaaacagggtctggagtggacctccagcaaactccagcagacttgcagcagaggggcctgactgttagaaagaaaactaacaaacagagaaaggaatagaatcaacatcaacaaaacggacatccacacaaaaaccccatccgaaggtcaccaacatcaaagaccaaaggtagataaatccatgaagatgaggaaaaaaaccaatgcagaaaggctgaaaattccctaaaccagaatgcccattctcctccaaaggatcacagttcctcaccagcaagggaacataactggttggagaatgagtttgacgaattgacagaagtgggcttcagaaaatgggttataacaaacttctccgagctaaaggagcatgttctaatccaatgcagggaagctaagaaccttgaaaaaaggttgcaggaattgctaattaaaataaccagtttagagaagaacataaatgagctgatggagctgaaaaacacagcacaagaacttcatgcagcctacacaagtgtcaatagctgaatcaagcagaagtaaggatatcagattgaatatcaacttaatgaagtaaagcatgaaggcaagaatagagaaaaaagaatgaaaaggaatgaacaaagcctccaggaaatatgggactatgtgaaaagaccaaacctgtgtttgattggtgtacctgaaagtgatggggagaatggaaccaagttggaaaacactcttcaggatgttatccagaaggacttccccaacctagcaagacaggacaacattcaaattcaggaaatacagagaacaccacaaagatactcctcgagaagagcaaccccaagacacataatcatcagattcaccaaggtggacatgacggaaaaaatgttaagggcagccagagagacaggtcagggaagcccatcagactaacagcggatctctcggcagaaaccctacaagccagaagagagtgggggccaatattcaacactcttaaagaaaagaattttcaacccagaatttcctatccaacctagctaaattccataagtgaaggagaaataaaatcctttacagacaaccagatactaagggattttgttaccaccagggctgccttacaagagctcctgaaggaaacactaaatatggaaaggaaaaactggtaccagccactgcaaaaacatacaaaattgtaaagaccatcgacactatgaagaaactgcatcaactaacaggcaaaataaccagctactgtcataataacaggatcaaattcacatgaaacaataattaaacttaaatgtaaatggactaaatgccccaattaaaagacacacactggtaaattggatagagtcaagacccattggtgtgctgtattcaggagacccatctcgtgtgcaaagacacacataggctcaaaacaaatggatggaggaatatttacaaagaaaatggaaagcaaaaaaaaaaaaaaaagggattgcagtcctagtgtcagataaaacagactttaaagcaacaaagatcaaaaaagacaaagaagggcattacataatgataaagggatcagtgcaacaagaagagctaactttcttaaatatatatgcacgcaatacaggagcacccagattcataaagcaagttcttagagacctatgaagagacttagactcacacacaataatagtgggagactttaacaccacactttcgatattagatcaatgggacaaaaaattaataaggatacttaggacttgaactcagcgctggaccaagcagacctaatagacatctacagaactctccaccccaatcaacagagtatatattcttctcagcactgcatcccgcacttattctaaaattgaccacataattggaagtaaaacagtcctcagcaaatgcaaaagaatggaaatcataacagactctcagaccacagtgcaatcaaattagaactcaagattaagaaactcactcaaaaccacacaaatacatggaaactgaacaacctgctgctgaatgactactgggtaaataacgaaatgaaggcagaaataaaaagttctttgaaaccaatgagaacaaagacacaatgtaccagaatctctgggacacagctaaagcagtgtgtagagggaaatttatagcactaactgcccacaggagaaagcgggaaagatctaaaattgacaccttaccatcacagttaaaagaaccagagaagcaggagcaaacaaattcaaaagctagcagaagacaagaaataactaagatcagagtagaacgaaaggagatagagacatgaaaaaccaattcaaaaaataaattcattcaaaaaaaaatcaatgaatccaggagctgtttttctgaaaagaattaacaaaatagacctctagccacactaataaagaagaaaagagagaagaattaaatagacacaataaaaaatgataaaggggatatcaccactgatcccacagaaatacaaactaccatcagagaatactataaacacctctatacaaataaactagaaaatctggaagaaatggatacattcctgtacacatacacctcccaagactaaaccaggaataagatgaatctctgaatagaccaataacaagttctgaaattgagtcaataattaatgggctaccaaccaaaaaaaagcccaggaccacacagattcatagctgaattctaccagagatacaaagaggagtttccttcggaaactattctgaacaatagaaaaagagggactcctccctaattcatttaagaggccagcattatcctgataccaaaacctggcagagacacaacaaaaaaagaaaatgtcaggccaacatccctgatgaacattgatgtgaaaatcccaataaaatactggcaaactgaatccagcagcatatcaaatagcttatccaccatgatcaagtcagcttcatccctgggatgcaaggctggttcaacatatgcaaatgaataaacgtgatccattgcgtaaacagaaccaatgacaaaaaccacattattatctcaatagatgtagaaaaggccttcgataaaattcagcacctcttcatgctaaaaacactcaataaactaggtactgatgggacgtatctcaaaataataagagctatttatgacatacccacagccaatatcatactgaatgggcaaaagctggaagtattttctttgaaaaccggcagaagacagcgatgccctctctcaccacccctattcatcatagtatgggaagccctggccagggcaatcagggaagagaaaaaaataaagggtattcaaataggaagagaggaagtaaaattgtctctttttgcagatgacatgattgtatatttagaaaccacattgtctcagcccaaaatctccttaagctgataagcaacttcagcaaagtctcaggatacaaaatcagtgtgcacaaatcacaagcattcctatacaccaataatagacaaactgagagccaaatcatgagcaaactcccattcacaattgctacagagagaacaaaatatctagaaatacaacttacaagggatgtgaaagacctcttcaaggggaactgcaaacaacttctcaaggaaatgagaggacagaaacaaatgaaaaacattctatgctcatgcataggaagaatcaatatcgtgaaaatgaaaatactgcccaaagtaatttgtagattcagtgccatccccatcaagctaccattgaacttcttcacagaattagaggaaactactttaaatttcatgtggaaccaaaaaagaacccgtatagccaagacaatcctaagcaaaaagaacaaagctggaggcatcacactacctaacttaaaactatactacaaggctacagtaaccaaaacagcatggtactggtaccaaaacagatatatataccagtggaacagaacagaggcctcagaaataatgccacacatctacaaccatctgatctttgacaaacctgacaaaaacaaggaatggggaaagggtattctatttaataaattatgttaggaaaactggctagccatgtgcagaaaactgaaactggaccccttccttacaccttatataaaaattaactcaagatggattaaagacttaaacataagacctaaaaccataaaaaccctaggaaaaaatcttggcaatgccattcaagacataggcatgggccaagatttcatggctaaaacaccaaaagcaatggcaacaaaggccaaaattgacaaatgggatctaattaaactaaagagcttctgcacagcaaaagaaactatcatcagagtgaaaagactagctacagaatgagaaaaattttgcaatctgtccatctgagaaaggtctaatatccagaatctacaaataacttaaataaatttacatgaagaaaactgcatcaaaaaatgggcaaaggataggaacagacacttcttaaaagaagacatttatgcagccagcagacatacgaaaaaaagctcatcatcagtggtcattagagaaatgcaaatcaacatcacaatgagataccatctcacgccagttggaatggcgatcattaaaaagtcaggaaacaccagatgctggagagggtgtggagaaatagaaatgcttttacactgttggtgggagtgtaaattagttcaaccattgtggaagacagtgtggcgattcctcagggatctagaaccagaaataccatttgatacagcaatccccttactgggtatatacccagatgattataaatcattctactataaagacacatgcacgtgtatgtttattgcagcacaatttacaatagcaaagacttggaaccaacccaaatgcccatcaatgatatactggataaagaaaatgtggcacatatacaccatggaatactattcagccataaaaaagggtgagtttatgtcctttgcagcatcatggatgaagctggaaaccatcattctgagcaaagtaacacaggaacagaaaaccaaagactgcatgctctcactcataagggggagttgaacagtgagaacacatggacacagggaggggaacatcacacactggggcctgtcacgggtgtggggctaggggagggataacattaggagaaatacctaatgtagatgacgggttgatggtgcaacaaaccaccatggcacgtgtatacctatgtaacaaatctgcatgttctgcacatgtatcctagaacttaaattataataaaaaaatctgtccgttgttttgtgaattatcatatttaaactcagtttctggtggttgatgtccaaaataagattttgcttagtggtatgtccagagcttacagaagaataaccaaaggctggaaaaatatatctttcagcccagcaactttattatagtacatatggtaaactgtgtagaatgttaaggaaacatcccatattggcttaccagctgctatttttatggcaagattttatttaatatgtaaggctggagggaggtgtgagaggaaagtaaagaaaagctttggattattaaaggtgtgggaaagctatttacactgcttcagggataaataggagggaaggagtactcagacagagggagcgagtgattatatgaagaaaaatactatgatgatactaattgtgttttgtaggaatatggatgctgcctctttgtctctaaatgtgctaccctgaattacaagttacctttggctttttgattctacaaaatcataggagctccctgaaatctggagcatttgctcagactattgctttctgttatctaccctaggtcggaaatatttaagtgttttttcttcagtcctacagagttttagtctgatactttagaaaacagaactgagttcctattcgaaaagatttactcacagtgttttgtgttataaagtcatactccagggtatcttttagagcaacagccctgaaccaggctaagaggcatggagaagagcagcacagggcttctgaatcctggctgtgcatagatgtgggttaaaattaaaatattactaacctttcctcatctgagatagtaagattttggagcttgaattcttcatgctttttaattacaaaaaatacgatgaaatttcagtgttcttgcaaaaatttgactaatacaagaattgacaatatgagaggatgtctttaataattttatgtaacacaatcagatctttaacttttgctcatgtaaagtttataaaatttaaactgcttaaaataatggcagtattagaatactgagattcataataatgtaaattaacacatataacccttttttctgtttgtatattatcttttaatatataatgaaaatgtttaggtagtaaatactaaggttaaggtaaagtcatataatcttaattcatctaacagctgcctgttgtttcatatttattccatttttgaagtagtttacaaatgaaaaaaattgtatgaatgccttggcattaaacagcagttcttggaaatcaggaaattcctaagttatacttcctctagcagtgatatatcagcgttatttctatgagtttagttatattcaattttccagttatatatacacctttaaagtgttatataagccaatttaagcaagttagtattagagtagaagtgtaaactttggaatttcctgatttttaacattttactttctatgttattttggtgaactggatcatgcaacttaatttatacagttagtatgaatatacttacaaagagctagattttattttcagccatcacattatgaatagctttttttaaaaaagactatttcatcctctataatgaagtacttagtgtttgccattcacttttggtagcttttaatttttacctcttcagctatgatctgaagtcattccaaaagttatggtctgttctatgtcttcagtagagagttatagtttcataaattatccacctgctctagatgcgttgtagagatacaaatagaattgcacatactaactgcagaagccaaagcattgggtatcaccttccttgttaatccattttttttccaactgtttttgggtttttgttttgttttgttttgtttttgtttttttttttttggaacaaggacagtcataatatagtaatatgaattcattccttaattctttattcaacaaacatctattgaaaatatgccatgtgccatatacttccaggtattgaagatacagcagtaaccaaagcaaagtccttctctcttagagcattcattctaataagtggaaaaagaacatagattgaataagtgtatactctatcaggttgtgattaacactatgaagaaaaattaagtaggatatggagatggagagcaataacggtactattttagggaaggcttttcttcctgataatacctaactggatacctgaaaaagatgtgcatgtcttaaggaaaaacaatccagtaagtaagaacaccaattgcaaaggccctgagatggaagtgtgcttgctaaattcccagaaggaggccagtgtggcaggagtagagtatgtgggaagagaggttcagatgataaggtgagagtaataatgggtatgggaggacatggaattctgtattgccttataggacttggtaaagactttgaattttcctcaaaatggaggatgttgagcagaaacatacatgttctgaattatagtctacaaggatcactatagctactgcacagaaaacagattgcaagggagcaatgatataactgatggataatcaattagtagaataaccattcagtcacgagatggtagtggtttagaccagaatgatgatggtggaggtagtgaaaggggaattccaaaatactttgaagggaatatggtaggatttgttggttagatacaaagtgtgagataaagtgagtcattaaagataaccccaaaatttacctggataacttgtgtctctcttacttgcctatagttgtctttacagaaatcctttcctaaccatgttggatcttctctaggtagtagccactcttactcaatttttaatcaaagctaacagttgtccttgaagtctattaatgtgtcctattttaacttctctataaagaaatggtcagtttctaaatgtttaccaaagtttgaaactcctttaagcaatttaaaacataagattaacttttcgtttttttaaataattgtaccttatggcagatataatatagcttgctgactaagagatgtggagaaccagtttgctggggaacagagctctttgtgatctttcataactatttcctttacttcctgaatgtctttctaaatgccacattcagagtggacttttctcaccaccacatttaaaacactcccgcattactttctatctccttaccttgttttatttgtctcagttgtatttaatatatgatatatatatttgttttttatttttgtgtctgtatcacctcactaaaatacaaatttcttaagggcagtggctttaaaaaaaaattgctgcagctcagtgggctaggtagttagtaacttactataaatgaattgaatgaatagatggttttaagtagatgtccttatgtcacataatgggtgtttattaaatggcagcatgaaaagaataatgggtatccttgtacattaccggtggcaatgaatgtaaaattgtatagccactctggaaaacaatatggcagttcataaaaaattatacatagaattaccatatgacctagcattgctacttctgagtgtatattcaaaagaatagcaaggactcagatatttatccacccatgtttgtagcagcagaattcacaatagccaaaaggtggaggcaacccaagtatttatttggcagatgcatggataagcaaaatatggtatatatatgcaacgggatattattcggtcataaaaaggaatgaaattctgccatacgttgcaacatggatgaaacttgaagacattcagctaagtaaaataagccagtcacaaaaggacaaatgtggtatgattttattttatgaggtacatagagcggtcaaattcatagagacagaaagtagaatggtagttgctagaggccagggggaatgaggagtagggagttattgtttaatgggtacagagcttcagttaaagaagatgaaaaagtctggagatggatggtggtgatggttgcacaacaatatgaatgtacttgttgccacagaactgtactcaaaatggttaatttggcaaattttatgttatgtatattttaccacaatttagaaaaaaaaatgttctgagcttgaatgtcacattcaccttgttggctttttggacttattcactgtttgtttatttgttgagatagattgtctttgtctcccaggctggagtgcagtggcacgatcttggttctctgcaacctccacctacaagattcaagcaattctcatgcctcagcctcctgagtagctgagattacaggcatgtgccaccacgcctagctgattgtttttctatttttagtagagacagcgtttgccaggctgactaggctggactggaattcctggcatcaagtgatccactctcgtcggcctcccaaagtgttgggattacaggtgtgagccaccgtgctcagcctggacttattcactgttctgctttaggcttttacaaatagaatctaaaacatttaacctaacatctgagatgtgggtttaccactgttattccaagtcctttaattttgtatgtcttcattttaaagtccctaagttcatgttattaatggttattttcctatatgttttactttctcatgtatataaaattcatattttaaagtcttaaattctgttttctgatgttgagggtcctataaggttgtactcttaatgggtggcttactttcattttctcatttaattattatttttaaaaaatttcctagttattgattctcatgttatttcttatgattgttgtcagtatctccctaaatctaataaggagacagaaaccacaaagtaattttaaacaggggaagtttaatataaagaattagaaagctatgatacgtgagtaactataaaagtgtaaagagaactgtaacaaacatactaggcctgaaggaggagagtatttaaggaaaagaacaacttggaagagggtccttccccaaagttagagttcagaccttgttagagaaggtacaatctgctaaggccagagttggtctgtagttgctgggcaagcaggaaacaatcttttgggggtgcagtcaagctgaggctcctggatgggcttgcaaaggtagtcacagtgccactgataggtagcatgttctagatcacgtactattgtgttggaagagcctcagagtggtgattaagacagggatccagtggacaaagtgtcttaatggagatgggaaacttgggaggggttgattgtattgggtggaccagaaataagctgggacatttggaatgggttttgagaaaggaaagaaagagacagctttctctctcatcttcatatgtttaaaatacatgtaaatgtaaatgctctttgcattaatatcttttcatcttcattgcttcaactgaagcttttattatctccatcctaagggactgcattattctcctaatttatcttcctgccttcagaatcttcctcttccaacctagtgtcatttttctaaaacaaagttctgatatgatactttcctgcttaaaatgtctaagtgaccccccccaccccactgcagaataatgtgactttgtaggatcagatctctgcctactctgttagtttcttttcatcccactttcccatagtcatcctaggaactttctgtattcaatttttcaaagattttcaagcatcattttcttctcctttgcatattttgtcccttctcttctcccttacctttgcgtctggaaaaatctatcaatcctttaaaacttatatgctaccttgtttgcccaaacctttctcagtactaagtggccatttcactttgaacatgctttcatttgtatatgtatctctcatcccacttcatactgagttttgtttccttattcatatttttccttttggaatttacacagcacatagtgggtgcttaataaacgtttattatctgaacaaataaacctgcatacttggctttaatattcttttactcagataatatgagcatgtaccttaacttaaaaagatagggttcagaatggtacacactatacttgagagttatttgggctcttttgtgttttctgcctgtaaaagaaataaatacttcattttcctaatgtttaggtatttagctgtatgatagataaagcaagttagagataaggaaagtaaggtgaaaatgagccaactgcttaaatgaatgatggagttgagatagaaaccacttcattttggattgtcttcttttattctcattagtattataagattgcttagataagtatttatttattgagcctctactatgtaacaaacattgtgttagacctgtgattctaggttctttcccacttcttaagattctgcgattaattagtaagattaaagccttaaacaaaacttactttataaaattgttctaaagtatatgattacattacatatttggagttattataaagttactatcaaattaacggataataaagtacaataaaatccctgaaggcaccaaaaatgtatcttgggtatgcaaatgtaaatgtgtaaatatttataattttaaaaatgtgtgcataactataataacggggatgatgccccctatttgagttcctgtccctaaaaacattcactattctaattcctaagaagcacttaatattatagcatcaggagatatatcatctcaggccaagtttactttctagcctagatgggccttttgcagttagttgactctgcttttcttagcagcattaaggaaagttggtttataataaggttttagcacaaaagttaatgccctgatttattctcagaagtggttagctgtagttgatgcagatggccactagaatgtattcatataaacatcttccattccaaaatgttaagaaaatataacattgtataccttaattattcaattacattagatacatgttatttaataatatacctgaaccagaggcttagggatttcagacgctctgtgttaaaggaatacaaaataagcttgttttaaaatgtaatacatcatgcttctgtccccatgtttacctatgtaattttatgattccataggtaaaatagctgaaagagaaccattatgttatcaaacactgtgtcatgcttgctgagtttgcaaaaatgtaaaacgtacaatgtgtaacttttatcttcaggaagtttataacctaataaataagattcaatacacataaaacctttaatgtacgattaagtgataaagtattaagactataagtgttgtgggagttaaataattttaaaacagattttaggaataatctaatatctcattttattgacgaggaaacaaaagtctggactagctgtttaactcaaaaatctgcccagagttacactactggataatgtcagaaccagactaagaacgcaggtttcctgactttggcctggtactctttccattcgtaaatacccacgagcctgtgtggaatgggcttgattcaaagcatgtagaagaaatgagacattgaaggttatgggtaggtggtggggagaagagctgttccacaatggaaggaacaagaaggaagcttaaaagacctggcacagagcataaggaatggcctaatgagagtagaaggtatacaataggaattaatttcagttagtaacctgggcctggattgaagcagtccttgcaaaccaggtagtttttatgggataggcaccagaatgcttttatagatttcttgagcaggatgacttgataaaaattatatcagttttatcaactggaaggtcagtgtgatggtaaccatgaaagattgaagtaatattgaggcaggaaaaggtagtagtagtaggaatgaagtagaaaactcaaatctacaagacatttcttgggggaaaatgattggacgagatggcagttttctatagaaaataaaggtaagaagagtgtagcaagcagaatgctatttccatggacagaaataaaataacttggaaggagggctgggatgaattgaggttttttgttgttactcttgatattaaaaagattattactcagtattaaagcttactgtaaaatataggattttaggtttttgagagctttccatatctttggacagtcaatactgaaatttttgaatttagggttaattgattatatctgttgtatacacttagagacgcttgggttacctctgtacattttcagttatatgtataaaacatttttgaatggaataatacgtacattcaggtttatagaaaccttgatggatatgatttaatacaaattagcaatagtatatctaaatttgtaattgtcactgatccattgcttaggatatattttaaaatatgttcactaaattctgttttcagttaagttattcatttatcttttgtttaggtcctaggccactgaaatggagtacaagagaagtgggtattttttctaatttgatttttttcctgtattagtgttgggataatggatttgtatttcatacataattttaagtgcctcatatttttaataatagttgcctagacaatacaatttattgtgaaattttctattagcagttcattctaaatgtttaagaaattatacgtttttctctttttgtgaccttcaatcttaaaagtttatttgaaaaacgaatttagtgaaaccaaaattaaaaaaaaataaactccctaactaaaaaaatatattcttaaaactatttttataaaatcaatttttttgacttgggatcatttagggggatcgcatatattgtagtatatcagctattgacgacattttaattcttatcattttaatgagttttttgttgtaatttttaggagaaaatgatgaaatgcttatttaaaaagtctttattaggctcatgtctctcatcccagcactttgggaggctgaggcgggcagattgcctgagcttagtagttcgagaccagcctggacaacatggtgaaaccctgtttctacaaaaattacctgggcatgatgacacacacctgtagttccagctacttggtgggctaaggtgggaggatcacttgagcctgggaggttgaagctgcagtgagctgagattgtgccactgtacttcagcctgggcgacagagtgagaccctgtctccaaaaattataaaataaaaaagtctttattattattgctgtactttcattttaattagaaatctgtttctgtagtgtacttctctgttggattacattgagatctctggaagtagtatgtgaatgtatggtcagttgataatatgtgaattctaaatgctgaaatttatgcttttggggtgtttgtttatcagtgttcttattattgaccaagattatgctttatatcttctatcttctgaagttgtgtgaaatagtgatacaatacaaattaaagctgagctggtgttttacatctagtatgaaagaaattagcagaaatcagagcagtttaaacctatctacattattgctactgagttttgagtcatagatttttttaaaaagtatgaaacatggttaatcataaaaatccacataaagaaggaaataataataggaagtctgttttgtcgaattctagaaatatttttagagaactattattttgaaatgtgcaggatgcttctggtccaaggaccatactttgagaatcattgttataaatcatggtggaaccgtttgacctaatcaaaattaaaatgagaaggaaggttttttaatttaagaaagttatctttaacttctggcaacatgatcttgcttatcacagtagtaggatattataaaattggccaacatctcagcatttctttaaacttgctactatattcatttattcagtaaatatttactaaacatctaatatgtgccaggcatatttcgagctggagataaagagtaggatagacatagctcctgcccccatggagtttatattctcttaggggacatatatatgaacaaaaacaggtaaacagacaaattatgtagttgccagttgaaatatgtcatgtgaaggacaagaacaaggagatgattgatactattagcaaactattttaggtgtagtgatctctgaggagatgacattgaaattgagacccacagaagagaaacaactaggtctgttaagaggagggaggcgcattattcaagcagacaattgaatgtatacaggctttgaggcaacaacaacaacaaaaagtttctttactctaagaactgatagtagtttagctctaggctactatttaatattaagattatggatggaaggcagggagggaggtgaaagagaaagaggagagaaattaagaacaataggtttccgatttatgtaaattaattaatggtagtattgtttactgaaatggggaagaggtgtggggggtgggtgtcagtgagctcagctgttttgagagagtttgagcaaaaaaaaagtcagttgaggtgattaaaaattgatacattaaagtgagaaatcaaagaagaaactttgttgctgagacatttagactatttctcagatattaataaaatttagagaacaaaacagtattctagagaaacactaaggttattaattaagaggaaagcaatctatttggggaggtttaagggaatgttgacatatacaaatactaaaaaattagaaagccaagtaaaaagggattaaaattctatctccaagtggaaaaaatcaggttgtccagaaaataataaatacatgattgatatggtttggctgtgtctcctcacccaaaatctcatctttaattgtaatccccataatcctcaagggcaggaccaagtagatgtaattggatcatgggggcagtttcccccatgctgtccttatgatagtgagtctcaagagatctgatggttttttaagcatgtggcatttcccctgcttgcactcactccatcctgccaccctgtgaagaaggtgcctgcttctcctttgccttctgccatgattgtaagtttcctgaggcctctccagcaatgcagaaatgtgagtcagtgaaaccgcttttctttgcaaattacccagtcttcggtatttcttcatagcaatgtgagaacagactaatataatgatcataaagagattgttggtgagagaggccattgactcaccagagaacctagaaataaattaccatgggcatataatatctaacattatattgagttagtcaaaatatgaaatgttaatatttataggggagactaaggatgatgccagaactgaaagaaaaatgtttctagaagacctaaaacctaaagaacttagcagactccttgagaaaaatgtaaatgcctgaagtagttttgaaaatctgggtttagctagctcatgccctagaatttcagtgactacatagactcattaaaatgaaattcaatcttgtttttattttaaacatatttttcaggtatccaagggactgttaggaggacttaaataacccatatccttatgaaagtgaattataggcctccttgaaattaataaaaatcttcaaagtagtatttaatttaaacttgtaactttctttgtgttctgagagagtgctgtttctttatattttaaagaaatagaccatttctgttttgttcaccaatatattcactgcacttagcacactgacacagagtaaccatttaataaatactttctgaatgaatgtataaatataaattttacatttagttttgggttacctggatagctgataattaatgaagcagttcctttgtggcccttaggaaatgtctctactgtgaccatattcaggtatatatggtggcaggctatacgtgaatagaattagtgcttattagaaatgaggtaggatgtttttgagattatatgtttccatgcactgcagagcatactggtgttattttaaacaaaatataaataacttttggattttgtgtggattttaattattttaatcagtcatccgttaagggttaataatccagttaactatgttgttctcaaattccaaatactaaattactgaggtcatgatgctttggggaacaaatactattaatgactagtgaaagaagttttatagatctcacattgtttctggaagaccaatagatgtatttattaccataataacacgtagaaaaaggacagacatttctatgtggttcttagttctgtctctctttttttttttaatccaggatgtcaatccttttgtgttcactccctaattatgtatttacattttctttatttttcttaactatatatctgacctttttttttttttctcaaggtcttgattaaaatcagctttactctacaataagttgaattgatttgggcttctttttctcatgatcctattatttagtgactgttttcttcaaatatttgtttccatgacttttgttacttctttatagacatatttttagtagttgcaatttcacctccaccccgcctttctgggttgataatattggttaacactgactcctagggtacagtctcatcaatgttggtgtagaaataagatataatgaacaccaaacctaaaaaagcagcgtcaacttttactccagcagcagtggagttgttatttaccaaaagaaaacagattcagcagagatctgttagaatgcctatgttatgccctattaatctaaaacagttccatgataattctctagggttgaactgtttttaatggtatgtatgagaaaacgttttatgggcttttagccagaagattttatatataaatggtagtagaggaacattgttaaattcatgaatcttggaggcaatgtaatataatcgattttggggcttttaaatcagctttgaatcctgaccccttcacttattaactttgtgactttaggcaagttacttgactcctctgggccttaacttcctattttgcaaaatgagaataatatgacttcctgacaagaattttgaaagaatagaaggcagttatacaaaatgtgtgataaaagttttggcacatacaggtttcttcccaaagatgaacaagtcctactgctaagtatagaaagggagatataagtacaagttcctcgttatttcttagagctttgcgcccatagatctttatattgtcttaacctatgtgatccacaatgacccaaactacaatgtatgtcttaagaaagcatagaatttttacttttttttcagtttgaacaaaaatggtcagttgtgctctgagtcctaggtgtcttctagatataaatatgtgggaaggacaaaggcaaggggcatttaacagaacctcaggtcctacttctagcagagcagctatacttttctgttttaccatttgtatttctgtgcaagatattgattgaacaaaggggtctgtgtattacaaaaaagcttgaaaaaacaaaagcagggtcaagcagtctatttcttggctttcctttttctccgatgccaccctgctttctccttggcgttttaaagtttgtgggaatgggtgggagttagggtggggaagtagggaggaattccattctgtcttattgcatggagttctctgagaacaaaacatagcaaaaggacaagggtcctatgtaaagagggcatttctggtggaaaaattccttgacctccttagctcttgcgttgaactctatcaacaaagagctatgttttgagccttgattacaaattttaaaactggtaaataacaaatacatcttgcctctgattgcttcctcctctgactacattgagatatctttattagacccttaatattttcattatcttcttatcttagactctaatcactttactctcatttcagtgtctgcaagttcttttcccattagtcttctctgtaccaaccagcaagaactctgaccctggatgaatgttacctgactttactgccatcaagcatttttggagaaaataacacattgggctaatggttacctatgatttcctgaggtctgggttcgaccccttttaatcatctgaggaatttttctttcctccatcttcattatctttctccctgtagactttttactgtcaacgtttaaacatgttcaaataaatccaagcatcgaatgaaggtaacaaattaatcaacttattggttcagctgcaactctgtttctcaccccgcagtcaaactttttaaacaaattgtttattttcattgtctttagcccattccaatacagcttctgctcccataaccccaaactgcttttgtaaatttgtttcatttccgcacttaacagctttcccattaccttctgatagtctcatatccctaacattatatttgcacaattctacctctcctttctagctctaagcacttttttcatttcatgaaatacagttaatattctccttctctgggtttttgcaggttctatcctttaactgggaaacactctctgccttcctcaactcctcccacctaactgttcagttatcagatgtgatcttctgaaggaggtttaccttgacctgaactggctgagttctcctacttcataccttctcttcacagcacttgtcacatttgtaataatgtatttgtcattctccctgtgccttttaatgttggcttctagagattagggatcccactggttataggactggagaggggagctcaagaaatatttgttgaagaaatgactgaataaattaacaactgtagcttttcccagttcagtgcatcagttgtgtccttggccttattggagtttctcttccttagcagcataatgaattttaagtggaggaaaaactattagtgattccactagagttattaagcactgtagcccgtaatgcatcataggcgcacaacatatatacttttccattattgtcctctcctttttgctttaaaaataactagaaatatgtaataatttcaaatactaggaagctgagtattttgtttcttatggcacttttaatcaaatcacattatttattgagtactactcagtgtatatcctaaagtaaaaaataataataaacaaatgaatcaagtttctaaaaatcaaaacaaaaaactttaaaaacagtatgggaatacatgtgttcaaaagagaccccagaaagtgttttcttcctgaatatattagacccttttcagctcctaatgctgtagaataaatgaagtgttatgaaacttataattaggaactatctgaaagccaaatgtttagctaaaatgtgtgataaattaatgaacatacaaatgaatagatagcagtggcagtgtatttgttttgtgaattttatttatatgcaaaataataattgtatatgcatttaaatataattgaatggtatacatatgtatagagattgctaccatatttgatggattggtaaatagtattagaggtaatttctgaagatattttagtgtaaagatattgatgtaaaaaaaaattcagcaacctatctatatatggctgtaacaaagaagagtgatttggactactgctacaaagtaggttaaatgatctctacattacttcatgcattaacattctctaaattacttcatatattaacatttacatgtaatatatttgtagtatattctaatttaaatatccaacggaaatttggaaatgaatatagtttgtgtttaactgagttgagaaagcatagtatggtaattaaattctttttttaaccaaacattattataaataaaattgctgaattccaagtatttatacttaaataactttatgttgtaaacagtgtttttttaaagtactttctttataccttacactttattttagttaagttatagccatgtgtcttgggtagaattctgagagaataataagggactttaccctgtaatcacagaagcagtttggtaatataggaaccaagtgacagcttttctttttcaagtatatagattcagatctggacaggaatctttaagggtgacctaaaacatcattacgtcagtttacaacagaaggtttactctgttagtttccagtaactataatggaaactaacctagatgaacattggtacctactttgcagttagtgactgattttatttgaccaattagtactcatgatggagaggaaaataacttgtctgtgacctgtcatgatcaactcctaagggacaagctttgattacctcttaggtttattgtttttgccttatcaagtccacttgacttaaagtatgttctacaggcggaatacactgggggtggcgggcatggaatttttttttgctagaattagagctaataagtttgatttagagtaatcagtttttgcctctgttctcccaacaattgtgtgatattaggaatatctttcttgtgtttctttttaatagtttttattttatttaaaaaaaatggaacacttcacaaatttgtgcaggggccatgctaatcttccctttgtctttccaattttagcatatatgctactgaagtaagtgagcacatggtttttctctttctttcttctttctttctttctttcttttcttctttttccttccttccttccttctttctttctctctctctcttttttttttttgacaaggtctggctctatcatcctccaggttggagtgcagtggcacgatcttggctcagcttccacctcccggctcaagcaatcctcccacctcagcctcccaagtagctgagactacaggtgcacaccaccacacttgactaatctttgtatttttttgtagagagggggtttctccatgttgcccaggctagtcgtgaacttgtgagttcaagcagttcacccaccttggccttccatagttctgggattataggcgtaagccactgcacccagcccatatgtttgttattaatgaaggttgtgctatcagacacataatatcactgtgaaaacaacatttgccacctaattccttaaacagtgttctacaagaataaaaaatttattgatggctcattgtatgttagggtttattctgagtgccttaggttccacttccctctgtggaagccaaagtggggcagatagttcctctcataactcctgtgacagctagagtttggggcatatgacctcctgtgacagctagagtttccatcaactagttggaaatcgctgcatgagacttcacatctaggaaaagtgatgcaaagacatagcaacagtttagaatttattcttctagtggtttccaactcccaggctcaagcagtcctcccacctcagcctctagtggctagagcagcatccagtgtctcataccagtggagatactggtaccagcagtggtggtggtgccacattctcagcagaggcttcctaggctgtcttttttccagcatgattttggttgcagttctggcttcctaaccttctttagtgccatcttgtttcccaagtctgtttcttcagcttcatcattttgtgtgccatccgaattgtttcctacttaacttaaccagaaatcacttccattctttgtgaccaagaactggactagtacaattctcttggaaaaattggccttaatccctagctgtttggcaatatcttattatgattaattttttatagccacagctgccagaaccctaaatttcagttaacactgtaaagagaatttaagaaagaggaaataagtttatttaagtcatgacatcagaagaaaacagtaatgaaaatctaatgaacagtactattttcaagaaattgttcatgtattttagcaaaatgaaaaccacttaaagcatattttcagttgttgctgtttattaatattatctttattatgaaaggaggtaatttgtactaggcatgtactcctgaccttctgaaaaacctcccttcatttttctttgaagaatctttccctttcctgctcttagagtagggctacctccaccaattcagaggtgatgtatgtgacctatgcctaagcaatcagcacgctttatctccttcaacacagtgattggttgagattggatgagtatatatcagggtacctccactgaaagatagctattgcagcttcaagcaccacagcctcacacatcacatggagctgagaagaccaaaatatcagaaagtaggactgagaggatggagggaaagaaactgagtcctgatggtgtattttgaggcctatatatatatatctagtagaaaatgttatgaaacttttataattaggaactgtttgaaagttaaatatgcagctaaaatatatgattaattaatgaatgtacagaggaacagatagcagtgacagtgtatgttgtggaattctacttacatacaaaataattgtatgtgcatttaaatgcaactaagtggtacacatatgtacagaaattgctaccatattttatagtttgataaatacccagctattttaaaaactatttctaatcctacagtttcagttccataacccattacactgcttttttgcctatgccagtttgggttagattttctgtcactggcaaccaagagttctctgtttctttggaatataaatgctaaatcatcttgagttgggattgtaaagtcttgctaccatgttttgaggaatacctcttatttatgttttagttacatataacttttgtacctaaaatattaacaaggaaagcaactaacaactttaagctgaaatactaatcctgaaagataagaatgaaaactcaaaccttaagttctataaaactttgagatagctacatgtttactttcagaataatttaaattggtagagtacaagttgggaaacaaacactttaagtgaatatttaagtcatgtaaaatatgtatttttaaaagtcaaattaaacatattaccaaatttgctggaactatatattttatttataataagcacttttctacattttacaccctgttgccttacataactttccacagttttgacattataacattgtgattttctgtcaaacatgaatgaaaatacgagtttatggatgatagactcatgctatttccagatttcagaggggtagaggaagcagcagaaaggccctggagctcgctggatcccctagcaggccattcctgcatgacaccacagggatccatcaggagggtggccagaggagcagggggcaaaactccacagagagaagtaaatctctagctgaactttgtaacaatttgaatggggtgagaagcctcctggccagaactcgggtgaggacacaaatctggagggcacactcaacaggtgggggaagaatgaagccctattcttttgcaactgggtggcggatagcctggggcaagttttcaagcctgtgtcacccaccacctggaaacagacttggggctcttgtggggctcggtgggagtgagactggccctttggtttgcataagagctgggtgacgcctgtgactgccagctttcccccacttccctgacaacctgcatgactcagcagaggcagccataatcctcctaggtacacagctctagtgacctgggaatctcaccccaacccccaacagcagccacagcaagacccacccaaggagagtctgagctcagacatacctagccctgcccccacttgatggtccttccctacccaccctagtagcggaagacagagtgcatataatcttgggagttctaagcccctgcccattgctggtccctctctgcactactacagctgatgctctctggaaagcaccacctcctggcaggaggccaaccagcactaaaatagagcattaaaccaccaaagctaagaaccctcatggagtccgttgcacaaccccccatcctcccaccccccactaactccactggaacaggtgctggtatctacggagaagagacacatagatggttcacatcacaggatgtgatattgtgcagacaacccccagtaccagcctggagccgggtagactcggtggctagacccagaagagagacagtaatcactgcacacagtaatcacaggaagccacgtccataggaaaatggagagagtactacatcaagggaacaccccatgggacaaaagaatctgaacaacagccttcagccctagaccttccctctgacagagcctacctaaatgagaaggaaccaaaaaaccaactctggtaatatgacaaaagaaggctctttaacaacccccccccccaaaaataacactagttcacaagcagtggatccaaaccaagaagaaatccctgatttacctgaaaaagagttcaggaggtgagttatttaggtaatcagggaggcaccagagaaaggtgaagcccaatgcaaggaaatccaaaaaacaatacaagaagtgaagggggaaatattcaaggaaatagatactttaaagaaaaaacaataaaaaattcaggaaactttggacaaacttatagaaatgtgaaatgctctggaaagtctcaacaatagaattgaacaattataagaaagaaattcagagctcaaagataaggtcttcaaattaatccaatccaacaaagacaaaaaagaataagaaaatatgaacaaagtttccaagaagtctgggattatgttaaacaacaaacctaagaataatcagtattactgaggaagaagagatttctacaagcttggaaaacatatttgatggaatcatccaggaaaacttcgccagccttgctaggaacctagacatccaaatacaagaagcacagagaacacttgggaaatttatcacaaagagatcatggcacactgactgtcatcaggttatccaaagttaagacgaaagaatcttaagagctgtgagacagaagcaccaggtaactaacttataaaggaaagcctattggattaacagcagatttctcagcagaaaccctataagctagaagggattagccttatcttcagcctcctcacacaaaacaattatcagccaagaattttgtatccagcgaagctaagcatcatatataaaggaaagatagtctttttcggaaaaacaaatgctgcgtgaattcaccattaccaagccaccactacaggaactgctaaaaggaggtctaaatcttgaaacaaatcctggaaacacattaaaacagaacctcttcaaagaataaatagcacaggacctataaaacaaaaatacaccttaaaaagcaaaaacaaagtacgcaggcaacaaagagccggatgaatgcagtggtacctcacatatcaatactgacattgaatgtaaatggcctaaatgttccacttaaaagatacagagtggcataatggataagaatttaccaacaaactatctgctgccttcaggagactcacctaacacctaacacataaggactcacataaactgaaagtaaaggggtggaaaaaggcatttcatgcaaatggacaccaaaagcaaatagggaaagctactcttatgtcagacaaaacaaactttaaagcaacagcagttaaaacaaagagggacattatgtaatggtaaaaggccttgtccaacaggaaaatgtcacaatcctaaacatatgcacctaacactggagctcccaaatatataaaacaattactaatagacctaagaaatgagatagacagcaacatgataatagtggaggacttcagtactccactgacggtactagacaggtcatcaagacaaagtcaacaaagaaacaatgaatttgtaccttggaacaaatggacttagcagatacatgcagaacattttatccaacaaccacagaatatgcattctattcaacagtgcatgcaactttttccaagatagaccatataattgaggccataaaatgagcctcaataaatttaagaaaactgaaatgatatcaagccactctctcagaccacagtggaataaaactggaaatcaactccaaaaggaaccttcaaaaccatgcaaatacatggaaattaaataacttgctcctgaatgagcattgggtcaaaaacaaaatcaagatggaaatttaaaaattctttgaactgaacaacaataatgacacaacctaccaaaacctctgggatacagcaaaggtagtgctaagaggaaagttcatagccctaaatgcctaaatccctaaaaagactgaaggagcacaaactgacattccaaggtcacacttcaaggaactagagaaacaagaacaaaccaaacccaaacccagcaaaagaaaggaaataaccaagatcagagcagaactaaatgaaatggaaacaaaaacaatgaaaaagataaatgaaacaaaaagctgattctttgaaaagataaaaaaattgatagaccattagcaagtttaaccaagaaaagaagggagaaaatccaaatgacctcactaagaaacaaaacaggagatattacaactgacactcctgaactacaaaagatcattcaaggctactgtgaacaactttatgcacataaactagaaaaccaagaagagatggataaattcctggaaagatgcaactctcttagctgcttacatcaggaagaattggattccttgaacagaccaataacaagcagtgagattgaaatggtaagttaaaaaattaccaacaagagaagtccaggaccagacagattcacagcagaattctaccagacattcaaagaattggtaccaatccttttgatactattccacaagataaagaaggagcccttcctaattaattatgtgaagctagcattaccctaataccaaaatcaggaaaggacataaccaaaaaaagaaaactacagaccaatacccttgatgaacatagatgctaaaatccttaacaaaatactagctaaccaaatccaacaacatatcaaaaagataatccactatgatcaagtgggtttcacaccagggatgcaggtatagcttaacatatacaagtcaataaatgtgattcaccacataaagagaattaaaaacaaaaatcacatgattatctcaatcgatgcagaaaaagcattcaacaaaatccagcattctttatgattaaaactctcaacaaaatcggcatacaagggacgtaccataatgtaataaaagccatcaatgacaaacccacagccaacataatactgaatgaggaaaagttgaaagcatttcctctgagaactggaacaagataaggatacctactctccctactcctcttcagtatagtactgggagtcctagccagagcagtcagacaagagaaagaaataaagagcatccaaattggtaaagagaaagactgtcagtgtttgacaatatgatcgtttaccttgaaaaccctaaggactcctccagaaagctcctagaactggtaaaagaattcagcaaagtttccggatacaagattaatgtacacaaatcagtagctgttctatacaccaacagcgaccaaacagagaatcaagtcaagaactcaaccccttttacaatagcaaaaaataaataagtaagatacgtaggaatataactaactgaggagtcaaagacctctacaagaaaaactacaaaagactactgaaagaaatcatagatgacccaaacaaatggaagcacatcccatgctcatgaatgggtagaatcagtattgtttaatattactcaaatcagtaagaaaaaaacaatcccatcaaaaagtgggctaaagacatgaatagacaattctcaaaagaaaatataacaaatggccaacaaacatatgaaaaaatgctcagcatcactaatgaccagggaaatacaaatcaaaaccacaatgcaataccaccttactcctgcaagaacagccataatcagaaaatcaataaacagaagatgttggcatggatgcagtgatcaggaaacacgtctacactgctggtgggaatgtaaactagtacagccattatggaagacagtgtggagatttcttaaggaactaaaagcagaactaccatttgatccagcaatcccactactgggtatctacccagaggaaaagaagtcattatttgaaaaagacacttgcaaacacgcatgtttataacagcacaattcacaaatacaaagtcatggaaccaacccaaataaatgcccatcaaccaacgagtggagactattattctaagtgaagtaactcaagaatggaaaaccgaccattgtgcgttctcactgttttgtgggagctaagctatgaggacacagaggcattagaatgatacagtggacttcgaggacttggggtgaagagagggagggggtgagggataaaagactacaaatatggtgcagtgtatactgcttgggtgatgggtgcaccaaaatctcacaaatctccactaaagaacttactcatgtaaccgaataccacctgtaccccagtaacttatggaaaaataaatatgttaaaaaaaaaaagtaatagccaaatctgttaactctgtgattcctgctttggttaatgtagattattatcacatgatattaaagagtcaggattatggagttaatgttttactggtgcttttttttttaaaaaaagaaaaatgtttattatttaaggctgtgtgcagtatgtgcttatattcaaacatcccttatgctgttagtcacagaaatactaactatgtgtatatgaatggcttttcacagtctatataatgattggaaaaataactaatatagtatattctaaatgatgaatctttatcttcctatataaaggacatcatattactaattttcaaatttatcagtaagacactgaacaaagcctaaaaattaatggatattgttttaatgtgatgtatgatttactaaattaagcttaggagcatttctgtcgatgtattcctatctttcagtatgtgcttacatacaaataacaactttgtaagtattttctttttacagattttcagtaatttatatcagaagtatataatcaagaaactttagtgtttctgtccgttaaatatttaaaatattttattctaaagtaaacccttttggcattttttaatgtggggttgcctcatcaaattttgcatagcctacattacaatcatagaatcttgagttttggaagagactgtaaagttcatttcattcattcagcatccatttggtggtagtgtgctttgaagacttactaagaaattaacacctaggataacattttttactttgcaaaatgtcattgtattaatattttacgcaaacaatacatgaaattacagtactttttttctgtttcttgccaaattgtaagtagagttgaaaacagaattattttttggagatatgatcttgccctgttgcccaggctggaatgcagtggtgtgatcttggctcactgcaacctctacctcctgggctcaagtgattcacccacctcagcttcctgagtagctgggacttgagtgccaccaagcctggctaatttttattttattttattttttgtagagacaggttctcactatgttgcccaggctggtctcaaactgagcacaagtgatccatccccctcggcctccctacgttctgggattacaggtgtgagccaccgtgcctggccccagatttttattgtctttgaaacagaaaattcatgaaaggattctgccattttattcacctttctgacactgcagtaaagtgcagattaaagtatagttccctgtgaaatagccagttaccctttgagtagactccagttcacataaagaagtacagggagattacatgacttgcctaggttatatattgagtcagtaggagaagtagaaatactaagtgcagattcacagttcagtttagcccagaactatggatgctttccttatggttattacctggaaggctttacaatcactgatgtaccctccctgctgtctcctctcacttacacatatgcagtcttgattattttgataatttttctacatttatacacacttcacacataatttttgtttttttaaacctcagtttatagccttaagttatactcaggaatgtacattgtactcttaagcagaaagaccttaatattagttacagctgaagagtgagcttaatttctaagtacattttggtttttccctttttgtatgccttttataggtgttcacctttagcagccagtctcttgactttgcctaatactataaagaatagcaaacattgtattgacataattggttgttatggaagtcatttttaatagaatgaccataccttatttattaaaaaataataaactttatttttcagagcagtgttaggttcacagtaaaactgataggaaggtatagagatcccccgtatattcccttcccctatgcatgcatagcctatccaattatcagtatcccctattagagtgatatgtttgtcacaatagatgaacctatatgattatcactcaagaccctagttaatattagggttcacttttggtgtcatacatttcatggatttggacaagtgtataatgacagtacatccaccactgtagtatcatataccataatttctactacacggaaaatcctctacagtcctgttttacattttcagaagtgtcatatacctggaatcatacagtatgaagtcttctcaggttttcttctttcacttattagtatgcatttaaattctccatgtcttttcatgcatcgatagctcatttatttttagtactaaataatctcttgtctgaaggtaccacagtttatttattcatttacctactgaaagacatcttgattgctttccagttttgctaagtataaataaagctgctgtaccatccatgtgcaaatttttgtatgcacgtaagtcttcaactcctttggataaataccaaggaacatgtttggtggattgtatggtaacagcatgtttagttttgtgagaaattgccaaactgtctttcatggtggttgtatctttttgcatttccactaacaatgaaatgagggttcttgttgctccttatcctcaccatcatttggtggtgtcagtgttctagattttggccattttagtaagtgtgtagtagtttctcatttttgttttaatttggatttctctactgacatacggtgtggagcatctttttatatatttatttggcatctgtgtaacttctttgatgaggtttctgtttaggtttttggctcacttttaagctgtgttttcttattgttgagttttaagagttcttcatatattttggataacattcctttatatcagacatgtgatttgcagatattctctcccagtcatctttagcttgtctttttattctcttaacagtgtcttccccagtatagattttttgtttttaatttaatgaagtccagcttgtcacttctttcttttatggactgtagctttgatattgtatctaaaaagtctgtttgttcaaaatagtaatgatttggatctgttagatcaattaagaatgaaacaaagttattttaccattatgtattctttccctaatgctccctctttatgtagatctgagtttctgacctgtctcctttaacatcttttaaagaactttaaaaaacatttcttgtgaggcaggtccactagcctaaaattttcttgatttttatttgcctgagaagatatttatttctccttcagttttaaaataaacagggtctcgctatgttgcccaggttggtcttcaactcctgggctcaagcaatcctccagagtatctgggattacaggtatgtagcaccatgcctggctttcttcttcacttttaaagggtgatttcaaagggcacagaattttaggttgttgggttttttcctcaacactaaatattttactctactctttttgtattttcaatttttgtggatacatactaggtgtatatattaatggggtacttgtgatgttttgatacaggcatacaatgtgtaataatcacatcatgaagaatggggtatccatcccctcaagcatttatcccttgtgttacaaataaattatattattttagttattttaaaatgcacaattaaattattattaactgtggtctccttgtgccatcaaacagtaggtcttattcgttttttctactatatatacttttttgtacccatcactccaccctttttgcttgtactgtttctgaggaaaaattggatgtaattatctttgctcctctgtaagtaaggtgtttttttcaccactttggcatctttcaggatttgtctttatcttcgattttctgtaatttgaagatggtatccttaagtgtagtttctttggcatttatctcttttggtgctctgtgagcttcctggatctatggtttcgtatctgacattaatctgaggacatttttagtcactattgctttacatttttttcctgttcttttctctttcttcttctacaatttttatcacacatacgttataccttttgtagttgtgccacatttcctcctgggttttttgttttgttttgttttgtttttgtctttgcttttcagttttgaagttttctgttgagatattttcaagctcagaggttctttcctgagttttgtccattcaacggcattcttgatttctgttacagtggtttttttggtctctagcatttcttttggttatttcttagatctctcttcttgtacttcccatctgttattgctgtcttcttatcccttagagcccttagcatattaatcacagttgttttaaattcctgatcttatgattccaacatccctgccatagctgtgtttggttctgatgcttgttctgtcctcttcaaactctgtgtttttatgttgggagaagagaagtgttctgttgtcctatgattaggtatcacttttttagtaagcctgtgcctcttgactgtgaatttcacaagtgcttctcagtttttttatccttctccagttggacagatggctagagtgagctggagttgggtattttctttctcccacctggaaggctagtgccaactggagttggatattttccttcctgtaagtcagttaggctctgatagaactccaacaggttaagctctgtttaaatagtttcctctatgggcagaccttggtaagaagcacagagtgatccggcatattttaaaaatggcgtgtcctttcctttgctggaagcatgagtggatttttctccagtattcactgtgagaaccagatcaagtttctggaggttaaactcaacagaagtgaggagcctccttatggctgggtgcccctgcatttttcagtttttacagttgtccacactgactccagcaattaattgctgtttaagttttcttacactggcactagctcccatggaggtttctacttctgggtttctactccaataagttacaattctctgtatttacatctgtctctccaatctggggggcaatggtttaccctatgacttgacttctcttatggatccgagaagaatcgttgatttttcagtttgttgagatttgtatttgttgttaggatgaaatggtgacttccaagcttcttacatgccagaccagaaaccagaaatcccagcttaatgtcacagactgacatggactgcactgcagcattaaagagaataagaagttgtcgttgggtttcaagtctgtgaaacaaagtaaggtttttaatttatccaaagttacacaccctgcaagtgacacaggtgggaatagaatctaaatatttggactcccaattaaattatctttctttttattttattttattattattatactttaagttttagggtacatgtgcacaatgtgcaggttagttacatatgtatacatgtgccatgctggtgtgctgcacccattaactcgtcatctagcattaggtatatctcctaatgctatctctccccctccccccaccccacaacagtccccagagtgtgatgttccccttcctgtgtccatgtgttctcattgttcaattcccacctatgaatgagaacatgcagtgtttgtttttttgtcctcgcgatagtttactgagaatgatgatttccaatttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatggaatggctgggtcaaatggtatttctagttctagatccctgaggaatcgccacacagacttccacaatggttgaactagtttacagtcccaccaacagtgtaaaagtgttcctatttctccacatcctctccagcacctgttgtttcctgactttttaatgattgccattctaagtggtgtgagatggtatctcattgtggttttgatttgcatttgtctgatggccagtgatgatgagcattttttcatgtgtcttttggctgcatcagtgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggtttcctgttcactccgatggtagtttcttttgctgtgcagaagctctttggtttaattaaatcccatttgtcaattttggcttttgttgccattgcttttggtgttttagacatgaaggccttgcccatgcctatgtcctgaatggtattgcctaggttttcttctagggtttttatggttttaggtctaacatttaagtcttgaatccatcttgaattgatttttgtataaggtgtaaggaagggatccagtttcagctttctacatatggctagccagttttcccagcaccatttattaaatagggaatcctttccctatgaatgaaatgaagcgagaaggaaagtttagagaaaaaagaataaaaagaaacgcagaaaacctccaagaaatatgggactatgtgaaaagaccaaatctacgtctgattagtgtacctgaaagtgacagggagaatggaaccaagttggaaaacactctgcaggatattgtccaggagaacttccccaatctagcaaggcaggccaacattcagattcaggaaatacagagaacgccacaaagatactccttgagaagagcaactccgagacacataattgtcacattcaccaaagttgcaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccaaccaaactaagcttcatgagtgaaggagaaataaaatactttacagacaagcaaatgctgagagattttgtcaccaccaggcctgccctaaaagagctcctgaaggaagcactaaacatggaaaggcacaactggtaccagccacagcaaaatcatgccaaaatgtaaagaccatcgagactaggaagaaactgcatcaactaaggagcacaataaccagctaacatcataatgacaggatcaaattcacacataacaatattaactttaaatgtaaatggactaaatgctccaattaaaagacacaggctggcaaattggataaagagtcaagacccatcagtgtgctgtattcaggaaacccatctcacgtgcagagacacacataggctcaaaataaaaggatggaggaagatctcccaagcaaatggaaaacaaaaaaaggcaggggttgcatcctagtctctgataaaacagactttaaaccaacaaagatcaaaagagacaaagaaggccattacatcatggtaaagggatcaattcaacaagaagagctatctatcctaaatatatatgcacccaatacaggagcacccggattcataaagcaagtcctaagtgacctacaaggagacttagactcccacacaataataatggaagactttaaattatctttctatttcactaaattccacttttctgaaaggtgatatgaatggttcatatagggaaatattacagtgaggcttgttattgtttgtaataccatattcatttagatgttttctccatcctcctttttttttctttttttaccttctttataattttccttttagttctggttcctgatggtactgaatattaagaagattatctgccatttttgaggaggaaatatctaatagtataatctttttcctctatgttacaggcagaagtataactgcagcagcaatctgcctttcccctttatttgaatttacagaatatgttaaaatcaataataagatgcaaataaaaaatcactcattgacacttaatatgctgaatacaaattcagcaccataattaaattgcaaagtttaacattatactccattttgatattaatatttgatcttgcaatgaatgtctgcttgtcaaccttttatttactgtggaggtcgtggtatacggtattaaagaagacattcaactagagctcaatttttctgatgagctcccaggttcccatcgcaattttagacaacacatgctgttttactggaagagtatctaaaggatatagtctgatcactctctacctcccatggtaaaccttctgtttgttttttgaatttggtagttaaaggtgcatgataaaacttgccatctctgttagatgctgctaaatgagactagtaaaatgactgccaagctccagccgctctttattttattgctttaaacatagatttcctagatggtcatgatctggtttgtccaaatccaccttaactcttaaagcaataataaatataaattttaaattctaaatgaaagagaggaaggggtctcttcataagtgaaaacattccttaaacaaatgaaagcaaacagaatttttttcatggacctgtattttcatttttctgaccattatacgattttcctagcaatataaaagaattctgcagtccctccctatttagttgttggaagagaaaaatacattaaatcttaattagtatactacctatagtagcatctggtgttactgaatttttaccatcttctgaaagcagtaatcattctttacctggaggaaaagattccagtaatctgttttattaggaaacttttctagccttcctttcagttacgggatttattgaaaactacctcatatacatatgcacatatacccatatatgcatatgtatatatacatgtgtgaatacatatatggctatagatctgtgtgtatgtacacatatagacacgtgtgtatgtttttgtgtgtatatgtttttatgtgtatctgtatgttcctttctaaatagcattctatttcataccttggaaaaatataaaattaaaaaatgaggtcaagatggcgccttttaagaaataagttgttataacagttcctttcagcttcacatcataagtgttaagaacacttgagtatttttaatgtaaacatattttagcatctatttgatttttactttattttcttgatactttcagatatatatttgctttacattattctcagggtttcttatttcccgaaaacactttgaatcatttccactgattctttttcctcccttgttagtttacatgtatcatttgtatgatagtgtctggaagtaaaagggcacttgagaaacaaagttgaataaaatttcatcatacttaattctgaaaattgttttctgaaattattagctcactgctgaaatatcttcagatcaaacgttcagaacatcagctcccaaggagcttcatatttagtttatggtggggtatgattgtgtatttcacaaaattcatgaaggaaatttgtacaaatttattatggattttaggccagcggaactgtttaaacttcctactctatttgttccattgagtagccttagagttgaaacagcagtttccatttttctcatgggtagatcaacccatatgcacatttatcattgatttctagcactggaaaagcatagacattggagacggtggtcgggcacggtggctcatgcttgtaatcccagcactttgggaggccaaggtgggcagatcacctgaggtcaggagttcaagaccagcctggctaacatggtgaaacccagtttccactaaaaatacaaaaaattaactgggtgtggtggtgcacgcctgtaatcccagctacttgggaggctgaggcaggagaattgcttgaatccgggaggcagagattgcagagagccaagatagtgccattgtactccagcttgggcaacaagagtgaaactccatctcaaaaaaagaaaaaaagaaaagaaaaaaattggagacagctgttcacgtatttaaaggagggagaatattcttggagaatataattggtgaaataaaaatacaattcatatgtactctatggaagataaactgcaataagcaaacctctttggcagattttaaaatcagaaatatattccagccagtgtgggatattcaatctaatttcctttgagaacctgattctgttggattggtaggcattaggaagcaacagctcttctctctccatctcctcaaaaaattgtaaacggaaatgttgtatgaaaaaaacttcaaagatacattctaatttttttcttttgctattttaataggcttttttattttttaagaactgaggttagtgaacatgtgagagaatctgaagtacttttcatatgtttttgtccttgaactgagttatttgaatctggcaaatttctctattaataattacaattattatatcactatgtcagtatgtgtgttatattcaatctagaatatttgctctttttactcccatggttttgaaataagcatataggcatttaatttttaggagttataaatgtccaatagctatgttttatatcaatatgaactgcattgtgttttattactaatagtttagataaatctgtatatccaaattgtgaaccactgaaatgaataattccctttcttagagaaggacatgaatatagtgagagatctgttactttctggattcttctttttggtccttcaagaagttgtacaaagataatatcgatgttctcttttattcatcagtttctctcaactggtttcagaacattgcagtatcagagaggggaaaaaaataagtatttcagatttttttttcttgagacaaagtctcactctgtcacccaagctggagtgcagtggcatgatctgggctcactgcagcctccgcctcctgggttcaagcgattcttatgcctcagcctcccaagtagctgggaccccaggcatgcatcaccacacccagctaatttctgtgtttttagtagagatgaggtttcaccacgttggccaggctagtctctaactcccagtgatccacctgcctcagccccacaaagtgctgggattacaggtgtgagccaccatgccctgccaaaaatcagtattttctctgtatcacactcccaacctttaacattgcctcccattctttcttttggctgttatttaatgagagactactatgggtaggacattgtgttaatctctgggaataagagaccttcatattcctgctattatggagttgcggtttagtagagatggtaggtaagaacatgggctcctgaattgcaatgcctgggttctgttcttggttgtggttgtactgcttactagaaaagttgaagaaatcacttcattatttgtttgagtttccttcttgctgaaataaatataactctatcttaaataagataatgtatgggttaaacaatgcatgtaaaacatttggcactgatgttagaaaagggaacatacaggttagtatctctaaccatgttgtaaaagtgatttgaccagctgtattcagttataaacattttattgcacttttggagccttttccaagtcctgtgtaacctttggaataccctctgttcacctccccccaccaaaaaggctcctgtaagtccatcacttcttggaagcttcctcatttaacatcccctgtctagccattcctatacatgaagcagacacgactccttggtatgcactgtgcagtaatgaacagttattccctccttgtacatgttgctaatgtggattatttatttgaattctgactctttgggatccctttgtttataattttaagttcttagaaggatagggaccacagtaatctaccttggtctatgtgacacttgcacctttagtattcaataattgaaacacataaaagtgatttcagtggaggtgagcacaagcttccttttttcactgtgtgaatagacatagaggtgaccacacgtttttttcttgtcttgctttttcactaagctttctctgtgattgagaacaaacagggaagtctgaacggttccctgttattttatcttttggatgtagaggcatacatacaaatttctgttgaatgctttgtaagggttacctcatttattcttaaacttttacacagttactgctgtgtatttatgggatgcaggtactgtttatccattgtaattatagttcgtttgttagaccaaacattgggaaaatcttttgttgtgaatggtgattttctaaatttttacttttgttttttatttgccagattctgtctctcttttctttgttcttggtgtactaatctgattcctcttccatggctattccactttttccaagtcttaccctaaagccttttaaagcgatacgtttagatcaactttttttttctttttgtttgtagtttgcacattatatgctgtactttgactaatttaataattttttcttataattccatgtggaaattttaattttagttttgttttcccctgacctttataaaaacaagagattaagtgtaatattttctacttactgcttcaggctttgtaaatttggcacttaatggtttcattgttttagaacagaaaagattatcttaactgaccactaacaacatagttgccagtttggcgcaccaaatctgtagttaatactgatttcaaaatagtgtttcttggcaaatcacaaccaaaagcttagaatattctgtatgacttttagttctaaagtaccttgcaagtattactgttaatctcattttgtagcagaaataatagaccaggagcattaaaaggacgtatttgtttattcatatggctagtatgtgtggtactactgaactgaacccatgcttctgcctagttaaatggtctcaaaacactaagaaaaaaagccaacgtataaaattcaatagcggttagtagcaaggaatgagtgttatctgaagtcatagcgtgcttgttaaagtattttcaattaactttctccacgcgtctcttaaatatatgtttttgtatatatttacagtttttttggacagatctatttggcagtcttctttaagatattgtcagctactcattcacaagaatggtgacatcttaattttaaaaaacattttatatagttactctctttattctggtgcaataataatactacacactgggtaaattgtaaagaatagagatttatttgacccatagttctgaaggctgagaaatctgagagcaggatgctggcatctggtaagggccttcttgctgcatcattatgtggcagaaggcatcacatgaagaggagttgtgcttagaagacagagaaaaaatcggggccaaacttattctttttataactacctacttccttgataactaactcactcctgcaataacagtcttaatccattcacaagggtggtatccacctgacctaatcacctcctaaaggtctgacctctcaatacatttgcaatggcaattaaatttcaatgtgagtttttgaggagacaaaccatagcagttatgtattttgttaaacttaagcattttattctgttaaattatgtatgtatttatatatatatatacatatatatacacgcaagcacacatatacaggcatacttatgtgtttatatgtgtgtttatagatctttttcttaggaagataattatattttaaaagtcattgatggtagggatgatagcagaggaagttgtgaaatacaatctaagtaatattatagagcatacgttcagtattttgaaaactgctcaataagggtatatttgttgacaagtaatagatcacattacaaacttactattagacattgtttatctagtcagcatttatgaatagtctgtggtgatctgtgtgtttatattccacatacagtctatcaacaaatcctgtcatttctactttcagaatatatgctaaatgcaaccacttcttactacctttatcactgccaccttatttcaaaaccaggttttacttatttactatacgatcttgtccaagtgtttatagtgttaggatttttcttttcacaatcattcgtcataggtaaagaacttatttttctctcacatggtacattaaaaatagaagcaagcaagtaattgtctttaaaaattttttgctttgcctattattattcctctagaaaagataataataatacatagttacaagaacatttacattgaagaaggtgacttaatatttgaaattattgtgtttaatattatttcggtttttattaatgcttggtatattttgttaataatttaaatattgctaaattttggaaaaaattataatggaatcattatattagagttcttcagagaaattcaaccaataagggatggttatatctctatataattatgtttatgtgtgtgtttatgtatatgtatgtatatttgtatgtatatgcagtcatgcatcacttaatgacagggatacattctaagaaatgtgttgttaggcaatctgatccctgtgcaaacatcatagagtatacttacacaaacctagatggtatagcctactacacagctatgctatatcatatagcctgttactctaagactgtaaacctatacagcatgttactgtgctgaatactataggcaattgtaaaacagtggtaagtatttgtatatttaaacatagaaaaggtaatgggttgcactaccacattatgatggctacagcatcactaggccataggaaattttggttctattttaatcttatggggccaccattgtatgtgcagttcatcattgaccaaaacatcattattcagtgcatgactatatatatatttgtcacttattagcacattaatatggatttgtataaataaatttctagtaacgctcaaataacatacatggatgcattttcaattgcttctcaaatatatggagtattttaaataagtagattccaaaaagcaaaacaagtttaataaatgtctatttgcagctacattacacactcatacacacacatgcacacgcacactctctcacagaggcagtcaactgttcatgaaatattaagattatattttacaatgatatttaaaacttgaaacatacatacaaaacaatgaagtgtgatagctaacagcacagacttggatcagatagaatgacatttgacttccagctctgactttctgagccttggttttcttatgtgtcaagtaatgataatacctgcttctttgtgttgattaaatgagaatatatgtaaactacttgccatggtgccctgtacacatcatacacagtaaactattaccatctgtattttaattcttaattccttcccctgaacacaacttgataaatattctttaggtttctgttcctcctttcaaaagttgatttaattcataatgtaacttagcgtaatataaataataccatagaaataaccatctgtagcagtggtttgatgggaaaatacagtcacagctacaatttgataagccaggaactgtatttttccctcctgaagttataaaagtagaagtagtaatcctctctccaggcatccttttatcttttgaagaatagaagtaaatatatctacatatccaagccagtggtagtccttctgtattggggctttttgcagaggattggggctttttgcagagcaggcctgcaaggggaatgaatatcagaaatgaggttccagtgacagaaggtactgaaatgctgtgtgtgtgtgtgtgtgtgtgtgtgtagaatgtgaggggggttggataggttcatgtgggtgtaaagtgaagagataggccagggtgatagatgtatagaacttctgattttaaaataagcatgtaagctgtatactatttaatgaaattactattgacattttattgaaattaaataatgaattcatcacattttatgagaccaactttaagaaaactagctggatttttaatggtttgcttcaacttaatagtggtatataacttagtacaaacatcgaaggctatcagaaaatgtatgttagaattttaatgattatagaaactgtggaatattctgtatatatctgacacttaaaattacttgttctggggtatccataataaaatttatgtcatgtggttttttgggtcagtattttcaggtataagcctggtgtgtaacagtgaatgctcttagaagattgggtctgtatcttttgtctctgtaaattacacaatgataggaagttaatatgttagggatttaataagtatgttaatgattatctataaagataatatgctttattttttgattggtttgtcatattttattggcctgctttctgctagaataccattatgatataacttgccaaggagccctagggtatgaaaaaacagtcttccctttttaattatgagaagttcagagaccttctgaatatattaatgattactactaaagcaattcttaataatttttccactaataggagttgtaaagatgccagactcaaacagatgtgaatactaggctcccttgctagttgagttcttgttacttcacatcagtcttacagctttctgttagtgtgagtcacatgtgggtctcagcaaaatgataaattagcatagaccctggacctctgggtcatggtaaaaataatcactgaatattaaggatctgtgtaaagattcttaacctgtatagggtctgtgttcagaagatctgtgaaactcctgaaattgtctgccacattttgtgtatacgtgcatacacattttttctgtgaaggatatatgagtattttcaagtctgtaacccatgaaaggttaaggaccaacggatttataacctgttcagaagtcttttacattgagttaccatttgccatctcatttcctcactaattgcatattagtgaggaaaaacttagataccatatatttttttattagtcttattttaattttccagaaaatttgtgaccttttcataatacagtgttatttcttctttatgtgattcgtattttagtacaaataccatgttaaggtgcttgataaaatgtgaatgatttatgaaattttacttatatacccaaatttgttgttaaaagggacaaaaaggaatttttttgtattttacattcagtccttttcatggaatagaatattttaaaacaactttggcttgaatttttaattatcatatttagaaatcctgcttttatgaaaatacagaaccctcactctgtggcttacagacaatagtagtatattatgtagggtagcctaaacaatggttgattattgtgtttgtgtatatttcattctctctgaattggacttgagaggcaaactttgtctttaaacctttagctgttgctttctggacctttgtattgcctaagggatgcaaacttcttggaaagtagaaccataaagttgtaaatgaacaagggaagaaatagaaaatataatttttgtcttcattaatgtttctaaagtagacagtaatttcacaattacagtatccactctcatgaaatttactaactacattaatgagcaaatgtgaagctgttttgctaatgtggaaattaaattttttaaaacaaaacttttttattctgtcaccaaagaaagaagcacattggttatgttaataaaaataatagaataaacagtcattcattggatgtttaattgttacaggcacttttacatattaccttactggatcttaaccactgtaagcattaaatggtattgccattttgatgaggaaactaaaacatgtagaagtttcttcaaggtgttctatgtgaccttcaaaaccaggcaattaatgggtgcttaatatttgttaaattgaattgcattgaaatctctttttactctgatcttttcattagtattatcattttttcatttatctgcggttaaattatggcctcaattttgggactccaggcctcagtatacattaacataggaaatatacccatttaaatgtctgctacattgtttcctgcagtgattcttctttttataatcaaagcagtgtgtagcaagcttttatcataatattttggaaaaatacgatctcttttataatcctaactgttagctaagtgaagcagattttctatactttcattcccacttattagtcacaaattatggggctggagatgagttgagatattggaggtcttttctccccagccttctatgcaaatagaggattttcattttttcttaatagtttgtggtgtttttcctaaaaagtaatccttaatatagtttttacccatattggtttagtttcttttgagagaaaatatattttattgatatataataattatacttttggtatctctcattttaaggtattagcctcatttttaaatagtgtttgaatcggcaaatgggtaaaaaatttgggtgttatggaatataagaaaaagaaatgaatagttgtatagtcaacattttatacagatgtaagtatataaagtttatatcaaagaaaatacttcaaaatattttaagtattatagctagtattgatgcagtatggtcaaattcatttagtgagggagtcattactgctacatctagcttttataaaatttgaaaaattcatgaatattatattaaatattttaccactttgggaggccaaggctggtggatcatgaggccaggagatcaagaccatcctcgccaacaaggtgaaaccctgtctctactaaaaatacaaaaatgagccaggcgtggtggcgtgtgcctgtagttccagctactcaggaggctgaggcaagagaatcgcttgatcccgggaggcggaggttgcagtgagctgagatcaggccactgcactccagcctgggcgacagagtgggagtccagctaaaaaaagaaatatatatatatatatatatatatatatatatatatgtatatataattcatataaatatagtactttatttaaaaataaatagcattttctcctcttctcatttgtttatacttttaatatgttctgtttacttgtaatcaatgtggagtcttcttttaaaaaaaaattaacattgctgttgtgaagaaaatttgcagatgaatattggaaaatatactgaatacctagaaggaaaataatgttttttgtccttcttaatatagaggtcaaaatagaaaagctatttctaaagttgccattcgtgggaaaggaaaggccttatcatttatagaatttgatatcagggaacagttgttctgaagtaaaacaatccagaccattaccacattgataattttctccaattagacagattagaggtttaatcctaaaagaaccccagtatccaatatttttgcctacatctttaacattaaggaaatcctgtttttaaatttatatttttaaccattacacaagatctttattattggaaaaaggacagacgcaaattaatcagaaaatttctcattgaggaagattgagtttttaaatgtatgttaacaaaaggtagaaaaactcatcacacttagcatgtatacagtacttatatggactagaaagtttgttcttgtgctttcagtagaagcataaaacaaatctgatgttgtcatagagatagtttcataataggttatgtttttgtacaagtcccatattttcactagaactattacaaacattacagtcatcagcagatgttacacatgtctagcatagaaatttctttttttgtttttgttgtttgtttgtttgagacggagtcttgctctgtcaccaggctggagttcagtggcgcgatctcggctcactgcaacctgtgcctcccggaggttcaagcagttcccctgcctcagcctcccgagtagctgggactacaggtgtgcgccaccacgcccagcttatttttgcatttttagtagagatggggaatttcaccatgttggccaggatggtctcgatctcttgacctcatgatctgcctgccttaggctcccaaagtgctgggattacaggcgtgagccactgcaccgggccctagcatagaaatttctaaagtggatataaattaatcatatcaattctaaattacagtttagttaacattttttaacctgttcttcagttattacactgtatttttagtccaaaaaaagatgaaaggatttatcaggatgttttgaggggatagatttttaaataggtcattttgaagatacttttgagtagacatagtcattacatagtcattaaaaaaccagagctttacatatttttataaaataatttttaaattctaaaagtaataaatgaccttagggaagatttggaaaatacaaacaagtatgaagaagaaaaaaaaaagtccccgcaatcccactgtgcaaatcaaccactcttttttttttttccaagccaaactgtatccagctttattaaagatactttccataaacagtcgtggtatttcaggcagaacatgggcagacagtcattaacagtacacaacaactttcaaacttaactaccttcttcaatggactaccgaaaatcagaaagccactataaaacccaatgaagtcttcatctgatgctctgaacaggcaaagtttagagtgagggttgacatgtcacatttagcatgttgtttaacaacttttcacaagctgaccctgactatcaggaagtgaaatgaaaacggcagaatttatctgaagatccacaatctagaaacggaaccactgctcttttgacaggtgccatctcagtggcatcccggaaaagtccagattgcctgacacactggtaaccaatgactggaggtcaggtcccaacagatgtctgggcttaagggagttaagtctgtgctgatagatgggaagggagaagagagataaaaatgattttgtttttccataccacaaggcttttgtgccaaggtggccatatgtgtcaaagtcgcggaatccctcctgggagccaagagtaagtctctcaaaactagaagggaaaagtgttttccccacatcaatccagcttcgaagacaccctattagtgacatatgccccttccccacaaaacaacaatgaagtgttctgtgtgctaacagcatagctcaaaaaaaaaaagtaaaacaaaattttgcatttttataaaacttggtaaaaatagtatttcaaactgttcagtcaccagaagtacacagttatcaaaaatgcacacacttctcttggcacctccagcaccttcagctttctgtgcctgatctgttttgacatctccattttctgcagggttattcccctccttgccagcatcagcttttccctttctccctttgggtaccttctctcccttctttgcaggggcctttttaggcctgggctctggctttggagaagcaggtttagcggacaaccttgcagatcttctctgtggttcgtcctttaccttggctttatctcctttagcatccccttcagcctttctcttgggcatggtggtggcagtgatggtggtgggacataggcactgggcgtaggatgcagaggcatgtgggctttggtgagtccaggggtcgttcttgcctcttgttcatactgctccaaatcaaccactcttaatagtaaattctttataaatattgactattgtgtacatttaagttgtttattacttttcactgttaaaaatagtttttcctcacacaatttctaaggatgcttcttaatgacagcaaaatgcaattttctaaagaaatttatccaacttgataaaaccaagagtcctttacttaggacaggtatatggggtagtggtaagagcttccctattccctgtttgacacaaattttcttggaagcaaggaaagtagaaccatattcccaagaagcattctcttggtgaggcagaatagaagaaagaataaatactatgagaacattttagggacagtcctgaatagtagtcgagtagtaagggctccaaaagaacttacattccttcctttgtcactggaaaatcccagttagctttgaatagggcgttgactctacccccatattaatatttttagacagtgttatagattgaattgtgcttcctcaaaatttgtatgttgaagctgtcactcccaatgtgtctgtatttggagatagggcctttaatgatgtaattaaggttaaatgagatcataaggatagggctattatccagtatgactggtgtctttgtaagaaaaagactagctaccaggtgtctgctttaatagagaaaacctatgagacaagaccatctaaaagccaaggagggaagccacaggagaaaccagccctgcggacaacttgatcttggactttcagcttccagaactgaaagtctggaggctgttgttgaaaatctggaggctattgttggtggctgttgtttaagccacccagtctgtggcatttcgttaatggcagccctagcaaaccgatacatacagttttctccctttcccttccccttccccttcccattttagtagtagtgcagtaggcggaataacagctcctcacagatagaaactgctactctgtggactgtgtaagcattaccttaaaaggaaaaaagattgggagactatcccgggttatctaggtaggccataagcacaataataaatgtccttataagagagaggcagagggagatttgacacagacatacataagagaaggtggtacgatcactaaggtagagactgggataatggccacaagtcaagaaatgctggcagctagaaggaggaagaggcaaaaagcagatttccaagagggaatatagccctgctgactccttgttttctgcccagtgaaactattttggactttgtgagggaatatatttctttttgtttaagctattgagtttgtagtaatttgttttcagcagccataggtaactaatgcaaatagctgctgaaaataccaaatacttttctgtgtctaatgatgtaatcttatggttttgaatcatatgatgtttgctttctaatttgtgaaaaaatcatatcgattactttgctatttttttgtaaactgcctctttctggtatttttttcaaacactgatggatttgataatattttgatagagttttttattaaggaattaaatagtctctactttttcttttttatactgtctttgtcaggtttgggtcataaggttatatgttaaattgttttggatacatagtcggagcccaggttattctaaccttgaaagtcagttatcaaagctgaagctttctatgatagacaattgggagataattttggttcttaagtagaagaaaccatattaaagtgtgttttttaagataataagacataacagtacatccaaaaattgtttgtaggtacctagggagcaaaatcaggcataaagtctcagataacaatctaggtactgagtttctcaaacacattctgtctcattcatgttcttcaggagtgaagactacgtgaattgagttttgggggatttaatcaggaagtaaaggaattctaagcccctagagaatgtcacagtagatgactgagaggtgatcatgtttatcttttccctgtaattctttcattccattttttttttctttggaagaggtgaacatcgtagataataaactttgggagtgttaggggatggaagggaacatgtctgtataggtcagagtttctgaggttggtagccttggactttttgtgagagaaagaagagtagagttataaggatccagggatacatatgcaacccaagcattgtataaacactggaaaaataatataactcacacgtctgttattccacattttcaaatgtacttaattactttgtaaatctaaatcatcaactgaaaaattatgtttctaaatttgtggcacctgtagttaatgctttcaaacaacaaataataacagcttatacctattaccctatgggaatctgtagagtgggtttaaaaaattattttaaagggaccatcttttaaatgaaaccctccctataaacttataaaattaatcagggaagaagggatggggagaaacaaaaaccaagcttgcagcacattcagcgttaatcactaggtgaggcttgctctctggtctgcttcttcatagttgtttggtgcctattgtcctacaatcacaaagaccttagattataattctccttaactgctccatagaaaacaacttgaacattatgaaacattaagttttccctttgagatactctttttttttttttttttaactgttccaaaggcacattggcacctttgagatacactttcaggtcctgcataccagtgaaactacaggcaccagctggtctgacggtgagctgtctcagcaaatgcactcggtatcttcatgatttcatctcccttattccaaccaatcaatgaccccaaatttccagccccttgccctctactatctccttaaaatccccagcccagaactcctctgggagatggatttgagggtctcctcccatctcctttctcagccaccctgtggttattaaattctttctgtgttacaaaccctgctatctcagtatattggtccgttactgtagatcaggcgtacaaatttgttggtcttgaatctaaacaccagtcccttaatcttattactgaggatactcttggctatgtagttactcatggttacattgctagttagttacagaaccctggtgagagcctgtgttttcaagatctcttagaaatgctgtgaagaaaaggtcttaggtttaggtcttagtagtaattatttggtttgactttggaaaagtgtagatacctgcatctcctcactgtgggctatgcacagatgaaatgtagcattattacgttttgaaaggtgcaggatagcttctgtttttcaacattatgctttagttgttctagccaccattctttatttaaatgagtaggaagccaagagcaaagtaaagatggatttttggagtcctttgcttattttcccacattttttcttaccagagaacacataacatagacaggtagataggaagggagggaggtagataggcaggcagttcaaccagaaaaaaatcaagcctgttttagcaggttgtgaaaagatgaactgaatctgtcaatgtccgcatcttctttagttaccaggagtggatgtgggtaagccttggtgcagcagataatactgataagtgtatatgttccaaatagagatgtggtcataggaggaaaaagaatgttaatgccatctgggatgttaagaagttagggaaggacacagagcataattgagatgaaattgtaacttcttactctcttcagtgatagtcaaatctaatttaagtctgttactctattctcatgaaaacattctcaagagttgaagaaaataaatagtaaggcagtctgtatggaccttaacaaaacttagttttgactattggaattaaattttaatattttaatttggaaatctcatcctgaaatctcttttggtaaaaacatggaatctttttagtatgaattagaattattctggtcaacaattatagtttctgtacccattagggtatcaaagtcttatattcaaattatattaaattgactcattgactcatctagttcagtgggaatatgattttagaagtagaataaagtctacttgtatttgtaaagttgacactatgttttatgagggaatttaatgttcttttcaggaacatgaggctggacagaaagataatcttacaagaaattatctcagtttttcattttggccttttgttcacaaaagagctagaattcaaaagaaaacaacatttagcctatttatttatttgtttattattttttgagagggagtcttgctctgttgcccaggctggaatgcagtggtgccatctcggctcactgcaacctctgcctcccaggtttaagcgattctcctgcctcagcctcccaagtagctgggactacagttacatgccaccacgcctggctaattttttgtatttttggtagggacagggtttcaccatgttgatcaggcttgtcttgaacacctgaccttgtgatccacccacctcagcctccaaagtgctgggattacaagtgtgagccactgcgctcagccgccctttttaatactatggttattttagttgatatcttcagattgctcttgattggagtatataaaatatgtcatagattgtgttattttaattttacttgtctatgttcttatttctttgaagttgctatttttcactatattttgctgtcacctataaattataaatattagtcttaacagaagtcagatattttctatattggatttttttttgaaaaaaaggagataggataaaatgtaaggaaatcaaatctaggaactaatttagaaaagtcagaggatttttatttagtattgagaagtataagataagttaaatgtatacaccagagaaaaaaagttcttattacaatgtaatatgtggaacaaaaaaaaatagtaaggatatggctatctatattttattttaatgtttatttaacaaatatttactcagctccaaattaggtactagaaactgtctcagactctgggaatatatttccacacatcctggtcaatgaaacattaaatttctaattagaaattttagaagttctaagaaagcaaaaagctcatggtgcttttggaacatagtccagggagatttaacctaatccagagaagctcgggaaaaatttgtgccagactataaggtgagaccgtaaggttgagtcagagagggacagaaggggtttggagagaatgttattggagtgtaggaatagtatgttcaaaaactctgaagcgactataatgtattgtaagataccctgaaagaagttcatgatcgtaggagtggaggcagtgagaagaggtgaagccagactggaatggttcaaaggcaacacttgaaattacctgattaaaataaggcactcaacatagccttaagaatgaaggttattccatttggtattctttgctgaactgcttaacagtatttttatgtttccatgtgctgaattcattttataaatttttttaaaagtaatgcatgtgtttggagcagcattataagaccatggaaatggttttactgtttgtctcttttacgttttttaagaacaaagcttccattttccacttccatctcttggactattcatttaacggtgatctttctgtttcttaatccaggttctaaggattctggggttggtagtttaactcttaatccttttaaaaaattgaaccaatgtatcttttcaatgagaaatagttcataaatcttgctactcaaataaatcatgagtctatatgaggacttcagttgggaattcgtttattcctgttcactagaattaggaaactctatgtagataggagccatctctgtgtttacttactgtctctacagttcccagccattgcctagtatattaatccatttttgttggtataaaggaatatctgagactgggtaatttacaaaggaatgatatttattttggctcatgtttctgcagactgtacaggaagtgtagtgctctcatctgcttctggtaaggcctcaggaagcttacaatcatggtggaaggcaaaaggggagttggcatatcacatggtgagaggagggaacaagggtccggggccgcggtgccgcactcttttaaacaaccagatctcatatgaactcagagcgagaactcatttattgtgaggacagcaccaagccattcatgagggatcttcccccaagccccaaacacctccctctaggcccacctccagcattagacatcctatttcaacatgaggtttggaggggacaaaacattcaaaccgtatcacccgggatattgttgatgaagtatttgttgattgaattaatactaaattttgttggcattacattttattttgactttaaatgctgatgagtatttgatagttcatggttctgtgataacatttaggcttgtagtgaataaaacattacaatattgtttaaatcttttcttttacatttaaataaaagatggataagaatgttactttaacattttatataatatcctttaacaatctgtaggctaatctttagtttatggggcttctaacccataatgcagttgtactgattcttttgccatttccaatttgttgctgtgaccatttggtgaatattttatttcacttattatactttttagatctagagttttctgtttttgttgtttctttttttctcttgagatttattctgtgttcactcactgatagcatatttttcttcagttctttgaatatatttataatagcttttttgaattactttacttgctaaattcaatgtctgagcccagttagagtcatttgtattgagtgtattttttcttaagtaatttcctgaagactttcctgtttgtttttttggggatttttttttttttttttgcatatgtagaaatttctggttgaaaactagacattgggaaacatatggtgaaatgactctgggttctgtcatattcttttgaggaccttggttttttgttctagtaggcaattaacttccttgggttgaaaccacaaactgtctcctgtgaggtattcagcttacacctttcctctgctgctttgttagcctgaacacctataggtcccccttgtatatgcacagtgtggtagcccaaagattttggcagatgctcatcttctttgttgtttctttgtgtctcagaatttcctcctaattgacagtagccatgccagctttgggccctatactctgacacatcaagcctgtctagattcatctttctaccactcaagctgtaaatgattgaaaaatgttctcagttaataaaagaatcacagattctaaaatcttgtttttttttttttctcttcctgctttttcactaggcttcataggcctcccttgctcatgtgtaaattttgttgtcagctaggaatttgtgtagcttgtgctctgaatttgagtctcgtgccttctgtgattagcttggtgctaacatttttcctttaaattttcagctctttttccagctctccactccaagttctagcatctttagccagtgcgatgccatttttttcttctccttttttgtagctgtagctatggagtttggtcagtgccttgcagccagtatgaactctcaattcttaccccttctagttttcaaaataaaactctcttcagccttatgtctgcatttgaaagtttgaagtatcttcaagtagtttgtttgctttaatctagtatcttattattggtatctctggggttttgtatgaccacgtcagtttttcagcatgatcagaagttaaactacttcatccctattgatttcaaatagtacatttaaaacaagggcttctaaacattcaatgaaattcaaatgatgttttagacattaacttacacctcaactcttccaaatttgtaagttcatgtttgcactttgtacttcccttttttttttttttttgagaacagcaaattatatttcagctgatggactttcctcagtttctgttaattacatgtgtgtctctatttagtagtgcatttagagtcactatttttcactgctgcagatatctagacatttgattggaaaatagttcggcattgaacttagtagcaatattgggggacttgggactaaaaagcaccaatcaacttagaaaaccaagccctgtagtaacacaagggaaaaaaaaaattcctgaagccaataccttgggaaataaagataatagaaatgaaatcatctaagtagatggccttaatatttctggacatgttccataaccctcacaggtaacagtggactggcatctgggagacaggacaaaacataaatgtggaatttcaaggatattcctattttctgttaaagttgcaggaagtatgaattactaaagactttacatatggtcagattgctgagtttcagtttcaaatattaaacactctttttcagacgttctcccatttcactctcatttcatatgagttcatattattttatgccccaggcccgaagtgtagataagtttactgctccattgtatactgtttatctgattcactctccccctcttttgccttctggtgttacagagtggtaagcaggaaagcagggtctgtatctatctgtgctataggttcactatccttgccataaattaagttgatcgcttaaaaagtatcactactttagcactagatttagctcgcttttaacagaaatttcatggtgatcttttctcatttcaaggcccttgaaataagggccttgttttctcgttaatggagcatctcattctccttcaacagggcttgatttcctttgaacaaacattattcttaccaataattctgataactttctggtaatttaattgtggttatccagcctctttattctccatcagttcattttagatattcttctgatttccttttgtctttcacaagatctttgaaatcccattttctctacatctttaatatgacctgaaaaaaatgtttgttcaatttatacatcctgccacaaaatagtactctgcttcaaattccacatttatgttttgtctcctctgccacaggtaataacccgtccactattacctgtgggggttatggaacatgtccagaaatactaaggctgcccacttaggtgattttattcttattatcttcattttccaaggcattggcttcaggatgttttttctccttgtgttttctgacttgattggtgatgccgagcattcacacagcttttcagtttctcagcttagaagcaaggaatgttaaaaagttactatcagtgcctttaatcatgaaaaagacaagtagaaggaattagttctctcacccagggacatcagtgtgtatgtataccagtgggaaccagacatcgtgtctaggtaaaatcacttatcacactgcagctaattttttcacctggtaattttagccaaactaggtcatgttataaatgtcagcaaggcaaaagagagaataaaatgtcatcagaataatgcacatacatttcaatggaggttaaaatcttttataggaaacaggattatgaggtaggagatttttttcattgcagcagtgaatgtgaatacagttactatgattcttaaggtattcactttggcctcattcctgctttctttaaattagaaaaaatatctcaagtttgcttacaggtaagagttttaagccaaataaataacagttattgtagtgatttggttgaaaaataaacttctaattcccctttaaaaactgagaagaaatgaaatatagtgcaacgtcagccacaaaatcattattttgatagctaacatcatttgtattctaggctagaattttaaaatttaaagttcaaaaaataaaattttattcacattgttgattttgcccaatgacacaagctatatgttaatattaaattaatatagacaaattaaagaaagtaccacatttatcactttcatatgtagtaatttttatttcaataaccagaattgtaggtttcaaaaaatgtttgaaaatttgctttaattaatagttttgacaaagaacctttaatagaccgctgcttttcttttcaaagtttcagttaaacctgaagaaataatatggtcctgctgtgatttttgaatgaatgcttttgtggttgcataaattgtgttttttcatgaatattaggattgtaaatgaaaattaagtctggattctgatccttttcctttcaagcttattaaaataagatcttttaggatcactgtgactctctccttgttagttttatgtcataacttagccctgattataaacaaactttaactgtttcttaattcagttttttcttttgtcatgagcaaagaaaaattactgaaataaataagcattgagacatattcttgtagttgaaaacttagtgtgggaatcatatttttgactcccagctcaggatagtattaggtagggtagattattttatcttcttgtaaaatagtgtaaaataaatatttgcctatagacattacagtttagagtagagaagtttcacattagaaagatgctgattcgtctttacatttaggcataaaagagggagtacatagagagcatttataatttatctactttaaacataattattttttattatttccctttgcactatttttaatcctactcatagaatgaaagatgaggcattgaacttgtatctaagattgatgatttgttttgagtctggggcagacagacacagtaatggcttagtctgatacaggcattttgggttcagtctctagggacaggtattcatatgtaataaaaccacttgaactggcattgattgccattgttgataatcctagcaggatcaacattgattgagtaaataaaaagatcgaatttaccttcttctggcaaggcaggcagagaagcaggacaaagcataaagacttgacagcactgtagcattacctctattcaactgtgcttcagagaaaagaagtggcaatgattaagggtactgttcaattcagcaagcaattattgagcagttctgtagcgcaacactgttagctgctaaaggactcaaaaggagaagacagtatgattttgcactaaagtagtttatcatctaaattggaagacaaacggttcatatgtgaaacagctagaaaacaaattatgacagtatataattgagtgtacagttgttcatgcaacagaatacaagcacaatttatttgtccagcaagtgaaaagatatatctttataatgtttataatgttaaattttgtgtggcaacataaagtaacatagcctgagttaattcaggtctttggttatttaagatgaaaaaacccccagcaatttaaatggtatttatttaaaatatcctttattttatttatcgtcctttatttagaccacctaaaaacactagatatatgattattcatacctgagcccccccaaaaaaaaatcaagactagcttactccctgttaatgattcaatcaattgagtataaactttattaggttttgttcactattgattctttgcctcatatatcataaaggttcattctgtctattttgcagtattttccaatgtctaggtattctgaattatgttcactaaaaagtaggtctcaaagagcatcgtaatctccttagctttgtataaggaagccatgtaacaaagcagccttactacgtttctgtttttgcttttgttttatttttatctccattacttgttaagtggtaatggtgtagtagcatcttaaaataccatactattaagattgagccggggaaccttctcctattctttgctcttcagatatttctctactgtaaccccatagctcttgaacatctcatgacatatatcattgtattttaatttaataaattcatttttctatgcactagactggcttctttgcattataaccaggacttcacatagatgctggtacctcatagatttctaataaatacctgctgaattaaggaaacacaaatttatgttctacatcacgatgttagtgaaaatttgttgctgtgtttatttctcacaataaataaacatggggtgcctcctgtagtagtgtcctatgggaatcaattattgatacccagtgatgtagacaagttgttttaaaaaagaaaagattgaaggaaagcagtctcctcttttaccagcccccacctcaactatataattttaagaaaattgatatcaaaagctgtgatatccgtttctctttaccatccaaagttcttgaagttgccttgacaagcagagattccttgaatcagtccaaatacatgatatatagataaataatacgtgtgtgtgtgtagacatctttagtagaaacagcttttcagatactgatttcatactgtcttcctcctggctttccattgacttactgatttcagatacagtttcaaattgcatcttaattgtggggagtggggatagtagctagcctctggctcctcttttttaaggttatttctgagactgccttggagtggttcaaaccagaataaatgcagtttactgcctatcactccatactcttaagatggttttgccagcttttagagcctctcagatgttctaaaataaggtcaagctgattctacatcctattggtggtaggtgttagtgatgtcaatttggcacaatgtttttgacttgagatagaatcattaatccagggatatcttgttaataaatttaccgactactcacttggaatttttgatgtagcagtttttaataatatagctttttcatgtcaacaagagtacattctgactgattctatttataaaagtatgcaatactaatgtttaatattagaacagttagcagtagttaactttggagaacaaaaatggtagaggtaaggggtcagtaagaggacttctgaggatgcaggtaatgtatttattcagcgagtcgtggttatatgggtgtgtttattttgtagtaactcattgagctgtatgattgctatacttcactaaaatctatggagatcaaaggctactttggcagctttagtctaatgacaaacttattattttcttaaacaatgggcaaaattttcttctgactttcagattcctacagtctaaagggaaagataaaactattttagtatgatagctaaaatgcttttgctcttttaaaattctcattataaagtgtattgtttattttaacttttatatgactgttattggctacttaaaagtctttaaagaaattaattgggaaataacagttgaacatgaatatgggagtacttacttcaagacaatccagaaaaaaaaacaacagaatataaaatgtaatgtttaacaaaaaacaaatgtcattttgtatttaaagaacagtttaaggtatgtttaaaacaactacttctgaactgaatgatactacttctcaccccctccatggcaaaggggtcatctaaattagttgtagtcagctgcaccaagctgaagagccactttacactgaactgaattttgtatggaagctggaaagaaccacagactttactaccacattctaattggcaggaaccctgcttctgatgctaaacagcatgtcaggattgcatactgtatcaatttcagaagtccaagttacatttgggtttattgtttatccagccacaagtaagctgccttctgtaacttacccattggcttactgggttatgattttctaattagaaatggaggactttgagatgttaaaagtgggggcccaataatgagtattgcactgcagatacacagactgaatatcactgtcctaaaaaaaaaaaggcttttaaattgaaatatcaaaatcatgattaaaatcgaaaggtaaacaagcaagataggataaattcaatccatggtgttggtaccagtactcttcacgtgaaaaggacctcggcataagtgttcagaaataacaaagatcaaccagcttggccaacatggagaaaccccatctctactaaaaatacaaaaattagctggacgtggtagcgggtgcctgtaatcccagctactctggaggctgagacaagagaattgcttaaaccccaggggggcagaggttgcagtgagccaggatcacaccactgcactccagcctgggcaacagagcaagactccgtctcaaaaaattagcaaaaataacaaaaatcaataagctgaaaaatgttataaaatttgacgttgaataattcattagacatgaaattacagagtgcttacatttgttgggtactcttttaattgctttacatatattaacttgttaaattctcaagcaacctatgagatacaggacaagacaaagagaagttaagtacatgtagaaggtcacacaaatgacatttaaatccaggcagtctgattgtaattctatgctcttacccttaaaaggattcgtcaattccggctaaatggtgtgcctgaataaaatgtggagcacggtagcatttataatatttattcattcaacaaatatttattgaacgcttacgattgggccaggcactatgctaggtatttatggttataatattcccccacttatttttggggttttacttttcatagttacctttggttaactgtggtctgaaaataggtgagtacagtacaataagataatgtatgtgtgagagagaaagactacattctcatgactcttattacagtatatagttataattattctattttattattagttattgttaatcttttacagtgcttaatatacaaattaaattttatcataggtatgcataataggaaaaaacatagtatatataagggtcagtgctatcagcagtttcaggcatcctttggaggacttgaaatatatctcccacagataagggggaactatacataacagtttatgaaagtccttgacccttgtgaagtctgtattctagtagaggtctacagacaataaacaaaaaagtaaaacaactaggttgtctaataaaatatttacatagaagctatgaaggggactgtaatttcataaggtggtcaaggaagacctcactgataaggtgacacttgagtaaagatttgaaagatgtgagaggataaaccacgaggaatgttctggaagcagaacattccaggtaaagaaatcagcaaggacaaagtccctgagaagaaagtgagcttggtatcttcatgaacaaggagagagttttaatgaagcacagtaagcaagagggagattggaagaggagaggtgagaggggtgtggtaggacagatgatgtaaagccattgttaggattttagctctcgttttcagatgggaagctatttgaggaatttgcatagaaaatcaaacctcaaaatgttgagagaagggttctagaagaatccttgataactggaaaggtgaagtttttacattaacagaagaggtaaagagtaataatcaaaaataggaagatcttcagtcagtgatgctaatgtgtctgaagagtcagggtccccagtaggggaaggaagaggaagaaagtgaaaggaggctaaaattttcactggcattgtaggtagaaagactagggtttgagtggacatctgctatggaagtcaggtgacagtggaggccaaagtaacaaaagcaggcagggaaattctcagcagcatcagagtaatacaatgaaattcctcatagaaatactatcaaggaaagacagagaaagccattggacacctatgtcaatcaactagggcagctttgctaacgaacacactcttaaatctggcaatcgaaagctgcctgtttaaaaacaaaaaagtaatgaatagcaatgaaaagaaaaaaatttcaattttagaataattattagcacaaggtcacatggacaggaacaattacccattgtttacataaattctcatggtagcaataatgtaatgcatatggctttgaagatgggtaaaattattactttaatacagtaaaacaggtaaatcatgaatgatgtagactgcttgtgccagtatatttgaagtaaagtaaaattcagtgttcaaatggagaaaccattgaagtgtccagtaatgatgcatttaaataaggtgatttggctgcaactgcattcatctgtaaataatttacacacagatcgagttaggaacttccgaaaaaatagtactcgttctaaaaacatccaattggataatttcacttataagggtaaagagtactgattttaaaaggttctcagagtctgttttgtgaagagatcccttaaagtataatggtggcggagcacagggaagagctcacatgcagccgcaggagagctagggaaaaagggtgacagctctgctaagccgccacttagaaaagagttggataagagcagtctcttcagagtctgacacctttcattttacggaaaaccttcacctagtctgtctatctcttaccagtgaacttcttcaaatgtaaaggtgtttgtaaaaggacataaaaatcaatcatttgtataatataatttcagatctgtgccttttatatatatacttttaccacttattttttccatctgtgaaatgtgctgacacctactttaacaaactgatacaattgagaagagagagtgtgggctgctaataagaagctctcagtcaaaacatagtcaaaaacagagaacagattgataatgaatacttaattctttttaggagtgtttttggtcctacaggattcagaattataaaagctgtaattccctttggctgcaaattgtaggcatgttgcttgcttgttacatttcgagttccaagttgaatcagttgctttcttgaacagttgaaaagctgtcatttaagcatttcaggtatttcattttcctgttacaatcctgggttagatttgctgttacttagctctcacctcttcatctattacagttttctccctcatttaattggagtatatcctcaaagatcttccacagaaaaggcatactggagatacaatttcagagttcttgaaggtctgaattatctgtttgctttcatatttaatagatagtttgggtatatagaattctgttttcaaaatcattctcctatagaaccttgaagacatttcctccattgtgtcctggaatttagggttgctgatgagaaatagaattccaatttgattcacattcttgtgttggtaacatctttttccctccttggaatctcttaagggttttcttctttatcttcgatggataaaacttcaagagaatatatttggattcaagtattttattcattcagttcgcttgatacttgctcagcccttccatcttaaaatcaatagttttcttcaagtctggtggtttttaaaaattacttgtctgattttctttctatagcatacatacattatttgtgcccacctgttatctttggttatctttgaacactcttttatatgttttatttgcggcattatgttacttagaaataagaacatcatatagtttgttagaaaaggatacatgttattgtaacagaagaagtagagcagaggaggaaatgtagataaccttgggtatggaagcatccaagatgtcttccagaggataagtaaacttggtacaaccagacaatggaatattattcagtgctaaaaagaaatgattcggctggacccagtggctcacacctgtaatcccagcactttgggaagctgaggtgggtggatcacctgagcacaggagttcaagaccaacctggccaacatggtgaaactctgtctctactaaaagtacaaaaattagctggtcatggtggcaggcacctgtaatcccagctactagggagactgaggcactagaatagcttgatcccaggaggcggaggttgcggtgtgccgagatcacactactgcactctagcctgggtgacaagagcaagactccgtctcaaaaaaaaaaaaaaaaaaaagaagtgatccgttgggccgtgaaaggacatggagaccccttaaatacacattactaactcaagccaatgtgaaaagactctatactgcatgattccaactatatgacattctagaagagacaaaactgtgaagagagtaaaaaagatcaggggttgggggtgggagatgagtagatggaacacagatgatttttagggctccagtaaataccatgtatgatactataatttattcaaactcacagaatttacaacaccaagagtgaaccctaatgtaaactatggacgttggttgattatgatctgtcagtataggttcattgactgtaacaaatgtactactctggtgggggatactgataatagtaggggttatatgggaaatttttatatcttcctctcaattttgctgcgaaactaaagccgatctaaaatagatttttttaaaaagtagagcagagtaaaggggttaatgtattggggtgggggtatgcaaattgcaattattgaatagaatgatcaaggtaggcctcattgagaagctgacgtgagcactgagcaaagactgtggctatctgaatgaagaatgttacgggcagaggatataactagtacaaggatcctaaagcagaatgtctctgatatgtttgatgaacagcaagcaggttaatgtggctcaagtgaattgagtgagggagagagaatggtgggaaataagatcagagaggtaaattgaaatgggctgcgtcactagtctagactttgtaggctagtgtaaagatttcttagtgtgacagagatgggaagtgtttacagagtagaatagtaatggttatatttgagtatttttctctttggtagttttattaaaacagatgtaacattgcagttttacaaatcacatgattttcaatttagttctatcataagttcataaacttgaaaaaaaatactacatcaagcttttattttaaaatgtagataaacgttacagaaaaaaaattgccaagcgcaatggcacatgctatatagtccagctacttgggaggctgaggtgggaggatcactggagcgcaaaagtttgaggctagcctgggcaacgtattgagaccctgcttctagaaaaaaaagaggcaagatttttaagctgaagtactcttaggaaatatttcacatgagcaggtattatctttaatctgctttttattatcatggttaaattatgagcaaagctcataaaatgcaataaatgcattttgtatttcttgcaagttagcagtggtgttaaatcttaaatctctgatctgtactaatatcatcaactcctactgagaattagaataacagtagaaactttgggaaagattttaaatgacaacaaagctaaagggtcagaatgtcgtcgtttcaaagcaattttcttagttgtaataaaggtaaatttaataaaagtaaaagcaatctgctcccagaatgttacagtattttgttttgaataaatttatattatctggaaatcaatatggctcatgttgcacaaaaaacaaggtctgaaaatagtaatgccctagagttccagtaggaggccatcgccttgaactgtttagaccaatatgaaaggctacttcctggaagaaacaatgcttctcagcaagatatttcttaaaataccattttcagaattatttgtagccactataataaaactatcagtaaattgtcagattgttcttggcattggtgacagaaaaactgcacatatttactggactgcatgacaattaagaacagagtttttcatgattaatgggttaaaaggcaagagttttgaatgaacttaaattgggcaattctcaaatctttgatgattttattatatgtcatcctgaccacttttagctggtttaatgtaattttgaaatgtttccctaaatgttacatctgttaatagttagaaaccagcttaaattcccattaagttttattcaacaaacctaaagcttctgttctgagaacctcataagtaagtaccctctgtgccatagaaggactaacagtatacttcaacattttacaattggttttgaaaattaaaaaatatgtaggctccccaggagttcatattcaatttaacaacatcaattctacttaagacataaaaatctatttctactggcaacaagatgaaaatctccagctcatactccttatatggggtaaacacccagggaatgattccagcaaagcacagaaccaggtttgtgagggagagactgggctttgacatagtaccactggataatacatacatcagtaattgtttctgtcacttacaaatatgtatctgtttaatgtcttcagttgtttagacgaacgatttggatgatcctaaatttctttgaaacttttacatttagagttccaaaaatttgtttttctccaagattaaagcaattctagcatagtagcagcatgctgcatcaacaagttgatttttttttaaagtgtatgtcttctattgaagagctcgatgaagttcttaactgttgtctctttaattaaacagagaacagcaaagcttgtttttttgccaatcgcaaatttatactcaatttaaaccatggcttttaacaaaattcctatactaaaataactcttcacacaagaatcttagtggattttttataggttcttggttaaccagcaaaactcaacaaaatttgttggcattagtaacaaatactttttaaatatgcttctatttctcccatcagaactttgatttctcttcaaagaagcctcatcatagacttactcacacatttgtgagagttattagaattgccataatcaatggatactgaagaaaagggaagatttgagggttggtttttgtttttaatttttaaaaaactcgtatcatgattctggagctaaaagcagctcacatgggccttatatgagctttgcctctctttgagcagtacattttaaaagtcaggaagaaaataaaatctgactcttgtagcatttagctttgtattggagtggcctttgcaggtaatgccaacttccacgacatttagaagattcataaagtgctggtcaaaataatggaaaaaatagcagctgtcatttgatcagaatctgtgtgcaaaccaattaaaagccctgtcataactatttaagcatgtaaggtgatttatgattacctttcataaattaatgaattctaccaataagagcagggtgctacattgggtgctcctgttctcgcagagtttacagctacacattacatgaggactgctccaggtttgctgtgtttaaatgattgacaaggcagaaactttgtcttttcttcaactgattggcactatctacttataacttataacttagcttatttttcactcccccccaaggagagtagagtccagaatggccggtggtagtctcagagtagaagagttgaggtgtcataagataacgacacccttgaatttatttctcctatactttgctttataaaagtgagcacaaggacagacaggcagaaaatagtagatcactatgtgaggctagagagagtcctctttcaggttcaacaaaggaaagacagaagaaaagtgaataaggtacataaatataagaacataagtgtagacaggtagatgatgaaaaatgggagaaatggaagacgtaacaaaaaagaaaaaagatgaagaaaaatatgggaagagaaaggtaaggtgagatgaggagggcaaaagaaacagaatggagaagagagaaaagaatggaggcaaaggaaagaagggagaatacagcaatctcctcctgaaatctgcctgtcccaagcataaagattaattgtaatattttaattacaaattagcttttcctgagaaaacttcataagcacataattcttataaaattgtgttacctcaaatatttaaaatgctttctagtcaaatatttagggggtcatcattctccaaaactagctagccttatgcagctggtaggagttcttcacagctgttctttaagccatgttgcatgagaacttcatagagaacctgagaagttccattttaagagtttctcctgcttcggtatcctaggcaagaaatcaggagaaaggaatgagaaggaagaatcactagtgtcaagtgacacatgaaactccagtaaatctgggtattacttaggtcaactagagtaattcaacataaaggtagaatagttgttaagattttaaaagccaagtggtgatttcgaacttgtagctattgttctaatatgatgggtaatcacttcctgcaatggtgaactatttataaactgctggctcctcaaaatgtaaataaagaaaaattattccaggctacaagattaattttcctctatgtctttaatctgaggtagatccattttttgttaaaacacacttgttttatttatttagtcaaattcttcacattaagaaggaggaatctgagacccagtaagattaagtgactagtttatggtccttgggtagaacaggaatgaagcagaggtttccattcctaggtcacttcagaactactaattgaggttcatcagaaaaaagacataagccaaagaaattagaacatgaagttgagtatcatctttagtaaaaaggatctagtcattgcttccttataatattgaaaattagtttaaccgtaggtggacatttctttgaaatggtttctaccactaaaaataaaactgaaggtagaggattaggttagaccctggagcaaaatcaaaacagcttatttcagcctaagaacttttttaaagtaaatggcaagccccaaatacctacatatctgtaattttctgagccaccataaaatctgcatactctgtaccaaagtaaaaaacttcacttactgacacaacctttactaaaaagtgccacagactgtacgtaagaatacttttatttagagaagaataaaatacaagctgtctagttcttaatatggtaaaactctctatcctcttacactctgctttcttatttatttatttatttatttatttatttatttatttatttattttgagatggagtctcgctctgtcgcccaggctggagtgcagtggcgcaatctcagctcactgaatgctccgcctcccgggttctcgccattcttctgccttagccttctgagtagctgggactacaggcgcccgccaccacgcccagctaattttttgtattttctttttagtagagacgggatttcaccatgttagccaggatggtctctatctcctgacctcgtgatccacccacctcggcctcccaaagtgctgggattacaggcgtgagccaccacgcccagccaatttgtcttttagttagcctgaataaatttaacctctcagaggatccctcaactcatgtgaaaaaatccttaatagtttctgtcttacattaaacaaaaaggcagacctatgtcacctggagtcataggaccctgagttatctcctaaggtaactctaatgtacattccttaactctgaagctaacagctatgaaggtgaatgccgatagctgctgtaggtttcacagagagactcaatgattatgaagattctgaccgtatctaataacagacaacagataattgtacagtaagatttaggaaaaaaaagtcatttcagttttgaaagttttgttaaggtatataaatgcatatctgttgcctattagtatgatgatatggtagacaaattgcctttgtcaggttttagttttggctctgccattaattagctatgtggtttttgagaatttcagtcactttaacacatgtttatagatggttacataccaggcaccgtgcaagtcattttaacagttatcttaggaaatcctctcagcaaccctgagggtttgacattattattatcatcatcttacaggaaagagaactggggtttagattgagttttttctcaaggttcagtagctagtggcctgcttccaaagcttgtattattttgaaaagcagccagtttctggaactatgtccttaacaagtacttttgacccagtgggaatgaaaggggagtgcagaaagaggtatataggattccagccctcctacttctgcttcagccagagcaattgcctgttcattgttttaatatattgagcttttcaggtaagattttagaggggagagggttctgtagcattaaatgcctgatctcacagtattatgcttcactagaatgaaggggtaaaagtggtattaagctaatataagaaaagtaaataataatcgttggataggcttcaaaaaagaaatgcatttgagatggaccttgacaagcagataaaatcttgatttagttgaaggactccatctggggaaacattaatgaaagtgcttaaattttcaatgctaattaaaatgtttatttttaaaatgtttcctttgatcctgtttttctttattaaataataccctggacaggaattaagagcacagcctgaagtgattgtgatgtccaagaagtactactcatggaacaaatagacaacttgtcatatttcaaaattaaatgctgactgcactatgaatatagaaaagtacagttgtaaacactatattctgtaccatgtaacatcttatgtatgatttcagttctttttaagaccaccagactacagttacaagaaagccaagatcagactgactcaatttgcattacatacatgttcagggaaagcctaattagggaaaacagaaacttcaaatttcactcttttaaactgaataggagagtatcttacatccactgccagaaaatatcaccccagaagtgaaaatttacatgttttaatttctgaaataatgactttgaggaaaacagttagaaattataaaacatacaaattcctatttgtcacactatggagactttggagaatatgattctccaagtatcttggtgtttaaacaaataaaaatatagttcagccaaaaataaactagctcacatgaaaaagctgtagtattaaaaactgctacatcagaaagtcgaagtgagtattcagtaaatttattaacaagatatccctggattaatgattctatctcaagtcaaaaacattttgccaaagtgacagcactaacacctaccaccagtagtatgtagaatcagcttgaccttatttcagaacatctgagaggcactaaaagctggcaaaaccatcttaagagtatggagtgataggcagtaaactgcatttattctgggcttgaaccacatcaaggcagtttcagaaataaccttaaaaaagaggagccagagattaaatactatccccactccccataattaagatgcaatttgaaactttatctgaaatcattgagtcaatggaaagccgggaggaaaacaatgttaaatcaatatctgaaaagctgtttctactaaagatgtctatacacacacacatattatatatctatatatcatgtatttggactgattcaaggaatctgtgcttctcaaggcaacttcaagaactgttgatagtacagagaaatggatatcacagcttttttcttaaagaaaatataggttgaggtagggactggtaaaagaagagactgctttctttcattttttttcttttttaaaacaacttgtctacatcaccaggtatcagtaattgattcccactggacacaactacaggatacactccatgtttattccttgtgagaaataaacacagtaacaaattttcactagcatcattatgtagaacataaattcatgtttccttaattcagtaggtatttattagaaatctatgaggtaccaacatctatgtgaagtcctggttataatgcaaagaagccagtctagtgaatagacaaatgaatttattaaattaaaatacaatgatatatgtcatgagatgttcaagagctatgggggtacagtagagaaatatctgaggaggggtaaagaataggagaagtttccccggctgaatcttaaaagtaaggtattttaagatgctactataccattaccacttaacaagtaaggaaaaaaaaaattacaaaaaaaaaaaaaaaaaagaaaacagccatatgattacatgaaaattgaataccttctcctgaatgatttttaggtagacaatgaaattaaggcagaaatcaagaagttacttgaaactgctgagaacagagatacaaaataccggaatctatggaatccgactaaggcagtattaagagggaaatgtatagcactgaatgcccatatcacaagttagaaagatctcaagttaacttacaacttaacatcacaactaaaagaactaggaaaccaagagcaaacaaatcccaaagctagcagtagacaagaaataaccaaaatcagagctgaattgaaggagattgagataagaaaaatcattcaaaacataaatccaggagctggttttttgaaaaaaaaaattaataaaatacatagatcactagctagactaataaagaagaaaagagaatattcatataaacacaaaatattcaaataaacacaatcagaaatgataaggggcgattgcaactgaccccacagaaatataaccatcggaggatattatgaatacttccgtgcacataaactagaacatctagaagcaatggataaattcctcaacacagctaccctcccaagagtgaaccaggaagaaactggatctctaaacagacaatatcaagcttggaaattgagacagtaataaatagcttaccaaccaataatgtccaggaccagacgtattcacatctgaattctcccagatgtatgaagaagagctggtaccatttctactgaaactatttcaaaagttgatgagcaactcctccctaactcatcctgtgaggctagcatcaccctgataccaaaacctggcagagataaaacaaaaaaagaaaacctcaggtcactatgcttggtggacattgatacaaaagtcctcaacaaaatactggcaaaataaatccagcggcacatcaaaaagcttacccacccccatcaagtaggctttatccctgggctgcaaggtcggttcaacatatgcaaatcaataaatgtcattcatcacataagcagagctaaagacaaaaaccacatgattatctcaatagatgcagaaaaggcatttgatacaattcataccttcgtgtttaaaactcatagcaaactaggtattgaaggaacatacttcaaaatgagagtcttctatgacaaacccacagccaacatcatactgaatgagcaaaagctggaagcattccccttaaaaattggcacaaaacaaggatgccctctctcaccactcctattcaacatagtattggaagtactggccagggcaaataggccagagaaagaaataaagggcatccaaataggaagagaggaagtcagactatccctgtttgcagatgaaatgatccaatttctagaaaaccacatagtctcagccaaaagcttcttaagctgataaacaacttcagcagagtctcagaatacaacatgagtgtgcaaaaatcgctaggattcctatacatcaacagcagtcaatccaagagccaaatgaggaacatactcccattcacaatggccacaaaaagaataaaatacctaagaatacagctaactagggaagcaaaatatctctacaagaaaaactacaaaacactgcttaaagaaatcagaagtgacacaaatggaaaaacatttcatgctcatgaacaagaagaatcaatgtcattaaaaatggccatacttcccaaagcaatttatagattcagtgctattcctattaaacctccattgagattctttgtagaactaggaaaaaaaaaaaactatcttaaagttcatctggaaccaaaaaagagactgaatagccaaagcaattttaagcaaaaagagcaaagctggaggtatcccattacttgacttcaaactatattacagggctacaataatcaaaacagcatggtattagtacaaaaaaagacacatagcctaatggaacagaatagagaacccagatataaggccatatacctacaactatctgatgttcaacaaacctgacaaaagcaagcaatggggaaaggattcctattaaataaatagtgttgggataattggctagccgtatgcagaaggttgaaactggaccgtttccttacaccataaacaaaaatggattaaagactgtaatgtaaagcacaaaagtataaaacccctggaagacaacctaggcaataccatgcaggacaatggcacgggcaaagatttcatgatgaagacaccgaaagcgattgcaacaaaagcaaaaattgataaatgcgatctgattaaagagcttcagtacagcaaaagaagctatcaacagagtaaacagagaacctaaagaatgggagaaaatctttgcaaactttgcatccaacaaaggtctaatatctagtatctatacggaacttaaatttccaaagaaaaaaacaaaacaacctcattaaaaactgggcaaaggatataaacagatacttttcaaaagaagatatacatatggtcaacagtcatatgaaaaaaagctcaacatcactgattattagagaaatgcaaatcagaaccacaatgagatacccatctcagtcagaaaggttattattaaaaagtcaaaaaataacagatgttggtgaggttgtggagaaaagagaacacttatacactgttggtggcagtgtaaattgcttgaaccattgtggaagacagcgtggtgattccttgaagacctaacagcagaaataccattcaagccagcaatctcattgctgggtatatacccaaaggaatatattaataaaccattttattataaagacacatacgtatgttcattgcagcactattcacaacagcaaagacagggaatcaagctaaacgcctgtcactggataaagaaaatgtggtacatacacaccatggaatactatgcagccataaaaaagaacgagatcatatcctttgcagggacatggatggagctggaggccattatccttagcaaattaatgcaggaacagaaagcaacaaccacatgttctcccttataagtgggagctaaatgatgagaacacatggatacatacaggggaacaacacaaactctggggtctattggagggtgaaggtgggaggaaggaaaggatcaggaaaaataactaatggatactaggcttaatatctggttgatgaaataatctgtacaacagatccccatgacacaagtttacctatgtagcaaatatgcacatgtacccctgaacttaaaagttaaaaagataacacaatatcaaaattttatgcaatacctacaaatttaataaaagttgtacaaagaattactgacagaaatttcaagacctaagcaaacaaaagaatcatattcactgaccaagaataccacttttactgctgtgagtagaaaatattgtgctaagccaaaaaaaaaaaaataactgagcatttttctttaagctctataccagcatgtgctcacatcagaatatttattaaacagtcatccttctatgaccttgaatttctcttaattacaatttaggagtgcataaattgacttaagtgtagcttttggacagcattgaaagtttcagatacagatggatacagatggaactacaaggcagccctgtgagggataattagaaaaagtataatattaagagttaggcatttgtaaagcaggtaacctgtttgacagaaaaagaattaaggttatttacaacaaagactccggaaaggtaaaggaagataggagagagtaaagcccttagtgctgatctatgccaggtgtgcgagaccctagttaggtatcaaaatagcctgtacagttctgtttttgttgtaatttggttttgttttgttttaatacatttgtcctggtctaaagacttgcacaatttctgggagtggccttctgtatagcagttattcatacaggtctctgttggttctgttagagacaaagttgagttactgtggcctggctgtgcaaatactcttgttttccttttctaccaactttaaaaacaacactaaaataaaaacaaaatgtgtcatgtgaagcaactcatgtatgttgctatctcttggatccggaaatatactgacaaaattgaaatggaagaccagagacagaaaaaaacaaaaaagcaatttctcaccatgcatattatttgaaacaaaagaaatttaagttactgacatcttgtttgaacatcttgtttggagatttctaaaatcaagtaataataagtaacagtaaatggtactgtgcccattattatacttttaagctgtgttaaatgttaatgatattgtctttagcaatttttattgtttttagtgaaagaaaaatatattcacatcagagcatggttaccattcatattcttcctttaaagtcatatttttcatcataaattcttattaccttggtatatttgggactgctatggttggggctatttcagataacaaataattgcaaagaagtatttacttttcattgaaatattctttaattttgttttatgacaggattgaggtatgccctcaaacattatttcagtgattattgtagataagtattcgaatctttcatctgttggatatctggataaatcaaatggcctggccatggcaaaccacaaaatccagtttcgtagagctcatttgtttcaatgaaagattttaattaatcatattggttgcatcacaatgattttgaagttactttgatattaaataaaaaagaattcttatataagcaatggtaataaagtactaaagtattaataaagtattgagaatttgaaattgactagagaattcaaaaatgagaagagacaagtcaaggtaaattccctcatattcacatctacaccttatgggttacaaacatttgaattctgaaagataatgctggcacgactgtgatggtcaatgggtttatatcaaataaactatattgtagtttataaaatggttttctcttactatagccaattaaaatcttaaaaatagagtgtgtaatgtagtacagattttaagttgcctttatatggcttatgcttcttgttatatttgtgttttggggggaattcttggcaagagattaggtccacatctgattttatgaaatgaatcaacaatgacagtaaagtaataaagtcaacataatgatttaattgtctatgattcacataagtcacttaacaattatatttgtttagtggtatgtttatcataaagttaatatgtttccagattgttcaagttttatattgttatatttttcaaatttcattttatgaataatgataatttatattccctcaaacttccatgtattaccatagttgatcttttctgttcattctctgttttgaaagaaatctgactttttactttcaaacatctagttttcattatcttggagctaattcaatcgctgtgatacctggaaaaaattacattttttatcttttagtttgtaaggagacttttgaacctgaaacagaaactgaatatttttgagattcactagatggattggttttcttaatatgcatttggtatagtaataataacgtgttatctttcaggtataattttcaattcatatgaatatgaacaatttatattgaaatgctgtggcgtttttatttgtttagttcttagaaagggtagctgttctatgggtttacagagacaagatttttatacataattggagatactagatggaagtagtttggctaaaaaggaaaaaaaattctatttgattgaagatggagggctgagcatacatgatgacttcttatccttcctgacacctcacctcatagaggcatatacataaaggaatagatccatgcagcaaagaaaatcagagagacttactagcacttggtatgttttcaagaaattactaggagaaggaaaaatgggaatgagctaactgatggaacaagcagtgcagaggaggagatgggagggaactgatcagcctgcctgaaccttggagagtctctcttctgagaatctgcaaggatgaagatacagagctcaaaacaggagactcaattaaaggaccatatctgcaactgggacaattggctcacctacttcacttttacaacccagattagaaaccagtctgatttcagttcttctgagcaatgaaccatatgggaaagggtgacgtttctgttgtgcctcttggcatgccactactaagcctacattattctggcttgggttggggggtgcagttttcctaccagttcctgccttaagtgaaattcctgcctaaagtgaagcttgcccgtatccaaagctacccatgtgcacagagctcctagttaatgctaccaagtaggcaagaagataggtgcaacctgtttttattattatgcttgttcattgttttctgaagctgtcatttcaaatgcttgatttttccattatgttcttaccttcagtttattgttcattaagtatttgttccccattacacagatttttcaaaaattaaagcagactcttttctttttatttatttatttatttatttatttatttatttattattatactttaagttttagggtacatgtgcacattgtgcaggttagttacatacgtatacatgtgccatgctggtgtgctgcacccactaactcgtcatctagcattaggtatatctcccaatgctatccctcccccttccccccaccacacaacagtccccagagtgtgatgttccccttcttgtgtccatgtgatctcattgttcaattcccacctatgagtgagaatatgcggtgtttggtttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaataatgccacaataaacatacgtgtgcatgtgtctttatagcagcatgatttatagtcccttgggtatatacccagtaatgggatggctggatcacatggtatttctagttctagatccctgaggattcgccacactgacttccacaagggttgaactagttgacagtcccaccaacaatgtaaaagtgttcctatttctccacatcctctccagcacctgttgtttcctgactttttaatgattgccattctaagtggtgtgagaaggtggcaaatctcattgtggttttgatttgcatttgtctgatggccagtgatggtgagcattttttcatgtgtgttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcctgtgcctatgtcctgaatggtattgcctaggttttcttctagggtttttatggttttaggtctaacatttaagtcctgaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagctatgtggcattatttctgagggctctgttctgttccattgatctatatctctgttttggtaccagtaccatgctgttttggttactgtagccttgtagtatagtttgaagtcaggtagtgtgatgcctccagctttgtccttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcatgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgctagtgttcaaagtgaaagcttccagtttttgcccattcagtatgatattggctgtggatttgtcatagatagctcttattattttgaaatatgtcccatcaatacctaatttattgagagtttttagcatgaagcgttgttgaattttgtcaaaggccttttctgcatctgttgagataatcatgtggtttttgtctttggctctgtttatatgctggattacatttattgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctttgcccggctttggtatcagaatgatgctggcctcataaaatgagttagggaggattccctctttttctattgattggaatagtttcagaaggaatggtactagttcctccttgtacctctggtagaattcggctgtgaatccatctggtcctggactcttcttggttggtaagctattgattattgccacaatttcagatcctgttattggtcttttcagagattgaacttcttcctggtttattcttgggagagtatatgtgtcaaggactttatccatttcttctagattttctagtttatttgcatagaggtgtttgtagtattctctgatggtagtttgtatttctgtgggatcggtggtgatatcccctttatcattttttattgcgtctatttgattcttctctctttttttctttatcattcttgctagcggtctatcaattttgttgatcctttcaaaaaaccagttcctggattcattaattttttgaaggtttttttgtgtctgtatttccttcagttctgctctgatcttagttatttcttgccttctgctagcttttgaatgtgtttgcccttgcttttctagttcttttaattgtgatgttagggtgttaattttggatctttcctgctttctcttgtgggcatttagtgctataaatttccctctacacactgctttgaatgcgtcccagagattctggtatgttgtgtctttgttcttgttggtttcaaagaacatctttatttctgccttcatttcgttatgtacccagtagtcattcaggagcaggtggttcagtttccatgtagttgagtggttttgagtgagattcttaatcctgagttctagtttgattgcactgtggtctgagagatagtttgttataatttctgatcttttacatttgctgaggagatctttacttccaagtatgtggtcagttttggaataggtgtggtgtggtgctgacaaaaatgtatattctgttgatttggggtggagagttctgtagatgtctattaggtccgcttggtgcagagctgagttcaattcctgggtatccttgttgactttctgtctcgttgatctgtctaatattgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttagcaggatgtaatggccttctttgtctcttttgatctttgttggtttaaagtctgttttatccaagactaggattgcaacccctgcctttttttgttttccatttgcttggtagatcttcctccatccttttattttgagcctatgtgtgtctctgcccgtgagatgggtttcctgaacacagcacactgatgggtcttgactctttatccaatttgccagtctgtgtcttttagttggagcatttagtccatttacatttaaagttaatagtgttatgtgtgaatttgatcctgtcattatgatgttagctggttattttgctcgttagttgatgcagtttcttcctagtcttgatggtcgttacattttggcatgattttgcagcggctggtactggttgttcctttccgtgtttagtgcttccttcaggagctcttttagggcaggcctggtggtgacaaaatctctcagcatttgcttgagcagactctattttcaagagaagtagttgagtcttaggagtctgcagaaactacttttacctctgaagacatttgctaatatgttgatgggatataatttaggaacaattagtgtttacattttatcattttagtttgaatttaataatagcataagctaacactgttatttaatagtgtacgtaaatgctaactgaatatatatgtattcagttacttattctttatatcttacaggcaaaaaagatacaacccatgagtgcttactttttcgggttgtaccttttttgcctgtaagccataaagagtattttattaaaacattaagaaatgttagtctcattaagtagaagagaagaacataattcttatttttaagccatttagtagtgggaattgaatgtagtgttcagaaacgttgcagttagatccactcttaatttttctcatttccttaaatttcatggatatgcatattgagctattttcgtattcaatctcagctaaataaagtagcgcaaatatgcatgactgaaattaccttctataaaaagttccaaaagcatttgaaaaatatcccacgggtgataagtctgtaatattttactttattaaaatgctgtacctggcttctgagtggttatctaagaagaagaaaagaatctacagtataatgagagttaaccatgttttgtccaaaatgattttgaatcaccgttcggacagatcttgaagactagtggaaacttcaaatggcagtatcgaacttctgttccttttggggttgttgagtatatgaagaatattatttttctgtgtctgacagtcggtagctttgacatgattatagtgaagtataatttagatgttagttttaactataatagactgtaactccttgtattttgggtgctgtagaaattacctttccctttgcatgtacgtgacagttaagatctgaagaatcttgattaatggttcttggatttatgtttaaagaaatcaaggatgggcatttttctcatctccgtctttggcatttgaaacagtatacaggttgagtattccttatccaaaatggttggaaccagaaatgtttcagattttggattttttcatattttgtaatgttttcatacacgtaatgagatatgttgggatgggacccaagtcttaacgtgaattcatttattttttatgtatatcataaacatataggttgaaggtaatttaatgtaatattttgaataattttgtgcattaaacaaagtttgcatacattgaatcatcagaaagcaaaggtatccctgtctcagccagccacgtggatactctgtggtgtttggcatcactgtcattcctgactctgaatttgtatgctactgataaacaactcttttattagacttactcacacatatgtacttaacagtgaaaaaaatgagttcagagtaactaagcagcataatagcatcaaacaatggcaggctttcatactttacctacagtgctgtttttgttaaaaggttactctactctgtattttattttttttaggtaagaagaaatattggaaacatttgagagatcaagaaatgggtcctctagggatgaggagaccttctgaataaactatgtcctgtgttcctgcattttgacagcaacccatcacataaggccacttacggaattttctacttgtagtgtcatgtcagtgctcaaaaactttcagatgttggagcatttcagatttcagattttcagattagggatgcacaacctttacaaagggcctttatagagattttaaatatataacttgttgtctactgagtaaaagatgggctgcttctgtttttctcctaacagtattttcagcttctgtactaaccagttccagatgttccacgataaagaaatatttaattttcatatgaaatttatgaaaggaaaatgcataggagggcattttagcaaaacaataagacaaaacagcttttgacagttggtttgctattaataagtacataggagtacacagtaaatggaaggctcatttagacccttagaatttttcttagcagggggccctttacctgaaatcatggtactagttttaaacttcatgttcttttttgtaaagacatttaaggcgatcagctcttttcaaaattaggttaatttttcagaaagaaataatatatcaaataaaaggaatattatggtgggttcagatgaattttaattgaaacataagcaacagaaaattttaagattcttatatgtggaccactttgtataatgtgcctacaaggtaaagattttgtggtcatctgaattttgggagaagtaattttccaagaattaatacttaagctttttgaatcacagttttgtatacccaatttcattatttggttctgtgcgatatagaatgttcaaggctaactataatcatttttgtccaatttgttttaaagagggttcagcagctccaggaatggtataatggtgaatgatgtttccatatcaatacagatctacaaatatgagtatatttgaagaaaagcaaattcatattgaatttaaaggcatataaattggatttcttttccattcatggacatctacttgtataaagaataaaaattacagtttgaatacatccaaaaccttttctcttaccgaatttcaatactcttttctaacaatgtcttagaattttgtagtatatctattcctcccctagataagatctgtagcacacttactctcttcctccctgttactatcctagaatgcttttgtattttaattttagattatttccttttaaaattatgcataaataattatttaaatttagcttcctactttttggacactactattggacaccaccacatctttttttctctggattgatttttttttgttttactggagttgatcatttaataattcttagattgtatctgaaggtattaaactagcctgtttttgcatgactgaaaatgtatatttattctcacttgattgctgattagacttgacatagagtcctatgtttaagtcattttatcttagatctttgaaaatactattctattgacttttctgatattgctaaaaagatttctgatatcaatataatttttgtaccactgtagatgaccctttttcatcccttcgtcctctttctttctctttggaagattttggaatttttatccttggggtttgatactacgctaggatgccatattattaatgctttgcctcatctgcctctccctgcacctctgcttttgtctgaaacccgaatctacctttagctaagggaaattttcttctttcatttctgtgattgctttttctactcagttccgttttattctttttttcagtagctactagaacttctagatctatcctccttttctcttactttatatttcctcattttgcaggggattctgaataatcttttgtctttgtcttctatctcaataattttatctttagctacgtcctttaatttttttttttttttttttcctgagagtctcgctttctcacccaggctgggatgcagtgatgcaatcttggctcactgcaacctctgcttcctgggttcaagtgattctcccacctcagcctccagagtacctgggattacaggtgcacgccaccatgcctggccaatttttgtatttttagtacagacaggatctcaccatgttggccaggctggtcttaaaggtcctttaatttttcattttcttttttaaggctttgtattgtcattattttgttagtcatgtttttaattttgtagcagtcttttccataattgtttttttttgtctgtgtgctatcttttcaaatctcactgagaattacaattatatttaacgttttcctctgtttcttttactctgctgagtgttatttcttcaatatgttaagtttggtgactttcttgctaatttttcctcaagtgtttggtgatttttggttgtttgttgtttgttgaatagttgagagcctaggctgaacagtcttggtggctggagggtatttatttcatcagcccaaatgagaatccctttttacttcttgtactatgtagattctcattacagaagccttcatccaataactgcagggcaaaagaagtgggtgtggctgggcagggtattcccggttgtagaagtttttcacctgggtttcggactacatttccataaattggctgctaccttgttctgtttctctaatctgggactctccatagtcagaaattgcatttgggagaatgtactcctgcttttgttatttattgaccatgagctttgagtttctctgagcctctatagcagactcacactttcttgttttagctgcaggtttctccaatgtgattttgcctttaaactaatcacatctcctctgatttgtgtttgtttacagagcttcttcaaaatttttggtctgcagtggtattattttcctgcactatcattctttcttctttttagtaatatattttatatggaatttgaggggaaaggaaagaggtaaatgtgtcctcattggccatccattcttttttaaagtaaaatggaaaaatacagattttgaaattaagagaactaagagatgatgaaaccatttcaatggagacttatcaacatattatgaagggaggaaaatgtgctgaatattgctgatgtttaatgaatttagaaaggacatttatttagcattagcctctgtcaccaatttattatttttccctgtggaaactaatgactttggagaaatttcttgggtaatgtttattgttagtcatcctgtttaagaacaacttgcttaaggtgatatttttatttcatggtagcaaatggattgttttgacatattcagtgtggacccatttaaagtaggcatgttattttcaaaagtgccatggcatgtcagtatcttgtaaattctaacttaaccaatattaaagaagtaaaccttcatgtactttaatggagatcacaaaaggacttcactgtcttgttctatgcaagatttagtaaaaacagagtattaggtgttatagtaatggtcatgcaaagcagtagctcatctgtacaagaaaattaatggtcttctaaaatggccagagatttgtttataacttcattttaattaattacatttttggaaaatgagttgaatttaagattagaccccaggcttgaatttgtcatattttttataatggtattttgaaacaaagtttgctaatagatgtttaaaagagagtaagaaaatatttacatagggtttatttgtggagtaagtattgtgtctttgtcattattcaaaaatagaaaaaagttgtgaagcaacatgttctctttgtgaatgttgaaaattactaacagatctgtgcgattggttttgtatgccttgtgaagacttgccaaatttgattttatttttctcttttacttttttctagtaaagccaagtcctacttgagagacatcagtagcctatggaaatttgttgcttttctttgaaaagtgcacctgcatccaaaactgagtaaaaacatatttcaggaagaaaactataactaattaaatttctcagtactacctaatttgccaatataactagttttggttaaaaagaagttgattataatgttcataactgtatattgaacagaaaaactggatgcaatcagaaatcataggtgtagtcaaggagatgaaaattgtagatgtgaccgttgctatttgcttttaaggtttcctaatcttgcctagcgtaatgactgagttttatgggtatttggaggattttcttgttccaggtggtggtcgtcctccttattttattttttggtaaggctaggagtaatgtagatgtgtattcttctcataacttagtaaaactcttttatcaaattggtcagtgcagcctgcagctggggacttctaaaaacatgttaccatgactagaaatttttatttcagtgcacttacttgacatctttctggttattattgaccaaaacacttgactcctgcctcttctttctttttatccattttgttgtccttattttgcatatttttgcatatgtacagatttctggcttcctcattcctatcaacaaccagaataacttttagtggtctaacttgtatcttcacttatcaacttaaactgttctttttgaaatgttaccagtgggttcagtgctcctgtctctgttctctgtctctggatctctcttcaacctttggttccactggccagccattcttaactgtttcggtttcagaaatattttttccctttagttttataataataattagctaatttttcttgagcacttactttgtatctttgactattctaagcactttacatgtcatatgatctttaacacaatccttagagatctaagtttgtattattttttccactttcagataaagaaggtaaggcacagagaggttaattactttgtttgaggccacactaataagtggtagaatcaggattcagacacaggcagtctgactaaagagctggtacttttcctctttagatgctatactattctgatgagtgtctcctctcatctttttctgtttggatctagttgtgtatattttcatttgccctacacttacctggttaggttaaaatttctacatccctcaaaactgctgaagtatcagttaaaaatatagttttcaacagaatagaagtttaatacatgttgtgaaccaatttcttcgtgttgccttttgaaattaaatttaaagagagcagtcattaatggctcaaagttagacctaagaggatttataggtgatgtgtatatgtgtttttgttttatccatcattcttcagtttcttaattaccaatactataccaagacaaatgcctgcatttcatcattaaccattaaaatatgattttcttagagttgaagattgaatttagggccagttttttcaagtacattaattatgtttaaatgtgtaagtctactcattataaaagtgaattattttgtaagtgttggttattaagtctgtgtattcccaagattttcagtctgaagtgagctgcagatacaatgcctaagcattttgtcctttgtattttgtaccagcaaaatgaaaatcattttttatagcctcattactcattcccaaaatgacctgaggtaccagttaggtccatttgcacaatatctggcaatatttctatgtcaaatatgttacaatctggtatttaaaatggccactgtaagtattatcaggcactattgttcctttttaaaaaacagtataaaatttgaaaacagtgctttggaaattatgtctttagtggctgtaatataaatggttaaccttacaaagggaaaacatgaaattgtttgaaattggtttatattggttgtcatgctaaacatattttttaatagtttgcttatttggtttgatattggttgtcatgatttaaaatgctatggttgtgtagaagttcttcacgaatatataagccgtttttacttacacatatattttagaaaatgaatagtttatatttttgctgttggaggactttttaaaaacatctatgaaacactaagatacgtctgaattggagctgaggactaagctctcatttatcttgcccaaattcctacataagggatctagagagtcatgccctacaaaccataaattctcatcagatgggttttatttgaccctatgtatcatgacttacttttcaatctgactctggcataacattacgagacaaggaaaaaatatttaaccccaaaatatatttccttgccataccttgaaattgccctgcaaagtctcttgtgggaaaaatccacatcttatagagaatcccctttcctctttgttttccttcctttctttccagatccaggcgataatcaactaagagccaggcacccttttaggtccgataagaaacattttacagcctgctctctctctgaagtctgctctctgagagattcctctgcccaataaaacttggtctccacaatcgtttttcttaacttgaacattcctttccattgatcccaggtcttgagataaactcgaccaattgtcaactagaaaatatttaaatttacctatagcctggaagctccccgcgcccctactttttgttctcctgcctttctgaaccaaaccagtgtatttcttaaatctatttgattgatatctcatgcctccctaaaaatatataaaaccaaaatgtaccccgaccaccttgggcacatgttctcaggacctcctgagggctgtgtcacaagccatggtcgctcatatttggctcagaataaatctcttcaaatgttttacggagtttgactcttttcgtcgacagagcaaaccgtacttcctgaaaagattaagagttagacagctagactttattcagagtgtgaacctatgtacctactatgtaaaatgcaagagctttagagcctttaactaaaggagtggcccctaaatcaagtcaaactcttctgtttcccaactacctcttgctgtataggagccatctggctctgctttctcaggtgtacattcttagaggaattttagtgattaaagtacaggccttggtgctgggggaagaaagagggttttcttctgcaggtttgttaaactgtaattcaggtcaaatttcgaatatacgtatgaaggcacaaaagtgtttaatattttagtttattccctttagtagttacaaaaattactgcttagtgaaaacttagcatcaggatatcccttcactaaaatctaggtctgtaatttgacaattcatttcacagcacctgacattactgttacattcactgtagcacttagcatgcaaagattatattttctacaactctcagtctcctctgttattggatgatgcgagcgcattaactacaaagtcacgtaaaggtcaagtcaaggcttaatttgaaaacagaagcctgagacccatccgtttacataacagacacagcactgtggtctcctgtgtgactgttaggtctgagcactgccccatattgctaatttctcacattgcttttcttaacattttttttctttaggagcttgatggagagatataccatttctgtcaggttttgcaaaatgtcttgagctccttgaaaaatagatgtcatgtaaatgcaaagtacggtcagttcttttagcctaagacattatttgatttttatagcaagtctattccatgtaaatgacatgcagtcatatagcttaccatgaatacgttcatgtcctaaaaatctcagatactgcctatattcagagtagctaacatttaattttgttttcatgtgttctttgaaaagagtagggaaaatgttttttatattattatggcttaatctctggatttggtcaccagtgaaatgaatttcatagcctcattctattacagacattttgtctgcttcgcaaaataacacaattttgcattattggtggtctgtgttcaagagacattacatctaaagagagctagaaattgcaatttaatactaagcaatgtgatgtgggaaaggaggccaactctccacatgctctttctgctagagcataatattctgcatattgacttttttttcactatccccaaaagtcaggatttttcattaagttctgataatactgttgaaattgaccttgattattcatgtaaagggcctctcagacaacctataggtatgagaatagctttcagaattgtaatcatatttaggttatatttaagcagtgatgttacacacttcccaaaaagtaatttattgggacatttacataactctgtgtacttaaatttatctacttattgcttatttaaaacattacatatgagagtttgtgttttccttactcaccattttccatacggctttattttcctcttagtttgaaaacttaaaaaaaattcaagttaacaagcatttattaaacatctgttgtattcaaggccctgggctacgtacatgtggaacataaaaaatgatgatgatgacagtgattgcaaacacttgcaataagtcctcatattgctgtcaagtaggtgctgttgttatgccatattacaaatgaagcagatgagccatagaatatttcataatttgctcaaggtcacacagccagtgatttgagaagactggcttaaaacacatgcagttcgacaccagagatgacactcttaaccactgtgctatactaaaatgaagacaagatcctacccttaagaacctttcatcctactagaaaagtggtaatacatattcagagaaaaaaacaaaaagaaaacagtaagtcagtatgtgttaggtgctgcattactggctcaaatatggaagacattggtgctcagaaagagatgtatttcttttgggaggtggggaaggcctcctggaagaagtgttttagctgacccttaaaaaagcggcaggattttgtcaagtgaagttaattagaggaagaccttctccttaagggggcaatgagaacaaaggcattgttttcaggaaaatgcagtgcccaaagttaatttgactatatgaaaaagaaaaatatttatacctatgcagacctttgaatgtaatgcatgttttcatttaaaattagaaatttatataatttttgaggtattatggatccaaattgtagattttttaaaggttaagctgttatatttttctttttaactaaaggggtatatttcaatggaaaggagttgcccaaactgaaatccgcagcgatgctaaggaataacatttatttcatatgaaaatattgtaaaatattttatggatattgttttttacatctaatcttaacattatctgtaagctgaactttgatgcagtagtagtaaacctactttctacaggaactacttctattacactctttaatttaaatctctttccataacctgtcaatatttaaagtacaacaaaagatagttgcactcagaataaaaatttgttttcacagagaattttagcccattatccctgatgaacatcgatgcaaaaatcctcaataaaacactggcaaactgaatccagcagcacatcaaaaagcttaaccaccatgatcaagtgggcttcatccctgggatgcaaggctggttcaacatacgcaaatcaatgaatgtaatccatcatataaacagaaccaaagacaaaaacgacaagattatctcaatagatgcagaaaaggcctttgacaaaattcaacagccgttcatgctaaacactctcaataaattaggtattgatgggatatatctcaaaataataagagctatttatgacagacccacagccaatatcatactgaatggacaaaaactggaagcattccctttgaaaagtggcacaagacaaggatgccctctctcaccactcctattcaacatagtattggaaattctggccagggcaatcagacaggagaaagaaataaagggtagtcaattaggaaaagaggaagtcaaatggtccctgtttgcagatgacatgattgtgtatttagaaaacctcattgtctccagcccaaaatctccttaagctgataagcaacttcagcaaagtctcaggacacaaaatcaatgtgcaaaaatcacaagcattcctatacaccaataacagacaaacagagagtgaaatcatgagtgaactcccattcacaatggcttcaaagagaataaaatacctaggaatccaatttacaagggatgtgaaggacctcttcaaggagaactacaaaccactgctcaacgaaataaaagaggacacaaacaaatggaagaacattctatgttcatggataggaagaatcaatatcatgaaaatggccatactgcccaaggtaatttacagattcaatgccatccccatcaagctaccactgactttcttcacagaattggaaaaaactactttaaagttcatatggaaccaaaaaagagcctgcattgccaagacaatcataagccaaaagaacaaagctggaggcatcacattacctgacttcagactatactacaaggctacagtaaccaaaacagcatggtactggtaccaaaacagagatatagctcaatggaacagaacagagtcctcagacataataccacacatctacaaccatctgatctttgacaaacctgagaaaaacaagcaatggggaaaggattccctatttaataaatggtgctgggaaaactggctagccatatgtagaaagctgaaactggatcccttccttacaccttatacaaaaattaattcgagatggattaaagacttacatgttagacctaaaaccataaaaaccctagaagaaaacctaggcaataccattcaggacataggcatgggcaaggacttcatgtctaaaacaccaaaagcaatggtaacaaaagccaaaattgacaaatgggatctaattaaactaaagagcttctgcacagcaaaagaaactaccattagaatgaacaggcaacctacagaatggaagaaaatgtttgcaatctacccatctgacaaagggctaatatccagaatctacaaagaacttaaacaaatttacaagaaaaaaatcaaacaactccatcaaaaagtgggtgaaggatatgaacagacacttctcaaaagaagacatttatgcagccaaaaaacacatgaaaaaatgctcatcatcactggccatcagacaaatgcaaatcaaaaccacaatgagataccatctcataccagttagaatggcaatcattaaaaagtcaggaaacaacaggtgctggagaggatgtggagaaataggaacacttttacactattggtgagactgtaaactagttcaaccattgtggaagacagtgtggcgattcctcaaggatctagaactagaaataccatttgacccagccatcccattactgggtatatacccaaaggaatataaatcatgctgctataaagacacacacatatgtttattgcggcactattcacaatagcaaagacttggaaccaacccaaatgcccatcagtgatagactggattaagaaaatgtgacacacatgcaccatggaatactgtgcagccataaaaaaggatgagtttatgtcctttgtacggacatggatgaagctggaaaccatcattctcaggaaactattgcaaggacagaaaaccaaacaccgcatattctcactcataggtgggaattgaacaatgagaacacttggacacagagagaggaacatcacaaaccggagcctgttgtggggtggggggaagggaaagggatagcattaggagatatacctaatgtaaatgacgagttaatgggtgcagcacaccaacatggcacgtgtatacatatgtaacaaacctgcatgttgtgcacatgtaccctagagcttaaagtataataataataatttaaaaagataaaaatgcttaaacagaaaaaaaattggtttttactgtcatgaatttttcccacgtttatgtttattaacaactgacacaaacaaaacctgtacagaaagtactctttattatacactttatttcaaagtactgaaatagtgttttatgatcatagtatttctagaggaaagattttctcccaagcctttaaggggaaagctaatccacttggagaaattttgggccacccaccaaacctgtgatttcctgccccaatttatgaaccaagttatactgagatcgttaaatggtgtgatttctccttatgactttcacattttactttataggttatattgacttttagatttcaggtagtaaaataaaaaatcttatgcagttcaagttagaaaaattggattagtccaagtgatattttcacctggtattttttttcaggcatttcaatgttactttttattacatttataaaattatatgttttaaattgtatggttttcccttatctttttgaaaaataccatactgattcatctcaaatattttagcctcttcttaagtttccctttcccctcaacttttccgtaagcgcacaaaagaaagtattgatttttgccaattattttggttgctgaggttgtaagccatcttggtttgcttacatgtaggttattaaagtacccttcctagtctgacttgccagtcttacttctctaccttttgttagaggaataagggatgaggatgagagaattaatatatattttttaccccatttctgcatattttaatcccatctccagaaaccaggttaatttcacctctgtcacaaatttgaaaggaagggaaaagatgtattaattgccatttttattgttattttctgactttcaagccttctaatctaaggttagtaaatggacagcatttaaaaaaatattcttgttatcttgacataatgaagaattatgtttttgagtattttgtccattgtttcttatttcctactttacatttttatttacagcaaggttttatccttttactaaagggaaggagatgggatgaatggcagactttaactggatgctttatttaggcttttcgaaagcaaaaaaagtttatacattgttacagctgggtgttgggttacaggctgtttgttatattcatgtattagttcctgttattttaacattttaaatatttcataattgaaaaaggaaaaattagactgggaccagtttatagaaagctttaacttctaggcaaaaaaggtagaactttacagttggttgtggagaagatattgactgtcttttgtagagagtagcatttcgaaaaactgaatttggcgtctgtatttagaacggtctagagaatggagatactgatgaaaaggaatgttagcaaattcagcattctgatttctgaaaaatgagtgcttagattaggtagtggcatggggactagaaagaacagggatgctgctgctttgtataatcattcccattatataaaggttatatataaattaggacggacacggtggctcacacctgtaatcccagcactttgggaggccgaggtggatggatcagctgaggtcaggagctcacgaccagcctgacgaacatggtgaaaccccatctctactgaatacagaagaattagttgggcttgatggtgcatacctgtaatccgaacactacttgggaggctgagacaggaaaataacttgtacctgggaggtggaggttgcagtcagccgagatcacaccattacactccagcatgggcaacgagcaaaactctgtctcaaaaaataataataaagattatatataaataaataaaatcacaccatttaacaatctcagtataacttggttcataaattggggcaggaaatcacaggtttggtgggtggcccaaaatttctccaagtggattagctttccccttaaaggcttgggagaaaatctttcctctagaaatatatgatcataaaacactatttcagtactttgaaataaagtgtatattaaagagtactctctgtacaggttttgtttatgtcagtttttaataaacataaacatggggaaaattcacatgatagtaaaaacaattttttttcctgtttaagcatttttatctttttaaatttttatatatttaatatataaaatatatataaaatataaatatatatttatatttatgattatataaaattcctatatctttatattatcatttccataaccattttagtaagcatccccaaatagaagttagggtgtattactaattctgcttaatatactttgtatacttttgtttcctatctcaaatctagtttctattatgtaagtataagtaccctccatgaattgggttaacattctaaaccatgaccagactgagagcatgacgactaatgtggtttttactcctaagctaccagtatggaagatcaacatttaagaaggcattagtcatctgtgctgctgaaaataatggtttcacattagtctggaccaattagaaggagcctatgtctacttggaagagtttgatttgcagcatagtccttggctgcttctacaagacttggcaaacttttgtttaagtcagaccctgcttaaatgtctaaaaggaaactcttaggccattatttccccctactttacataatattgctccatacaaacattccacttttacaaaatcatttactttttcccaactctgtgatacaaatgagttatcttttcgtaaccaccaacctctcagttttatatttgttagctcagatctgacatgaaagtaaaaattacttataaccactttgggattacacaaatttaacctgttcccatgttgtattcagtcctctgtgaaatacgagggtacttcaaaaaggtcaaggaaaaattgaattaaaatataaaaataaaagatgcaaattttatttctcaacataggctccattaaggtcgagacacttttctaagcgataataccagccatttagtccatccctcatttcttttggaattgaggaatttagccatgtcagtgcagtctttttgtaccttactaactgaaaaaaatgggtattctttatagatatttttaagatcaggaaataaaaagtcagaggaggcaaatcaggtttgtaagggggatgcttaatggcttcctattgaaactcttgtaaaattgctctgtgtgattagaggaatgagcaggagctttgtcgtagtggaggaggactctagtgaagctttcttaggtgtttttctgccaaagttttggctaatgctctcaaaacactttcataataagcagatgttatcattctttggcctcccagaaagtcagtaggcaaaatgacttgaacatcccagaacactgttgccatagcctttgctcgtgactggaccactttcatctcttggtagccattgttctgactgtgctttgtcttcaggatcatactggtaatgccatattacatatcctgttaccattcttggaagaaatgcttcggaatctttatcccactcatttaaattttcattgaaagctctgttcttgtctgcagttgatctgggtgttgtaagagttttggcatccatctagtggacagtttgctgaacttatttctcaatcacaatcgtgtaagctgaaccaattgagatgtctgtggtgttggctctggtttctgctcttaatttcggttctcttagggcatgaacaagattatttttttcctctcaaatggatgtggatggtctgtcactgtgggcttcatcttcaatgttgtctcgtcccttcttaaaacaagttatccatttggaaactgctcatttcttttgggcattgtctccatcaagtctttataaaacatcaatgatttcaccacatttcacccacaattcatcttaaatgtgatgcttgttcttgcttcacttttagaagaattcagtttgctctgataggggctatttttaaatgaatgtcctatccttcttagtgcctcaaactagatcctgttcagacatactgtaaaaagttagtatattttggtgcaaaagaattttgaaatccatgcatagttttttcataatatgcatttttcatgagctttttgaagaaccctccttgtaatgtatcttaattccctattccattaaatctatgattttgaaccagccatatgtgacctgtaatcaaaaagtgatgtttgatagatgctgtcaccattctgtcatttttcctcatccaagatagaagatgtcttcgaaagctttgtatatgttccagtcctataaaacaattctacaaaacaatttcaagttcaaaattattattgagaacttttaaacaggatatttagaagtttgttttattaacttggcctaggtcacaaaactcattaatattaatgactagactacagaggcatgtagcctgtctaaacattaacagatacaaaacattaaaccaaattgtgaagcttcgttatgctatgagtcatttcaggcaaagaccaatatagcaagcaaaagctgaacagtccagttgaaatgtttctgatctaagcctttgacttctgtttgtagatgaactggagttttgaaactgacactcaaattttttattgacttcatatgaataaatgattcattaaaatataatacttggaactaaagtcatcattcaaaaaaggcatttattattaataaactacagaaaagagaaaatttgagggtacaatttactttttttaaagtatcttaaaattgcatttattttctcttagagaactttagatgatatcagtcattactaatgtcataaaatgtatgtaaatatgagctaagtgatgtattttatttacccaaagatatgatctaacagcctctgcaactgtcaccaacctttcctataaaacagcaatatattaaatgatagtgaagagggtctgaaatttcaaccttgagatgcacttacactgtattcagtacagcagatttatacttctacttatatatcaacaacaggtctttctaactggcaagtcttgtggtaaacatgagaaatatggatgcttattaggtcacttttggtaaatagaactaataatttgagacatttgtctacaatagagtttggcaaactttcttctgtaaaacaccaaatagtaaattctttaaatttgcagactatacagctctgctgttacaacacaaaagtaggcttagacactatataaaagaatgagtgtggctgtgttccaataaacctttatttacaaaaactgaaagtaggtcagatttttcccaaaagctgacagcaggtcacacttggcctgcggactatcaatccctgagctacatttgcttgattttcttactgtatactcattcctctgttcagctgggcttggcttttccccatcactgcaccaaaatacttttgccaatatcagtaacattctcatcattgaattaaaatgaacacttaccagtccttgtctcatttggattcttgggagcagttgacattctaatcaatctgtccttaaaattttttctttctttagtgtccctgacctacctctagtttttaacccacctctcaaggcagtctcttaattattggtgtgccttaaggatttattattgatcttcttgacacatttgccttaagcagtactttgtgttactatagctctaatttctgtctgtttttctccctcctgagcactcttaagtattaatctgtagcccagattcctaatttaaatactgagtttgtacatctaatggcctgctggtattttctacatgcttatccaaagatacttggaaatacctgtcttaaactgaacttgaaattcccaacctctatttcatccccaagattacttccctcaacccccattctatctcaatgaatggccctacccatctttcacttgcccaaggcagatacttgtgcttcatctttgattcctaactcttcatctcacccatgtctttcattgaaagaatcagttttgtggatgtacctccaaaatagctcttaaatctgtatgtgttatagtctgttgcttctatgctagttcaagccaccatcatcacaaatttaaattactagtagactgctctgcttttccctttcatgttctcttttgctggtgggaatatcccccatcctgctttattcccaataatttatctttcaggtatcagattagatatcagttctactaggaatcctttattgactccagaatgtaggtgtagtgtttgttctctgtgccctatactttgcctgttagggcaaagtatgtcattttgtaacctcagtttatttgtctctattggactcgtaagctcaaggaaaacaaagattgtacacattgtcttcatcattgctgtaaccccaacaccctagcgtgttgctcgtaaatctatgttgaaaacaagtgaaattagtctcaatatccataaaatacaccatgttctgtataaatcaaagcaccagaacatatctgatggcttaatttgcactcaaagtaagtatataattagaaagttgaataaattaatgaaataaagatgtcatacttcacaaagttgtatgtagaacatcagatcctaaatcataaggcataaactgctaatggccagatttgcttcaccatatgttaatgagcgtacaagtaatcactgtgcttataagtaatataagtatcccctattcttatttaatcctggctccttttagagggaaagtaaagaaataaactgaaaaaaaaatgtatatatatatatatggtactacccttgaccttaaggaacacactatgttttggaagccttcattgtaaaatgatcgtaagtactaacacaggtattcttactgtgctgtacagcaccaaagcaagcagcaggtggataggagggggagaggaaatcaggcgaggttttgcagaggaggtaacacttcagaagagtcttaaagtatcagtaagacattgccagaaagaaaaataaaaattaatttcaaataaaatatatataagcatgtgaagcatgattgagaaatatcttcttttttttcttcttttttgagatggacttctgcttttgtcacccaggctgtagtgcaatggcactatctcaacttactgtaacctccacctcccaggttcaagcaattctcctgccccagcctcccaagtagttgggattacacctggctaatttttgtatttttagtagagacagggttttaccattttgccaggttggtctcaaattcctgacctcaggtgatccacccacctcagcctcccagagtgctgagattacaggcatgagccaccatgcccagccgtatcttcttaattgtcaaaggaaaatcaaagtgtgttagtagcattatcatatattatgtttttgtgtcatacatgatttttttattctaaattttaaaatctaaccttaattcagttatttaaattaagatacaagccttgctaaacagaatttttactgatacatgctacaacatggatacatctcaaaaatattatattaaatgaatgaaactggtcacaaaagaccacatatatgatcccatttaaaattgataggatttccagagtaagcaaatctgttagaacaaagtagattgctggttacctaggaccgggagaggagggagcagggggtaagacaggagagttggtggataataactaaaggacatagggtatctttttgggatgatgaaaatgttctaaaattaattgtggtgatagttgcacaactgtatgaacattctaaaaaccattgaattatgcactttaagtgggtgaactgtgtgggacatgaatatttccataaagctgttaccaaaaaatataagttaaattctccagtgttgttattttcactaagttatgaaaaaaacccatgttccatcctttatttaggtatcattgtacaaactgaactatcagctgttgctgcattgaattcacagtagtacacaatagacatatttcaaacataaaataaaaccttattagctccagatatactaaggattatagaaatatatcaactcatttaaaccatgtactttttagaatatgcatcatttgttcacttgattccaagaagattttgtgaatcataatcaggtaattaggttagcagagaactaatgtgcatggaaaaatgaactccagtttttatcagtcatatttagttggaagagcctcattagaggttaaaattttcttctggatagttactgccttaaattaaccacatatcttatcaaattagttattgtacctgcctgtctttaggaatttggttccacaagtgttggaggtaaaatagcatgtttcctattattatgctgcagtttacaatggattttcagttgcctgttgtatgataaactcactgcccttcataacttgaggtaaatgctgaacttgccctttttaatttgttgaaacagagcttccattcactgataagaagtgtaaatttaactaaattgtcaaattaacctcatttaggtgcacacattggttctcttttccttgaagacttacgtgacagcacaagatagagaaaaattaagcctgcacatgttttcagttacctttttcttactctgtgaattacattaggttatttcattcaggatgccaaatacatagtagctcctgaaagtacaaatgcatcatttaaatttctgtctatgaatctaatgcagtcattttataaagaaaagagaaacctaaatttgaatgttgagatcataatctttaaaactacacactagaaacaatagaatttcaatttattgtttaaaatttacccagaatccctcagccaagatagtaacacatgtcttgagaagttaaataatgtacctattacaaatgatgtttcagtcatcagatatgtacttatccttagaataaattataaatacttagaaaaatataccattacctatagtattgagtacagaaaaagctccattgtttttagctgtcaatgctcttttcaacctagtttctcactgttaaaaaagcttcaaataatcatattcaaaacctcttaacttgctgattatattcagcaaccatagctaaatatttcagtaccaaagctgaaaaatcataatggcatatcagcacacacataataaattatggttaatgaatactatacaaggtgtgttttgattggctccaagtttgtgatctgctcatggatagcacattgtatttttaagaggaaggaaaatatagtgatgatatgactgccaagcatattgctttacactgaagcaaagtggtattttagccaaactcaaaatgtaacatatagacaacaagtcaagtgacctaatagccaaaatgaatatatctaattaaacatttcatgaaaatatttcatgcgctctcttatacgatttttatactgaataaaggtttctggtcaaagacagtttgttatgttgacagctaaaactgttgtatgttttagctaaacatgtataaaacacaaaagcatttgccttaaccagcttgaggtggggaccttcaagtgtgaggtgctacctttttaagctaactacagaataaatacttagagtgtaattactatttagcccatatattttctgagtaaacaagacttataagacctgtaagactactaccattggggtcaaatactacaatataattagaaaatattgaaatcatttagacaaaatccacttattctgatattttccatatccaatatttttttccttcaggggaaaaatgacttgatgtcaactgaactatactaaaagatctagctaaatgaaatcactggtgtatgcatgtatgccctaggatgtgcatgcatgcaattggaagcactgttgggagaacacaagagacaacatgaaaaaagacccagagagaagtatgtaaaaccctactggtacttccgtactgcctggacatgcagtgcattaagaggatattgagagatgagtccgtaggaatcatgggccagagtttggaagtcttgaatgctatgctaacaagtttagagtttttgctgcttacattcttaaataggtaatcattttgttaaactgtacttttcaaaaattaaaagttattcgattgatttaacactgggaaaatgccttttgttgtgtattccatgtatttgttgcagttgtccttttgtaacttttatcaaactttgatgtaagctcaggagtttccgtttgcccagtgcccttcttaaagaatggggacattcctgtgaggttttggaaactgctggactgcataatattttaatgaagtctttggaatcacagggcttgaggtagcaacagagatcagctgaaattcaggtgaaaatgataattatgtagtatattcactggactaactttttttatttgtttcatattagaattttaacctgaatgaaacctagctttttaacttggcaatggtattgcattgatgtttgtaaaatgctcacagtggctgtgaaaattttgttggtctaattggtgtaacagatacaaagagatttgattacattttttcagaccatttttgagaaattgaagactttaaccttgcattacctcttattattaagacagtgtgacaccccatccgctatatttatcaaaataccctcagcaaagcttttaaatatttctgtatagaatgagttactgaatggaagtaattgtgcaaactgattaggacataggttctatgtattatcttgatatacaggtgaaagtgctatagcgatctgaagttaccacagtaatgcaatggcaagaacaatgacatgtttcacttttatgtattttatgagttatttcaccgttatgggcgccattttcctcatctattaaataagaggattgggcaaggatactgctgaagtgttttgttactgacatttcgtggttctacctacttccattcactagtttaacttgcatacataggtgtacttttcaacattcttgaatcatagaattggaaagaatcttgggtagccaggctgcctcacagaaaagtagaaatttattcattcactctgcctaggatgctttgcttgcactttctcaggctggtgccctttgagccagagctggttgtgacatcaattattatccctttggttgccaagattgatttcatggtttggagagatgggaagagaatcctattctccctcgttgccccacgtacagttcttcccaaatttgggagcttagttataaaaggcaacctgcagacataaagaaggatctttctttggttaaacgtctattccttgccatggtacattcatctttgtatcatgagcacttttctcgggcagcacatgttactcttaaatgtttactgaatgactgaatatagtggatgacaaaaatgactaacagttgtaaatgtaagtagagtttcatggtttatttagcctatggtggagctgaaattatatctctaggtttttgaacaatgatgcttagtaaagattgtcaacaaataataatagagatattggaatatgtttacaatcatctataattatattgttatagagaatatatctgtagacatatttaataaatggtgcctaatgagttttgttttataaactcattcagtaagacttgaaatattatttacattttatctctgccttttatttctgtaactaagaagaaaacttcctctttaagtacctaccaaagtatttttacattcaacttggacaagagtttagtactatttcttttactgaaatattctatctcctgattttctagttgaaaagataattgcatcatttctaattctgatatccaatttaaggtttaaagctaagcaatgtaaatttggtttaattcttacctagtttatatctgtattatttagaggatatttctgcttgggtaatttgtgaagaggttaatgcatttctgtcttgaaaaatgtatatgtgttcctaattcctaactaatgggaaaacagagggtatttttagtgtcagctttcatcaagtcagacctttctgaagaccttactgaattctatttccatgggaattttgctaatgggtatgtgcaacattatctaggtactcatagataggattacaaattaaaaataaaaaggaatgggtggtgaacaaacacatctttcttttcttttaagaaattgacagaatattaatctttgcactttcattttcactttcgtttcactttgcattgtttttagattaggtgcagaaagtccaagtttggtactaatgcatgagatcagcatagacaatataagtaatgcatttattaaggaagttcttagttgtaatcttatatgtacaagcagaagagagaaagtcttccagtttctctatatttagttaacaatattagtgacttcaatgtgttttacaggaaaatggaaaatttaaaaataagccatccagttgtattgcctgtatactcgtttactgatttattttgattcatgtaatgcatgtgcactgtacatgtcaaaatactgtgcagaaaacgttaatgaagctggtgatattcaacatttattgaacacctgcataccctggatattggaatttccttatggctcagcctcaggctacctctgttttcatactactacttttttttggtcccatgtgatctgggaaaataccttcttttcctgggcaatttcatgtactttcatggttttaaatatcatcaatatatcagtgactcccaaattctcttttctggctctccagacatatattgtcaaggaaatcttgcagatatatcaagctaattgtgtctgaaactgtactttggatcctgcccttcttcagatctgcagctcttaagaatttctaatctcactcagttccatccctccagcttctgccagaaacctgagagtcatttttgactcgttttattttttcactacccttcatcccaattcaagtctgtcatcaagtgctgtctcatctacctctaaacattacctcagaatttttcacttttctctgtcattgctgccatcacatttgatcaagccactgtgtcttgcctggactaatgtagtttggagaaactccaaactggtttctccatatacagttcagccagttctaattcatttccaaataaaagccaaagtaagttcttaaatatgtaaacataattatatcactcttatatctaaaactctataatgcttttacattgctcttatgataaagatctcttttatctatcccagaagaggtgtttggtcttaaattagcttcctagggcgaccataacaaagtaacacaaacgaggtagcttaaacaacagaaaattattttatcacaattctgtaggctagaagactaaaatcaatttggtttcttctaaagcatctctccttggcttgtaaatggttgtctttctctggtgtctttgcatggtcttccttttgtattatctgtatccttgtctcttattagggataccattcatttggattaggggccaccctcattgactacattttaccttaattacctccaagctctgtctccaaacaaagtcacctcctgtggtactaggcgttaggacttcaacttaaaaattttgagaacacagaattcagaccataacagagcctaaactcatagttgatagacgaggaataaacatgtacacataggagcagagacttctggtgggttttgtgggaactaagcaagttagattagagaagattctgtagaaccaagaatggaagactaagaaaaatgttatcctgctttattctcccttaagcaggtatcatttgcagtagcctccaaaacatcttacatataaatgcttttatctcaagaggaatcatgcaatactgcagatgactcagtaaaaatccatcacctctcctacaaaaacaaccattctacctacaacaaaaacgatgacagcaataaaacaaaaactctaccttatttactgacttcatctttatgttttaaaacttattcatttgtatggaagggtgtgtatgtatatcaatatcttggcctatctagctatcacaaaataacaactttttttttttttaagacagtgtcttgctctgtcacccaggctggagtgcagaggcacagtcttggctcactgcaacctccacctcccgggttcaagcgattctcctgcctcatcctcctgagcagctggaattacaggcacccaccaccacgcccagctaatttttgtatttttagtagagacagggtttcaccatgttgtccaggctggtctcgaactcctgacctcaggtgatctgcctgccttggcttcccaaagtgctggtattacaggcttaagcctcaaaataagacctgttattttgaggcctggcctcaaaataacaactttttaaccaaatctgatcaatgtttcgtattagtcttactgcataatggcagtatccattgatactgctgttaaacaaccaataaaaaatccttccagaaataatttatattacatatccagttattatattcctttgaaagaattcctgttacaattatcagcaaaggccaggtacagtggctcatgcctgtaatcccaacactttgggaggctaaggtgggaggatcacttgagctcaggggtttgaaaccagcttgggcaatatagtgagaccctgtctctacaaacaataaaaataacttactgggtgtggaagcgcacttctaatcccagctactcacaggctgaggcaggaggttcgtttacacccaggagttagttcgaggctgcagtgagctgtgattataccattgcactccagcctgggcaacagagcaagaccccatctcaaaaataaacaaacaaaaaagaatgatcagcaaatttaatttctttaaaatcttttaacctaaaatccaattttgcattatatgaaaatatccttgtatctggtttctggaagaatggagatgtaatgtcattaacttttatgctaaagacagctatttttaaaaactacgcacagtatcatctaaaggattgtatgtgtgtgtgtatgtatgtgtgtgtgtgtgtatatatatgtatttagatagatatactttggtttaattcaagatagttttggcttatggatgacaagatgtggatgtgttttcataactcacagctgtcgtttatgccataagggtaattctcttcttattcagtatgacataatatgctacattttattatccagactatctttctgactctgaggaaaaaaataggtccaaatagtcaaattccattatctaatgacagtggtaggcaggaagcacatggataattatatatacattgtcagattcagcctatgaaactactttaaccaggagtttctacattttccaccatgaagtctgttgttagagttgctactgataactaagatgacaggtctgaatttcattttattttctctttttcttcccttaacaaagatactaatgaactatgagttgactcataggccagaagtatataaaattaaggacgaaatatgtagagcctagacaatccaaagagaagcacctttaatactagtaattgaactttcattgaacttaatgcatttcatatatctttgttgggtgggggctgcaactggtttgtgttcaaactgaagataaattgtttgaaaatccacttaattgatggataaaaccttctgtacattttatgacaggtaaaaaatgaagttagttgattctggttttataagcaaacttgtgacttcctagttatagtcctaaggaaagctgaatgtgttttcctcctaaaaatgcaatgactccagggtagcttttgatcaaacccactcctaatatttgtaagacctgaaacaagagtaaaaatggagacccatatcatacatgtaaatgtaaaagtcatttaaaaagctaccgaactcttaaatgtgctctatactccttacttgataagataacttcttgatatcttggaaagacagatttaaatttaaaatttttggactccttgggattctatgtcagaacatgataatgtggggagttggcccttggcctgccaccctttcctttttatcctgcacatctaagctccattcttacttccccacaaaacaactgccctgggccaccccttggaagactatggagtatatgctgtctacaaatagacatgaaacacttaccactgctgtattccccatggtcttctctaagtcattatggattgaaagagaaatggcaatgattatgacagacataagtcagatgcttttctgtatcaatttagatgattatgtgtctttccacctttattctgttaatgcagtgtaatacactaatcaattttcatatgctgaaccatgcttgcattgtagaaataaatactacttgtataatgatatgtagtataccatggtgtataaaccctttaatgtgctcttgactttagtttgctagtgttttgttgaggatttttgcgtcaatacttacggatattggtctgtagttttcttgtagtgtctttgtctgactttggaaccaggataatactggcctcattagaataagcttggaagtatctcctcttgttcaagtttttggaagagtttcaggacaatggatgttaattctttaaatgttttgtagaattgtccagtgaagccatctggtcctgggcatttctttgttgaggagtttttaactactgattcaatctctgtattcattattgatctgttcatattttctatttattcatgatttagtcttagtaggttgtttctaggaatttatccatcttgtcttaggttattcaacttgttagcaaacagttgttcatagtggtcttttataacacttttttatttctatggcatctgttataatgtcctctctttcatttttaatgttagttatttgggtcttccttctttttttcttaattagtctagctaaggatttgtcaattttattgatctttttaaaaaactaactcaatttctatgaatttttatattgttttttgatttttctatgtcatttatctctgttgtaatctatattattttcttcttcctgcttactttgaccttagggttttttttttttcctagttccttggatgtaaagttaggttgttaagttgagatatatatgtattttacattatacacttaacagctataaacttaaccctttaacactagtttcactccatcccaaaattttggcatgttgtgttttcactttcatttgtcttaagatatttcccagttccagttccccttattacttatttggcccattgattgtatgagaatgtgtttaatttccacgtatttgtagatttcccagttttccttgtgctactggtttgtagttttattccattgtaatcagaaaagatactttgtatgatttcagtcttctggaatttaagatttgttttgtggcccaatgcatggtcttatcccagagaatgttccatgggtactcaacaatacatgttctgctatttttgattagagtgttccgtatatgtctgttaggtctaattggtctataaggttattcaaatcttgtttccttgttgattttctgaataattctgttcattgttgaaagtggaatattgaagtctcctactattattgtgttgttgtcaaatttcttcaatcctgccaaagtttgttccatatatttagattcatgtaaatacagtaagtcctcatataacattgtgataggttcttggaaattgcatctttaagcaaaacaatgtacagcaggcttttaaataatgtcattttgttcagtgtccttttatcataatgttgagggaaaaaatggctttgttgtttgtactttttcttaaagctgcagttttcaaaaaactgtgacaacattgagaacttactgtatttatgcaccaaagctatgaggtttggtgcataaatatttataattgttttattttcctggtaaattgacccttttgtcattatataatgtctttctttgtgtcttgtaatggttttttatttaaagtatattttgtctgactttaatgtagccacttctgctctcttttgttaccatttacacgggatatctttttccatcctttcactttcagcctatgtgtattgttagatctaaagtatgtctcttgtaaacagggtatagttggattctgttattttatccagttaaccagcctgtatcttttgattggggagtttaatctgtttacatttaaaataattaccgataggcaaggacttattgccgttttgttagttgctgtctatgtcttgttcctttcctctctcattgcctttctttgtgtttcattgatttttttttctagtggtatgctttcattcccttctcacttccttttgtgtgtattctacagatattttctttgtggttaccattgtaaatccataaaacatctcaaagttatagtattctatttcaaactgataacaacctaactctaatcacatatgaaaactttctcctttactgctccacttctccatttgttactgatgttacaaattacatttctatatattacatgtacattaatatagatttatgggttttgttttgttttggggttttttcatttaaatttcacatactaaatttacagtattacgtattactatatttttccatgtatttacctttattgagaaccttatatttttatacagctttgtgtttttgcctgctgtcctttcatttcaacttaaagaacttcctttagcattttgtatagattagctctaggtgatgaactcccatggcttttctttatctgggaaaatgttaatttcttcttcacttttgaagaactgttttgccagatgcagtattcctgattaatagtttttttgtttttgtttttgtttcctttcagcactttgagtatatcatcctactcctttctggccttcaaagtttctgctgagaaatttgctgataatattatggaagctccctcatatgtgataaatcacttttctcttgctgctcttaagtttctgtctttgactttacacagtttgactataatgtttcttagtatggttatctttggattttcctcgttggagttctttgaatttcttgatctgtatgtacatttctgtccacagattggggaagttttcagccattttttcttcagataagctctcttatttttttctctcttactttcccttctggaatacccatcatgcatatatggacctggttgatattgtcctaaatcccttatcatctcttcacatttcttctttcttttttctcctctgctcagtgatttcagataacttgtctgcaagttcactgattcttcattctgcctaaaactgttgttgaatacctctaataagtttttccattccgttactgtatttttcagctccaggatttctgtttggttcttttttatagtttctgtgtttttcttgatgttctcgttttgttcatgtatcattttcctgattgttttcaattgttggtgttctctctctttttttttttttttttttttttttttgtgagacagtctcactttaccacccaggctggagtgcagtggcataatcttggctgactgcaacctctgcctcctgggttcaagtgattctcctgcctcagcctcctgagtagctgggattaaaggtgcatgccaccatgcctggctaatttttgtatttttagtagagatggggtttcaccatgttggccatgctggtctcgaactcctgacctcaggtgatccacccacctcagcctcccaaagtactgggattacagatttgagctaccgctcccagccttcttttagctcattaaacatccctataatagttattttaaattcccagtcaggtagctgatagacctttgtttcttcagggtaagtgtcccgagttttattttgttcctttgattaggccatatttccctattgctttgtatgctttgtgatttttgctgggcattttgaaagacaactacctcccctagtctttgcatactggctttgtgcaggggaagaccttcactaataccccagctgggagttctagggcctctcaaatgttttctgatattttgctccctctggcacctgcccgtggaactgcagctctaatatgcctctcacctctgttttcagtgccttccaaacgctggtgctgggcgtgtgagtgcccttctttaattaatacagaaaccagttccttgggaatcccccagaaagccagaatgttggatgtatggttcattcttttatttctgtcctgagggaggagctctggcatggggggtggtgggttcttcttggttgctccgctattccacatgggagagaggcatgcatgaatacactgaacactgtgaaattcatttcctaccactttcattggaattccttcttggttttataatggtgtgggtgctgtagcatctcaactggtctctcaagttctcacaagggtattctgatccgtatattgttaacttggtaccttagtggtggaaagagggcctctagctttctagtctacccctatagctattgttcttttaagaagtatgttttcgaagttacatttcttctctttcctcaatgtaacattttaggaaacaccaccttaaaacaaagcaaagcaaaatatagaaaacaagaacctggcttgactgccacctttaggggtacatcagatcagttgtttacgtgctgattcagccttcattctctcctatctttttggatggaggtgagagtgatgaacttgtcttgcttttctcagaactttagggtaaacctaggcttatcatccttccttaactgctaggagggcatatactatgtatagatgatgctgattaaatctttggagctttaatgatgtgtgacagccaatgaatttttctaatatagtataaaaacttcatgattttatatcattcttaaaggaagaggctttaaagcagatgtacttcttttttcattttaaagcttaagtacttagatatatgagagaaaatgaagaagtatggaaatttgatcctgtacacttagcttcatgaagagtgagatgcattttctgaacatagccccattgactcttctggaattagttggagataatttggtttgaaatgtcggctttgtaaatagaaatggaaatcattaaaacagataaaagtgaacatagaaactgcgaactagaataaacagtatgttggaaatgaccatgtggctcaattttgcatcagttttctacttctttagttcatgatgcccattttatgtcatgtgattacagcagtgtgatcagagcagttagcatattcttggcattttctcctcattaactttcacttcttcagagggaccttgagtaaaataaacacatttgagcagtcttaagcaaattgtttgaattgtttcctcagtatacagaatcaaccaaaagtaggttggattgagttgagttgggtttagtttaatatcatactttactacagcatcatacatacatatacaatattacctagcatctgtagcacccataaaggattctctaatgcatgtgaagtaaaaggaaagagagtgtttaagtcctgactttgaaactgttgtgttaattgtgaacttttgctgagtctatacattgaagaaggtaacactcagcatgttgagatcacaactgctagattagtgcttggaggcagtagctgtgctgatgtgaggcattaatggctgggtgagttcaatcagatatcctgcctccagtgtctttgtgtaatggtatttactagatttcaaacagactgctgagaaagatgaaatataatctcatgtattatctctgtcttgaaaaaattagataataaagttgttctcttactggcatatgttttattaaccttcgtagagtcaacttaaaggacagatgtctgtagaattgaaaccttttgctagagtgttattaagtgcatttttgagttctaggaatcatggggttgagtagagcaggtaagcattttttaaaaccactcagaggacaatcttatgtcatattctgaggttagctggagagaaaaaatgtgatgtaaattgtgtgcaactacattctttttgttgtttttcttccttacagagcctggagaaagttcttgtggaattcagtcacaaggagttgtttgatttctataacaaggtctgtatttttaaaataattttctaatatgtggagtttttttcataatattttgtttcattttatgaattcttatttttaaatgtcatattatggaactaagttctttaaacttcccttataaaagaccttatgtttcacaggaggaagtatagcagaaatgaagagaatttgaaaaactaaatcaggaagaaaaggaaaatagttttaattaaagcaataggattgttgctttaatataaaacattaagtaatgaactttgtgattcctagccacactgacactttaaatatatataatgtcaaatactttaatttctgggcccaagggtaaagggaaacatgcctttagagatttatctgtgagtatatttcatgtctctttctgaagactgattttgtaatccaggaaaatatactccctccaccccccaactttaaaatattatcaagtaggcagttcttctgccagtgtactgccactggagcatgcgtgtggttatcctgttcagcccaccaccactgtacccactccctcatatgtaagcctccaataaaaccccatgtctcattaaaaaaaaaattatggagtgataatttaaaaggaaacagctgaagacacttaaaacaacagtattaagaaatcttctttctttgaaaatttgaaaacttaaattttcaagcacaaattctaatatcttcacctaaaaagaaaaatattctaagtggtaattttattgctatgtgaatggatttaatattcatagttaccagtgctattttttcctttctatttgcatgtgtctgaataacacttgatatgagtttcgttcccttcactaacgtctttttttttttttgtctttgtaaatagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtc

SEQ ID NO: 556 - DNA, 183299 bp, Homo sapiens
ttcaaggacaacacctttatttcattatataaaatctattactagagcaaagaattaatttattaaaatagatgcaagatactatacagtgtacatggattaataaaaagctagtgtactgatgatatactcattgcttactaattgtcaaactagaatattctttaactgtcacattttaaatttgacaactagtactgatgagaggaagagtccaacttggaaagactgtggagggtgtcaagagtgaatttcagttatatacaaacttggcgtggattaaagctgtggaaagttatgatgaacacccagctaggtgtccagcctgggaaaggcataacagcacatgcagtggttagcgggtttgcggcatcagctcacctgcacactgctaagttccttcccctgagggcttcttcaggcgggcaatggtgaatcttttctttggcgagttggggtcctctccatcccagagagactcaagcatggttcttcagaaaggcattactttttcttttttgcctttttctctttcttttatttccttttccctttgtcctttgccttttctgtgctgcctcctgttatcgccaaggcacgttttttacccagaggagttttggcataccagttctgaaatacaatagaagtttcggaaaaggtcagaatgacaccaattcaccgcaatactcttaaaaataaagaaaagcctgctaagcaggaaggggcaagcagccattgtactttgggcatttaaggtatgcttgacacaagctctttctcagtgggttttccagactgtttttctgcatgatttgaaacttcaacctgtatttctgcatgatttgttaactcagggagttaacaatttcagagaatctcaggctaaacctaaccagccatccttcccaacaaagttgcctgtttttccggggttgggttttcttggtaacgtgaagggtgctcatggttcatatgtggccatgttcagtaaacaatgggcggccattcaactactctgggggagttgctgttgaaaccacggtagaaataatggagcccaaatactaaccaagaacttagtgattgtaactggccccacaatggcatttttctcaacctttgcgttttatttgaaacctaagagacatttgggtttataaactttatagtagcaatatttcattgcaggattatattacatgttatttatcgattctcctattaatggatatatgacatttgaatttttggttattatgaagaatgctgaagttcacaatttttacaaatctccttgtaactatgtgagagaacctctttagggcacacatttagaaatagaactcctggggttgtagggtttgaacatcttcaattttacttggtattgctaaattgctctctgaagttctgtaagtgggaaactctcttggtctttgtatgtcttttttttttttttctttttttgagactgagtctcactctgtagccgaggctggagtgcagtggtgtgatctcagctcactgcaacctctacctcctggattcaagcaattcccctgcctcagcctccggagtagctgggattacaggcgtgcgccaccacacccagctaatttttgtatttttagtagagacggggtttcaccatgttggccaggctggtcctgaactgctgacctcaagtgatctgcccgtctcggcctccccaagggtagggattacaggtgtgagccacggtgcgtggcttcatatgtcttaaaatgtctcttttctcctgtctcttgtatgccagtttagctggatacaaatattaggcagatagttgtttttccttagtactttgtagatattatttcactatcttctggcacctatggttgttaaagagatgtctgatttcccaattgtttctttgtaggtaatctggtaggttttaagcctggcttttaatcttgttcttaagttcccaacaatatatctaggtatagatttatttgatttgttctgctgattactaggagtttattagttaataaattattttacttggaattgatttttaatccttctttaattcaggaaaattctcagtaataatatctttaaacaattgttcctctgatacttactgtattctttttgtgttctagaacttattgtgttctagaacttccattaatgaaggtcagtgtcttcaacccacctttgatggatctttgtatttttatggattttaccttcttgtttttttgtgctgactatttgggggtactccccaggaccatcttcctgtccacagattgctctttgatcatgtttagtttagagttcatacctctttcatttcctttgtcattttatactgattgccatatttttaatttctaagctttctttctttttctttgcaattcagaccttagcttctgactctctaagctttctttttgtaatattttttcataattatctcttctcatttcatttttttccaaaatgttctgtgcatttctaatggaagtcatgctctcatttattttttgaacatcttaattatattaatttaaacattttgtcagattgtatttagcactagatttcctaaaatgttttggaattttgattttcagatttgttgtgtgtgtgtgtgtgtgtgtgtgtgtgtgtgtgtgtgtgtgtgtgtgtttgagatggagtcttgctcaggcacacatcaccacacctggctaatttttgtatttttagtagaggcggggttttgccatgttgttcaggctggtctcgaactcctgacctcaagtgatccacctgccttggcctcccaaagtgttgggattacaggtgtgagccaccatgcctggccaagattcattttgaatgggaagttttgttttgggctctgtctctctctccttattctttcctccatagcagttctacagctgcttctataagatcctctaaactcaaatacagaaccaggtcttataatgatgtttttgattgatgcttcccttaatgcttcctggtgatattagggatatcaaagatccagtcataaaagaagcaggtattatcattttatctttcacaaactgttctttttgtttttgtttttgagacagagtcttgttctgtcacccaggctggagtgcagtggcacgatcttggctcactgcgacctctatctcccaggttcaagaattctcctgcctcagcccgggactacacacgtgcaccaccatacctggctaatttttgtatttttagtagagacagggttttgccacgttggtcaggctggtctcgaactcctgacttcaagcgatctgcctgccttggcctcccaaagtgctgggcttacaggcatgagccaccgtgttcagccaactcttaaactctctttgatttctatcctttatttttctctatgctgcattctaggcaattttctttgctccctttttcagttcttttgttttctctttagttttgtccagtccacagacaatttattcactgagttatttatttatttattttttgagatggagtttcgctcgttgcccaggctggagtgcaatggcatgatcttggctcactgcaacctccgcctcctgggttcaagcaattctcctgcctcagcctccggagtagctgggattacaggcatgtgccaccacgtccagctaattttgtatttttagtagagacggagtttctccatgttggtcaggctggtctcgaacttccgacctcaggtgatctgcccgccttgattcactgagtttttaattttaatgactatatatttttttcactatcaaaagttctatttggttctttttcaaattttcctgtttttcctccctaatgtttctggtctttaatttaaacatgcttattttgtagtctctttcagaatgtccttttatctcaggttcttggtagtgctattctgttatttgcatttgctgactctccttggggtagattattgcttgtggctcataattttttattatgaactcatctttagcaaggctggtatttcctgtaggaatcctatgtaccctgacttggctaaatttccatacagagtggtttttaattttgcttttgatgtgacttcaggggttttaatgataccattatcattttaaaaattatattaatatttcaactcgagattctgggaccatggaggtagtacagatttggaagtttgacatgcatggtgtaggcttggattttgatttcttatgggccacttttattccccacctagatccctgagaagatcacaagttccttgatgcttccccatggcaacctataaagtgttccaactttgtgcagttccagcattctgtctctcatgggcctctccttgcctttctgtttggatcttatacacccctaggccacccatgtattagctcatatagttgttcctgtctttgagatgtacctctctgttagtggcactgggggattccctcttccttcttttagccttggctctgtttttaatgtaaggtgaggtggccatgtacttaaggcgatgaactcctaatttatcgagaccccgtacagaatatagttaatgaagttcgctttggggaaaggtatgaatttcagctctgctactttctagttgttacttgcctcttgtattgtttattttattgctgctgtggcaaatttccggaaacatggtggctttaagccacacatttatgatttcacagggctgtaggtcagaaacctggaacgggcctcactgggtgacaatcaagatggctgcagtgctgtgtccctttctggagcctccaggtgagaatctttcccttgccttttgcagctctcagaaatcacctgcttttctggcttgtggcccctgctccacctttggatagcaatgctgggctacctggagtaccaacgtgcccttctcagactgctctctctggttttctcttccaactccctcttcggcttttcatgattacattggactcaccaggataattcaggataatctatcttcaggtcagctgactagcaggcttactccatcggcagccttaatccccctgtgccgtgtaacctcacttattttcaggttccagggatgaggatgtagacgtccttgaggggccattatccggcctaccatgcctgtccatatctcagtttcctcatgtgcaaaacagggggttatgagtctaaatgagtcagtacagtggctggcacataataagcagtcaatacgtattagctaacattattagacttactatcatcgttatcatacatattctctccatcatgtctgtggagcagggtagaacgtgtttggagaatctgcaaggtcttcatctgagataacgttgtcggaagcacaattaggtgaaatttctcagggtttgcctcattagaaggaaccatagcaatggtatcacattattcaggagagtgtgagggtgtcactccatctatccatgtgtttaatgaatgtgtccctaaacaaatttattaaacatctacttggggccaggcacagggccaagcactgttgctgtaatggaggcacaaagggattgggtggaaagggtaatgatggcaaaatgatgcagtttcttttgaaaatgaatagagcaaacaaatacaccaagaatggatgtgtgaagcatatgcattctcatcccgggtcataaaagggtagtaattccttttcttgaatagtgtgatcagacctcaagcacctatagatagaaaaacttctagagattacttcggaaagttaaaggctcagccacgagaaaggataggcttccacaccttatcatctaactcctcaaaataaggaggaaaattaatattttagaaaggagaaaaaatggggaatttcagaaaagaatatgatgtatcatttgaagaggataatatcagcaattatgaacaggtttaaacagttaacgagaatattactaataattcaaatgcttggtaaacactcagctagagttacatttttttttcagccttgccagagcgggggtcagcaaaatatggctgatgggccaaatttggcctgttgtctgtttttgcaaataaagttttattggaacccagccatacgcattcatttctgtattgtgtataggtgcttttgtactatgatgcacaactgaatacctgtgatagagactgcatggctctcaaagcctaaaatatttactatctggacctttatgggaaaagattgccaagttctgtgctagaccattacttctgaaatcattattatgactatttttcacctttctaatgcttcactgaagaattaggggcaaaccaggaaggaatcatagttttagatttgatggaaaagtgatgtgttgcagagggaaattttcctgatgttaagcaggctcccagagataggcttggatgggaatttcagtgccccttctggtgactgcacagccaatattgtggtggtcttcagttgcatgcatataatctcttacctttggagttggtcagggaaacttccttcagaaagacaacaccactgtatttatttttgcttaaaggagagcaggcagagtttgaggagtgcctgctggcctgggcactcctataagagagggtgttgggagagataattctcaaagtttccttcagatccaaaaagttctgtgaataggtcagaatgtattcaaacattggaaaactaaattttgatgagttatcttgtggcttcctatcgcaaatgaactgaaactgaaaaacaaagtgttccatgacaattgtgggccccaaacagcattggcttgaactatactatttggggaatgatttctctacgcaaaacttattccataataccaaatatgaagtaaaaacccaaataagtatatgtgtctatgtgaatccaatggtgttgaagctgctactcaattctgcaattgggctgttaatatataaggccacacaccatggttttcctaaaatttggaagatacatgctttactgccaaaaccccaaagattttgtcatccaaaatttcaggtttccaaatttcactgtatatggccgagttccaattcacgaaacccacggaactgcagagggaggaggcagcgtgaggagtgtctgctgctaagacttggtcatcagggtgttcatttaccttaaagctctcttcttcctctttgtacactggattcatgctggttatcgccgtaataaactcaactgcagtgagaggtttatgaatttgccgccggattctctgatctgtgagcacgcctttaaccacttcgactatatgtccttgggtgaagccgtcagtgaccttcgccaggcagctgacattcaaggcactggtgaggactcctccattgcgttcaatgatttgcttccacagaactgttgtatccagaaaagacacagagaacaagggttaccacagagaaatcagtgccagtttccctctcggttgaaagttgcatctcatcaagaaaggaatacacagaagtctactctagcttatttgtaactcaaatgaaccgaagccaagtaactaaatgctttcctctagagaattttcaaccataagccatacatatcaatgaccctgaggtctatagatccacaagtgccctgcaaattaacaaggagaaacacaaaaccaccgtcagtatagttttaatgtggtacctgtaaagatgttgacaatctgtcaacactggaaattttcataaggtgtataatggcatctcttctcatcagaatattgtatttcccaagtaatttgggtaagtagtttaactttttttttagatataaagttaatttctcacattatttttacatctggaatcagaatgcagattccagttttcatcagctactgccagggtcagttccctttcagtggaagacactgtattacacattttattaaatagagcaatttgacccttattctttccccctcagcaactgtaaacacgcattggttgactagagtccttcagatgagtcctgggtgttctctggttcgtgggacctggagtaaatgagatatttcaatctgaacacagggatgctgtgaaaatgaattatgaaataattctggatgcttaactttagagatggaatgaactcctgtacaatccttaaaatcattctgtatttggagaattacctctattctgtaaagggagcacaagggaagtaaaggagacttgctgtaacttatttaattatatcgagacggtggagaagggtgaagggtgtttacaagagcatctgtcagtctcagcactgggataatctggtcaaatatttctaaaccattttgacttttcttgaggaacacttgaaaccattttttaaaaaatgaccatgactacctgatctgagcattgtcaggcctggtaagcggttaattctgagtctgttaaatgactacatcacacaagtatgttgatccaaaaatggctgataaaatgaaaagatctacttactataaaggaataaaatggcctataatgtaactatgaaccaagctggagaatctggcttttgggccacgagctattgcagcagttcactcccactgtcctcttttggggggtccttggccctgtgggtgagctgagctgctgggaaagggtgaactgtaccttggggcctgccaatttctctgagctgtggatgcataggcatccagggtttggagatctgcagtgaaaccaaggagggccacagggaccccaaattggcctaaaggatcatgaaatccctgatctactctgctcctgccttggtgggtttctttgagcttgagccccaaactagtcttatccgtaaaacaggcatagaaggattgacttctcagtgctgctgtgaaaaacaagcccaaaaatgtttgtaaagcgcttggaagtgcagcagcccggcacttggtggggacttgactttctgtggctgtgttactgttgttattacaatgacaatgattgttcttcattctatattgcactgaagtttcctaaccctcattaaaacatcaattacaaaagacaacacaaaataggctacaagagtgtttcaaagcctgtttgtgtagcgatggatggcagccggtgaagattatccttgtctaaatataactgttgcagagttagagatcagaaaacataacccatggtaaaaatgatcatcacaacaacaacaactagcccacatcttcacttgagatctggtgtgtcttccgtccaaatttataacatctaaacaaagtaccaccgggtctgagtggcgactctggaagctgagaagggaacatgatttatgggagagtcacaggtaaggccccaaaagctgaagttgacatcccaggctgggtttcatgcttgcggacttggttctgggcacgcatgagcaaaattcctgccgtggtgcaaaagggaactatcagtgggaaggggtgagggccacgtgctcactggcaaccaataactaactctctccctggcttctctgtgaagccacaacagtcacaatcttggaagttttctgcccaaatcatccaaccttcttgcaggagtaatcactcgatgagtagagattcattagtaacggtgtacagttactgtactgggaaagggtgaactgtaccgtggggcctgccagtttctccgagctgtggacaattaggcatcaaggctttggagacctgcagtgagaccaacaagggccagagggacatgtaaacccgctgctgcccatttaaagtgtaggatacttggtgttcacggagagtttcggtcaagattcctctgaatacatgactcattggttactctccatagatcaccatttttactggagttgcagcaagagagctctgtgagacagtcccagctgtggtgggacctgcccacctgcctgctcatctgaagatccagagaaggggatgcaaaaccaggcttggcttccttcctgcagctgatgaactcgagctgttggtctttcaaagaatcgcttctattgcttttacacaatcacccactcatggtttcttggcccttaaatagctgctgtagggcccacggtggtgtcaggtgtggagggaggcacagcgtggtgggctgggtggagactggagccggcagtgagcatgggagccccagaggctgtggggtctctggcccagaagtgcagtggggagcacagatgcactgcagtcttggggtgtggcaatggctgtgttggtgaagaccaaggctaggggccccagagtgttgagggcagcagaggggctctccaggccaagtgctgaattttactttcctcttttggaggcaaaaggctcctcacatcttcagaccaatctacattctctttcccttctttggatgaaagagaatttggcctttggctccccttcatctgctgttgacattcccagtggattctgtcttggctggcgctcgagatgacgcagtctctgaacattcatttttatttggagttttccaaaagcctgagaggtgaataatgtgatgtgggtgagcttctgaccctctgaagcctggaattgcagaaaagtctgaagacagaccctggacccatccgaccagacactgggtctgggtgggcctgtgatgaattgggttattagcgaaatgcaccccaaggagagaggcaagaggaggagggcactgggaatgtggagaaacggaagcccgaagggatttctggggaccagacagggcatccatcagcctggggggtggattttctttgcagagacagcttggtctgggggaaagaaggagagattgaatgatgtttggtgaacctgagggctgtgtttcctctacaaatccacccttcacttttcagcaccgtctgtccccacgtggcccggaggaatttgaggagtggggccgcggggactgctgcacacctttgagctccattgcgggtggagagacaactaagccaccgtctatgttacggattggcagcccttgctttatggactggaagatactacttttgatagctgcaaagacaagaacagtctttctgtaagacagatgtcccagccactgtggctatgaaaacttcaaggtcactggaggaaatgctggatgaggggcgatgacgtcggccagaatggcggcctgaacacatcactccccaagacagaaatattgaggagctgtgcttcagcggacagaacccagggccccagagaagtgtctggtgcagctttatcatttgcccacaggtggagggatgctttctctccttcctctcccatcacgatgctgtgaggagattcaggtaggaatctgcagcgtgatctgaatcctaagcgatgtgtggtgttttatcaaaagaacaaaattgctgaccatccatcaatagcttcatttttaaagggcctatagttttgtcaaacaatagaaaccattctgtccagagtccagaataatgctccagcccctttgaattaataataccctaccttattccattaacacagcttaaaatatagataccatacaaaaaaggaagaaaaaaagaagaacgcatgagaggagacaggggtagtcctgctaaggccaggggtgtggaacccccggcattggctgtgtgggctgcggcgagactgtggtgcctgcccgtcttgcgctgtctcctttctcggctggacagcgctgcccccttcatccatgtttctcattctggccaacatgatctggctggaggaaatgttggcttcttctgggtctagtccttaagatcttctgtgactcctccatcctgtcttccctcgcttctttggatgctggccaggtgcaaaaggttcatgggggacgttttgaggccctaaaagatgaagaaggcactagatggatgcagaaatagctgggcctaaagtgttcctgtattttgtgtataacactgatttagaaagccaggatcacaatttatcaagacagaaataagcacatgttgcaaacacagtggctaataagctagctgtttatagcatgcagggagtagatggttgttcttttagcaaaaaaaacggagcagcaacttacgaacagccagagaggaccgtatatgccctctgctttgcggtgctcacgtgattggagaaggaagaacagaaaccaagtctgacctaatcactgtattactaccattcatgctgaccaccaccaccactgccaccacggccaccaccactgccaccacggccaccaccactgccaccacggccaccaccactggcaccagcacgtctgctgctcctgccactgaccatcatcatctccagtgtcaaatgtgacctttgccaccattcccaacaccctccccagagccacccacaccaccatcaacacagtcaccctatctcccgcctcctcagcgtcaccccacactgcctccacccctactgccagcaagcacttctgtctccattagcacacgctgtcacctcccgccaatcccctccaccatctgtaacaccaacagcaccatcgccatcttacctccaagtcctcaccgctccccgccagtgcagtgttacggtggccccgccacgagccacccctgtgcattcacacccgtgtgtcctcggcctccctcgaatctgggctggccctgtgccttcctcttgaccacagagggtggtgatggtgcctctgtgtggcttgtgaggctgggtcacaagaatcctttcagctactgctccaacttcttgaaacatgtgctcatgagataacccgtcgtgggacccagctgccaggtctgagaagctgcactgaggccaggtgcagcctgtccggtcgacataggccccgctcagtgcccacgacggccagcagcaactccagtcacatgcgcgagcgatcctgggtatccacactgtccagtctccagacgaaggagactcaactttcatgtgactctcacatcatgaggtacattaaggagaatgccccagctctgcccagacaacccttggaagcacatggtggaataacgtgctgtttgagccttcagggaggttttcacacagcactagatagcagaacggccgccagcactctccccagcttcccctgccgttcaccacccgtccttccctcctcctgcccagcccacaccaccttcttctcttcctctacctccactgccactgccgccaacaccctttctctctgggggccacatggggccaggtgctctgctaacacctcgtgagtgtcacagcagccctgtggcgtgaaccgttctcctacttcacagatgagaagatgaaggctcagaaggtgaccgacttgtcagggtcacccagctatgcaggggcagagccaggattctgagccaggcgtcctgagagccccagcccaggctcctcctcgctccactgctttgcctcccaggggctctttttttgtgtcattcccattaaaaaacatgtttcaaaagaagtggattttgaatctatttaaggagaaggaattgaaaaagtaagctctcgttgtattttaatgttcattttaagtaaatcattacacaagtggactttgagactggaagaaaaaaaaaaaaacccaacccggtgaaaagaaactacactctatgaggaagacaccatcaccatgggtgcaaggtgagtgatcttaatctacccgtcccaagaaaaatcagcacccacaaggcttttgtcactgtcagggccagaaatcataatccttgtccagtttccttttgtcttgggtagagagatatatgctaagaacagaacgtgacctagtggtttatatctgcagcacatgctctgtgttgggtgcaggtgcacacaccccaccgggtgcaggctcccctcaactcatctggcgcccaccgggtccaagggccgccctcctggcaagcacacagtggacagcccagcctcagctatcatgcatgggaaggggctgggggtacttgccgtatctggaagcatagtctggtctgggcaccaaaataattttctggtaaactttgcagaaagattggagttcagcatcgaagggacgccgtgtggtccccacaatcagaatccggtcatctggtttcaggagtttcaggatttggggaaggtgttttttcaggcgtttaggttcattctgggagagagaaaaaaaaattggtccacatatagaaaaaaagaatgaaaaaatgaaagaaaatttacttaggatgcattgcagcatcctttgttaaagtgattgcaaagctctgacaaacacaatttcttaaggtttgtcctgggatgggtctcggaatgtgcttcccagtatgacccagtggattttaattgtcagtgtttcctttcctcaacctctggtgtccagatttagagggtgggaaggaaggaagcaccttggccctaggaatgggaagtggtggctgatttacaaacggaaggaagctcactcggacctgtaatgagctgtggtgctcccattttcctaagttgtttggaagctggacacaagacttcctttgctgattgctggaacaatgaagagcccagctcctgcatctcatgtctgaaaaatacctggttacataaggctgtgaaacttatctctctgaagcagttgggaaatagtttgaacctgaattattttagtataatctcagcactaatgagggagaggaatgagcgagaacaggctggctgttcagcaccccagggaggacgacttccagcccgtgggagtcagatctgaccatgttgccatgggcaacagcctggctgcaaacgaacctcgcccccagtgcagacagcaaagaggaagccggggaaggagaagcacaccaggggcaatggtgagagcctctgcagagacttcccaagcacagtcgaggccatttttgctcccatttggctgacggctaatgatgttcctgcgtcttttcatgtgcttattggtcatttgtgtatcttatttggaaaaatgtgtatttagattgttggcccactttaaaagttgggttatttgtctttttattattgagttgtaagggttctttgtaggttctattaatagatagaagtccctcaatattacatggtttgcaaacattttcttctgttctgtgggttgtcttttcactttcttgaggatgtcctttgcagcaaaaaagtttttaattttgatgagttgcaattttctttttgtggcctgtacttttggtgtcatatctaaggaacaactgcctaatctaaggtcacaaaatttatgcctatattttcttgtaagagtgttctagttttagcccttatttttaggtctttgatacattatcagttgatttttgtatatggcgtgaggtaagggtccaactctttcttttgcaggcagcaattcaacagtcccagcattacttgttgaaaagattattctttctgaattgaattgtctttgcacctttgtcaaaacgaactgtaatgtaaggctttattactggattcctgattctgatccattgatctatgtctcttcttaggcaagtccacactgtcttgattgttgtagctttgtggtaagttggaaaatgaaattgggacatgtgagtcccccaactttatttttcttttgaagaatgttttggctggatctcctgaatttctggatgaattttaggatcagttaccaatttctgcaaataagctggctgagatttcatgggaattgcattgaatatgtaggccaatttgggaattattaccatcttaacaagattaagtctttcaaccaatgaatacaaatgtctttccatttatttaggcttcctttaaatttttcagcgtttttgtagttttcagaaaagtcttgcacttcttgtgtcaaagaactttgtgagaacaatttcttttatttttgagacagagtctcactgtgtcatccaggctgcagtgcagttgcacaatctctgctcattgcaatcaccacctcctgggttcaagtgattcttgtgcctcctgagtagctgggattacaggtgtgcaccaccatgcccggctaatttttgtatttttaatacagacaaggtttgccatgttggccatgctagtctcgaacttctgaccttaagtgatctgcccgcttcggcctcccaaagtgctgggattacaagtgtgagccaccgtgcctggccctaagaactttgtgagaacaatttctatagagtggtgggggtagcaagccgatggtggtgggttgaggggtgagtagggtggtgagaagagacttgccttaaagaacaaagcaggtggtgggagtgactgggcatttggggtgcacatgtgagctgcccaaagaacagtggaagtaggactgatctgacagtcctggtgaggctggagactgagaatccatgggggtagagacacacctgcatggtctgagcccaccctcagcaacccagttgccatggtgatggcagtgtgatccctgccctttctgaggcaggagatgacactgttacctttctgtcctgaaatggcagggacatttgaaatgaatcagcctatctggatgacaaacgttgattctgggcaatgtccagagtgacatccttgctgatggtgaggtgcagtcccatgaacaggggacagaaattggtgtgtcattcaactggtagttcccctacactcagaccacccccattccagtgcagagccgtctgttatgcacgagacctgtgcactcatccatcatgccagcaaaccaccccatgatcacctggccacctccaaaaccgccgcccctaccgcggggcctgccagcccctcacaactgtattactttgggcaatttcaaattagtggctagcatccacgcagcaatttcaatttgctattctgcagttagctccacaatacaaccgccacagccagccccaagaaagcagcgattccttggcagaggcactatcgtgatgtcagggaggcgcttgctagatgaagtaacaaagggtaatggggcagaaaatgcaggagcagcccgtgcgcctcattctttaccgccttcacctcagatacaaacaactgactgagcgcactcgaggcgcaggtgggaggagacgctactctcctaggaggaggagaaaggagcgggcctggtccaggcgtctgcagggggcaggggtgtgtttgtaaaagtggcaggggttggagtggaggtacttggagtttggactttgctgaaattctagaggtgtgaggggttctttcaaagattgctgaggacagtgtgaggggaacaggagtgtgtgcaggaggacagagaattccggagtagggcccatttggttctaagacaagagggccccaaaggcaggttttgggatgatgtttggagtggccccagggctcagagggccgcagggatgcggtgtggtttaggtgcaccaggagggctgacccaatgggcagaaggcgaagctggtggtttcccccccatgtcttccagcctgtgctgtgtgtggtggggagaaggccccattctggcaaccttgtttctgaatcccagcatgacccgagagcagctgtgcgccttctgggagcctttgttctcttttgtgtcacagggaaaacaatgccttcctctcagggttgccgggagtttccctgacatatgtattgtgcttgggaaagaggaggtattcaactgatgtcccccaccgccaccggggtcctccttttcctgtccgcaacagtgtccctgcgcccgggaagtttggcttccatgctcgggtggcgtcactgatcttcgccatgccccaatccccgggtgagcttcctgcctcttattgcgggaggggcctcacccaaaggcagaggggccggagggtgcattcagtcactggattttcaaggggatttcccggagtccctcaaccccagggcaaggtcggccctgctgcctgtatggcacccgtagctggtggagtgccagcctcctggatgttcttctctgtgcctctgtgcccttgggatcagggcagcctttgggacagaggccggggcaggtgggaggaaggactaggctccctaggtggctgagtgatgcaatgaggagcaggttacgatgcctcctgggctcctctcacctgtggatgcctctgctgcccttggcttttggtcaccttcagaatgtggacgtccaatgctcatggccacctggggccctggtggcagaggatcttgggtgagacacagagtctcagaggctgggaaggacagcaggactggcccagtcatggctctggagacgcaggaaggcagcaggaactctgcagccctgctccctgaggggcaggccccgcaatgccatcactgcacggtgcaggccgagtggagctggagttccgtgtagagctgggcatgcacacgcaatggtttcctcccccgctcctctcctgctgcagcattggagctgggggtggaaatactgggggtgggaggtggaggatggcattcatgcctcttgcagctctgagtctggggtggctcaggtcccctcgccggccttgcagatgctcaggaagccagggtgccctttggcttgcagtcccctaggacttatcccagggtgtgactcctggtcctcagtgcagttgacctccccaacacacgacggactcctctaatgggaagtgaacagagaaaacgtccagttcatccacagcaaagaccatgcctccagtggccttcatttcctacagggacaaagctaggcatgggcagggtttgcgggaatcggggatggtgctgagaggttcgctctgtgtcaggagcacaagggctgattcaaggcagggttccgcaggctcggctgcttcttcacggctttcagctccctcctcagcgcgcctccttcccctcacatccactccctttatgcgagggtgtctacagggtatatttcattccctgcctccagctttctctcagaggccccctctcagcgctccttccccagtgctcctctggctctctcaggaggaacattcccgttccccttgctctcccagactcagatgtgcagtgagcaggcagccgcaagcactgatggcaagcccagggcactgtgggagaatgcagggggctgcatgaactcagaggccgtgcgggctgaaatgctttcatttaatagtaaaggaagcggaggctcagagaggttaagttacttgtttaaggacacacagccagctgtgtgaatgctgttcactgctggcctgagttccaggccagtgtcttccactccccaggcttatgtctggtgggagagggagtagcccctgcccatgaatgagccaggtttctgataactccaggtgtgtgacacgtgagacgaaacactgccctgcatttctcttagacgtgggacctggtggagaacccggtcattcctgccatccattttgcatacctacttgtggaccttttcaagtttttctgcaatgcagcaacttcgccagcagagggagtgaactacaagagtcccagattaaataataaatgagttctctgaagactttctgaaatgacagggcaatcaaggctcatttggggaagaaaagattgagcttccactctttatccaaatcatctctacctgcgaaaagtgatgtataatacataaggatcaaaagtgattaaaatccttatgaatttaatcagaaattcacagttaaccactatttgctttggtgcaaattgatgtggaataacaatctcgtgtatctgcacattttttttaacttgtgggaaatttgctggtgatttgtggggggaagtggtggaggagggggaccattgaaaggagagaaaagaaggaaggaagcaattgaaaaaggactccctggaggcccgaatgtggtgcacttagcagttctgctgagggtctttgttcatcaattgtgggccttttgctatttattatgatgaacaataggaaatcctaataataactcctatgtgtgccatttgctttaactgagcagagttctctaaattgtttcttacctctgaatcgtatgtttgggtggaaaatccctctcccctttcttccacactttctttccttctaaactatgtctcataaagtcagaccacagaaccctttcaaatacagttagggcagacagagaccactacagagagccccagtgtttccttcctcgcttgaaaaggcaagaccttctcaaaaagtagaggtaggccttggtaagggcctcctttggaggaaagaaaaggcaaaagtaaggcatgagaaagtcctcaccatcttttctgcgttgggaacttttttgtagaaggttttttctgtgtcttcaatccacaccacggagggctggagctgtcgagccacctgcagaggaaaaggcagggccctggttgtaaatgcacttccctctcaggtgtgcagagccctggttgtaaatgcgcttccttctggggtgtgcagagccctggttgtaactgtgcttccctctggggtgtgcagagccctggctgtgaacgtgcttccctctggggtgtgcagagccctggttgtaaatgcgcttccctctcaggtgtgcagagccctggttataaacgtgcttccctctggggtgtgcagagccctggttgtaaacgtgcttctctctggggtgtgcagagccctggttgtaaatgtgcttccctctggggtgtgcagagccctggttgtaaatgcgcttccctctggggtgtgcagagccctggttgtaaatgtgcttccctctggggtgtgcagagccctggctgtgaacgtgcttccctctggggtgtgcagagccctggttgtaaacgtgcttccctctggggtgtgcagagccctggttgtaaatgcgcttccctctggggtgtgcagagccctggctgtaaacgcgcttccctctcaggtgtgcacctgctctccccgtgcggctcatcagctctgctgcacaggcacagaaatgtgttctgcagctacaacctgccccaccacgtcccttccttcacagcaggacaagtccccaccccccccaaccgctcctctgtcagtcctgttctgacaggcaggacaagcttgaggacaaacattctgctctaggacctcaacatcctctcagtttggcttgaaagaaacccacagttttctgctgaaaatgaatggagaactgggccacgagttttaattaccgcctctggccgttcccgggtttattcaagtttgcttaccatgagaaaaaccgtttcagcactcgggcccccacgaggctatttgttcatctctgtttggctgtgcctttgtggcctaggctccccctgaaaggtggctccgagcccctctggacaagcagggcctcgcgacagagctgggatgggacttaccctgggcccatgaataattgctgtacacctaacaatctcttcaaagcacccctgtgatagcgaagttcaggtatttttgcaacaatttgtgctttgtgcgaaattgtgacagataaaagccatggtgaatacagcgttatgtactcctatttttatatttcttaaaacatcattaaggcagcaggcatgattttaaaccaagacagtcattcagtgagtgatggaaaaatcgctagggacactctactgtgtctgcctccctgtcattatgtacgaagtggcaagtcagggctataaagcagattatgcgccttcaaaggcagaagtgggcactgattgaactggatccttgcgctggcccaacgcctgggccggctgcattcccaggccccaacacacacggacattcagagagaaaagagtgccagccaagcaccatttgataggtattttgcagacccagagtcacagaatttaggaactcagaatcccaaattttaatcgtgatccctgagccagtgtggtgtgataactgcagtgaatgagttggcagacatgtgccaggcatcagccacctatgttgtgcccagcatcacacatggtcagagccagcacacacctggcgctgcctcctcctggaggccttagcacatgtggaataaactgctcatctcatctgaaccctatgaagcagataacaatgaaccattgttatcatccctgtttgcagacaaggaaactgaggcttgcagacattaattgatggccctggtcatacaggtccagtgtggcagaagcaggactggaggccaggctgggggctacaatctgtgctggcagctgaggcagcctatgcgggttccctcatctactctcaccacgagcgtgaggggccagccctaggacctctgcttcggagctgagaactgagacgagtaggtggttatgttacagtggggagctagtcgggcatgagcagggcaggagaaggctccttccaatacatacacacaccaagaatgtcaggtgaccatcccatgatgggcaggtggttgttttctgtatttctataataatcattggtcacagccagcactagcgaaaggcagtctcccaataaacagaaacaccggaagtgggtgatcagcagcttcccaataagatctcaggggttgggcgagtgggttcaaccatgtgcattaagaggcaaaacggtggaatttaactggcctatgaccttctagggacattcgactggtaagggaggagcatctcaagtgagcatgcgcacaactccagtgaacacactgtgcatgcatgctccctcccaagtgctggcaggccactgtgcatgcggacagcccaccccaagggaagaatcaggagagaagggacgcaagaccccagaagcatgctaacatagaaaacccaggctggagtgcagtggcacgatcttggctgactgcaacctagagcacgagacctctcacccttcgttctgctgaatgtgggggtgatctgcatttgtgagcactttattttggccttgccactaggattttattttttggcatgatcagggaacatttttacactgctggtgggaatgtaaactcatagagctgctatggaaaacggtgtggagattccttaaagtactaaaagtagaactaccatttgatccagcaatcccactactgtacctacccagaggaaaagatacaaaaatgattcttgcacatgcatgtttatactttgcacatgcagcacaatgcacaattgcaaaattgtggcaccaacccaaatgcccatcaacgagtggataaaaaaactgtgctatatatatatatatatatgatggaatactactcagccataaaaagaaatgaattaacagcatttgcaatgacctggatgagattggagactattattctaagtgaggtaactcaggaatggaaaaccaaacatcgtacgttctcactaggacgcgaaggcataagaatgatacaatggactttgggaacctgtggggaagagtgggaggggggtgagggatgaaagactacaaaaagggtgcagtgtatactgttcaggtgatggatgcaccaaaatctcacaaatcaccactaaagaacttactcatgtaaccaaataccacctgtacccccaataacttacggcaaaaaaaaaaaaatcaaaatctcaaatctcaaatcaatgagtaggttattaactatagcacctgccagtggactcgaggagctagtctatttcaaagcctagccaagaagactagctgatgaggagaaacaccaagccgggcgctttgcccccgagctttcatcaatgaaacagacaaaatgctacaggataaaggaactctctcgtcttctctcttcatctttgatttttaaaagaacgtttaataaaatcagctctctagtagatcacagcaaagtattaagtgattctccagcttaaacattctgtgcttctacaaagaaagcttttgcataaaatgtagattcgaaggggtctctgagctggcaatccggagttctagtcagtgtgcaggagaaagttgccacaggagggaaatccaggagaaaatgtagggtgggctcaagggcctttggaaatggagctcgacgctgtacactgagctgatctatactgatcccggctgggcaccataccctctgctagagcagcaagggcaggaagaggaatgggatgggtccggtccgaacagggtcactccaaccgggaaatgcacccagtcaggggcgacagcaccacgtggtgttgacaaaaacacatgcttggaagttggagaaaagagacccctgtgtgcagagtctcacagtagcaggtaagtgaggagggggcggagcacaagccagagagggaagcctctttcttcccctgacaattcagtgcttctcactgggatcactaggggagctttggaaagtacgacctccgggtctcagccctggagattctggtgtgactggggtgttgtctggcgttagcagttttgaaagctccccagatgatgctgaagagcagacatggtcaggaagccccgctcggaagcacagatgtctactatgcactggcttatgcacaggttcccaaagaccctgccctggtttctctgcactctctcaataccaccttgagggctgatctcaaccactctggtagcttcagctggcctctacgtgctgaccacaaccaaatgcacatccagagctccaggccagagtttcccatccccacatggtgcctgcctactgaagcctcagaaggccaccttccctccctccatcctgcctcctgcccgttccctgcgtgactctgctcctacccaagccagaggcctgggtatccacccttgtctcattcccgacacctaacaaccccacagtctattcatggcacttcctaatccctttcaactccaagtcttccattctctcagctccttggtgcaagcccccgatttccttccaacatggcctgggcactgctgccaagggatggagctgaagagtgaggagggggcaagctccaaggggccattgttcccttacagctattttgagtttaagtcaaaagcttccctacttccagctccaaaagtaaataagaaaatgagacgttgtatgtaaaaggtttatacttcgtaaagataatttgtaataacaaaggcaagatcttattttttttcagtacctcttaagaatctcagttttagaactgaatccaatggagaaaccatcttcgcatcaacaactatctcttcagattggataaagaaaatgtggtacatatacaccatggaacactatgccgccataaaaaagaatgagactatgtctttagcaagaacatggatggagctggaggccattatcctttccttagcaagttaatgcaggaagagaaaatcaaataccacttattctcacttataagtggcagctaaacagtgagaatgcatggacacgaagaagggaacagcaggcactggggcctccttgagggtgaaggtttggaggaggaaaatgagtggaaaaaatcattactgggtaccgggcttaatgcctgggcgatgaaataatctatacaacaaacccctgtgacacgagtttacctatgtaacaaacctgcacacacacccctgaacctaaaataaaagttaaaaacaaaaacaaaagcaaccgtctcttgtcttagctgactgcactcgtggctgctgtggatcacttctcgcgatgtccacgtggcaagcaatgggttttccatagtgcctattggggcctctattttctcaacccagatgggaattgcagatgtgaataccaagtatttcagcgttaacttttctctttttgctcttaacaaactaagctgcgcagccttgaaacaggagtcgccctaacttggaatgattttgagacccacaatcttgtttccagcatcagattctaaatcagttgttttgaaaacggcggctccattctgttgactgtgaagttagcgattgttcctttaacgtgtagctccttcagaactaatgggggaattccatgcttcctgaatttttaacacacacctgtgaaggaattgctctccctagttcagcagctttgggggcacacagggttgtacagggcactctggagtgatgtggtttggaagggctcaattattaccaaacaagacagagaacgcttcccaagagtgttctcagatgaggataacgatacaactgacttcatttgcaaagtgctctggcgtccaggacaccatttgcatcctcaccggacacatgctccatgtgtgccaagcacagccagcggctctcccctttcacagatgaggctgctgaggcagagccaggtgagggatgagtcatgtgctggctcagcaactggtaagtgctggaggtgggagcgggacctgggtctgcccagcacccacaagcccttgcatggaccaggcggccgccacactgccaggggagatgggatgcctattccttgacctgtaccgctacctgatccgctaccatctttcatcccagcaggaagaatgctaaaaccatcactgtcttgccctccagagctcggatctctggctttcctgaccttcccctggggaagctgaggggcctgctggtcacaggacccctggtgaccatgttcaggtctggccagaaagaagatgggcatggaaactggggcagtgtcaagcggaagctacttcgtccaggagggatgaaagggacagaggctgcttctcttggagaaaagaagacttgaggctggtaagtttgctgttttcaaacgtgtgaaggactgccatggggaagaaaggcaggttttgctatgtttggccctgaacgtagaatgaaggctgttctttcatttcttcctttataagacatttacagaagagcttggtatgccaggcactgtgctaggtgccagggtcacaaagagtaataatgcagggtccctgacctccaggagcccacctgtggtaagggagagcagacctgaggttgagggtgctccaaggaaatcagggtgtcagtgaggggcaccaatgacagaaagtgggagaagtgggcgggtggggggaaccaggaacggagaccgcagacagtggttaaagcagacaggtcttccgagatctccagaagatcagatggtctggagagggggaagcacccttcctgggccaggagccagggcacagggtgaggtatcctcacctggggcacatggggagcacctggcacttctggaaggggtcagaaaagtgcacggccatgctacagaggttgcttgtatcctggaggctgtggaagtcctggaaaggactttaatcaagaattttgatcctttttatgttacagaaaaatccctcttgggagtgtgtagaggaggatgtggtgggagctgtgctggccttggggagcaggcaggtgtgggcggtgggcacagtgaggacaaggcccaggcagggaggtgctgcggggctgctgtggggagaagatgagagcccgcagcgggggataggcagggcaggatggggagggcaggactggccagcctcaatgacagtgggttgtgggttgcaggaggggtctcgatgctagatgcccagtggatggtaatgagggggtcagtgccagctgccatgagcccctgggcagcagggcaggcagggagggctgctggggccagagaagaggagagaggcaagggcagaaagggcctccgaggccacagcaatggcagtggacgcctcaagaatggatggaaggaattctcgagtaaagggggacagtagatgaggccgggagagggtgacagagagcccggggccacacagggaagacgatgatagaggaggaggtccgggctgccaaggggcagcagccgtggatagaagggatgggtctggagcgatagctagcctcgaagccagggggccaatgagcaggaggggggcggccagcggtggcctgtgctggccagagagtttggtaatgaggaggtcactggtggccttggcggggagtggagggaacagagccaggtgacagggagagctccttcacaaagacgggcagacagtaagcctggggaggacgtggcgcatggggtagtcagtgcccaggaaatgtctggggatagcgtgggctagggacagaaggcaggaggatgggctgggaggagaagggctcatcttccttgcaccacagacactgggggatagggtggctgctgctgcaggaagtgtgcaggccagacaagaaatgttggcaggcgcatctgctgggaataaaatctgcccttagagtttgtggaaaagcagtgttctttagtaaaaatctcagaatatactgaatggcataaacaacacctcttctccctccacctagaatcaaccgttgaacacttcctgtccttacagatcctttacgaaaatgggatcttgttcaacacatactgctttacgggctgccttgttcatgtcatatgaaagttatttctccgttatcattttaacaggaagcaccagcattacggttctaattaatcccctggttttgaatgtatagatggtttccatcttttactaccccaaatagtacttatttagggcacctggctgagaatttccttagaatgactgccaggagaggcttccaggtggaggggcctggacattctgtgcgtgtcgtttttatgcgtactgtcacactgcccccccaggggttccatctgtttacactctccccaggaataaatgagggctctggctctctacactcttctcctcgacaagtattaatagtaaaaaactctctgccaatttgctaatgaaaaatggtatcctttgcttttctaattttcatttagctatgaaaaggcttcatttaaattacccacagatagtttgaggtcacggacaattacattaattaattcgtaattgaactttccagagttctgtcgggtagttcacgtcacctgccagtagagggctcttcgctactatcaaatatcactagagggtttttgttgtgtgtcaattatgaaataaagacaaatttccaccgtgtgccttttcaaattctaggaagttctagcaaacaactaaagacgtctctatccacatgcattttatgggcttgatcttttgtattttccaaagaaacactgtcaaacattcaccatcagaattagattctcaggggataatggctcaattaaaacctgtttgtgtttcggcatgcatgggttatgaagatgctctgcccagatgacccctggacgttttggaggttctctctgaaaggatcctattttgcttgccaaggagaactgcaggaaaaaaaacagctactatttttttcagctgatgtgtctcggctgaaactcattcattcattcattcatcccacacatatttacggagcatctgagagctctgtggtgggaagcaggggtgtctgggagttgggagacacggtccctgcctgtggagggtgcagctgcctgtgtctgaatgggtgtcgctgagtgaggtgctgcggggttaggggttagggagggtgcaggggcgtaaggcttatttgcagggggagggggctcactttcccatactgtggtcacttggattctgtttaaatacttcatatgacattttggcctgcatttccactatttaaaaattacattttaagtttctatttccttgtaataccttttatgtacttgcggaggttacttcaagtcctcactgcaattagctggatataaaccatagatgatcatcaaaagaagggcagaggtatactagaatgagaagcctggctgggctggtaaactgaggcaaagcaaagaactagagaggagctgggatgcaggggctcacaggaaagactgggcacagtaactaggaggggacatgcgtgtatgtctgtggtcaatgtgtgtgtgtgtcaatgtatgtgtgtgcatgtgcgtatgttagtatgaggtatgttagtgtgcacatgtgtgcgtgtgtgtgtatgagtttatgttagtgtgtacatgtgtgcatgtgtgtgcatgtgtgtgagtgtattagtgtgcatgtgtgtgtgtggggggcaggttggtgctagtaacaggaacatgttgatgcaattagtgcttatccagactgtgttcaatgggaaggtgttggatggtggggggcgtcaggcttacaaaccacctgaacttaactcttgaagccccgtctcctccccagcccactgcccaccacactatggccaatgaattctcgccaggtggaatggactctagccagcttggagaagcctgtgtgcaaagccattctcaacttcccaaggtacctccatcgcccccaccccgagtgtttctgggttgcctaaacattttgaatgctcgtggcatcaaaccctggtcccgccttgtccccactgcctgatacacaacacctgcggatgccactctgtgtttttggtgattgacagcctgcagagtgtgtttccacacctgactgacacacagtgcccggggcctccacagcctgatgccctccctgtgtggggtgctccctgtcgtcactggacaggtggagtgggacatgtatcccgggtcctggagaagcctggctctcttgttgccttcctcctgggagtccccttcccacggcagcctctgacacagctggacccggctacatggcccaccctggtctaggggcctttcttttgtgttcttttttctccttctttctttgcaggtgcatgtgtctgaattccgagaagtttcctatgtgtcggggtctaggctccctccccaccctgggcccctcccgggtgtctggtttgacgtggcctcccaggactgacaccgatgttccaggcaggggaaacaatggcagaggcctcgttggccgtacagacgccggcatccccacccacagtgggttttgatggactctgggcgctagtgaggtgtctgtctgtgttcctcactgtagcacatggtcagtgtggcccactgtggggcggggagagtggggaggccctgcctatgtgggagcaggctatgtgggcgctctctgcactttctcctcccttttgccaggaaccgaaaactgctctgaaaaatagtctatgtaaaaaagaaaaggttctgcagcctatgtgcatgtcgctcctcagcctgcagctgcgtccgcacgcagtggaaggtgagcctggcctcttcatggacgacccactcaagactcagggcactggcctcccaccgtgtccatacccgaggctgcactggagccgctaaatcctgtgtccctctccccatgtccttactcctctctttcctctccccctcctttttgattagccctgttttaggggccagatgtaggccttgggttatccttactgatattcaccttgtaaaatgagactaacatatgtattacactaattgtacatctctctctctctctctctctctctctctgtgtgtgtgtgtgtgttttaaatcaaccacaaatagcagcaatgtctttgtctgggttattaatcaggaagagaagtcttcttctatgagctacagaaacataccttttatgaactacagaaattggccaggcacctctgctgacacctggactagctgtctacaccaccacacaccacatctgggcaagagcccttggtgtgctgccataaggctgctggctgtgagcccacagaggagccgggtggatggtactggggcacaagagcatcgagggtcccttttgtccagatgctgcagaccactgtgggccacgtgtcctacagctgacactgcctcggccccgttctcccaggtcctcactctaactcagccctcaggggccaggtcaccaagcagaggggaggaaagcagaacctaagaatgtccaggggcagagagggccctcgacccagatccagggggccgctgaaacattctctgctccagcctccttccctgcgccctgccctggccttcccttgcctgtctaatgagaggtctggagggcgggggccattctcactggcaaggcggatacaggaagaagcaggatggccttcagttgcttcatcttctcacactgggatattcccagcagacccgctggcccaggaatggccttgcccctgtgtcttgtggagggcacatcctcccacagggtggggcatgcggagccgatgcttccccagaggccagctggggggccacgcgacggtcttggggcctgacctagcgtgaaatccagaggtcagacctctggttctcttgcatttttgttgacattcagcactctgagtgtcacttttctcatctgtaaaatgggcacgttaattcctacctcatcagagctttcatgcaattaaaagagaaaatatgtgtaaaacgccttagcatgtgcctgactccagggcggaggtcagaaaaagcccttcccgctccgctgtcccctggtttactattatacagactcaaggagactggtacctggggggtggcgggggtggtaggcaacagccctgccttataacttctttcacctgtgaaatgtttattgcatgttcatcatttgtcaaatatttatcaaatatttatactttttataatatgtatatttatatattatatatattcatatatatttatatattatatattcatatatcataaatatatatattatatattcatatattatatatctatatatttatatattcatatattatatatctatatatttatatattcatatattatatatctatttatatattcatatattatatatctatatattttatatattcgtatattatatatctatatattatatattcgtatattatatatctatatattatgtattcatatatatctatatattatatatattcatatatattataaattatattcatatagtatatatctattataaatgtatattcatatagtatatatctatatattataaatatacatatattatatatttatatattatatattcatatagatctatatattatatatattcatatatgaatatatatattatatgtatatatattataaatatatttatatagtatagatattatatagtatatgcatatttatattataaataatttacatagtatatgtatatttataaattatatatatttacatattacatgtatatttatatattataaatacatatttacatattataaatatatttatatattatgaatataatttatatattattacatatttacatatatgcatagttatatattataaatatgcatttatgtaaatatatatttataaatatataaatatgcatataatatgtaaatatataaattatattcataatacataaatatatatttacaatatgtaaatatctgatatgtaaatatgtatttataatatataaatatacatataatatgtaaatatataaatatacatatactatgtaaatatatgttatatatacatatactatataaatatagaatatataaatatacatatactatataaatatgtaatatataaatatatactatataaatatacatatactatataaatgtatttataatatataaatatacatatactatataaattcatatatgaatatataatatataaatatatataatatatgaatatatactcatatataaatatatatgaatatatatttataatatatagatataatatgaatatatatttataatatatagatatatattatatgaatatatatttataatatatagatatataccatatgaatatatattatacactatatgaatatatatttataatatataaatagatatatactatatgaatatataatatatatactctatgaatatataatatatatactatatgaatatattatatactgtatgaatatataatatatagatgtatactatatgaatatataatatatagatatatatactatatgaatatatataatatatagatatatactatatgaatatatatgatatatagatatatactatatgaatatataatatatagatatatatttatgatatatgaatatcatatataaatatatatgatatatgaatatatatcatatataaatatacatataaaaagtataaatatttgataaatatttgacaaatgatgaacatgcaataaacatttcacaggtgaaagaagttataaggcagggctgttgcctaccacccccgccaccccccaggtaccagtctccttgagtctgtataatagtaaaccaggggacagcggagcgggaagggctttttctgatctctgccctggagtcaggcacatgctaaggcgttttacacatactttctcttttaactgcatcaaagctctgatgaggtaggaattaacgtgcccattttacagatgagaaaagtgacactcagagtgctgaatgtcaacaaaaatgcaagagaaccagaggtctgacctctggatttcacgctaggtcaggccccaagaccgtcacgtggccccccagctggcctctggggaagcatcggctccgcatgccccaccctgtgggaggatgtgccctccacaagacacaggggcaaggccattcctgggccagcgggtctgctgggaatatcccagtgtgagaagatgaagcaactgaaggccatcctgcttcttcctgtatccgccttgccagtgagaatggcccccgccctccagacctctcattagacaggcaagggaaggccagggcagggcgcagggaaggaggctggagcagaggacgcttcagcggccccctggatctgggtcgagggtcctctctgcccctggaggtttttaggttctgctttcctcccctagtagactatatatagtagactatatatactatatatatatagtctacaagtaaatagtcatttacttgtagatacatttcttaaaaaggaaacgcttcccctcacccctcactcattattctattagttactgtttgtaaaataaatcctccaaacacaatgatcacaaaatggatttgaatttacagttgtgaaacaaatcggagactcattttccctgcgtgcttccacggtgctgtgagtgaggcgaatgccacctgcctgaagtgagaaatgacaagcatttccctgtagttgcattgtttaccctcccgagattaacttggtaacaggacttctctctaggaagaatccatgaggaatcaggcccttctgttatttcaccttctcctgcaaatgccatgaaccatattttgctgctcttgagccacagcccgtgttctgcagctcacacggcacagtcaggccctccagcttcctgccgtcaacgtaccagcacaagcatcctgtcctgcttgcctttggttaattaaaagcaaatacctctttgcagtgcagatagctgctctgtcagtcacactgggacacggtggcctcaccgcacacaatttttaattgattgactcccactcctgagacctctgggtctttcattaatcagttatatacacaagaaaggtgaagtttaatgaggtgtgtgtcaggcactctgacatgaagtggcccaggtgggtgaatgtggtgctccacattttaataatttttgacacccagcattttgcagtccacacaatgccagtttgtgataattctaataaacgcaaagatcgcttatctggtatcaagacaaaatctctcagcagcaggaacaaagactttcctagagtgagaacagaaagatcacatccttgctctgtcctagattcacaccaggagctactaagctgtttggtgagtcagaaaatggatacttaattcagccattcagccctatttcagtgagcggccgtataatgcagttttgaaacttggaggctctggagccagactgtgtgagatcctatcattgcactgcaaccaggaaaattactaaaatgatttgtgcctcagttttcttaacagtaaaatgggtataatgaaagtgtctacctcatagagttgttgtaaggactgagtgagttaatacgtagtgatgtatgcaacagtctgggatatatagatgcttacgaaacactaatatttttatatttatgtgcttctgtctgttacttgacaaatgtcaacaaaatttgatgtttagaatgaacaaatgcaggtgttcttttgggcaagaggaagggttcattttacctttcctctgaagaacttagtgcttacaacttggtagttaagcacatggaggccacaagtcaggctgcctggcttcaaattccagctcaccttcaaatcattggctaactttagatgtgtgcttgcgtggggaaagattccaagctcagtgaaaagcaatagatgaaaaacagagaacgcagcacattcctcagctactgccaagtcagaggagcttggtaaacaggatttccattgaaactctggagtaaagaccatattccaggactaagagatttgctttggaccacagacgaagtcaaaatagacccatattaacaaaatggaaaacgaagtctctgcaagttcaagctgatcagccagtaatttaactgcctgctagaacaaagccccgcttgcttcagaggctccacaacgtaccatccacaatgtctaatatacaataagaattatcaatcagatgaaaaacagagaaatgtgacacatggtcaagggaaaagcagtcaaatagaaataggccccatgatgaccccgttttgaaatgagcacataaggactctaaggcaattaagttcaaagacttgaaggaaaaagatggtcatatgaaatgggcggatagagaactacagcagagaaatgaaaacgagtaataagcaaatgtaagtgctagaactgaaaagcaaaagataagaagatcagaaataaaaaataagaagatcagaaaaaagaaaatttgttgccagcagatcttcactaaaataaatgctaaaggaagttcttcagctgaaagggaaatgataccaggtgaaaacttaacttgacagagacaaagagagtactaaaaatggcaaatatatggagatgtataaaagagtatatttcttctctcaattttttaaaaagacaaatgaccatgaaatgcaaaaataacattctattgtggtatatataacatttatagatgtaaaatgtataataagaaaatgaaggacagagataataaatggattatgttgtcacaagattctcatattttatgtaaaataccatattaattctacatagactgtgataagaatgactacagtaatccgtaggccaccactaaaaaagaaaataaaaagagaccaaaaagaaggcaggaaaagagaagttgaatgaaagaggaatgaaacaaatggagaacaaatagcaaaatggtagactgaactcaatcatctaaataattgcatacaaaaataaacggagcaaatgctctagttaaatgacatatgttgtcagattgaagaagaaagcaaaacccaactatgtgctatccataagaaatgcactttaactataaagacatagacatattggaaataaaacagcataaaaatataccgtatacactcagcataagaaagctgatgtggctccattagtatcagaccaggtagatttcaagacatggagtatttccaggacaaaaagggtcatttcataatgataaaataatcaaccaggaaggaagacataacaatcctaaacgtggatgtatctcataacagtgcttcaacatatatgaagcaactgacagtactacagggagaaatacagaaatgcatatagttggagagctcctcaaaattctcagaaattttgaaatactaaaaaatatgaaattaacctaaacaatgaaatgaaccaatgaaaacaataacccaatgaaaggtacagttgacccttaaacaacactcatttgaactgtgtgggtgcatatatacacagattttcttccatctctgccacccttaagacagcaaggctaactcctcctcttcttcctccttctcctcagcctcctcaatgtgaagaagacaaagatgaagacctctatgatgatccacttccacttaatgaatagtaaatagatttttccttctttatggttttcttaataacattttctttgctccagctgattataagaatacagtgtataatacatacaccatacaaaatacgtgttattcaactgtttctgttatcaggaagacttccagtcaacagtaggctattggtaattagacttttagggagtcaaaagctatacgtggattttcaactgcacaggggattagcgccccaacccctgtgttgttcaagcatcaactgtaggtaaatgacttgaatataaatttcaaaaaaaagttgtacaatgaccataaagtgcatgaaaatggtggttacacattgtatactctacagtttcctctctgaacgccttccttacaagcatgagagaaaaggagagtgggatgtcctgagtcgctgcagtgggagggaccacgtggctaagggaagaaatcctactgctgtcgctccctagttttttggtgtattagcgtgacactaaggagacattcctgtccgtttatcattcctgtaaactgcctcgttgatgagcatctctcatgctttacagccccttagaaagcagatacagagccaacacctagcctccaatatgggacagtgtttgccaccatgtaggctttgatacagtaaaagctggcatggcagcaactgaaatgaatagcataaggctaacctggaggttctcaaccaagtagaaattaaattttgtaaagccttgatactaaatataaaatatctgtatcaaagttctttcaaacgcattcattttgtgatgataaaatggagacccagggaagctaggagcttagctaagatcacagagctgctcggatcctgtgatatcagcacgtctttacattactctggtcggcttaggtgcctgcaggcttttccatcacacctgtgtgaggagtgcacagaagcacagaaggtgccataccttggcaacccatgtcatgtgaggaagaatccaaataatgcaaatatctctacctgatgccaattattacagtgaggtgggccgagcaaagaaattgtgggtttaattttcaatgagacatgaaagcatttccagaagggttcctgtggcagagggagggtgattgggatggcacagtagggtgcttacggaaagaaaaaagttgtttctaattgtgtgtgtttggccatacgcaataatgaagtaatttgcaggagtagacaatgaggaaatttaagacagtcatgcttgtctgccaatggaaattatctgcagggtttgaaaatgtaatttgaaagagggaggagagttggaaaccaagaaatgtaatccataccttgaagactgcatgcagcatcatttggaggccatttttgccagggtatttcccagcaatgttagaggaggacaagttgaagaggttggctcccgtttcggtgcagatggcatggaccagcattttcttccctaccccagacggcccggctaacagtagcgatttcaccaaaggagctttctcatgcactgctgcagaacctaaaaaaggcagaggcaaaggtgctaatgttctgccaagaaaatcagtggttcttcaactaggataactcaaggtcaaaactgcatcgtgtgactccactttctgcaacagtgataaaggcgtccaaagcatttcaaaccagagacacgcctccatcccagctggctctgtgacacctttaatttgtaggtcagggctcgtggtagagccatagggtctctgcgggtccttaatacccttctccccctctccacatcagtatttcccctgaaatcataattttaaagagcattcctgcaatagcttacctctggctttttttttttttttttgagtgctttctctgcttgtcggcagcagcattaaattctttgaaagcttgggaagaggaatgtggagacatagacgataaggttgactaagtgtttatttccttgcacccctcttgcctaccatttagtgattcttgtgagatcaagggaggatggagatgcaggcagcagcagcctgaacttctttctcctgccctggtttctagctgtcagtagcggcagagttaacctgacgcttgataatgaagtgacttgaattactggagtcattcagaggttcatgccgtgttctccaccacactgtcaatttccttagtgcccagaaggggcctcaggtgtgggtattctccattgcagagaacacaagcagagcagatattgggcacaaagcaactaaaaagtgaacgggattaaattctggaaagtgctgtgatcaaatcatttactatcatgttagtttgcgttctgtcacttaatgggctctttttgatactctgtaaatgtcagtatgatgattatgcttttcttttttcttgtataattgaaaagatacagaaaatttaagtgatgattagacacctaatttttatggttacctaccattctccacataaacttggaaaatagttttgagcaaattctctttaccacgtaactcaatgagcatgccttttttgtggttagtaggggctgcggcaatctaatgggataaaggagagactctttttccacaacaggagagagatgccattcatttgccctgcgttggacacctgggtatggaaggctgctctgtggtagccctggctgggagctagtgtgggggtccgtgggagtggggactgtggcggggagtgacacaaatgtggaaaagactcaggatttgctgtggagagttcaggccaggggaggagctgaacctgagttgccataatgagaacgggaggcaagcagtgagaaggtccaggagagccacagggagttcagagaagaaactgctccccgcggaggactcaggctggacttccaggaggaggtggcatctgggccagcctctgaggaatgggcagaatggtagcatgcggtgaggggggtgtgtgggcaggcttcatgtggggccgggaagccaggctggcacagggaggggtgaggagccagcggtcaggggccctgaaaggtggtcggggactgcaggtgccaggcgggtgctggctgaagccagggggccgggagaggtttctgggagtggtagaggaaggagagaacagtgctgaggacagagccttgggttgggagggggcagcaggaggcagaggagcaagggcaggtgagtggacccgggagagtgtgtggcagtgacacaggcagtggccttccagagaaagggggtggtcaccaaggtcacccagagaggtgaaaaggttggtccagggaggcctcttcaacgggggcctggctgacctcagggaggacaaaggtggacagagggcccaggagctgacaggacacacatgtgccagtgtccacagctcttcctgcccctctcgtagagttaccaagagacacagtatggttccagttttcgcacctgagccctgttcaactttccgagaattaagagataacaaggaggccagtgttctctgtcctcaacccagtttagccccttcctagccctgtgactccaaggaagtgcccctgcatcttggaacagcttacgaatcactaaaagctggaccacgtccacctggaggggtctggcaggagatgaaacagtggacacggtttctgctctgtgagcatgcccccacccttcacttctccctgatctctacgtggcagtaatacctccaggagggtgggtggatgctgaccagatacttcctgggcttcctcttctctaacaaggtggtttcggagtctaagccctagccccaggctgcagccggtgtctcctggccaagtatgtaagcggccaggagatgttctcaaggtcctctgctgagtggccaggtttttagtctgggcagccgccaccatcaaggtgatctaaacaactggagcccccagacattcctttttatgacaggatgttattttaatgtatgaaatgtaaatcagcctcccaaaagcttaactgtgcacacaattcatctgcctaacgtttctatgcattccaaacacttggcacacatgccctgtcatgagaacaaatgccccagccagctctgctctccggaggacctcatagcccttttggacagtaggttcctcagtgagaaagggagggtgtgggtggggtgcttcctgagggcccttctgtggtgtgttcaaagccagcttggaaaccacagataccaccttgtatcctttgcagctgtgaaatacaccaacctcattagggaggcgttcccttccaaacttgttggctcttggttctttctttctcttttattccctccctccctccctctccctctccctccctccttcctcctcctctctctctttctctctctctctctttctctctttctttcgatggagtttcactcttgtcgcccaggctggagtgcaatggcgtgatcccgggttccagcaattttccagcctcagcctcctgagtagctgggattacaggcacctgccaccacacccggctattttttttttttttttttgtatttttagcagagatggggtttcaccatgttggccaggctgctctcgaactcgacctcaggtgatctgcccacactggcttcccaaagtgctgggattacatgcgtgagccactatgcctggctcactggtgctttctgtcttactgccttccatgatgcttcatggaagtgtgaggtctcctctattttatttccattgacacttatacatttattctgttgaccacaaattatgttgcccctcaaatatgatatatttgttatatataatataaattatgtgctattatatattatataaaacatatatattatatatatataaatgtatattaaccccaaattccatttactacttctgacatcaatttagaagaggaattaactatttcttgccaataggcaagttctgaagtcttaagttctgaagtcaaagtggaacaataagggtttgaactactcccatctcattttaaagcaaattaaaaacccagaaggtgatttctatttgagagttgttgtcagaactgaaactcctggctggagttgccatccctgcccctggtgattcaggtcatacacatatcaaagccataaagaaaaaaaaaaagaaaaaagcgaacgtgagccgcagatatctgtgctgtggagagcccatctttcctgcatcgcctgcacaccacagagctctagtgtgtctgtctgaaaaaagtcacaattgaacctcatttagcagtgagagtagacgtcggtgaaaactggcagggccttaaaggtgatcctttagatccatgaaacacacttgcactgactcctgaaaggctgcctctgtttaggacctagtaataggagcctgtgggtaaaaggcaagtggtagccctagcccgttctctaatttgattaatcgtaattgcaggtacttgctttgcctattatctccccagctcattgcctgtatgtccttcagcccagcactgctaagcaggcacgcagagagggtgcagaagtgctctccctggtagtactttgtgtgctggtgggtgcactatcaaaatgaaactgtgcccactcagaattctcagtaggaaaagttaaggagcactgtacttttgatgacaaacaggaacacactgtccaaaccagcaagcggtgcaagctgctttggaaaaggcacatccgcgcacgccgagtctttacctaatggccagattccgtacaatgtgatgagctgtctgacatccaggagggagggcatgggttctatggacacctggcgaagagtagtccccaggtagctgtactcacctggagagaaaagaaacagaggaacaataaatggaaaacagcgctggtctgagctgcataattttggcatctgcaaaacgatcggagaatacaaattgaacatttcagagcaaagagaatcctattaggagagtcattatgaagaacacatcttttctcagataaaggtttgaagaaaagctatccaggcaagaaagccctgctctactagctagagtaaactgggaatgatgttgactattatattagcctcctaatactttctaaaacaacatttgaatatagagttatgtgaaatgggacaaagtgctaaaaagaaggacacacaaaaaaggctgaaatatagggggctctgctttatttatattccaatagattatgtataacatttgtgcaaactttataaataagttatttaagatcgatgtagaatttgtattggagcagtgtaaatctgagtgtaaaatgcagtcatttgaaaggaagggtatgagtctaatttaggataaatagaaacatctccttttgagggtaatattcatttacatttttatcatttttaagagagtaccaaaggaataatgcagaaataaatctttacaggtttaattagaagatatcaaagggcttaattgtaactagtcataaatctgaagtgttattttctaactaatttagataaggtcaccaagaaaattagtttggctgtctccatttgtcatgaggacggacctttataggttcatatgattctctcttgatctgtatctgaatctggagtaaaaatattcaatgaacgaatcaccatgtctggatttttttccctgatgctttcttcctatagcgagtcctggtcctgcagagcttcggatgctacatgtgtacagcaagtacaatatgcacatttatgtgtgtaggaaacactgaaagtatcccaagcttttaagtattttcaaatgctaagaaaatcagagttaaaattcagacagtgaccgctgttttgttgtggggcagggggcagcctttcagagcctccacatgaacaaaacgtccttggcaaggacaatgggtattggttgggagaatgagtgataatgaaagcatctattatggcttcagataccacactttttaatgagcaggtaataaatagaagagtggttaatttagcctccactagaatagaaagagatcctgtaacaaccgttaaatccagcgctcattgccagtaaacatgacattcaaggtgacaggaaagtgaccccaattttcctgcttatctaaacccatattaatctccagatgcaccatattttctagaacataacagatcttgtttaaacaaattatattcagttgaattagtgggtgttggttctaacagaggcaaggacacaagtagccccggctgcctgccaaggtctgagactcgcactgaaagcacattcctgtgtttgcagtggccccacacagaagccatgccccttcccatccgtgcattcggagctcggaaagtccagcattcccggcacagacatcagatcttccacaggggagggaagaagaaagtggcagacgaaaaggcatttaggatagagggcgtgaaaatgccaggaaacccagatcaagagggcagaaaaccaaacagcggctgcacgacaggtggaatcgaatccccttgcaattctaagtggaagtcctaatccccagcatctcagaacgcgaccttatttggaaatagggttgtcgcagatagatttcattaagatgaggtcattagagtggaccctaaatccaacaggactggtgtccttataaaaaaggagaaatttggacacagagacagacatgcacagaggcagaacaccacgtgaagataaaagcagagagggaggtgatggttttacaccaagcatcaccgaagatcgccagccacacgccaggggcagctgaatgccgtgcaggtgcagcctggggtgctccatccagccacttgcttaatgtttacagcgatttagtgaggcatttgctgtaattacctcatcccatagtagtggaaactgaggcacagaaagagtaagtaaaggcctggcatcttggagggaggcagcctcagaaagacgagaggaaggagagattccttgagcctgggaggagagaccggtcagtggtccctgagcagcgggcatccagccccaggccctggaggtctggggggccttcatgggcaccggcccccagaatttctctgcagcaccctggtgcttcctgggaactgggggccttgaggatacctagggcaggggtggggactggcaagaaggactgagtttaaatcaccttggtagtataggggttgtgaagccaaattaaagtgatataaagaaaataaggaacttgctatttcttgcacacctgagattgtggcaggtgcttgctgctgggcacagggccagttctggagcagggtggccatgcaggggtgcagcaagcagtggggtgggtggtgggggtgggctggtgggagccgagggctgggcctggaggaaggtgttgtccccagctctgcagtgcaggctttgcatcctctggctctgttcctccccttgtctcctgtagctcttatctgctgtgattctaatgactgttgagattctaatgactgttgggagttcaatggtgttgaggacagagtgggattacaaatctcaagactaaaaaaagcaacttcgtgtccagcggctgagcacgctggatctgtgcagagcattcctggcctggtggagacatccatccgggcaaccacattctgcgtccggggatccctgctcctgccctgcctggatgaagggctggggaggaacagcccacatccaccctctctcatcttctagaagcaggagaaataaacggctctgggcactcaggctttgcagtgctggcctctggagcaacggaataggcaacagaggaaccctctgggccatgcctctgttgtcaaggtgttaaaaaggaaccaagataataaattcaaaaccagggaacccaagggtgagtgagggtgcctgggtcctcatctcgttaatgctcttcttagacaagatgacgaggcatgacttatctgggtgctgagagcagtgtgctttccagaggcaggggggcattcccaagccccctgagtttatgtgatcaggaagaagctcccagctgtgcaagagcccagtacccctaaggtaggaagtctgcaatgccgtgttgtcagcgcacaccgctcttatgcattgcactctctctcctgaagccctcaccttgtcctggttttatgggtatatagagaatgctcactaccaatcctcgtgccaaggtgtctcacgtcatttttgattgtcagtaggtcattcttagcagattcttcaggaagggctcagggggaaaactgctgagttctttcatgtttatcagtttgtgtcccatgtacttgaaaataaacttggctgggtacaaaatcctaggatcctgcttcctttccctgagcatcttatgtatgtcactccatttacttctggtgtaaagcattgctgtggaaaagtctgagggtaatctaattttctttcctttccaagtcatatgatctcttttacacagatacccaaaggcacttttattagaatgtcttcttgatcaatctgagtcaatattctcagatagacagtgtggtctttcgttatgtggttttaatgttttttaaacgtctaaacccttttcccgtttgccctgagaatacttgccagaggtgctttcgaccgcagcatttaccccaagataactttgccacgaaatatctcgtttttattattatttttgcagagctctagtatactgacttcagaaacaaaagacatcattctatctatagcattctgttttcactagtggtatttccatttaggaaatatagtaattcttgattgccgaaaaatatcaaatcctaggaaacgtagcattcctatgcatgatcttgacatcgttttccagtggttgttggctgaagattcatttgatgaatctgattttttctgaaatagacaattctgatgattcagaagattctgatattagttctgtttagaaataactccaagaacagtttttgtattttattttcacattgaaaatcagtcagatttgcttcagcctcaaagaacacgtttacttaaagttaaatgatcattagcagcgagctgcactttttttttcctaaacaggaaaaggcctaaaagaaatgttcatgaattaaaattatatatatttataaaattaaaatttgagacaaggtcctgctctttcacccaggctggaatgcagtggtgtgatcttgactcactgcaaccttgaattcctaggctcaagcgctcctcctgcctcagcctgctaagtagctgggactacaggtgtgtgtcaccatgcctagctactttttattttttattttgtagaaaaagggtcttgctatgttgctaggctgatctcaaatacttggtctcaagagatcctcctgcctccgcctcccagagtgctgagattacacgtgtgagccactgtggccggccaaaattctttgcattttttctgttcctttgctttgattttcttctttagggactcgtattatctgtatgttggattttctttgtctgtcgtcaatatttgatatgctctttgaattcttttaatatccttaatttctaattttactttaaaaatttgcctttttgccttttatttctaaagcattactatttttatttgctcttgtattcattataatttatttttttctaaaacattttcccctttatttatatttattgagatttgtcacctcatttctgggttttactctttctattttatgctgttctcacacgtcttctataattctttaatgtatattaacttttttttttttttttgcgacggagtcccgctctgacccccaggctgcagtgcattggcacaatcttggctcacgcaacctccctggcttcaagcgattctcctgcctcaacctcctgagtagctgggattacaggtgtgtgccatcacacctggctaacttttgtaatttttgcagagatggtgttcctccatgttggccaggctggtctggaactcctgacctccaatgatccgcccacctcagtctcccaaagtgctggaactacaggcatgaaccaccgcgcttgacctcttactgtatattaacctgttttgaaataggtttcagtatagacctgctttgtggagatgtctttttgggaagttaatgttttcttattctttttttcttatgataattttgcatgggcattgaccttgaacttttccattgctcaaatttatatgagtgaatagtccaatacttttagaaggaagtgtggcgcaggatagcttttccagtttcacagagctccctcctctgtcgtctttatagatgttaaaaatgcggtggtttgctttctgagatgttctggctctggtcccctcccctaatttcttctgggccttctctatgcttcatctttacttttcccatcctgttcaattttgatttaattcccaagagtttctttgtagtatgggccctgtggaggaaggcactggggtgggtcaccgccccagctccttcacactttcttattccggtcctttacactcatctgctattgaggtgggccaaacccctcctagtttcagctttgattcttacctggcccactgcacattacctggcccattgctctctggttattttggggtctcctgttctcaggtcctttggtgtccctaaagcttgtactttggggctcaatggggaaaatttgtcatttagttttggtgcaagtgttgcctggggggttttggtcttgttttctagttgctctattttactatgtggggatttgggaagatacactgccatctttcaagctaaggaccttaactgggaaaaaatgaaaatatggacaggggaaaaaatgaaaatatggacaaggtcaaagtgtgccagattttggtggatatttgactactttggttagattgagtcattttcacttagagtctgtatgaatttgttcttgaattgctataaagaaatacccaagactgggtaatttataaataaaagaggtttaattggctcacggttccgcaggttatacaggaagcatgatgctggcatctgctcagcttctggggaggcctcaggaaacttacaatcatgacacaaggcaaaggcggagcaagatgtctcacattgtgagaacgaaagcaagagagaggaaagggggagatgctacacacttttatttttatgtttttatttgtattattattattttttgagatggtgtttcgctcttgttgcccaggctggagtgcaatggcgtgaccttggctcactgcaacctccacctcccgggttcaagcgattctcctgcctcagcctcctgagtaactgggattacaggcgcgtgccaccatgcctggctaatttttttttttttttttttttttagtagagatggggtttctccatgttggccaggctggtctcaaactcttgacctcaggtgatccgtccaccttggcctcccaaagtgctgggattacaggtgtgagccaccgtgtccagcctgctacacactttaaaatgaccagatctcgtgagaactcactaccatgaggaaagtcccaaggaggatggtactaaaccgttcatgagaaactgcccccatgatccgctcacctcccacaaggccccgtctccagtactggggattataattctacatgaggtttggtgggcgcacagatctaaaccacatcaaagtcactcttaaacggctgactccacccactttgatcttaggcatcttaaagatgcttcctggaaattgacagatcattgaaaaagttcagaagggatgagaaattaataattagttgagaagtcagtccgcacataggtaatgagaatctaccacgtgccaggcactgtactcggcactaggatcttttgttcagaaatccaaaccataaataagagacagttctgttaaaaacagccattttaaaatattaacagaattaacaaaacagaatcaaggtacaggagaaaattctccagcacttgaagaagaaacacagaaagtaaaataaatagaaacccaaaacatatcttaataaatattccagcaaaattcttatgctattaggaaatgtgagggctcctttaagccctcaagaagaaaacaaggctgtcttgcaaagggattaaaataaccaccctttgatcaaaggagaatgccagccttcttgccctcacagaccaaaattgggtcaatgtaaataccaggatggataatgatagggacagacgataatacattgaataaaaaaagaatccatgtgtctacactgataacgcaattttaaaagattccacacttcctcacagaagaatgatatctattcaatgtagaaggaatgatagaaaaatctccacttttacaactgctacagcaataactgatgcagatacaaaatcatcagtgggtgctaaaacgctgcctgagaggctgctgggaacagaatctccacagcctcaaaatatcaccccttggattgattgttcattaattataaagggaaagatgatgctttacagtggagaaatcccgggaacagcacctaagccacaggattaaacttaacctcaccactgatgggacaaagtggcattaagtgcccccagtgggaaacactgacagggagacaccatcattttcctgtcaaaatgtttaacctgaatcgaataatgagaaaaccatgacacacattcaattgagagacagtctgtgcacagctcagactcttcaaaaatgtcagtgttgtgaaagatggcggaaggctgggaaactgttcctgacggaaggaattacgggagacagaagagacacaacaatcacttgcaccatccttggctggattttggatggagaaagacaagtatttatacaggacattatcaggacaattgggaaagctgaaggttcactgtatattaggtaacagtattgcatttgattttctgagtgattttccttctgtggttatgtaggagaatgttgtcattcattgggggtaatttcttcataaaagtaaaactaataactgcattacggtagtacagttatgaggaattttaagctttaagtgtgttttcaggtcatcatggtgttttttaaaaatttagagaaaaccattaggtgaggctgtgataacaaatgtccccacctcattcctccccaatatttgtgtctctattggaaggtatcttttggaaagaattcctccagtaaggattctgttgtggaggccttaggtgctgccccaggtgcattttttacaagtgaaatcattaacaattccccatttccttaaatcagattatgccagaaagaatgcaccaaggaaccttgctagtaggttaaaaacctgcttctattacgttaggggagagagctgcaaccattttattaagagaatctgttagtccacagcatcctcttaggttatttgaatcaattcaatccaacaaacatttaccaggagccaccatcggccaggttttggcttgaacaaaaatgtaaataaaacatatttccggctgctgggatttcaaaacacaagaggtgacacgtgacacatacatgtattattctctgtgtactcaccaatgtaatcagagaggttgactttcagagcctggatcagtaatccttcttccaccagttccttatacagagactcgatggtcctggggagaaagcagagtgtctgttccagaggcacacacacagaaatcggcggtatttctgttaatgatcacatacgcggagaacttaaaccagatctatttcaaagtacatttgttcatatgcaaataaaaggatttttgaagtgtttctacaatttggggataaattaggctttttaaaaacaatactttcactcatccatgtgtgtatctgatgtttcccattaataagaacgatatctttgggcgtctgggaccagctctaactcctgcagtctgcccttccatcagtcttcatgatggcacaaatatgaattagaaattacccaataatagtaatgcaatggacctataattatatattcggctagcatcttcaagctgtagtacatcattaatcctttgtgaaatttatgtttccttttaacccaattgcacaattgtttgaaagaaacatctacaaagaacaaagacttatactgaagataattcttatatggaagataaaacgtctaaagcaatgagggtgatgattttttaggagggtgttatactttacagagtgtttacagatgtcaaaaccacttctctaaaaggaccttgagcatatagccagcacattggtaatttatactaattgagaaaaaaatggacatagtatcccacataacggatgaaactcccaatgatacttgctggggtttggcttgcagaaattagataggttaaactcaaatattattcagtataatccttcgagatgttttgtcttttcctcttctttattctcccatcctactctggtctttctctaagttgagaattgtaaatacaactttatttagacagttcttctgactgtcctgtgatccaagttagtgtgattaaaagatacccaagaatatcagttagacccaagccaaatactattcggggaaatgttaatccaatgaccctagtctttggatgactggagttgtattgcatcaaacatttaaagtagtatgccctctgctgaaagttaagaaatatttaatttagtggaatttaggatagcaatatttgacccatatatatcaaggaagtatcaactgtagtgttttaacttgaatacttatttaatataaacaatatacgcataaaatattaacataaatttgaagaagattctctaacaatcgaacaaatgatattaagaaggtctgaggctaggtgtgatggctcacacctgtaatcctagcactttgggaggctagggtgggcggatcatttgaagtcaggagttcaagccaggctggccaacatggtgaaaccccatctctactaaaaatacaaaaaaattagctgggcctggtggtgggcaactgtaatcccagctactcaggaggctgaggcaggagaatcgcttgaacaccagaggcacaggttgcagtgagctgagatggcgcaagttctctccagcctgggcgaaacagcgagactccgtctcaaaaaaaaaaaaaaaaaagctagaagacaccgtggcacagtgtgtgagcatgggctgcaccctcctcaagggatgggactccgaggcccctctgccccccaaatctgccccaggaggtgccggtgtttacgcatggacagatgtgtgcctccccaggaactggggcacctgagactcaaaacgctgaccagctgcttcttcggcagcagtcagccacagcatctcgacctggaactgcttctcaaacaatgcagccttgagtggagaaacctgcagcccctccccctatggatgtcccgtgacagccatttctctagagagcagaaacccacactcccccgactgtgtttccaggggctgcttgccagggccgcggcagtgttctggcctccctggaggccacagatgcccagtgcccctctgggtgctctgccctcctcttccccccgcagagagctctaggcagggctttctccctcactgagcttccctccaacagagtttggggagagtaatgctgggacacagggagaagcaggaacccccaaacagggtagcgacaggactaagggaagcggagggaacccccaaacagaagagtgacaggaccaaggggagggaacccccaaacaggggagcgacaggaccaaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacccccaaacaggggagcgacaggaccaagggagaggggagggaacctccaaacaggggagcgacaggaccaagggagaggggagggaacccccaaacaggggagcgacaggaccaagggagaggggagggaacccccaacagtggagcgacaggtgttgatccattaataagacctatgggaagaaaaatatacattcaaaattacttcccacattattagggattttaattaaattccttgataatatttgaaaacctacgtactatttattttcagtgttaaagtactttcaggccacttcaagttaaaaatgaacacttgaattcattcgtcctgcactgaagctgggcccatgaagctctgagaaaggacaccgcccttcctgagactgggcctcactgctctcattccttccgcggcaggagcaacggcctcagcagaggcgctcgggcagattcctgtcctgtgagaactcagagtctccgtatttcctcaaatgcttcaccagggtgttatttcttaaacaaaaaacttaaacaaaaaattccatgaattttaaaacttaaaaaaatgttatgacgtcagaagccatgggggtccaggtttgccttctgggccacccaggcatctttccagtctgggatttgtagggacttagaggtggctcccaccactccgggactgtggaggatgaagagggcgtggcatcacagagggggcgtactcggggttccctgtgctgttctctggggctgctcacgcgcatcacaacacaacgagtccattcctcacctgtcagctgtcagatctttatccttctttgccttcttctctttctttttgcctttctttcctttcttctttggaaaaaaaggaaataaccaacaatttagtcaaaacaagcaagcaaataagtcctagaaattagctaagcacgttgttttctgggggtggtgggaggtggaaagttaattgtggtggcgtgaacacagagctgccgtgttttcatgaacgtagggactggcctggaaaatcccaagttgcttatgtggtgtgtccttgtgtggacagacgtgaggtccccactgtggaacttgcacagggccaaattccaaacagggaagagcattctgactttctgggctctggcttggtgtcccacaaaggatgagagtgccgtgtgcacatacaggagtcaagctgtgctcacctttggtgcctgatataagctgaatgcttgtgttcccccaaaactcatgagttgaagcctacccccaaggtgctggtattaagagatggggcctttgggaggcaattaggtcacaagggttccactctcatggagaggtctgagggagcttgttcacccgttccaccatatgaagacacagctaggaggaaccatctttgaagtggataatgaggcctcaccagacacaaaatcaccagacttcgagtccgctggtgtcttgatcttggacttcacagctcccagaactatgagctattaatttctgttgtttataaattactcagcctaagaacgttgttatagcagtccaaacagactaaggcagtcccaatcgcctttcacagctcccagaactatgagctattaatttctgttgtttataaattactcagcctaagaacgttgttatagcagtccaaacagactaaggcagtacccaatcgcctttcgcagctcccagaactatgagctattaatttctgttgtttataaattactcagcctaagaacgttgttatagcagtccaaacagactaaggcagtcccaatcacctttctctgttggcatctagccccacatctggagccctcagggcctggcaacagtctacctctagttcccaaggggctttgcactcaggtacttgtgacagcctagagagacatgcttcaaatgtgcttatttcatgtgcttatttgccatctgtacatcctcttcagtgtgatgtctctttatgtctttcacttgttttctaattgggttgcttgtttcttaacttctgagttttgagagttctttatatgtttattgtttcagagttctatatatgtctagtatatgaatactagatctttgtcagatatgtggtttgcaaatatttcctcccagtctgtagcttgtctttttatcctcttaacagggtctttcacagagcaatcatctttagttttgatgaagtccaatatttccttttaaaaattgtgttttggatgctaattctaagaactctttatctagcctagcccccaaagtcttctctttttgtttttctaaaagttaagtctgtgacccattttgaattaatttttatataatgtgtgagacttaggttgaggtccatttctttttgcttatggatctccagttactctggcactacttattcaaaagtgtctctttcctcctttgaattgcttttgcaccttcatcaaaagtcaggtaggcatgtttgtgtgggcctatttctaggatctctgtcctgttccactgatctatgtgtttagctctttaccaatagcatacagtcttgattactgtagcaatatgataagccttaaaattgagtaaattggtccttctcactttattcttctttttcaaaattgctttagttattctagttccattacctttccataaaaattttagaataaatttgtctatgtctacaaattatatttctgggattttgatagaattgcattaatcctatcctataaaaatatcctaatggacatttttactatgttgagtcttccaattcatgaatatggtatgtctgtctattcagatctgctttgatttctttactggcattgtgcagttttaacatacaagtcctatacctgttttgttagatttacacatatgtatttcattttttgagtgatttaaaaatcacattccattttaactttggtgtctatgtattcattgatgatatgtagaaatataattgatttttgcatgtttatcttatatcctgcacccttgctgatgtaagctgatttggagtttgtagattccttgggattttccacaagaaaataatgtcatctgtaaacaaaaccttttaaccttataatagttttagatttacagaaaaattacaaaaacagtacagaaatacctctcacataattttccatattaacatcttacatcaagtatgggacatttgtcacaactaagaaaccaacattggtataatattatcaataaaaacccgaagtttattaggtttccactaatttttccctaatatccttttgttttccaggatcccaggaaggttttggagtactgatctaacgtctttatttgttattggtgtgttgaagctttctatttcttctagatttggtcttggtaggttgtatatttctaagaatgtatccatttcttctaggttgtccaacttattagcatataattgttcataacagtctcttatgatctttttcgtttctttgacattggttgtaatttcctctgttctatttctgaaggtatttaaatctcatctttttcttagtctagcacagagtttgtcaatttttaaaatcctttcagaaaaccagctcttagttttatcattttttcctattgtctatctattctctatttcatggatttctgctctaatctttgttatttcctgtcttgtgctagctttgggtttaatattctcctcttgatctagttccttgaggtatgttggttatttgagattgttcttttttaatgtaggcatttattgtgaaaaacttccctcttagtattgcctttgctacatcctataattcttggtatgttgtgtggtcattttttttttttttgttttgtttttaaaacaacttttttttttattatactttaagttttagggtacatgtgcacattgtgcaggttagttacatatgtatacatgtgccatgctggtgcgctgcacccactaacgcatcatctagcattaggtatatctcccgatgctatccctccccactccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggttgcatagtattccatggtgtatatgtgccacattttcttaatccaatctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttccagttctagatccctgaggcatcgccacactgacttccacaatggttgaactagtttacagtcccaccaacagtgtaaaagtgttcctatttctccacatcctctccagcacctgttgttgcctgactttttaatgattgccattctaactggtgtgagatggtatctcattgtggttttgatttgcatttctctgatggccagtgatgctgagcattttttcatgtgttttttggctgcataaatgtcttcttttgagaagtgtctgttcatgtccttcacccactttttgatggggtctttttttcttgtaaatttgtttgagttcattgtagattctggatattagccctttgtcagatgagtaggttgcgaaaattttctcccatttcgtaggttgcctgttcactctgatggtagtgtcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgcataaggtgtaaggaagggatccagtttcagctttctacatatggctagccagttttcccagcaccatttattaaatagggaatcctttccccattgcttgtttttctcaggtttgtcaaagatcagatagttgtagatatttggcgttatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgacgcgggctcttttttggttccatatgaactttaaagtagttttttccaattctgtgaagaaagtcattggtagctttatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaactgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcgttttgccagtattttattgagaatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagctcctccttgtacctctggtagaattcggctgtgaatccatctggtcctggactctttttggttggtaagctattgattattgccacaatttcagctcctgttattggtctattcagagattcaacttcttcctggtttagtcttgggagaatgtatgtgtccaggaatttatccatttcttctagattttctagtttatttgcgtagaggtgtttgtagtattctctgatggtagtttgtatttctgtgggatcggtggtgatatcccctttatcattttttattacatctatttgattcttctctctttttttctttattagtcttgctagcggtctatcaattttgttgatcctttcaaaaaaccagctcctggattcgttaattttttgaagtgttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcacttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagattcttaatcctgagttctagtttgattgcactgtggtctgagagatagtttgttataatttctgttcttttatgttcgctgaggagagctttacttcccagtatgtggtcaattttggaataggtgtggtgtggtgatgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttcagcctgtgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgacgttagctggttattttgctcgttagttgatgcagtttcttcctagtctcgatggtctttacattttggcatgattttgcagtggctggtaccggttgttcctttccatgtttagtgcttccttcaggagctcttgtaaggcaggcctggtggtgacaaaatctgcagcatttgcttgtctgtaaagtattttatttctccttcacttatgaagcttagtttggctggatatgaaattctgggttgaaaattcttttctttaagaatgttgaatattggcccccactctcttctcgcttgtagggtttctgccgagagatcagctgttagtctgatgggcttccctttgagggtaacccgacctttctctctggctgcccttaacattttttccttcatttcaactttggtgaatctcacgattatgtgtcttggagttgctcttctcgaggagtatctttgtggcgttctctgtatttcctgaatctgaacgttgacctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcactcttcacgtagttctcgagccttggttttcagctccatcagctcctttaagcacttctctggattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccattgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctatttgagtacccagctgtgtgaggtgtcagtatgcccctgctggggggtgcctcccagttaggctgctcgggggtcaggggtcagggacccacttgaggaggcagtctgcccgttctcagatctccagctgcctgctgggagaaccactgctctcttcaaagctgtcagacagggacatttaagtctgcagaggttactgctgtctttttgtttgtctgtgccccgcccccagaggtggagcctacagaggcaggcacgcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaaccagcgagactccatgggcgtaggaccctcggagccaggtgccggatataatctcgtggtgcaccgttttttaagcccgtcggaaaagcgcagtattcgggtgggagtgacccaattttccaggtgccgtccgtcacccctttctttgactcagaaagggaactccctgaccccttgcgcttcccgagtgaggcaatgcctcgccctgcttcggctcgcgaccggtgcgcgcacccactgacctgtgcccactgtctggcactccctagtgagatgaacccggtacctcagatggaaatgcagaaatcacccgtcttctgcgtcgctcacactgggagctgtaggccggagctgttcctattcggccatcttggctcctctgcctgtcatttttgtcttgagatattttctaatttccctgcgaatttttttctttgactcaatggttattcaagagtgtgttgtttaatttccgcatatttgtgaatttttctgtattctttttgttattgatttctagtttcatttcattgcagctggaagttacttggaatgttttcaatattcttatatttattaagacttgttttgtgacttagcatgtgatatatcctggagaatgttccatgcatactcgagaagaatgtgtattctggtgctgttgggtacaataactgttaggactatctggtccctagtattattcaagtctgctgtttccttattgattttctgtctggatgatacattcattactgagagtgggatagtgagttctcctactattattgtattgctgtctatttctcccttcagatatgttaatatttacttcatatatttaggtgctttgattaaaggtgtatatataattgttatatcttcctattgaattgacccttttatcattagttaatgatctttttggtttcttgtgatagtttttgatttgacgtctattttgtctaagtatagccatttcttctctcttttgcttattatttgcatgagatatcttttttccatcccttcactttcagcctatgtgtccctaaatctgaaatgaatcacatgtatatagcatatagttggatttttaaaatccattcagtgactctgtatcttttgattggtgagtttaatccatatacatctgaagtattttttgaaaggtaaggacttacttttgccattttgttaggttatttctattttgaggttcttttgttcttctctgaagttacaagttgctgtgtaacttaacgatgttttgtagtgatatactttgattcttttctggttctgggatccaaagacaggcccaacgctgatttttgtgggtgggcccacaaaaataaagcagcacaatggttgcagtaaatgacttgctattactacaccacaaaagtggagaaagctgccatagaagcaaggtgcacccagggtttgtgggaggcccatggttctggggtccaaagacaggcccagtgctgatttttgtgggtgggcctggtgtcagggtttgtgggaggcccatggtactgggtttcactggcctggtgctgagctccatggtgaagtcagatgttcacttctctgtccctttcttccaagataaaactcatgggtctaggagatctctcttggcactaggctgtgtgggctttggggtgacatgggtaaagtgaaactttcattcttactctcttcagtgcatctttttttttatgattctgtgctccacccaggtgctgcagcctctcacctgaatcccagagctcttgtgaagttactttcatctatggatggttattaaattggtgttttcagcttacagtgaaagatcttcagaacaccaattcagttgccttcagggttaaaccataatatcaacacaaaatggatcaagagccagtcatcctaaaaagaccacatgcatggcccctgatctagcaaaagtagtcacaaatgcagctgaatgtgtggaaacctctaagagaaaatgtgtgaatcacagaaagagtggctccagtcatggaacgtggagaaagctgccacagaagcaaaggctgcctatgctcatgccagcactgacagggagaactctccgccctctaccttgggtattctggctccaatgacagggctgtctctggaatgaaggtagaagcaggggccaaactaaatgaacttcaaataccctgatctaactagctactctaaaccactgtgagatggattggtggcaacttacacttccaattcatccaattcctttccctatgattccctcactcacaaaaacctgctcattaccattggcctcccttatagatctatgtacaggaacagttgggggctgtttggggaatgtgctttggctcttttgatagttcccattctatcagtggggcttgggtaatatgaatctgcaactgaccggggctggggagatgttactctcagatggttgggtttatcctatttatgaatccacaggcccaaaggttaaatggtggaccaattaaatttaccaaaggcaggcatgtttccccgtgaggtgtcctggcaacaggcggccctcctggacatgccacagcatgtcaggggctgcttttcatgactgaatccgctccaccgcacccctctgcaggctccttccccactcaccttgtcctttttctttcctgctttcactgggcgctccctttctctgtccacagctagctttaagtttttaagttcctgtctcatcaactcatcaacctaggagaatacaaaacatactacttttaagtcactttgcatgtcttgtgttttgtttgtgaagtttaaaaatcccttaaattatggggtaggtcattagtaggaaattgtaaagaagcacaatggttgaagtaaatgatttgctgttactacaccataaacgtagctgtacctgtatcctgatctctgactgtaattcttttcgtttctcctctttgatcagttctggatcatagtcctgagagaaattccaagactcatcttttttcatccagatttctacactccagaagggtaaagaaaaagaaaaagaaaaaattttaaaaagatataggttaatgaaattttaaaaagacgtaggttaattgtaagttattgcaatataaacataagcctaactttatatgttattgcataggataaaagtttgaataaaataagctggacagatgagattcatatatgtgcttgtaaatgcactaaaaaaagaaaaaaaactgctgatgtaaaaatattgagttttagtttactcaatattttttaagtgtgatacaatagtattctactgtattattataatcatgtaaaaacaatatgttaatgctgggattatacaatcacagatgaccttttttgtaatgttttatcttactttttttcttcaaatgattcactaaaatacgaaagattttgttgcctgttgaactctccaggaattatcccttgcctcctattacaaaacagacaacactaaacacacaagtacccagtatttctccctaattcaacagctaaatttctgaattactttttggatgtttttgaaatcacacatatttaaaatttcccttttgcctcttcctggtggttaggagggtggacctggagaaacatgaccctagacaaagtaagaataatttcccatcactaaaataaatggaaatagagctcctttctcagaagggaggttccaaatgtatgctgaggtgtggaatagctggatcctcgacgtgggacttggaagaggtctcccatgggaagccaagacttgtcatttggggaaggagacatctttctggaatctatgtcgagaatgtaaaggaaatttgctggaatttgtgaagctgacaaccgccacccagtctggccacttcactgggagctgcctttagggttctgatgaccttcaacctaggaaggcagctgaggacccagggcacagacagaggctcccaacctctaagggacaagggctgccccttgtgaagacagcagaggctgcaggcctccaaggcagggggtggtgaatgaatgagggaggcttctcagcatggcttccctgacaagcatggcatgacccactgaccgagaagggagagggtggtgctctaactctacattgggaggaaagtcatagtcacagacagaagcacaaatctggctgctggagacccagagccatcaaacgtgaagacctagcatagagacgtttccccagagaattacatgggcaaactaatgggaaggaggggttgagtctctgaacaaaccacagaggaccaggaactggcaaaagggatggacaaggaaaggggcagggataaggtgctgtgagacccgggaaaagctagactctcaggagaggtggggaaagcctggggagactctgaggcaaactcagaactggtgaataggcaggacaattgtcccgagggttttggccacctgccacctgcctggggcagcacagcttggtgcaagagccactgtttgtggccaggtggaacccctgccctaccacctaccagctggtgaccttagcaggggatagcctttgcagagaccattcccctttctgagaaatgaaaataaccccttcctcacgctgatatggtgatggtaaatggaataaaatatataaagttgtatgaataaattaatttttaataaatatttatatataaataaatatatacagttccagtttagccccaaatagttgctgccatcccccaggaagcagagcatctcacagggtcttagcctacctcattgacactctgtacccctcgaggggagaggataatgcaggacagcagctacaccagaaacagctatgccccaaagccccaaagcaggtgcatgccagcaaagaggaataagggccctggggccagtgcctgcgtctttagtggtcagagtcaggaccctcaggacaggacacctgcaggaagacaggacatggaaatgcagctccagttttcaaaaagagtgggttgggccaggcgcagtggctcatgcctgtaatcccagcactctgggaggccgaggtgggcagatcccgagatcaggagtttgagaccagcctgacgaacatgatgaaaccctgtctctattaaaagtacaaaaattagccaggtgtggtggcgtgcacctgaaatcccagctactcaggaggctgaggcaggagaattgcttgaatccaggaggtggaggttgcagtgagctgagactccagcctaggcgacagagcgagactgtctcaaaaagaaaaaaaaaaaaagtgggttgggttcacaagctgcagctgctgataccagaggtgagcacagaaggggcagaaggggttgtctgccacacacggcagaggcaggtccacctgccttcctggacagactacggcacggatggctcagcaggtgtctgagcggggtgggtggtgggggttccagcaggacccagcaagagctcttggctggcctacctcctaccagcaaaccgaagggcagggctgtgtgtgtattgctggctgagcaccatctctgccacagagatatggaggaccagcccgtggtggcgcaagggcagttgggcaggtttttgaaaatgatgcagaaaatgatgcaaatttctttcagaatggctaatgtgggcttacaaacagacagaaaataaatcacaaaggtggtaaatttttcataggaccaatgcacttaggcgtccttccccagacagggcagtctcataagaggtggcccagggattgggggcacagcgctgggggtgggaagggggctcagatgggactctgaaggtgactgcagaggtgaggccaaagttcaaggggtgtcttcattcacacggggcaggtggccagcccaaaacaggtgtgacgacaagaggggagaagaggcgaaaaaggctgatgggctggagtgggcctacaggaggcagctgggaagcctgggctgaacaactctctttacacataatcctttccagtgagagccagcccgagagccaaggtatagaaaacaagcattgcatacattgtctaaagcatcccattggtggaagagatacttcatgtcactaatatgtggaagttcgttctttgctctgcactcccttagattttgtggttagcttgtaggaggtatgtactccaaaggcccggagagtttacgactcctgcatttgaagtgaattgctcttttctagtaaattttctgaaatgtacataagcttaaactgtgaaaaacttcaaaatgtaggaataacacgtagtgataaaacataggaaaaggaatcaatgcttccttttatgtgtttaaaattgtaagcattctccttcgaaaattctagaaaaggtttaaatgtgtcataatgtgctgtttactaataataatcccccttgtaggatttctaaatcttctgcaatagcagcacctacctgttacatcagggcattttaaacaaaacagctttgttagtaacgggaagctacttttctttttcactagattcactaaaatcaggaaataatgtatttaataataaaaggaaggcagaatctttaacagaagggaaaccatgacacgattacttatgtagaaacagttgtacggtagaacacattctcattctggagttgcaattatatttaaaataaaacactgcagagccgttttgcccatttcccctctagatcgtttaaatggattgagttttccactgaaactttgcttttctcatgacacttttgcgcagggcacttttcaatcccttcaagaatttcatggacatttataaatgcaggaagctattcatggccctcaaagggcaacaactgccccactctctcctagagcggagaaagagcttttatcctaagaatgtgaaaagcgaggccaaggcagtttcacacgtgggggggcaatgaaagaggggcgggggggggttaatcttagtgattaaaatgctaatgttttatttgaagaggaaaacctttgatttttaagaaaagaattctaagaggaagacatttaattccttgaagttaccaaagacctggcagataacaagtccaatgccacaacatccaaccaggaaaatgacactacaggcttgcttctaggagggacgctgcttgctttttcagtcttaatggaaacagatattacacaaaaggcgtggacagttttcagagcttttgggccggtcagcaggttgcaagagttggcttcccatgggagcattagatttctctaatgcttaacgtttgcttgtatagaaataatacacattgttttaaacaaagtcagagtattaaacagattataataaaaaacctgtcccactctatctacctgctaattacattatccaatggcattctttcctatattcatttattcattaaaaatacataggtcaaattcagttattacattttgactttattgagccgattataggccaggcactgctctcagagcaggtggataatggaaggccctgccctcaaggacttggcattgcactgtgagaagcatccgtgaacacacactcacacccaagtggtaagtacagcgagcaaagggtgggcgcgggcagagggggactgtcactccacaagggccctcaaggaaggggcctcactggcactgaggcccaaagggacaagcattctgagccagaggaacagaaagcatgagtgccggaggtggagcgtgcccagcctgctggaggaagcgcagtggccacaggggcgtgtgtagcgatctggtttcgtggaagctctttcgggtggtttctgtgttcttttcctagtgtctatataacatgctcatatgctacttcttgatttatccatgtcagacatgagcccctgacttcctgccatgggacagcaggcttctgctctctggctcctttcttcctgtgccctcattgtctttacatagtcgtatcagaagagaagggagccctgctttccacatcctggggcacctactgtctgagtgtaagtgaaggacagctttcagatgcccagggcagccacaactcccctctgtgagtcccttcttgggacatcctagagaatgagctctaccaaaatgagggagaggcaagaagtcagcaaaggccaaggaaggctcaaggatcgcagctgagacggagggctccacaaaggtgctcttcggaagaaaacaaattagtaagttacctggcatgtttgaaggtgtgggagttatcttataggtacatgcagtaccaaaccagtgagggtggctgtaaaggccaaatgatgatatgcaaagcagagtcttagatgggatgttgttgcagacacatacctgatgccagtggaccctagccaggcccacggccccactgtgtggatgacagtaactcccagcaggacccactggatgttgttactgtcatccgaacttacagaaactactcagtttatgccactatctccaccccatcccaccactgtaatccccaacatataagctcattgttggcaggtgttacctttatatctctgggctagcactgcacctgacaccctggaaatgctgaatgtttgttgaaggaatatgcaagtgaaaaggtgtttttgatagtgactgctctgcaccattaaggagttgatggattcttaagcttggatgacagcggggcttctaccagtacctgcccatacgaggagagcaacatttacctcccccagttgttgtgaatattaaatgagatgggcatggaaaaactccaagccttgcacgtcttaggtacttaataaatgttagtttccccttttgacctcctttcttcccagtgaaaatggattgagttgccaaatcctgccagtgtcatcgtgtcccccagggttcccctttagttcagcatctcatgcagtggggtgcccttgccactagtggtatgtaagagaattttcagtggcacacagacatttttatcttatatcactagcatatcaaacctatgaccacattcatattgttgcttaggataaggtgcaattattaaggtgaaagccctgagtcaatttaaaaatacatctattaagttaataatatccagagaagaccaaggttgggaaggaggccacgaatgactgccatttggaaagattccacttcacatccggattgcaactttcagaaacttccacactagcactaatgactgaggtcaccttggcaggtcactgtgtttggatttatcttgagggcacagtagaaccacaggagttcggtaatagttctaggaaattaaaatgcaaatatctgaaagaccagttcctacacttgcggatccagccagatgacagctatgctcatcaggctgaacaactgacagaaaaatcgtgtgtcagaattgaggcacacatcttagtttaataggaataagacatttgactacacatacagtatcaattttcttaatttaagcaatctaaaaatatgtttcttccctgccactagcatgaaaacattcagctgaagtcttaggggttcaaaaacaggatggaggtcttgactatcttctcatcctatatgcatcttgccttttaaccaattgtatgcttaaggccaccaaaaggaatttttttttttttttgaggcagagtctcgctctgtcatccaggctggagtgcaatggcgtgatatcggctcactgcaagctccgcctcctgggttcaagtgattctcctgcttcagcctcccgagtagctgggattacaggctcccgctgttacgcccagctaattttttttatttttgaagagatggggtttcaccatgttggccaggctggtcttgaactcctgacctcatgtgatctgcccacctcggcctcccaaagtgctgggattacaggcgcaagccacctcgcctggccaggaaatttaaaatagagacaggcagaatgtctcggttgtgagtggcatacagcagcctcccgtgatggggttcccagcacgtgctgctgtcttggtgaccatgcacgttctcctaaactgacctttgtatgcgttacatccttccttcattgcaggaagaaaaagacttggtgacattttccatttttcgtcttcttcctgttcaaagcagaatattttcgttaatctcaggcaagaccgggcagcaaaagacgcagacgctgtgataaccgtgacgagggtccatgccgcgcaggcccagtcctggtccccctgggcagtgcccctctggcccgtctaagtatggagtgctgtgtccactgaccaggcatgggtggtccaggctcaccgaagcatcccctgctgataccggctttctcttctcagtggcctcccctggggtaccccatgccccgagtttgatcctgtcttcttttttgattaaaaaactttctttctttctttctttttttgagacggggcttaaacaatcctcctgcctcagcctccccagtagctgggactgcaggtgtgcaccaccacacctggctaatttttaaatttttctgtagaggtggggttttgccatgttgcccaggctggtcttgaactcctaagctcaggcaatctgtccccctcagcctcccacagtgttgggattataggcctgagccaccacacccggcctggtcctgtcttctcatgctctcactccttccttgctctaaaggctgagttcctagcctgagtccatctgcctccctcctccacgttgctgtaaccagcccttggagctactccgagtcctttgctgagctgtgctgcttgccagttctagcaccagggctgttccttcctctcgctacctgccccatccttgagcctggagctgcagcctgactctggggccctgcttccttcccggagccagagtctagctagcctccctaccctgggccccccacagcagagagagcctggccaccatccttggctcctgctgctgactctgtgcaccaagatgggagattgcggtgctacccgccgccagcccaggccatagctctgctctgagccccagcacaacaccccctctgcccctctgccgccagggttcacctgcgcctaatagtgagagctaggccctgcaaaccctcatgtgatgtttctctgcaataatgttgacactgcctcaatagtctggtttccgatgaccactatcatggctattgctacccttagagagggcgaaaggaacaacgctggcctccatttggtcctcgggttcccgaagcaggctcagtactctctatgcagtgacaggaggggcagcagttgggtggcgcgggcgtgcctcccctgggctgcttccagagcacgccctgactctggcacctgatgggctcttccgtttctgggctccagggttgggctccgggatgcggtggcctgaacacggtgcccccacagtccctcgtggttgtgtagtatccatgcatcagatccagaggtatttctcctctctctccccatggccaagcaatcaccaaaccccactgttctgccgtggaggctttcctggggtctccctgcttctgcctccagtcccactgccctggccccttgctccaaggttggctaacgcagggtcactctcttctctcctgctggaaggggtctgcagcagacctggccttacgacttccttccttggaagccccacagaggcatttgtcttggagctcctgggaggcaccgttccccacaggacacagtccaagcccctcagcagaccacacacaacccccacaggtgtggtccctcaggagtgcccccgcccacctctggggcctttgcccttgccgcctcctgcctctgccgtcactgcagagatgctgacaaggccaccctccctgcacctgccatgctctttgccctgctgtcctgtccgcttggaaggccacccttgtcctacactttctgatgaattcagagtctgaacagacctcccgtcctcctgaaatcctctctgatggccttcctgcccttttgacaggattgtcacttcctaagaacagcccgcttttcccaccagacacagcaggcaggaaggaccccgccagccctggggcctggccacttggcctgtgtgcgacatttgctggatgaaacaagaagagggaaagtataggctcaatccatggataaatgtgtaaatacaatgtggtatttccatacaatgaaatgttgaactcacccacagaaaggagcgaacacagacacgggctacggagcggaggaagcgtgaagacctaggctgagagcgtgaagtcagaaccaaaaggcctcacagtgtatgatcccgtttatatgaaaacagataaactcagggacagaaagcagatcagtggtgccagggggttggtgcggggaagagaggggggaaggggagggactgtttaatgggtacggggtctccttggggttgatgaaaatgtctccactgtcacgctacttcactgcatccctcgtgatttttgccagatctgagaatccctgaccagcagaaccatcatttctttaaagactcacttaaacttatgttctttaaagaggcactctctattgctgaggtgaaaccatagtggatacactggtttcccgatacacatgagaatacaacacaaccatcggaataaaagaggctgggtgtggagccattggactctccccagtgcgtgccccaggtggctgggaaagccagggcttcctggaatcctccccagctcagggctggcagcggctcttgctcccaagacagtgctgggttacaccctgagcaaaggcacacttggttgcctcagttactttctgaggcaactgtagctctgatcaagtcacctcctggctcaagtgtccccaggggcttcccacagccccctgagaccacgggttaccagctcactcagaggacacacctcctgcccctgctgactctcatctgtggtctattcccctgtgaatccaccacgtcttttttcagctttgcatttcagctttgcatttttcagctttgcattttgctttgagtccactgtgtctttcagctttgcatttgctcaggtcaccaggaagcaaggaagacgcaggaaatgggatcacaagagcttcaggggaggcccggggtgctcgggagaggactctcacttcatggggtgggggggcatggcaggcttgcctggaaccgcagcccataaaccatgcagggggagctgcagccagcggggaaccagggagagaacctggacccagaaacaccagggggcccaaagcctatgacacagctcacccaccttccagagcgcacactaaatcaaagctctctggtaagaaagtcccacctacgacacaaggcttgggttagctacgccccattcctggctcccaagagacccaggcattagagaaaagcctgcaagagcagcaagaaaaagactagtagtggataaagcaaggcctgggaggaaagagggagaattcatgaacgaaagagaaatttaaaatcactttaattagtatatttatcctcagatatattatttatcatctgtctgtctgtctgtctctctctttccaggtatcactaaggagtcatacatctttattactttttcgtcaatgttattgtctattattgccatttttgttttggatactcagattgttctatgtttggtctctgggagcccctacactggtgaggctgtgctcttagggatggatgaaggcaaggaagaggaggagggggagggggagggctccagggaaggagactgaggtgtgacaaagggtttccagcagaaggaacagcatgtgtgaagtccagatggggaggctgtgtctcacagggatggctgaaggaggttcggcagccgtgaggactgcgtggggctgggcagacagacatgaggctggagtggcgggagagagagagaggcagagagaagagggaggaaaagagagacagggggacagagatggagacacagagaaagaggatggctcttgaaaggaccaagagctgcagggagcttggagttggcttatgagcagggcagctacccaggagcctggtgtgaagggaatggccccttgggacatcactctggctggaactgggggttgaggggtggggaggaggctagtttgcatgcatatgtgatatccatctgttatagcagaatcatagtttatggcttaaaagttttgctggatgaataggtgtaacatggtatttaaaaaaaattatatttctttagttggtgtggctgaacttcattttatttgcttttcatttcctaactttgtggccttatcttgatttttacaaatgaaagtgcatgagcctacctatttacctgtgaacctttcctgagcagctactaagggtgggactcactagatactagaactgcacagggcctgcctctgagatccttgagtcctcctgcctccccgatcctcgctcgctgtgcctcggggccccgactgcaacacaccacagcccctcttcccccgatgccttttactaggtggttcccaggtccagggcttccctgtaactgtcacacacacgtttccccgaatagaaaccaggggtcgccttcccagatcccatcccaccactgtggctggccttgcacactctggcccacttcctgaggtgaggaaggctagccatgacccgagttctgatgctctcttcctctacacagggtgggtggcccactccactgtcagacaacttttttgacttaacccaatggagagttaaaaaaaaaaaaaaaaaagaaaaagaaaaagaaaagaaaagaaagaaaaaagaaaaaaaatccaatgccccagctctgccctagaccaattatgctcaattaagtgagaatttcttccaaggtgtgtggatattgggagtcgttttttcctaaaaccaccccaggcagctagactgaaggccatagattcattgaagttgtccttccatcagctgaggcccagttcctggagcctcagggagtctgcaccctcttcatgccctaagtctgctccagatgaagccttcctgactcctatccccatcgctcaaaagagatttccagattattcgccctcctggccatcttctgtggactgttctagctacccaggctcccagtcaagcaacggtgctggtttaatggtcatggtggagccacggccggtaacctccttggcctttgcggcatgtgaaggtggcctgcagttatgccactgtctggacattcccagcacaccatgggcctggagttaacaaagtcctcctatctttttaatgcatataccatgtagacagatatctcctgctttgaaattatatgaatggtttttaggtgtttattcgtaatgacttgaccggctcaggctgctataagaaaatagtatacactaagtgccttataaacaaaagaaatgcatttttcacagttccggaaactggcaagtcctagatcaaggtgcagattctgtgtctggtgggggctgctctctgcttcagagactgcaccttctagccatgtcttcactccgcggaaggggcaaagcagctctctggggtctctttcacaaaggcactaatctcaatcacaggggctctgccctcaggacctaatcaccctcagaggccccacctcctaacaccaccacattggtgattagctttcaatgtatgaattttttgtaggtgggtgaacacaaaaattcagaccatggcacccaacaaatgtaaatttcttacatttggcccacctaagtgacttcatgcttctggaggggagtgtttattcatgcctccgccattttccatctccattgctttccacacttgctggctgaacaaataatgaacaggtgggaggagaagtgcgttctcacctgcagaccgacctcagagttgagtcactgtagtatctgccttctctgcttggccacaccagcatgccatgatctgtggtttgttgcatccaactttcttgcctttttttgcaaactgagccatttccatggctccagttttctgggccttgctttctctggggctcctcaaatatcacagttagtagtactgagacttgacctgcccggtctctgggtaccgctaagatgctcaaccgcacagaaagcttcctttagagcagacagttgctttctcatcggcctctcactttctcttcatggcccaatcagttataaatcactcaggacaaagcagttgttaagtgaaaataaacttatggaggcctctcgatttgatttagacgatagtagtcctcctttctccaaggaggatacattccaagaccccagtgcacacctgaagcctcggatcgtaccaaccactacatacactatactttttcctatacagaaacaggcaggtagtgtatacagcatgaacatgctggacaaagggatgattcacgtccatggtgggatgggacaggatggtgtaagacttcattcacactgcgaagaatggtgcacaattcaaaactcaggaattttccatttaatacttatgggtcacacttgaccgtgggtaactggaactgcgaaaagtgaaactgagaataaggggggactagtgcatatttaaaaagctggtttatggaaactgaccatttttcgtaagtttccggctactgtgtgaactttgtcccttacacaacacagataaatgctacatggagaacgtttctaaagtttcttactgagagtcaatgggacatactgagagatgcagagatgcaaatgcaaatgtttccagaagaggctttgttatcaaaatatctttgtgaaattaggagggcagtcagagataaaccgtgcgccttcttcttgccctccccaaatgttaactactgctattatttcctgcctggcttaaagagcgattcaaatgcatggaggttttgttgaaaattttctattggtaaatatgtgcatctgaagtaggctgttgagggatggctaacatctcacactggtagggctgtggaaaaattcaaatagggctgcaactgttagattttttgaaatgaggttatatattttgaaatacatctgttctcagcggctttcagattacctgctcctcccctctgggtccgtatcctggggtgggggagaggtcgaccagcgattttgaagaggctgacgatttcccactgatctgagagtgaaataataatccccttctctagattcagaagtgaaaaccaacccagaaactataatggctgaacactatatttaaaaattaatatgcaccaaacaacgtgatagcttatgcaactaaacttgaaaaacagatcaaggatctccactattttttttttttttgagatggagtttcactctgttgcccaggctggagtgcagtagcacaatctcggctcactgcaagctctgcctcccgggttcatgccattctcctgcctcagcctcccaagtagctgggactacaggcgcccaccaccacgcctggctaattttttgtatatttagtagagatggggtttcaccatgttggccaggatggtctcaatctcttgacctcgtgatccgcctgcctcggcctcccaaagtgctgggattacaggcatgagccaccgcgcccagccacatctccactatttttgagcttgcatttagctcgtcattttactttctgctcatgcatttgcgacagcactagggaatcaacattcctcatggctttgagggctgcagagtgctactctttcccccacaaaagaaatacaagagataggagagaatctacagtgggaagtctaaaaatgtacagctgtgtcctaaatacatttgtcacaagtttctttgatggtatctgggttaatttttgtcggaaagagcttcttggttatgagtacggtagtaagaaataaaccacatttctcacatgggccatgcaagctgccagctggttactggctctccagtcctcagacttgggctggagtctacaccatgggccctcagctctctggcttttgaactctaccaccagctctcctggggccccctcttgtagacggcagatggtgggacttctcaggctccataaccaaaggaaccaataccttataatgaatgaatctttctctatataaatataaaagggcacagaagatatctatatatacacacacacacgggccacatgtactttttatatatcgctctcctattgattttgtttctctggagtgccctgactacactttcttctcaagccttctcctcacctctgctgcatcatttcccccctgtgatcctctctctctttaaagaacctcctcactgcctccatcatagccttagttttcactcctcattttttttttttcagtggaaaataacttttagtgagacctcagcagctgcaaaatctattcctggcattaagctccgtcttctactgcaatttggtctttcttgagtggtttcatgaatattttccatgaatactttcttctcttccatggtctgggagcagccatggccaaacttggcagtggtgtcaatgaacttaaggtcagtcttctccagagcccgctgtttggtctcagccagcaaagacttgtggagggtgagcactcacttcttggttcccaccacacattccttcagcatgacaaagccactggtcacttcaccatatgggacaaagccacccagagagttgatattcttgtcaggaaggtcatggtcagtggaggcattgttcttgatcagtttgtcgtccttgataaggtagccctggccgatcttagagatcaatcttcttgtgatctcagtgcggtgatggtagcctttctgcccagcacgtgccacagagaaggccacacaggcaggatgccatgccccaatccaggccaccttgcgcaagcctcagtgggtcttgcagggtagcttcttggtgtgtcaatgacttgtgacccctttgtagtctttgcccttggtcaccttgaagacgtcaatcatctcatcctgcccaaacacttggttcacaggtatgggctgctctagcctctcccggccccagtccagcttcttggccacggtgcctctgttcacctggatctccatcagcggggccttcttctggcgtggaggaagcaggtatatgtgggtgtggcagtgacatggatgacttggcagtgcttcttcatgctgctgaagtcctgctccagctgcttcttgccatccatattctgccatttcttgcagtaattggtaaaggcctccttcttagatttatgccagttgttagagaagtgctttttgcactcatcgctgatgtactgagcgaagatggtcttgaaggtctggaggccttgaggtttgaggggtttccacatagcccacaatgcccatagccaccatggcagtgtctccacaatagtcacagcctctaccacctccttcttgttcacgttggatcctagcctgttgacttcttgcacgatgtgggtcatgccaaccttgtatcccaggaaggctgcgaagtggaccggcttggaagggtcatccttagggcagctcttcaccttcccacgatgcgtgctgtgcacttccgaggcaggaagccgagggacccatgtctgggagtggaggacttcttgtgagacatcacgccatcacatcttgctggtagagcctaattttttttctttttttgagacagagtctccctctgttgcccaggctagagtgcagtggtgcaatactagctcactgcagccttcctcccaggctcaggagatcctcctgcttcagctgcctgagtagctgggaccacaggcacacaccatcatgcctggctaattttataaaaattgtttgtaggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcctatcagcttaaagagattttgggctgagacaatggggttttctagatatacaatcatgtcgtctgcaaacagggacaatttgacttcctcttttcctaattgaataccctttatttccttctcctgcctgattgccctggccagaacttccaatactatgttgaataggagtggtgagagagggcatccctgtcttgtgcccgttttcaaagggaatgcttccagtttttgcccattcagtatgatattggctgtgggtttgtcatagatagcccttattattttgaaatacgtcccatcaatacctaatttattgagagtttttagcatgaagggttgctgaattttgtcaaaggccttttctgcatctattgagataatcatgtggtttttgtctttggttctgtttatatgatggattacatttattgatttgtgtatattgaaccagccttgcattccagggatgaaacccacttgatcatgctggataagctttttgatgtgctgctggattcggtttgccagcattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcaaccactgctcaaggaaataaaagaggatgcaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactacactacaaggctacagtaaccaaaacagcatggtactggtaccaaaacagagacatagatcaatggaacagaacagagccctcagaaataatgccacatatctacaactatctgatctttgacaaacctgagaaaaacaagcaatggggaaaggattccctttttaataaatggtgctgggaaaactggctagccatatgtagaaagctgaaactggatcccttccttacaccttatacaaaaatcaattcaagatggattaaagacttaaacgttagatctaaaaccataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccaccagagtgaacaggcaacctacaaaatgggagaaaattttcgcaacctactcatctgacaaagggctaatatccagaatctacaatgaactcaaacaaatttacaagaaaaaacaaacaaccccatcaaaaagtcggtgaaggacatgaacagacacttctcaaaagaagacatttatgcagccaaaaaacacatgaaaaaatgctcagcatcactggccatcagagaaatgcaaatcaaaaccacaatgagataccatctcacaccagttagaatggcaatcattaaaaagtcaggcaacaacaggtgctggagaggatgtggagaaataggaacacttttacactgttggtgggactgtaaactagttcaaccattgtggaagtcagtgtggcaatttctcagggatctagaactagaaataccatttgacccagccatcccattactgggtatatacccaaaggattataaatcatgctgctataaagacacatgcacatgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacagaggaaggggaacatcacactctggggactgttgtggggtggggggaggggggagggatagcattgggagatatacctaatgctagatgacgagttagtgggtgcagcgcaccagcatgccacatgtatacatatgtaactaacctgcacattgtgcatatgtaccctaaaacttaaagtataataataaaaaaaaaagaaaaaaaaattgtttgtagggatgggggtctccctatgttgcccaggctggtctcgaacttctggattcaagtgatccttccatcatggcctccccaagtgctggattataggcgtgggccactgcgcccagccaattctcacttctcatggcagagggactcaggaggcagaaagaaaaccttccttttatccttccagaaattcccagttggaagactatataggaagttcatggtgctggatttcttcctgccttccatgctgttcccatcccccagttggttttagctcttcctgctgcctcaatatgtggctgtaatccagattctccagcctccattcacatgaattttcctatacctcatccgtgccccaccttcaactagagttttcctgtgcagggatatgtcctgatccgcaccactggtctttatctctcctgagtttgtcctgaacttccagctgttgaaccatagacaatggtttgactcaatagctctaaagccagccggtccatctgttcttaatcttacctctgttccactcaagatacctggagttcacttcaattccttggtctcctgtttcttccacacgctgtcagccaggcaagtcatcctttgtggtatctcttgcatccttcgagatgtctcttgcgtctatttcatctttttatatccagtactttcacccaagggcagatcttcatctgagcatttattcatgtcttcaaaaataattactgcatagctcttgagttccaagagctgtcagagatgccgatcagagtttgggtcactctagctgctgtaggggaataggctgtagaatggcaggagaggaggtgggggcactggctgggaggctggtatagttgcagctgtgagaggcaatgatgcctcttggtcaggtggttgccgtggagatggggagatgtgggcagacttgggctgtgagcgtaggctcctgaaagagtctcctgccattccatatccctcatgaagcctcccctgccactctggtgcctaagatcatcactctcctttgagtctgcagtgcctccattggccctttgcctgtgtaaccaaatatatcctttctctaagcagtgatttttgagctttttataaaagggacctcttgaaaacatgaagaaagtccacacaccttttccccagagaatgttccttcccatgaaagtttacaaacaactgcagggtgtttaaccatggggtccctgttccctaggctaaggactctattatctctgtcacccacaagccaacctctcacttctttccatcttcttctcttattgtatttcagtgggcacagaagatgctccagacatacatttccttgatggcaccctcattcctgataacttcctttggaaatgcatgacattcacttgtccatttttgtaaagtcatgcaaaatttggtttgaaatgttctaaaataacctaagaatgtggttggcttaatggttcaatttggagcacctctttgggccaagggattggagaggaggagctgtggtcagagttaggtctgctggcactgcagataaacaaatgttttcaatgtgaattgtgctgtataaaggtccaagggtctttccagaagaagttagcactaagttaaagcattttgaggctggagtgcatttagagaagactcattaatgttcatgtgatcatgttatgacaggtcaataccactttaaatcattccaaatggtctaacatgtggcttgaaaaataacagaggaaacagttgtaaggatgattgcatagtgctctattactgcgacttttgtttctaaagccaatgtgagggccacacaactgtgagacaaaggcgattactttggtattgaaagcacctttgcaggactgctatcagttagcagaaaatgtcctcctggcactagcattgtcttctgttaaagtgctttccacagagcattccttaactgcagtccacaacaattctggatttaaaactgagaactcaaaagaaagactattttttttgagagttctgtatatattctaggtgctaatccttttcagatagatagtttgcaaatattttctcccatccatagcttttttttcatcctcttcactgggtctttcagagagcaacagtttctgattttgatgaggcccaatttatacattttcccttttatggatcctgcttctggtgtccagtctaagacctctttgcctagctctagattctgaggatgtttttcctatgttttaatctcaaagcttcatagttttatgtttaagtccatgaccgattttgagtttaatacttgtgtaaggtgtgaagtttacctagagattcattttgttgcctatgaatgagagactaatttttagaacctcttatttgaatgtatttattgcgcttctttttttgtttttagtacagatggggtctcgctgtgttgcccaggctgggtgccaactcctggcctcaagtgatcctcctgaccaagcctcccaaagtgctgggattacaggtgtgagccactgggcaggactactgtgcttttgtgttttctcttccactagccctgagctgaagacgaacatcccagaatgttctgttttcttctgtctttcagtatctcagtatggaggggctccagatggatccaaataaggaactgcgaacgttcatattttaaacattaaactgtttcaccaagtttcttgatgaaaagatcaaatgcaggcaagattattaatcacaagatattttattctaaaatggtcttgtgtacaattacagagatccaccatgacaatcctgctctttctcactccactagccctgcaataaattggaaattcacacagaaacactgattcattgtgaaattcaaccgaaacattcagcagttctcatgactttttttgcacttataatagattttttcatatttatgttaatttgtaacgatctcatggacatgtaaagcttttagctctctacctgtgtgacattcagaaaataacctattttccatttaaagaggttagttgaaatattcagataggattatcctatctaatcctatctgaatatttcaactaacatattaatatttcaattaaaacatgaggtcttttcaagttttccaattatgcatatagaactggcaattgatatgtggtcttgtcaaaatagtgaaagaacaatcatgcagctgggccctgtgagggctgggataagccagcgtccagacaagttagacacaactattttcctctctcttctcccttgccctctaaccatgaggaattatagtgccttttgctataagtcaaaatgtcagttctcacaaaaggatttgaataactggtctcaggaatggtttgaggtactctagggttgataccagagtaagacttttaaaagtctctggaaagggtagcagcataacttaaatatatcaatttttattagagatgaccatttcttcttttaataatcacattgtcactatgcagatctgcatttttcatgaaaaacttcatttctgattctgaaggcgtttccccttcatttgcaagcatttcataaatgctgatgttcttaaactttgctttttgttcaaaactgttcatcgttaagtgactctttaatagctagttaataaaatactttcacccaacaaagaccagattgtgtagctggtaatttcagatttacacggaacaagcttcactaacagcgaatttttaatttgcaagtataaaactcccttgtgcatatttagaggaagagattcttagaataaaattggaatgcttccaattctctttattcttaggcacttcttcaaaattgtctcgcagagtaagagtatgatttttaaaattaactgtattcagggggctttttttttccagaacaagctagaacttctggggtataggcagaacaatagggccctaggtggtctcccagatcgggttccctggaaacactcagatggagatggatgtaggtggtctactgggaacaccacccagaaggaagagagggagggaagcagccctgggcagagggagaagctaagttatgatgcaattgcaagagagctatcagctaatcccaaagggagcaacagaagctgggagaacccttggagttgtccaggcaaggtgagggggctgggctttggtactatcacgtgactgtccttggatgcagctgccccagaagtggtgtaacctcgcctgtagtggctcccttagactggagcaattcctggggtgggatttagctgtgagtgtcagcactgtcatgtggggagccaggtgcttgagtgccttggtcctgaaaggggtatccaaggggcccaactcagcatctactgccagtgaattgggttgtgccccaaatgagcagtaaggggtctcttcttttgttcattcagtgaacatcagtggaacgtggttaaagaaagggatgaagacaaatggaggcagacggaagaaccactgcgggtcacagtgcaggagccgagcatgtgaaaggaaccactgccttcagtcggccagccgcagtcatgcccggagctttgaacacaatgttggcttttatttatttatttacatatatatatatttatatatatatatatatatatatatatatatatatatatatatatataaataattttgcgacagagtcttactctgtcactcaggctggagtgcagtggcacattattggctcactgcaacctccgcctcctgggttcaagcaattctcctgcctcagcctcctgagttgctgggattacaggcacccaaaacaatgcctggctcatttttgtatttttgtagagatggggtttcaccatattggtcaagctggtcttgaactcctgacctcaggtgatctgcctgccttggcctcccaaagtgctgggattgcaggtatgtatttttagtagagatggggtttcaccatgttggccaggctggtctcgaactcctgacctcaggtgatctgcctgcctcggcctcccaaagtgctgggattacaggcgtgagccaccatgcccagccaaaatgttggcttttgttaccattgcctacatcgtgccagatttgggtgctgtgattttatgtttaccattaccctctctcccttgctcgtaacttctaactcaagtagctcgtcttgcttgactgcacaggctatcccttttctctctcactgtgacctggcaccagggttcccagacacagtctgccagaccctcggagctgctcctcccacacagaagtttgcgagtctgtgtgctggtcagaacatccttgtaacatgaggagcacgactgtggctgtctgagctggagctgggtcactgcctctcaacagtcactgtggatcataacctctatcaatccactctgaagagctgatgcagactggagtcacagcaggatcatgatcttttttttttttttatattactttaagttctgggatacatgtgcagaacgtacaggtttgttacataggtatacatgtgccatggtggtttactgcacctatcaacccgtcatctaggttttaagccccgaatgcattaggtatttgtcctaatgctctctctccccttgccccccatcccctaacaggcccctgtgtgtgatgttcccctccctgtgcccatgtgttctcattgttcaactcccacttatgagtgagaacatgtggtgtttggttttctgttcctgtgttagtttgctgaggatgatagttttcagcttcattcatgtatctgcaaaagacatgaactcattctttcttatggctgcatagtattccatggtgtatatgtgccacattttctttatccagtctatcattgatgggcatttgggttggttccaagtctttgctattgtaaatagtgctgcagtaaacacacgtgtgcatgtgtctttacagaatgatttataatcctttgggtatataccagtaatgggattgctgggtcaaatggtatttctggttctaggtccttgaggaatcgccacactgtcttccacaatggttgaactaatttacactctcaccaacagtgtaaaagtgttcctatttctccacagccttgccagcttctgttgtttccacactttttaataatcaccattctaattggcgtgagatagtatctcattgtggttttgatttgcatttctctaatgaccagtgataatgagcttcttttcatatgtttgttggctgctgcataaatgtctttaagaatccactcttcagagctgattccgactggattttggtcagccatgaagtggtatctgactgcaacacactctacttcaaacatagtcatgttttaggatgaggccatcttcaagcctgagatccgtttctcatagaaagtgtttatgctgaaagcatatgggccctaagagttcacttctcctgcaggcttcaccatgaagacccccccagttattggcaagttcattccacctccgcttccaacccccctacacgacggaaggacgggcccaatgtgacactgtgtgaactctgatttcctttggtaacaaatacttctgttaaaatatatccagatgtcagcgctagatgataaatttgaacaaacacattttggttaaattagtatgattattttgactttccagtgtttacttggtttgttaagcatttttacttctctctaccattgaggaaagacaagtgggataatttattttgaggaaggaaaactcaaagctatcacgtatgtgaaaaaacatgtgaggtatctgagttgttgaaatcacgattgatcctaattgatacttacaagttatagaaaatgtggcaatggattgccaatcaatatttaaaaactgaaaacctgttggtagataacatggtttctctaggaaacaaacggctgcactcccaacagatttgtaaatatctcattgactcaaagcaaagaagtcaataaaaagaaaatgaaatcaaatttctaaaatttcatacaaatattttaccttatttttctcctttgttcctttcttttgttttttggctttcttgggttgtttttcctttttcttcttcttctttttgtttttttcttcttcctcttggtttgctatgatatcctcaataacctagtgaaaaccaaaataatcataccattttcatagatccctatcaagagaaggactgttttccctgtctgaaaggaagtttttgtgctggtcagtgtcatctctctgcctggccctggaccctgcaggccgaccccttctggggcatggtggggctcctgcctaccatctacccttagctggattcatgaacagggggcagcagcctcagtgtagatggagagagagtctcgacgtttctgagcccagttccttccctaattccacccactccagctcctggaggttccacaaactctaggggaggtcatagcttcctcaacgtctcagcaacagctggatgtgccagccctgcccacagctcgtcaaaatccagggggaggatgccactgcttcctgctaggctccaatggcaacagccactcttgcaataactttcattttcatgagttggtttctttcaccagtgatttaatttatatcccctacagtgacaaaagaccttttatcctcctaaattataaaatatttgttaaaaagtatccagttcacataggattagcactactggagaattattatagatttgttaaaaaaacatataattcagttcaatacaacagtgttcactgagcactcactcactgccatagagagctgtgaattccaggagatataaaggtgacaatgacaggacacgcttcctgtttggcccccagggctctgctcatgacttgtcatgtggccaagacaagctgcataagctctctgagactcagtttcctcagctctaaaagggagccagcatctccgtacatagcacttaggatccgccaggcatgcttctgagagcctcacagagacagactcctttgctgctacaccagacgcatgggggttgctgttgttgccctgttttatggatgagggaactgggacacatacagtgcagtatcccagccagggacacacagctagtgagtagctgagctgggattcagcacgtgcttaaccaggatgaatttcataatgtagggagaaaagaggcataatgtataagaacacatgtcaacttactccatcgtacaaaatgcacagagtgaaaccaacaatccatactccagtctcaggtacatacacatgtagtccaagtacaaaggaatgtaagggaatgacaaactccaaattaagtacagcagttgcctttgaagatggagcaattaaaaaattgggggtggggagacaagggctaatatcgttttatcctagtgtggagaaaggcgagaggtgaagcatgtgttgtgaacatatttggccatgcaaaaatgatcttttcccagcctaggcaacatgatgaaaccccatgtctacaaaaaaaaacacaaaacattagccaggcatggtggtgcacacctgtattcccagctatctgggaggctgaggtgggaggattacctgagcctggaaggtagaggctgctgtgagctatgatccagccactgccctccagcctgggtgacagagtgagatcctgcctcaaaaaaacaaaacaaaacagacaaaggctcaccttgactcacagaatcaaggtgtggctgcccaggtcttcattgtactggagcacttgtaacacagacattgtttggaccttagaaactgtaaaacttttctgctttctcttgtgggcatttagtgctataaatttccctctacacattgctttgaatgtgtcccagagattctggtatgttgtgtctttgttcttgttggttgcaaagaacatctttatttctgccttcattttgttatgtacccagtagtaattcaggagcaggttgttcagttaaaattgacaccctaacatcacaattaaaagaactagagaagcaagagcaaacacattcaaaagctagcagcaggcaaaaaataactgagatcagagcagaactgaaggaaatagagacacaaaaaacccttcaaaaaatcaatgaatccacgagctggttttttgaaaagatcaactaaattgatagactgctagcaagactaataaagaagaaaagagagaagaatcaaatagatgcaataaaaaatgttaaaggggatatcaccaccgaccccacagaaatacaaactaccatcagagaatactataaacacctttatgcaaataaactagaaaatctagaagaaatggataaattcctcgatacatacaccctcccaagaccaaaccagggagaagttgaatctctgaatagaccaataacaggctctgaaattgaggcaataattaatagcttaccaaccaaaaaaagtccaggcccagatggattcacagctgaattctaccagaggtacaaggaggagctggtaccattccttctgaaactattctaatcaatagaaaaagagggaatcctccctaactcattttatgaggccagcgttatcttgataccaaagcctggcagagacacaacaaaaaaagagaattttagaccaatatccttgaacattgatgtaaaaatcctcaataaaatactggcaaaacaaatccagcagcacatcaaaaagcttatccaccatgatcaagtgggcttcatccctgggatgcaaggctggttcaacatatgtaaatcaataaacataatccagcatataaacagaaccaatgacaaaaaccatatgattatctcaatagatgcagaaaaggcctttgacaaaattcaataacactcatgctaaaaactctcaataaattaggtatcgatgggacgtatttcaaaataataagagctatctatgacaaacccacagccaatatcatactgaatgagcaaaaactggaagcattccctttgaaaacgggcacaagacagggatgccctctctcaccactcatattcaacatagtattggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctgataggcaacttcagcagtctcaggatacaaaatcaatgtgcaaaaatcacaagcattcttatacaccaataacaaacagagagccaaatcatgagtgaactcccattcacaattgcttcaaagagaataaaatatctaggaatccaacttacaagggacgtgaaggacctcttcaaggagaactacaaaccactgctcaatgaaataaaagagaatacaaacaaatggaagaacattccatgctcatgggtaggaagaatcaatatcgtgaaaatggccatactgcccaaggtaatttatagattcaatgtcatccccatcaagctaccaatgactttcttgacagaattagaaaaaactactttaaagttcatatggaaccaaaaaggagcccgcattgccaagtcaatcctaagccaaaagaacaaagctggaggcaccacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgaaaaaacaagaaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaaaaacaacgccatcaacaagtgggcaaaggatatgaacagacacttctcaaaagaagacatttatgcagccaaacgacacatgaaaacatgctcatcatcactggccatctgagaaatgcaaatcaaaaccacaatgagataccatctcacaccagttagaatggcgatcactaaaaagtcaggcaacaacaggtgctggagaggatgtggagaaataggaacacttttacactgttggtgggactgtaaactagttcaaccattgtggaagtcagtgtggcgatgcctcagggatctagaactagaaatactatttgacccagccatcccattactgggtatatacccaaagggttataaatcatgctgctataaagacacatgcacatgtatgtttattgtggcactattcactatagcaaagacttggaaccaacccaaatgtccaacaacgatagactgtattaagaaaatgtggcacatatacaccatggaatactatgcagccataaaaaacgatgagttcatgtcctttgaagggacatggatgaagctggaaaccatcattctgcgcaaactatcgcaaggagaaaaaaccaaacaccgcatgttctcactcataggtgggaattgaacaatgagaacacatggacacaggaaggggaacatcacactctggggcctgttgtggggtggggggaggggggagggatagcattgggagatatacctaatgctagatgacgagttagtgggtgcagcacaccagcacggcacatgtatacatatgtaactaacctgcacgttgtgcacatgtaccctaaaacttaaagtgtaaaaaaaaactttcagaaatgtaaagacttaaaaaaaatagtcggatatataattatgagcagctgaaaagatgaaatccttatttgtggagtataaatttcactgtggccttatcagttaagccttttaaagtcttaccaattatatggtttatttcatctctctccttttatagtttattagtttaaatttttgagtattacattttcatggttcacaattcaaaagttatgaaagagtaattatacataaatacagtgaaaggtttcctccccatactgttaactagccaagaagatccactttctctttttattttttattagggcataattgacaaaaatttaatatatatacagtatacaacatgatgttttgatacatgtacacattgtggaatgattaagtcaagctaactaacatgtccatcaccttacatgcttagcattttttgtgtgtgatgagaacatttacaatctattctcttagcaattaaaaatatacaatataatattgttaattatggtcatcatgctggacaatacatctccagaactttttcctcctgtctaatggaaactctgtaccctttgaccaacatctctccattccctgatcttcccctcccacccttggtaatcactattctactctctgcttctgtaagttaaattgtttttttagattttatttataagtgagatcatgcagtatttgtctttctgtgcctggcttatttcacttagcataacgtcctctgggttcatgcatgttgtcacaaatgacagaaatttccttcttttttaaagctgaatagtgttccactgggtatatacaatacattatgtttatccgttcatctactgaagaacactgaggttgcttccacatcttggcttttgtgagcaatgctgcaatgaacatggtagtgcagacatctctttgacacactgatttcatttcctttggatacatactcagtagtgggattgctggatcatatagttctatttttcattttttgaggaacttccacactgttttccataatggctgtgttaatttacattcccaccaacagtgtacaagggtccccttctctcacatccttgccaacatttgttgtcttttgtctttttgataacagccatcctaagtgtgaagtaatatctcattgtttaatttgcgtatgtctgttgcgttcagcatttttccatatacatgttgaccatttgtatgtcttcttttgagaaatgtctattcatgtcctttgcccaattttaaattaggttgttttcttgctatagcagtctttaaattctttatatattttggaaattaacgccttatcagatgtatggtttgcaaatattttctcccaattcataggttgactcttctcttttgtttccttgctgtgcagaagttttttagtttggtgcaatcccatttacctgtttttacttttgttgcctgtgcttttggggtcatatccagaaaatcactgcccagatcaatgtcatggagatttcccctatgttttcttacagtagttttatagcttctggtcttttgttcatggctttcactcattttgagttgatttgtgtatatggtgtgagataagggttcaatttccttgttctgcatgtggatatatagttttctcaaaccatttatcaaagagacttatccttcttccattgtgtgttcttgacacctttgttgaaaatcaatttgctgtagtgtgtggatttatttctgggctctctcttctgttccactgatctttatgtctgtttttatgccagtatcacgctgttttgctttctgtagctttgtaatatatttggaaatcaggaagtgtgatgtctttagctttgttcttttagctcaagatttcattggatatttgaggtgttttgtggttccatataaattttagaattgctttttctatttctgtgaaaaagtgtcactgaaattttgatagtcattacactgaatctatagatcactttgggtaatatgttcatttttacaacattaattcttccaattcatgagtacaggatatctttctatttatttgtgtcctcttaaaattctttcaccaatgttttgcatgttttgtaggtttcaatacacagatccttcacctccttggttaaatttatacctaaattaaaagaatgttactataaatgggattgttttcttgatttctttttcagagagttcactgttagtgtatagaaatgctactgatcttttgtatgctgattttgtatcttgcaactttactaaatttgttcgtcagttctaatagtatttttagtggagtctctggggttttcctttttctttttcaaaatttttaaaaattcaatacagacagggtcttgctatgttgcccaggctcttctcgaaaacctgtgctaaagtgatcctcccacttcagcctcccaaagtgctgggattacaggcgtgagccaccgtgcccggcctctggatttttctatatgcaagatcaaagacaggaaatttcacttcttcccttcctatttggatgccttctatttcttattcttgcctaattgctctggctaggacttctgtactaggttgaataaaactggcaagagtgggcatccttatcttgtgcagatcttagaggaaaaactcagattttcactattgagtatgattttagctgtgggcttttcgtatatagtctttatcgtgttaagttccttctctgcataatttgttgagtttttattatgaaagagttttgaattttgccaaatactttttctgcatctattaaaatgatcatatgatttttatccctcattctgttaatgtggtatattatactgattgatttggataggctgaaccactcttgcgtcccaaggataaatcctgtttggtcatggtgaatgattcttttaatgtgctcttgaatttggtttgctagtattttgttgagggtttctgcatctatgttcatcatgaacattggcttataattttcttttctctcagtatcttgcctggttttggtattaggtttatgctggcctcataaatgaatttggaagtatttatttctcttcaatttttgggaagaatttaagaagcattggtattagttctttacatgtttggtagaattcacacaagaagccattttatcctgggcctttctttattggaagggttttgattactgattcaatttctctactcactatgattttctattttttcatgattagtcctgttgttgtataataatttatccatttcttctaggctaatgaatttgctggtatataattattcataatagtctcacgatcttttgtatttctatggtatcagttgtaatgtatcctctttcatttttaattttatttgtgtgactcttttctctcctagtctagttaacagcctgtcaattttatctttcacaaaaccaactcttagtttactttttctgttgtttttttgaggctccatttcatttatttttgttcttatctttatttctttcctctgctaattttgtacttaataatagtttgtttttctttttctagttccttgaggcataatgttaggttgtttgagatctttcttcttttatggtgtaggcatttattgctagaaatttccctcttagtactgcttttgttgtatctcataggttttagtatgttgtgtttccatttttattggtttcaagacattttaaaatttgcctttaaatttcttctttgatccattggttgtttaggagcatgttgttaatttctatctatttgtgaaatttcaaagatttttccttttattgttcctggtttcacaccattgcagtctgaaaagatatacttcatatgattttgatcttcctaaatttgttaaggcttgttttgtggctgaatatatgatttgtcctggggaatgttctatgtgcatttgaaaggaatgtatattctgctgctgttggatcaaatgttctgtatatgtctattaggtccatttggtctaaagtgtagttcaagttcattgtttccttattgattttatgtttgaatgatctgttcattgttgaaagtaaggtactgaaattccctactattattgtattataatctgtctctcccttcagatctattaatatttgcttttcatatttatatgctctgatgtttggtacatatatatttgcaattgttatatcctattgatgaactgatctctttataattatataatgatcttatttgccctttttacagtttttgacttaaagtatattttgtctgacatgattatagttacccctgctttcttttggattcaatttacatggaatatctttttctatcccttcaccttcattctatatgtgtccttaaaggtaaagttaatctcttgtatgcagcatatagttgggtaatttaaaaaaaatccattcagccatgctatgtcttttgattggagaatttaattcatttacatttgagataattattgataggaagaacttattgctgccactttattactttctgattgtcttgtaaatccttctttcattttgttctgctattattttcctgatttcattaactagtttatttgtattgtcttgtaatttgctgagcttctttagaatacttattttgaattctctgtcatgtaattcatggatctccaattctttagggtcagttactgaaagtttattgtgttccgttggtggtatcatgtttccctgattcttcatatagtcttataaatgagtctgcaaatttcaagaagtagtcacctcttccagactttatggactggctttggtaaggaaagaccttcacctgtgggcagcagggtggggggacagaggcatgctgggggcactgtagcatcaggtctggtgttgtgaggtaccaagtgttggggtatgtggtggctccgaatctgggggagcgttcagtcttgccatttcaggcagctggagtctgtgatgttggcacctgcttagtcctttgtggctggggtcagctgcaggtgcacatgtggcactgggggccagcagcttgcatatgcataattgcagaggccagctgcaggtcatcaacaccatctgcatgcatgggcatctttaggctgagctggaggggtgcatgcacatgtagctacagggaccagctctgggaacaagcacagtgtggggatagttgctggagggcatggccaactggttatgctcatctagttgtgggggccaggctagcagctactgcaatagcctggctacaggagtcagccttgggtgcatgcagtggtggggttggagtctgtggtagggggctccaaggctgttttctggcatgcatgcagtaggtgctctgggtccctggcccagagaacctgtggaggcagtagctggggtggtttcaaggagatgtggtgatttaggcacctagggaacacgagggccacttgggtgggtcggtgggctgtgctcactgtggcaggagcagtcatgtggctctgggtggctccagtgggggacaggtaggagactcaggcacctggagactgtgaaggtgaaaagaaatgcagtgtcctcagtggtgaaagctgaagggggtcccctgcttctgtgcaggcagttggtttcctcagctatgaaaactgtaggatcctctgcagaatatgctgttggggttcatgataacaaaccctgaggggtcctctgtggtgaaagctgcaggtggttgtgtggtggtcttgagttcctcagcagggctgttgagttcctcagcaggggtctgctggagtcctgggctaagcaggccactggggtttgtggtgacttccagtgtgtggctgatcataatacacttgctaaaaagtcaacccaaatactttggatatgcttctaaagacattttatatacatatatgcgaatatacatataacacacacacacacacacacacacacagagcacactggcattgttgtgttatgtttgccaattgtataggtgaaaagtaatatgtcattgaagttgtctcttttttaaaccaatacaaaatttattttacctgcactcttcagttatagcaaaatcttccaagtgcacagagatgtacacaggtatacacacaaatgcacattataaacatcaacttgtcattttatacaaatgttagcgtattatacatactgttcttgttctgcgtttttcacctaataatatatcttggccatctttccttagtggtacatacagaacttcacggttcatttttcacaggtgtattgtaacaatttatttggccattcccctaccaaataagattgaggttatttctaatagtaatctgctactactaacattgttgccatgaataaatgcatgcaaatatcattttgcaggtggtgaacatatctgcaggataaattccttaaagtggaaatgctggatcaagtgtatgcacatttgtaatactgttaaacttcccaccatgggttgtgtcaatttacccttctgccagcagtgtaggagtggcctgtttccccatatgcttgttgtcacagtgcatcttgtttgccagttgcatgggtggaaaatgtagtcgcttttgttttttcaagaagccaatattgaatttattttgctcctgctcatcaacttgagcaaaatcttccgaagttaaaagtgcactttactggctattaagtcagccatcatttttttgggctcagggccaaatctggcctggtgcctgttttctcttttcaaaatataattttattgaagcatatcatatactcacccatttcaagtgtgcaattcaataatttttcagcaagtatatcaagttgtgttccactaccacaaatcagttttagaacatttctatcaccccaataagattctctcatttccattaactgctaatcccttttctctctccttcccaggtgtattagtccattctcatgctggtatgaagaaatatccaacactgagtaatttataaagtaaagaggtttacttgactcacagttccacatggctgggaaggcctcaggaaacttacaatcatggtggaaggggaagcaaacacgtccttcttcacatggcaacaggagagagaagtgccgagcaaaggaggaaaagccccttataaagtcatcaaatcttgtgagaactcactcactgtcatgagaacagcctgagggtcactgcctgcatggttcaattacctcctaacaggtccatcccacaacaaatgggcaacatgggaactggtattcaagttgagatttgggtgggaacacaaccaaagcacatcaccaagcaagcactaatctactttctgtgtctacaggtttactttttctagacatttcatataaatggaataacaaaatacattgtccatagtgtctggcttctttcatgttgcataatgtttcagtatggcataacactttaagttcatccatgttgtagcatgtatcagttgtgtgttcctttttaattgccaaataatataaagttgcatggatataccatattttacctatctattccccagttgatatgtatttaagctgtttcaaatttttggcaattatgagtaatgctgctatgaacattcatgtacaaatgtttttgtgtggatatatgttttcatttctgttggatagagtcctaagagaagaattgctaggtcctttggtaaatttatgtttaactttttaagaaattggcatgatgttttccaaagtggcaacattttacattcccactagcaatgtatgtgggttcccttttctccacatcttcagcatttgtaattgtctttttttttgtatccatcctcatgggtgtgaaatagcattacatttccattttaattttcattaccctaatgatgaataatgttgaacatcttttcatgttcttactagccatccatacatcttcctttgtgaattgtctgttcaaatcttttgcctgttttttgactgaattgtttgtcttcttattgaggtgtaagagtactctgtattttctggctgtaagtcctttaacaggtaggtattctgtaaatattttctcccagtctgttacttgtatcttcattttcttaatggtatcttttgaagtgcaaaagttttgcattttgttgaggttcagttgatcaattttgtttgtcagtgtagttttaatttgcatttctcttatatgtgtgaggttgatcatcttttcatatgttgaacatcttttattatgtttcgaattcatttgagttttcttttctgagcactgtctattcatatccttttgctgttttttgtattgggttattattctttttcttgtagagctgtaggagttccttacatattagaagaaaggactcttgtctgtgatacccatcacaaataattctctcagggtgtcatctgtcatttcccttactcaggggtcattgtttccatgtaggattaaaacaattttgtgtgtgtggttgaatttatcaatttttttttctgctatgatttctgggtttgtatcataattagaaagatctttcccattctgaggttatgacatatttctttcttagcttcttctagtccttttgtgttttgttttgttttatacgtaagtgtttgatccttttggaatcattccaaagtaaagtataaagacttgggaatttaattttcttttttcttagatgacaacctggctcttcttataccatttatttccttttttcctttcacatttgagatgctgtctttattataaatttccgtatgtatttgggtctatttcttgattttctgttcttttccattgatgtgcctttttagtcttttgtctgtgccagtgggctcctaagaatatgttttcatacctggcaaagctagttcctcctcactatgcttcattttcagaattccactggttattcttggttatttgctttctacttaaagtttagtttggtcatcctccctgcctcctccccgccaatgccccaatataatgctattggtattttcatttggatcatattatgtctatagatgatgtttaggagtcaaggtatgtatggtgtgagcattcctacctacgagcatgatatgcttttccatttcttcgcatccctcaggagtgttgtaagcttttcttcacgtagaatgtacatttatcattaagcttattcctgggcatttgacctttgcattgttgctgttgtaaatggtctcttacattacattttctagctagctactgtttgcatgcacaacagcgattgctttctgcatgttaattttgtaatccccccatcttgcttctcatattatttaaagtagttttttagtttattctctttgcttttttgctctttagtttattctctttgcttttctaagtattgaacatatgtgcaaaaggtgatcatttgcctcttctgttcccctttagaacactagaaaggggatatattatttagtagttcctacaggacaatggtaaataatagtggtgatgatggccattcttgaatttttcctgacactcactagtggaaatgtttctagtgaatttctttaagcatgacactgggttttgaattaagaaatattttataatgttcaacaagtatccatctattccaattttgtagagttctatttttaaatatcaaaaatggatgttaaatttgtaaaatgcctttgcagcctccatagtgaggagcttatggttttcccttttggattttttaatacgatgcggtgcattcatagacatccttaacccaaaccattcttgcatcctggaataatcaccacttgtggtgttttactaatttaatgtggtgctggttttagtgtgctaacacgttagttaaaatgtttgtgttaatactcataagggagactgatctgtgtctttttttgtgttcaatcttttttgggggttttgattcaatgttatgctcgtttcataaaaagtatttgtattatttttgttttattaatatatatttcaccttgtatgtatattgttataatgacaatgcttggcctattctctattcatactatgactacaatgactactattactgctactgtcaacgttagtaacaactgctacgattttctgaagggtttcaatatgccaagctctgttctaagtacctcacgtgtattgtctcatctaattattacctcagtgcagggaggtagacgttgctagtaatctccatttatagatgagaaaactgaatcggagtgtggggggatgaagcttgtctaaggttgcaggtctagtgtgtgggggaactgtgatttgtaatcaccatgccgttctgactcttcaatcatctgtctttcaaggctaagctgctttgtggtctcctctgttctctttcaatgtgttaaccagacattctcaattttcttttgactagtattttttaatgtttctcatggcaatttagatgttctaccaacattcttaatcctataatcgctacctttctaactgaacataaaatgtgtctggatgcttgccatggactttcaagacacaacttgtgcctggcaatttagctggcgggacaacacctaaacacataaaaaaagtgaaacaaccccaaatcaaaatgacaatcactcaaggcagggcttgacaaactgccaaataatagggtcaatatttggtgctcatggaattcagtgaaggagggaggagtcctctagagggctgaggcagcctttgggagcagaggctggtttctgatggagaagtgaagaaagagcaattcctgtgtgcttaactctgagggctcttggaggggagcacagggacacagggaggctgacagcagggtcagtcatgctgaagtcctgaaaccccgagctaaagcctgtattttactgctgcagagaacttcatgttacttaacgaatttcctgttaaagaacatcaggctgttttcttctttgtcaatgcaataaacaaggcagacgtgaacagcatccatggcaggggtcagcaaattatggcacatgggccggctctggccggccgcctgcccatttttgaaatgaagtgtgattggaacacagccatgcccatcatttacatgttgtctatggcttctctgatgccggtattagtccattctcacattgctataaagaactgcctgagactgggtaatttataaagaaaaagggtttaattgactcacagttccacatggctggggaggcatcgggaaacttacaatcatggtggaagggaaagcaagcatgtcttacatggtggtaggagagagaaaaagagagagcacaaaggggaaaatgcccccttacaaaaccatcagatcttgtgagaactcaggatcacaagaacagtctgggggaaaccaccccaatcaggtctctcccttgacatgtggggatttgagatgagatttgggtggggatacagacaaagcatattaatgccatattggtagagttgagtagtgccagcagagaatgtatgtgccacagcctaaaatatttactgtttgtccttttacaaaaaaaggatgttgacctctggcctatgacaacttctgttattattatttatttagtataaattcctcaaagagcatttatgagccaaagcacatacacatgaaaagttttgatatttgtttgatccacgtcacttaaaaatgtcatgctaatttacatatccagtagcaatgtatgagagtgactttttcccacatgcacaccaactccagtcattacaatgacttaaaatttttaccagtcctataggtgaaaacagatatggcaacattactttatacatgtaattgccagtgagttttaaaaatttttcttgtgttaaattcctgtttatattctttgcttttttatcagggtgttccaatttttgttattattttccgagaaatatttatatatgaaaaatacccattgtcatacatgttgcaaatgtttttcctcagttatcatataccttgaacttcatttgtgattttttttggccattttgctatttgagttttgtgtagttaagtatatgagcagattctcttcatgttatttgcctatggtgacatgtttatgaaatttttctccaattcaaacaatttctttagtaatttgtggtttaacatttttacatgtaaatatttaattcatctgaaatttgttttgtataataaggaaggctctacttgattttgccaaatggtgagccagttattatttattaaataatattatttattagtctgtccttccccatttatttggaatgtcatcagtatactactgaattctgatatatgtacctgactaagtttctgagcacactattttaaagtcagactccttgagtatgaacctcagctccacaactaatttggccaaatttttgatcttcatagtttggaagaattaaatgagttgacttatataaagtgcttgcatggtacctggcacagaatatttgtccaacaaatgttatctgttatttttgttgttatctgtctattcattttccaacattgtggtattttggctactttatatctttataatttgttttatatcaatatggaaagttccctattatagcttttttaaaaatttattattattatactttaaattttaggggacatgtgcacaatgtgcaggttagttacatatgtatacatgtgccatgctggtgtgctgcacccactaactcatcatctagcattaggtatatctcccaatgctatccctcccccctccccccaccccacaacagtccccagagtgtgatgttccccttcctctgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtatctttatagcagcatgatttatagtcctttgggtatatacccagtaatgggatggctgggtcaaatggtatttctagttctagatccctgaggcatcgccacactgacttccacaatggttgaactagtttacagtcccaccaacagtgtaaaagtgttcctatttctccacatcctctccagcacctgttgttgcctgactttttaatgattgccattctaactggtgtgagatggtatctcattgtggttttgatttgcatttctctgatggccagtgatgctgagcattttttcatgtgttttttggctgcataaatgtcttcttttgagaagtgtctgttcatatcctttgcccactttttgatggggtcgtttgtttttttcttgtaaatttgtttgagttcattgtagattctggatattagccctttgtcagatgagtaggttgcgaaaattttctcccattttgtaggttgcctgttcactctggtggtagtttcttttgctgtgcagaagctctttagtttaattagatcccatttgtcaattttggctttggttgccattgcttttggtgttttagacatgaagtccttgcccatgcctatgtcctgaatggtaatgcctaggttttcttctagggtttttatggttttagatctaacgtttaagtctttaatccatcttgaattgatttttgtataaggtgtaaggaagggatccagtttcagctttctacatatggctagccagttttcccagcaccatttattaaaaagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattactttgggcagtatggccattttcacgatattgattcttcctacccatgagcatggaatgttcttccatttgtttgtatcctcttttatttccttgagcagtggtttatagttctccttgaagaggtccttcacatcccttgtaagttaacaaggatacccaggaattgaactcagctctgcaccaagcggacctaatagacatctacagaactctccaccccaaatcaacagaatatacatttttttcagcaccacaccacacctattccaaaattgaccacatactgggaagtaaagctctcctcagcgaacgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcagtaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaacattaatgaatccaggagctgtttttttgaaaggatcaacaaaattgatagacctctagcagactattatagttttttaaaaaaacttttgggatatttccatgcattcattcttcagatacttgaaaataattatgtcaataaaaacttgttttgattttaattggaattgcattaacttcatagaataataaaaagatagtgtgtatttgtactttattgagtctttttatccagataaataattgttcagtctatcattcaagtcttctttcattttcttcagtgagattttgtcagtgtaattctgtacaatcctgtataatttgtcaatataatttcttgttaaatgtattgggtttcctagggagataattacatcatgatcttaaaacaatgataaaattatcactttaaaatatttatcacttctttcctttttcttatttgtttggcattttttataatgtccagggaaatattcaccaatcgttctgatagcaactattctttcttgatcttgacatttttttccaacagatttaacctaacaattttatttccttaaaaaagaaaacgtttttaatttaatttaaaaaattagagactatgttctcatggctgtaaaactagtattatcattattaagaaaaactaaataaatattgagcacttactatgcactcaattctgtgattttaaagaatcgtaaaatatggttcttgccctcagaaggtttataatctcatggagaagataagccttctgttcttttgttcagcaaatatttgttgaatgtttatatatgcaaattaaaagtccttcctcttgagaagttgacaggctaaggaagagataaagcatgcacatgaatgttatgatacaagcttgtaaatggtgaaccagtttaatagaaattcaaataaaatgctgtatgtttgaaggccccctacattaaaagaaaggtgtccatgtgaagtagcgtagggtaaatgtcaaatgaatgatgttaatagcgcagggctttagaggaagggttagtcacccaggttgtgggcagttggggaaaattttactcaggagataagacaaattgcccttattgattttcattttgacaatgcctctaatgcctcatcattgagtataatgcaaatcttctcttggtttctatgctaaatactgtgaagctaagaagagttttcctattcctagtttatgaagacattaaaaaaatagttttaaatgtcaatttcatcaaatgccactgaagcatctatagagatgatcaaaggtgtttcactcgaaaaaaggcaaggagctgggtcttgacagcggagcaggagctaagcagaaaggcacccagaactcaggaagagcatggcacacccaaaggagcagtggcatgagccagaagcacaggtgagtaggctgctggagccaagggcctgctgaggaggtggggcttggagatgaggggagagggaagctgggaccagaacacaaagggctcctgcagccaagctactcagaatttactaagaaaacgaccttcacacatcatcacatctctttcaaaggtaagacgggaaaaaaaaatgaactcattttgaataaatatgaaagtgtgtacaatgatgaacacccaaaagtatttccatgtaaatatttgtaggaaaataaccaagacctaataacgctataaactcattaattttaaagtttaaagaaatgtcatttgatatatttacattttatttctcaagcatatttgtacctgttgtatggtcttgtcagaaaaaataatagctgaccctccttcttcaacgtcagggtagtcaggaaatgtcccggttaaatttctgcaggaaaaaaaatagcaaattaaaatggaaatgaagtcctctcttgttatataccccatttatttgcttatgttcatttaaatgagtgatggtcattaagggtggagggttccctgtagatcaagggctgggcatggtgtcttgaagaaactgaaggtactgattacattcagtagcaggtttccttcctctagagaattgttagtctgatgcaaacatctctctttaaaacatattgtactttttttcctcctttttttttttaatgttgagatgctctgtgtttaagaatgaagacagaagcacaaataatttcttcctgtttaaaattgaggataaacacaggatttcaaactaaacgaaggatggagttgtggaaattacacagttagtaataattgtgaaatatacacccatgctttaggttttagttaaatctgaggccctatgttttatgggttgcaaatagtattatttttccataatcacataatttctacattttaataaagcagactttgaaatttaatgttgagaatttcagaaggggtagacagatagtattcttaaaagaagttgactttgacatgaatgttatatttattgtacgtaagactatctgccaagttagttccattaattcacagaagtacagaatctgaggtttagaggtgaccaccatgtttaaaatggcccttaaaaaactggttcccaaacttttggcctcagaagccctttatattcttattaatttttgaggatcccaaagagtttttgctagatgacttacagctatcaataatttactgtgttaaatattaaatctggctgggcgcagtgtttcacgcctataatcccaacactttggaaggctgaggtgggaggatcacttgagtccaggaatttgaggctgaagtgagccatgactacaccagtgcactccagactgggtgatagaacaagatcctatctccaaaataaacaaataattaaagcttagaaatgtataaaatatatattttagttaatttaaaaataaagtaagctcattatatgttaacataaataacattttatggataataaatatattttccaaaactaaaagaaaaaactagcgagaagagtgtcacagctttgcatcttttcaagtctcttttgtgtctggctgaatggcaattaaccggatgcttatatctgtttctgcactcagtctgtggaaatcttttgttttggttgaagtataggaagaaaatctggcctcaaatggaagagtacatagaacaagaagtattttaatagcccttttagctaactgtgaatattctgctttgatactacaccacagctagacaactggtagcttcctacaggctagctgtgatgtggaatctgaacccatatcaatgaactttccccctatctgtcacatgaaaatccatggatttgtctcgtgcctggaatagaccttttatccatgcatgattttttgtcctcaggtctcggtcactggaaaacgatgctttgcagaattatgtgggtgttcccacagttgatacatttcatcatattgaaaagcacattaattaataacactacagatcttataatggaaggtctaagtcatgggaacctctccaactcataggagtgaatacaaattttccaaaatcatatttttttctggaaggttcaaattttaccattggcaacaactgttgttgacggtttgttcttcttcaggttcatctgattcacttttgaggaaaagtctccccaaaacccaaagtccagagtttgtcagttgttttctcaagggaaagatgatgttccattaagaaatggctggttcagtctgagccttaaccccctcacaggtgtttcttggagacaatcttcacgttttggtatgcagcagaagggatttataagcactgctgattttgtcacatagaacgttaaaaagctatgtgtttcaagggtcaagtctgaataatattattttttactgcatcctcaagaacattgtcaaataaaataaaagtcgaaggaaaaataataattttaagttgtggggtacatgagcaggatgtgcaggtttgttacgtaggtagatgtgtgccttggtggtttgctgcacagatccacccatcaccttagtattaagcccagagtccattagctattcttcctgatgctctccctccccgcaacacccctgccccaacaggccctccccatgtgtccacgtatgttgatcccatgtgtgttgttcccctccatgtgtctgtgggggacacagggttctcactgttctcactgttcagctcccacatataagtgagaacatgcagtgtttggttttctgttcctgcattagtttactgaggataacggcttccagctccatccatgtccctgcaaaggacatgatctcattcctttaatattccatggtgtatatgtaccacattttctttatccagtctattattgatgggcatttgagttgattccatgtctttgctattgtgaatggtgctgcaatgaacatatgcgtgcagatatctgtataatagaattatttttactcctttggctatatacccagtaatgggattgctaggtcaaatggtatttctgcctctagatctttgaggaatcgtcacagtcttccataatttccttccacattcccttttctctgcaaccttgccagcacctgttgtttccagactcttttataatcaccattctgactggcgtgagatggtatctcgtgattttgatttgcatttctccaatgatcagtgatgttgagcttgttttgacatatttgttggccacatgaatttttttttttttttgagaagtgtctgttcatgtcttttgcccactttttaatggggttgttttttttcatgtatatttgtttaagttccttgtagactctggatattagacctttgtcagatatatagattgcaaaaattttctcccattctgtaggttgtctgttcactctgatgatagtttcttctgctgtgcagaaactctttagtttaattagatcccatttgtcaatttttgcttttgttgcaatcgcctttggcgttttcatcatgaaatctttgcctatgcctatgtcttgaatggtattgcctagattaaataaaattatttttaaaggcaggtgtatggcagtgaagactacagtgtttactgctggagctgctggcttgattctctgctactattgtaccattggtgccaatgtcaacaaagcaaaaatagcacgcaatgtcttggtattcatttgaaagcagtttggcttttggattccctgaacagatcttgaaggcccccaggggtcctgggacacactttgagagccaggcaccctggggacctgggacacactttgagagccattcccttggccactgctgaaatgtttcccatgatggtgagctcactcccccaaggtagcccatccacttccggatactttctgacactgaactgtcatctcactccctggaccactgagctgccctctggggccaaacagaacctgattctctttctctacacaggagttactttggtgggatcactcacttattcactcctccatccatcaaacctttcattcatatagtcaaccaacaaatatctgtctagtcccaactggattctagatgcagtgatgggagacagagatctgacattcaaagatggcagaggttgccctcacgcagctcacattccacaatcatatggccagtgtggatattgggccccaggtggtgcctgtccacaagactcatgtctgaaaccttgttaaactgaccacgctccgccacagacccgtgcatcgcccagcctggacggggcttagagagaaaccatgaatacattaggagtcaaaatgacagcactgttttcttcagtcccactcacgttattccttcaataaccacttttacaaggaacctcattgcataattttattttcgtattgtaaagcttgagtgtttttgaggactcaaaacaaacttagtgacatatgaaaaagcaaaaagaatttacatacatcatttctaacgtggaattcttaattatggaacacatcgactgtcatactaagatttaataatattacattatcatggtgcttttggcaaagataatattaaatatattatttatttatttaattttagacagagtcttgctctgtcgcccaggctggagtgcagtggcgcaatattggctcactgcaacctctgccttctgggttcaaatgattctcatgcctcagcctcccgagtagctgggactacaggtatgcaccaccatgcttgactacttttttttttttgtattttttgtagagatagggcttcaccatgctggccaggctggtctcaaactcccgacctcaggtgatccgcctaccccagcctcccaaagtgctcggattatgggtgtgagccactccgcctgggctatttttaatagatgaacatatttagttttcctttgtcatgttagtttatataattagtcataatctgaaatttaattagtcttatccttaaagaatgaaaaaaaaactgttgtagggtacacattaaaaatataaaatttgtatctagaaagtgacaatgtgcctgatagctcttatcacacatacacagacacacccacacatgcttgtgcaaacagatgggtgtgcactatccctttcttgctcactgcactccatctgtccctcccgtgggtggctagaaggcctctgttcccacagagcttggacccctgctgtgcgatactcccagggtcccctggctttgcactgactgtctcttcttggccccttccctgtgacttggccacttagagcatgttaagagagacagttatgagttctattttatattcctgagactttaccaccttggctgttggatttctccctccctcgattttcagctgtgtcctggggcacaaacaggaactcatcctgacacatcccgactgagcctcctcagaatcaaggcacagtcggtcccgctcctgttgttaatcgtaaggaagctgcgaggtgatgagtgctttatgctttgggctcagcacgctacacgaggtgtaaaaccttcagaggggagagggcagatgatcacagaccagtgaatggaaaatatttggctcccatgatgtttctggtgcaaacagatggggtccgaggcactgactgcaggtgacagcccatctggggacttccccaggagtaactcaggaccccaaattacagggcgtcaggaagacggttctcttggttaaaagtggaaaccaaagtctctgctttttgtggaacctgattcctctgagccgccctcttgccctaatgggcacttaccctgtctttgttttctcagggtctcaggcccctggagaggcacaggctgtcctttggatgcttggacacacatgttcaccaaccgtggtgcctgggacccacaggccgaatgcctggaaaaccctcttctgtgcttagggctgccacacggtgtgggcacccacagcattcaaacaactggaatcgcaaaatgctgggctccaggccctggacaggcactgccagccacacactcctcaggcctcaggcactgtctgcccatgtgtcccagggagagggcagaggggagccaccaccttcaagagctgattcgtccacctcggacctgtcttgccacttcccctgactgcggctgctgggcgtggggtctcttgggcccttggcatctcccacctcatgctcctggggaccctctcctccttctgtgcctcatcccaatcagacactcccccgtagatctgcaggatgctcaggtctcactcatttaacaaacacgcagcttcctgagctcccagcctcctccagtgactctctcatctctgtctccttcccagcctggctcttcaagaactcttcatgggacctgtctccattaaagtagctctcacaagggatgatgggctgtgctgcatcccctgccccctcatagtcacatgcagacgtccaagctgccaatacctcaggatgcgaccaggttggaaacagaatcactgcagaaggaactggcagagacgcggtcatgctggagtaggagggccccatccagtagggctggtgtcctcgtgagaagaagaaatgaagggaagatgctgtgaagagacgctgggagctggcgaggagagagacctggacagaaaggtccctggtgccagaaaggttgggggccactgtgttacagatttccttatctcctccatgacagcatcagccacatgatgggacttacgttttaagaggatcactcctacagaggagtgtaattcctaagaaaggcaccagcattcacttgtaggtgaccaaatgttgactaatggttcggaaatacctgagaaacctacaacggtcttaccaaatcagcatccacttcccgcactttgtgttcctgggtgacctttgcctttcttgtttctcctcttctgttttgttctgtagatttgggtgaaatgagagagtcctcacacagatagtccaggttatatttttcatgtgaccacgtgatgagttccattttctgcatcgctggttccatttggtggtttggatgcccaatcgaggagtcggcttggaccttgcctgttgcggcaatctgagagcaaatgaaagctggccaggggagggtgggggagggtggattcaggaatgacattgtagcacatgctgcatgtcaactttgtaaatcagcaaaacagttcgcagataatcaagtggctttggaattaagattcgaagtataattgagggaaagctgcaatttaaataattattatgcaaaaaagcagcatatttaacacaatgattttgcagaggattttgtgttaaaattgttttaattaggaaagatctctgcatctattaaaatactttacaaactgcaaagaaaaactgagataatcatcccctcaaagcttaacatccccctttttctccaccccaaagatacacacctcagtaagaccactggctgtaagatgagagggaaattattttatttgattgaaaaacttatactatacaacataactagggaggacctctctgatatgatggcatttgagcaaaaccttaaagcaagtgaaggaatgtgccacttagtatatttttaattatttacttatttttgagacagagtctcactcactctgtcgcccgggctggagtgcagaggcgattctcctgcctcagcctcctgagtagctgggactacaggcgcacatcaccatgcctggctaatttttgtatttttagtagatacggggtctcaccatgttgcccaggctggtctcgaactcctgagctcaagtgatctgcctgccttggcctcccaaattgccgggattacaggcatgagccaccatgcctggctgtatttattattattatttttcagtcaaggacacaggctctgaggaggaggcctccggagggcccaaggtgcagccaggagagcagagcagctgtaaggcagcgggacaaggctggtggtcggggcagagactatcacgcagactgttgtaagtgggggagccatggaatttcatgtctagaccagggcacctttaagaatgacagagggcgctgttagttttttattttttatttttttctgagatggagtctcgctctgtcacccaggctggagtgcagtggtgtgatctcggctcactgcaacctccgcctcccgggttcaaacgattctcctacctcagcctcgcgagtagctgggattataggtgcgtgccaccacgcctggcaaatttttgtgtttttagtagagatggggtttcaccatgttggccaagctggtctcgaactcctgacctcagatgatccgcctgcctcggcctcccaaagtgctgagattacaggcatgagccactacacccactgggtgctgttattaatcaaacataaactgggcctgacactaggaaactgggacatagatgaacctaaccgtatgggtactggtttcattctgagcgagagaactgggaactctgagccaacacatggcatgacatgtcttctgttttaaaaggatcactctgctgtaggaggcacctgcccaaggcaccattctgtcacgaagccagggccagccagacctgcccactctctcgcctccgcctccgcaatactttattttgtccacggggtgtttgcctggcagccgagtgactcaggccgtgttgctgccatttccttatcgtacctggaaggttttccacccgagccccacagtccggaggcgggggctgggactcccctggggcagagaaacctcctttgcactgtcggaggctgtgtgcctgccttgctggcctggctagatctgtggcacactactactctattcaattcatgtcagtttagtttatggctttacaggcatctctgctagccccgcagcaatctgttctgaaaatcaggtgctctgtgcaggcaacactctcttggaggcctatttctcattattttaaatgggaaaattgagacgccttacatgtgaaccacctcccctccccagctagtgttttgccagatgatggaagcacactgggcaaagcctgctcacttcctgaaataataagaggaaaaaccaggctgtgaaaagacatgagttgccactttgcttttggttgaaagaaaaagggacaggaggagaaacccctatgtgtgtatttacagttgcaggtgctcagagacaggcgagaagctgtccacctggattagcttggaggcatgcgactggagggaggaagactgctaatttaaaaaacatatatttcagtattattgtccttgctacagcaaataggaactatgtaattaaataaaacaatagaatggtttataataaaaataaatatcatgtttggctttatgtcttagttttagagtttgattattgactttataatttttacagtggaatgggtccaattttctttgaaaatatttttgtttctagagttaggaaattgtgacctgtctttaggggagttacattctctatttggctttcttttttcttttcttttctttttttttttttttttttttttgagacggggtctcgctctgttgcccaggctggagtgcagtggcgcaatctcggctcactgcaacctccacctccggggttcaagtgattctcgtgggtcagcctcccgagtacctgggactacaggtgtgcaccaccacacccagctaatttttgtatttttagtagagacggggttttaccatgttggtcaggatggtctagatctcttgacctcgtgactcacccgcctcagcctcccaaagtgctgggattataggcgtgagccacaatgcccggcctattcagctttctactatttgttggctttaacaattaaagcaatctagttactgcacctctgttattttccattcttactacgtttttaaccttcatttatcatacattactcatttccatcgatttctgtcagctcctggctctccactttgtctgatgtatgtttatgcttttgtatcagtgtgatgcatttaccttgtttttctttataataaagttgactatccagtgccatttgtccttccttattgttctcattttattttaatcctaatgactttaacaattatgttttcaagttcaataaataatcctgttgggattttaattgaaattgcgttatctctataaattacctagagcagatttatcatctttccatttaaccagaaacatagtccatttctccatttattcaagtcttttctcatttcttccttttaacactcatagacttcaattttcataaggttcttatacttttcttccatatttagcatatccttgattgttaaaaatacattttgccactttctttaaagtattcatttttatttccttttcatgtcattgtattaccaataatttatattatggcactaattatattaggggcaaaggtcatctacattgtcctttcctttcctgggaagacctatagtatttctccattaagctgtcttgtttaaaaaatatataaaaaagtatagctgtcttgtttaaaataaaacaaaaacactttacatatatatatatatagatatatatgagtatagctgccttgtttaaaaaatacttggtttttcattcattccttcataacatccctgtagactatttttgccagatactgttctgggaaaaggcagtgaacagaagacataaaaatctctgtcttaatcgagcttacatgttattatgctgtgaattaatcttttctatttaaaaattttaaaaataagacgagtaattttatcaaatgccttttatgtatgaacttaaaatgataaggctcacaggtggggaacccagtggagcccactggccaaggacgccacgctgtgggtgtgaaggctccaatcagaaactttaaaataaagctttacacccgataaagaagcagttgggaggctagatgtataatgaaaattgtattttactggaaaggaagcagcccagggcagctgccattgattagttagctgtgcgatttgggcaaatcatcgtatcacagtgggaacttggttagttttcctctctgcagaatggtgcaattgaactagctttattcatttagttatttaaaaataagtatgtatgcctagtagacaatttccagttcctttcagctctggaaactctttgatttacatgtgtcaaatgctggggagggcaatgttaattttttacataatttattccatgattaatgttactttcttaatagaaacacattcaacatagccatctgcctttacattcttttatttgcaaaagctggataagagaaacacgtatgcctgctatctttcagttagcaaatgtgaggtatggagcatttggtcaagttaaggcctattaaaaatttatgcatattgtcaaaaattcttgcacaaatgtgaaaatgaccatctctggagtttgcagtgatttagaaagcagagctactacaatgatcaatctttcccctgaggtccaacactgagcttcaacgggcctcacatttcagactcacaggacagagatttatctgtgtttcatcaagtatgaaaaatatgtggatggaggggtttccagccggtcccccccaagtcatccagccacctccattaatgtcagcaggctcataaatttttcctgcgttctaaagaaagcagcttgtgccactgcacagaagcctccaaaggtggcagttgctgcctataaattcacttacactcaataaaggcaattgactgcacatggacttaattaccatggccctccttgggaaactgaggggctcactatttctcaaaggaggggaggaaaaagtgttatgcgaagcaaggcaacctcttagcggcaccttacaaaatctgatttattcattgatgtttctacttattactgggatagtcttagcagttatcactcaagaccgaagtgtccttcttgattggaaagtattatctcgaattctcctcaggcttgaatcctacaggaacctccccatccaacttccttttttaaaaaaattttattaaaaggaacaatatattactcagcacacaattggctatttcggttctggttactcttctactcagaaaatgggatgcatgctttattttcacctttcttcaatatttacttgtgtagaaaaatgaatacccagagaagaagagagtaccttaggaagagatagaaagattttcccattaaaggcactgtcatccctttctcttcaccgacccatcgttcaaaacctgcgccatcattcacccagcaacccctcctcattgataggagcaggtcattcccttttctaactcaggaatccagaaagcttaggaaaacagacataggagaaaggttagcaaaatgttcagtcatttacatttgaattcacttcttatgtactacttttgaaaagaagtaatcttttacaagtagcaacaagagtgagttgaagaaaaggacaagtttagggtctagaggcaaactctgaagatctcccagccttatttgatcaagtgctaaatgaatatctatcatatttatgaaacacaaaggcctgattgtttctgctcaaagcaacacatacatgttgacatacatctccaaatgacacagaaattaagagcgtgctagaacaaaccgaatggctctatatccaaagaacagctctgtcctctgccgcagatgcgttaagtactgtaaagaatatgactcccaagtcctcttacttccccagctacggtgactgcagcagagatgcagtagatttgaggtcctccactttcccaggatagcaccaattttaatttttttttttttgagatggagtctcactctgtcgcccaggctggggtgcagtggtgcaatctcagctcactgcaacctccacctcctgggttcaagtgattctcctgccaaagcctccttagtagctgggattacaggtgcctgccaccatgcctggctaattttttgtatttttagtagagacgggggtttcatcatgttggccaggctggtctcgaactcctgaccacaggtgatccacccgtcttggcctcccaaagtgctgggattacaggcatgagccaccgtgcccggcccagtgttaatatttttagtggtgtccttcccctctttagagtgattctctgccctggatggcatgcagagggcagcagtgactgcttagcccatgggttcttcaggtcatgccccatcagcagcagtggggagctcgcttatcacttgcattccagtgggatggacagaaaagcacaatagagggtatgctggacccaagggtgcaacctgggacagcctgcgggcccacaaaaagaaaatccattcagcgcatttgccaaagagccccgaatctgtctttcatcatgacttggtgcccggataaaccaagagagcctagagctgctggatgttcttaacttgatttactgtgacgaccgacatcaaaacctgtaatttcacgcgagctgtgcacctgtccctaaggcctcagtgaataatgcctggaccttaagttctcatcccacctcttcctccgttcaacctaatatcttttccaccaaagcaaacagtagaaaaagttattttccttctcatatgagtaacctacacatggttcacatctccacagatcacagctgcttctgagaatttactaaaaatataattacacaaggaattcaaaataatgagcctctaactcacctctctgcatgtgaccatcagtctccctctgtctttctaaaacctcttttttcatgctgaaagtaattcatgctccatgcagaaaacttggactataaagggaaagaatacatacagccatggtcctcagaagatatctattgtgaaccttcaggtggtttcctttgatgtccttagaagtcctcagagagaacaattctgaactttctcttgagaaacaattctagttttacacaatgctcgtgtttcaaaaagtctttactcacccagattgtagttctcaatctgccagtaactaggcaggtttttagccaagttacctgacttttctgagtctgctttgtcatccgtaaaataattggggcaagccacagccagctttctcaaatcccgcaattcttctccttctctctttctcccctcctccatctttttctcttttccttttaactacacagaaccatcactatgctctgcatgaagatgctaagaagtaggagagaggcaattaggagttaggaaagacccaggttcctaggtggcacatagtgagctgcatgactttgtgcaaccaccatctgtttccaacaaaatgacgctgaccacctaccactcctctgcaccacgtggctaaggacattcctgctggcatgttcggaaggaggagacctacttggtgttgtgggaatcagaaacctgaatatgaattccagcctcgcctattatgagccatgagccctgagaaagccactgagcatgtctaagccttgggttcccatgacagcttcctggggcagcccctggtgctgtgcccttgcctggcaggagcagtagagaaatgcaagttcatctgagagaaaggaccagcttttaaagtcgtgactagtgatgggaggtgctgcagtcctgagagctcggagatactagcagggagagtatcaggctggagtggagggaggaacgtgaagacgcgacattctgtccattgcccgaagctctctggacagcgagtatggtcgctctcgctatttgtggattagctctcaaattcaactggcatctactgggaagatgacagacaaggaatctggaggtctccccaggtcccacaagccttcgaacgacaaagctgaactcgcagaactgtacactgaaaggggagaattttactgcatttaagctgtatcttaatttttaaaatgaaaacaaaaatataacgaagcatttcaagacctcctccagaaagaatgtgcatttgctggcaatctggaggcatggtgctcacctgccctggagactcaagcacattgcgtgctgtttttttttaatttttagtttgtctgccctgttattatcccctcagctgcatgcccacccccaccactggcagcccttgctctccgcgcctccaccaccagccagcctctccttttgtaggtcggcaatgcagcattttgactgtgggagccacagaagctgtgtacagctgtgaatacaaaggccccagactccagaataaaaatatggggtactatggatatgggaaacatccaaattgcaagtcatttatctgagaatctgatggacttcctataggtttaacatgattactgagggtgtatcttgtgccacatattgttctaagggctttatacttacaaatctatattactctacctatgaggtaggtactattactacccctacctcatttttaagatgaggaaacagaggcacagagaggttaagaaactggctcaaggtcacgcagcccgcaagtgatagagccgggatttgaacccaggcagcctggctctagggcctctgcccctctgcatgtgtgtggcatttgcaatgcatttgttgattagagatgcagaagacaccatcacatcacaagactgaaagtggtggctggtctacaccctcaatcaggctcacctgctgaggaccccgataacctcaagcccccgagttttcccaggccacctcacttctgactgattatgtgttggcttaaaagatggaatgtggctacctaatttacatcactttcagattcctcaagcttacgtgagttaaaaggagtctgctaaaatcagactagcaatgcccctcggccactgccagagctggcacctgatgggagtggggtagagggtgggtgtttacctccctctgcactgaagaatgagctggatgtcaggcatattttcaacaaattaagtaacaagcgtaggtggcggagaaatggcaatgctccacgatggtgcaatttggaattttcaattggaaagatcctgaggcctagaatcagtcccagggtccagagatgacagccactcaggtggctccaaagcccgtggggagatgaggagaggctgctgcatcttcagtggcaggagcccgcagtcccaaggctggctgtgggccaggcagcccacctgggcttcaggcttctctgttatcacaccaaggggctggatgaagttacaaccaagacccctttacgatactttaacatgaagcttattgatacatcctgagacctagacggcagttcaagccatgagaaataccaatcagagcaagatgttttctgacaacaagtgtacccatgactgctttgtccaatatgggagccactagcaacaaggggccatctaagcttaaactaaaatgaaataagatgaaatgaaattaaaaattcagatcctcagtcaccccagccacctttcaagtgttcagttgccacatgtggccagaggctaccacaccagacactgaacatcaaacacgtttccaccactgcaaagtcctattgcacagccctggtctggacaaatacaaacgtctataatttcttccttcattatgaacgctattcatgaatgaaagcgattatggcgctcatctcatagagctgttgagagttgtagtagacactgaataatgatccctaaagatactgagtgctaatccccagggtctgtaaatggtatcatatatggaaaaaggggttttgtaggcgtgattaagatccatgagagggggagatgattgtggattagccaagtatgtcctaaatgcagtcctaagtgtcctataagagagaggtagaaggagattagacgcacatagaagaggacaaggtgatgtgaccacagaagcagagaacagagcgatgtggccacaagccaaggaatgctggaagcccccagaagctggcagaggcaaggaagggagcttctggagggagtacagccctgccagcaccttgatgtcagtctcctgacctgtgaactgggagaaaataaatttctattgttttaagccaccaagttggtgtcatttgttacaattcaatagcaaaccaataatagggttaaattagttaatgtataaagcacttcaaattcctggtatagaattatagaatgagtgctcagtaattgtgagtctctattattattattattgttgaatacacatctaacatgtccaaccaccaaaatggttctaattacaaaggaggccaggggcggggtacagggaaggagcccacacttgagttgtgactctgggagtaggaggtagggccgaaggtttaagtagagggcatcagtgtttgcttgatgaacaactaaagcatctccaaacccaaatcatgttccttaaattgcaatatttgacaaaaatcgctatttcaaattgttcatccagtacaaagaaaaataaacacaactatcacacaatctagaaaattctaggcctgtagagcttaagtgtgaagcaagagaaaacacaccagagtgggggcaggaagtaaaatccaagtgaattaactaaaaaactacaagaactaatgtgagaattcacttagggatgcacaaactatatacaagtatgcaaccaataataaggaaaatatttgaagaaaacctcattcaaaacagcaaatgtacatataaaatgcataaccccaataagtaatttgtggggcccaagtattttattggcatcacctcatttgaccccacagcatcagagaagtgatgcccaggtgctcccagccagcaagggggcattcgctggcagaaaatgggcaatgggctgctggggacagtatcatttttcttactgttgctttctttctctctctttctggctttcctataagtcagttagaaaaaaaaaggccaggcatggtggcttacgcctgtaatcccagcactttgggaggccgaggcagatggattacctgaggtcaggagtttgagaccagctggccaacatggtgaaaccctgtctctactaaaaatacaaaaattagctgggcatggtggcgggtgcctgtaatcctggctactcgggaggctgaagcaagagaatttcttgaacccaggagttggaggttgtagtcagccgagatcgcaccgtcgcactccagcctgggcgacagagtaagactgaggctcaaaaaacaaaaaaaggcaaatgataaactgagaagtcactattacaataattcaaaaagctttagcatctgtaatacatatataactacattttagagatcacttaaagaaaagaaaaaaacacccaaaagggaagcccataaatgactgggcattttacaatgcttgcaacgaagaaaccaaaagattatttaacctccctattaatacaacacatacaaattaaaagatgactgagaaaccatttttcttttatcaatttggtaaaatatttaaaaagatcataatcaattaattaactagtgcatccatgcaatcgaaagtgaggccatcaaaacaaagatagttctccttggatgaatattttaaggacaagcgaaatctcaatgttaaatttttacaaattggagaaagaattcctaaaactgtaattaaaaaatatgtatacgtatatatgtatacgtatacgtatacatgtatacatgtatacgtatacgtatacgtatacatgtatacgtatatatgtgtatacatacgtatatacgtatacgtatacatatatacgtatataagtatatacatacgtatatacgtatatacgtatatatgtatatacatacgtatatacgtatatatgtatatacatatatacatatatacgtatatatatgagagaaaaggactggaaggaaatttatcaaaaaatttcatggtagctatctctatatcctcacagatgattttaattttcctctttaagctctatcttgcgaatgttctacaacgaacattacttttaacattgggaaaaaaacttcatatacaataacgtaagaattgacttaaaaaacaaccccttatgacaactataagtgctgactcaatgagataagcataaggattccaaatcgtgggaatgcatattaagtgcaacttttaagaatttgttgagccatcattgtgtgtcctattggaatttatcctgaggactgaccgtgtttcatgtttcaaaaaacaatatttgctttttatttgcctttgatttaaaaaagcaaggaaacggattttatcaaagtcaatcagataagtgtaatccaattaaggaaaataaattcacccttgaccttccattacttcaaaaagaggcatttttacatctttgtgaagtctgcacagcacacccacgaggacgactctaactggactccaaactgtcaggtcaaggacaccagataaagtgttctcaagggacaggccggtgagggctggatcttcaaagggcgtccataaacgctgggacaacggagagcgtgctcccaggatgatatccagagctgctcctgtctcccatgaccctgccaggacctcaggtggggaagcaactcacatccacggccagccccgtctccttgcccttttgtcaaaagatggttgccacgggtgcccaaggtattatactcattgatgtttctaaaatcagggtgtcttaaaaatgtaaaatcaacccaaatagatggcctttctttgtcctcatattttttaatgagggtttctattataaaaataacacttattttttctactttaaacagtacagaaaaatatgaaacaaaaagtaaccccaccactctagcggctagaagtagccatgctgacagtttctagtgtatccttcctgaaatttccatccatctgcaaatacatatttattttatttatttattttttgagacagagtctcgctctgtcttccaggagggaatacagtggtgaattctcggctcactgcaacctccacctcccaggttcaagcaatcctctcacttcaacctcccgagtagctgggattacaggcgtccgccaccatgtcaagctaatttttgtatttttagtagagacggggtttcaccatgttggcccaggctggtctcgaactcctgacctcaggtgatctgcctgcctcagcctctcaaagtatagggattacaggtgtcagccaccgtgcctggactgcaaacatagatttagtaagttaaatgtgtttgtgaatatatacaatacatatattttagcatatttggggttacagttgtacatagtgctttcaacttggttttgccacttaataataaattagattttaccctggctgtatgaaactaaagaatcatttcatttacagaaaatatatttttgaatacctattctctgacacacgagaaaatggggaaagtttcggataagggaaattcatgaacattgagcacacagcatataatccttgttaattatggaaaggaaagttttaggtgtaaaccaaagtgatttaatcagaagatttaattcttttgaaacaatgcctttctacctgcatttccatgattgcaactgcacaaaatcatcccaagtatattttctccagacccaattatgtaattgaataagaatgaaaaactgtaataccattggcttgcaccattcactgcttattcatgaaatttatataccagtttcatcctagtaccaggcacagtcttaatgggacttgcagtttacatgagagagggggcatctgagtgagcagtggttacagcctggagaaatgacagtggcccacactttgaggtctcagcacccttcatctgttcacaactccatgaaacagggacaattcttgtccttatatcacagatgaggaaactgacgcacagagaagctaaatgacttgcccaagcttacacagctattttgtgggaagcaatggctccagtttgcattcctaatcattgtgccaaactgcctggaggagcaaagtggaggggctctcagagctcaaggaggagacagaaggaacctgggagggaacagtcagggggctttcataacaaagcactatcaacttgaacaacaaagtagtggggcagcacggtgagggaaggaaagagaggagtgagggtggggaccctgagcccttgggccccatcctgtaagggcctcggtcaaagagcggggtgaatgttgagaccctagcagaagccctggggtggctgagaacttcgaggcggtgctcatcttcccacctgggcagcatggtgtggggctgatggtagcaaaatggaggggacctgctggataggcccctgagacctgggcctggtaccacctatgctcatgggggagaaccagcagccagcagagccgggctcagacccaagaggcttggattgtgggtggccagtgcctggggacacgtggcagaaaccatgggctgcaaaggaagtccccaacagaccaggtgggccgtaccagtgcagccataccacatggctgtagaaacccaccaggcgccgggtgcggtggctcatgcctgtaatcccagaactttgggaggtcgaggcgggtggatcacttgaggtcaggagtttgagaccagtctggccaacatggtgaaaccctgtctctactaaaaatataaaattaggctggtatagtggtatgcacctgtaatcccagctactcgggaggctgaggcagaagaatcgcttaaacttgggcggcggaggttgcagtgagccgagatcacatcactgcactccagcctgggtgacacagcgagaccctgcctcaaaaacaaacaaacaaacaaacaaaaaaccaccagggtatgaaacggtgtgcctggcactctttgccccagccgacagctgttggtgtaatttccttttacagtcagatgcagtaaggagaagaaaaatggggcaagattcttgaaagagagacatttaaattgacttcaaatttccccatgagagacagttaacatgaaagagactactttaaatcagaagagacagagtcacctataattggcaaatgcaagtcttccctcccccactgctttttaaaattatttatttattgtcttttttactgtgagccatttttggtgaagatgcaagtcttataccacgagcaggagtgggagtctgagaacgatggtagcacgggaaaactgggttttggtattctgggtaacagaatatggtattttaaagaacgaaagcattggcatttttgctgatatactaacattactatgatatatttctaacagctttatgaaggcctgagtgatatataataaactgatcatatttcaaggatagaattttataagttttgacaaatgtatgctctcatgaaaccatccccagaaagcaaggagaaaagggatggagaaagaggggtatgtgcacatcaatactgtctgctcaattaacagcagccctctgtctccattcatcactaacagtacagaatttacacaacatcaaattcctcattttaaataccccttcattcaaaatatcccattttgctataaaatatacctgataaataagacatggaaagaaaacctcacaaatgtaatcaattctgaatttttaaaagtcatcacttttaaaattgtattgtaggaaaagatggaactctcagtcaaaaacatgtcattgaagcaaacattcgtaaagaaactttgatataaaattgaagtattattgaggagatagtgtattaggatcccacataaagttaacacaagaagtttatagtagtttaggtttttgtaaatcactgtaaaagtaattgatatgtattagatatctattgctgcataacaagtcactccgagccttagcagcttgaaacaacaaacacatattgtgtcatggtttctgggtggggaaccagatgtggctcagctgggcgcctctgcttcaaggtctctcacaaggctgccatgaaagtgctggcgaagactgtggtctcatctgatggctcacctgggtcgaggggatccacttccaagtctatgcctgtggttggtgggcagcacttagttctcaggctgctggagggggccctcagcttctcactggctgttgcctgggagcctcctccagctccctgccttgtgggcctctccactgggcagctgacacaatggtcgctgactctgagccagcaagggagaaggcaaatgagagagcaggaaaggtgagcaggatgaaagtgatatcccatcactctagccgtatccttgtctttggaagtgttactaggtatagctcacacttcaggggagggatcactggaggccagcttagaggctgcctgccacagatatcttttaatagaatctttttgagagaaagtttgatttttctattgccaacatttaaattctctggtcctaaccacagttggcgtcagagcatcttgagacctgaagtgatatgatgcaataccccatcaagaaaacagatgggcaagcttgccttctatggctcctgggactgatcataacaatctgccctcttttcttcccttcttgaaataaaattgatttaaaatctcttctaattaggttaccatcaaagtgttctgctgtgtagaaaaattctctgatgaataccttttacaaaccatcttttgtaaacaagttttaactcatttaacatttcatttaagaacattaaagaacacccttaaatatgaatacgcctggagccttgtctccaaaactacctatctacccatctgataaagtttggatgccccctccaaatctcatgttgaaatgtgatccccagtgttggaggtggagcctggtgggaggtgtctgggtcatgggggtggatccctcatggcctggtgctgtccttgctatagtgagtgagttcttgcaagatctggttgtttaaaagtatgtggcaccaccccctgccgccaaccccgcactctctctttggctcttgctcttgccatttgacgtgccttctcctgcatcaccttctgccgtgagttgagttaaagctccctgaggcaaacaggagcagataccagcatcatgcttcctgtaaagcttgtagagccttgagccaattaagtttcttttccttagaaattatccagcctcagatatttctttatagcaatgcaagaaccacctaacacaccatcattcaaggagacctggtggccaggtgtctagtcccaggaatcagcagctgcctcaaaggattatgaccgagagggaccatgattgagaatctcaagcttcttacaagtagagaggctggctagatgccagaagggaaggttatttctgggtcccctgacttttggacagacctggcctgtgaagtcctgccatccttgggctatgtcatgcacccattatattccaagccatgtggtcacataggcactatgtgggccgtttttccatatttaaaaaaattaatttctgaattcttagccttggcatttcacgtttctaaaacgaagccgagaaacctcatgactctatatcaatatgcttctgtgcttaaaaacatacaataacctcagccactaaagaacagactggatatgtcacgatgtagctcatgttcacctgcattcgatgaaccaatgccggatctggtcttgaaggttctccttgatatccacgccttctatcaactttaggtcattcttgatggtaaccagggcttccctgtagtcctcttcatgctttatctgcacctcattccgcaggcggtccaccttttcagcctggattactgtagcactgacttcattaaagagaggaggtggattctgaaaatatatacaagcaacaaggtttgaggtcataaaagttacagagttggtaaaaatatcagaaactgaacaaatgtgttaatatcttccatagtgtctagcaaaggcaaataagaaatacaagcatccagaggaagcaaagctaactgagtgcatttactcagtgtatttaatccaaagtccctgacataatgctttatgttcttttgttttgaagttttcagcttcagtatgtttgaggtttctctcctgtcaacaacatagatctggattaaaaaaactcaatctgagaattatagaaaagaaaaattttattcattgtacagaagaaacatttggagataatcttctcaagttttttatctaacacactttcttgttttttttttcttcctttcctaccttctgttggatttatgtagttttgttcattcttgtcatgcagtggtttaaaaattatacatcttattttaatcttctactggttatcttaaaattttaacatgttacttaacatctacatttctatctgtctagaatttatcataatctagagcttctttgaacaagtataggacctacgcatgtgttcacttttcttcccacaacctctcgttttataatatcatagactgcaattaattttgaaaagcaagatatgtttacatttaattatgagatgttctggtttctctgtttaccctttgcattagtccatttttgcactgccgtaaaagaatactggagggtgggtaatttataaggaaaagaagtttattttggctcacagttctgcaggctgtatgagaagcatggtgccagcatctgcttggcttctggcgaggcctcaggaagcttacaatcatgatggaaggtgacagggagccagtgtctcacgtggtgaaagggagcaagagataaagaaggggaggtcccagacttgtataaacaaccagatcttgtgtgaactgagagaattcactcatcaccaaggggatggtgctaagccattcatgagagatctgcccccaagatccatcacctcccactaggctccacctccaacactgggaatcacatttcagcatgagatttggaggggacaaacatccaaaccatataacccttttcttcttttttgtattcagttttcattttgctgaagtatgtccttgagtgtaactttcagaatgaatatgtacagccataaatattataaggactagcatttctaaagatgtcttcatttggcccctcccacttgaatggcattttggtagttcccttgaggaattctacttctaatatgtagagtttccagttccttttttgcaaatttaattgttgttcctttgcaaataagctgtttcctccctgaaagtgtttataatgctttactctcaagagttttgaaagtccatcaaaatgtatgtaggtgtaggcatttcttcattcattgtattctcctttggtaggtctatacaatataaagaattgccttcaactcttcaagttttctttctattatttctttttctccatttccttgtctgcaataaacattagataaatgccagagcaccagattgatctttcatgactctgagcttttatattttccatttgtctatttgcactaggtgatagtgcaaataggagaaaaaaaatcactatggtatggtgcaaataggagatttctttagctttatcttccagaaacaatttgactttcagttacgtgtatcatttggattatttaaattttgcagtggttattgttttaatttttggcatactcttatattcccagaatagtttcttattttatacttgtgccttccttattttttgtggtcactatggcgaacactgttgtgcttctggtcattagggcagcctgcaccaatagctaagtgggtgaaatccaggaatactagggagctctggagtaaagaaatgtccaagggtaagagaacaacattaaagtccattttgaaagctgtgaaacaagaatatggcaacattcaagaccctgtttagaaaagacattagcaaaactataaacttagatcaattacttggaaaaaaacattatcttaaagattcaattcatgtcataaactaaaataaattttaaacgaattagttaaatgtaacacaaatgtacacacacatatacacacactctctaagaaatacctatgaacctctggaggtggaagggatttcacaatgaagatgtcattaaaatacagtgtccactcaccccataaaatcagttaaaagagaaaaggaaaccacatatatcatactttgtaaatatatgcattagaaaatcctaaggaatttgagccaattttctaagtttagtaaaatgagaacatataacttttcttttttggagacaaggtctcactctgtcacccagtctggagtacaatggcacaatctcagctgaacctctgcctcccgggcccaagtggtcctcccacctcagcctcccaagtagcgggagtacaggtgcacaccaccacacctgggtaattttttgtactttttgtagagatggggtcttgccatgttgcctaggctggtcttgaactcctagactcaggcaactcgcctgtctctgcctcttaaagtgatgggatcacaggggtgaacgaccatgcccggctgagaacatacaacttttatgatgctagaaaaaaacccctaaaaattactttttaaagtaatataaaagcgaatatggaatgagaattacagaatcattttaaagaacaatgttaaaaacaaatgatcattaattgccccaataaaggtactcaaaagcatgacttttctttatattatgtattttgtgtcaaaactgaacagtaggaatttcctttatataatcattaaaaatatccaattcttatgtcgtccaggtaatgtttttcattcctcgtgcttacatcttaagtgtgtaagacagaagcataaattcatatagagactttaatctctccaatggctaatttagttttcacggagatgttaaaatggatatctgcaataaatgactcaaatttctttttgcctctgatgaaagtgtaaaattgttttgaagtcttgtattaataatgtcacaattatctactgtataatgtatcatctgatgttgcttttctccaaattacgttgttcctgttgctatttgaagatttccttcatagatgtttacagacaaactatattttacctgagtcttttctcctttcatccctaaaaatgaatgaatgagcaggtgactttgatttgtgtcttgtcaacagccctatacgaagtgtccaagaaacttcctaacacttccacaatccatgagtgcaacaaaacactcagctgtcattggattttcctgatagccccttggcatggttcccatcttacatattcctgtaccgcgtttctttattcatgtccacatctatttttattttacttttatttatttatttagtttttgagacggagtctcactctgttgcccaggctggagtgcagtggcgcgatctcagctcactgcaacctccatctcccgagttcaagtgattctcctgcctcagcctcctgagtagctgggactataggagtgcaccaccatgcccagctaatttttgtatttttagtagagacagggtttcaccatgttggtcacacatctgttatttgaggtaagaatgaagacatgactatcccacttaacagatgaggaaacagaggttcagaactcagtgactttcccgtcattccatgttaatgaagaatccagcagtgaggcttcccggctcctttagtgctgtgtttctcctattacaccatgctgtgctgttagtatgtgtgtattcatgcatgtttcttgatatagactttctctgacaaaaatacatttgggtaatttgtggctcctttctccggttgcttttgaatttaaaggttataacatatttaggtcctatgttaatgagcagcttttcctttgggctaaaacatcttttcctctttagcaactttggtcatgtggaattcaaatttgttaactcactgcataaacagcaactcatttaaaaataaattacaaatattaaaggaagatagagaacacgatagtatgctatatattgaaatacatcagctgtagaataatgcatcttaatgaaggcttcccatgtgaataaaccattatatttacaagctttccatagttaatgacccagaactggataacgaaacctacatttatagcaaggtcctccgtcagcaaaaatatacatattaataattgatgttgctgtaaaaataggacataatgtgatgcctcctgagtttgcggggaaataggactacatggtccattaacttaaaatgcttatctaatgtttgatgggctttgtctttaaaaatccttcttcaaattagtaagagaaaatggacatttgtccaaatgaaagtctgctcaatttatcagctgcaaatatacttgcaaataagtgactgaatgctgttaactttctggggcagctcgctgtcttgccggagtgtgctcttcgtggcgctttgttgttaccaaaggtgaagaaggagcagggtagacatctattcccagcaaatgaccatcctgtgaaatttctcgccatcgtcaatgcagagattgatgagcaccacggcccccctggacacctcagtgttcattaggaagcacttagaggcgcgtgttcggtcagatcattgggctcgccacatgccctgggtctaattttgcacatggaagacctcacgctgcggaatgcaccgctcctcagtcggttcatttcaagatcatgcgaagagggaggtgttctttagtttgttaaaatcagccattttgtttcatcatttcatttcagagtaatatatctatatttatgtatctgtgtttatacaatatacctactcataaagatgaacccagcaggagaagtgaaaaaagatagtacagatagctagagctgatggtttgcttttgccctctgctcagagtaaagttatggtaaatctttatctcagatgcaacaattttagtgggcacaaaactattaaagaataaaaaatgttctagcctgttaagcctaatttctaaaaaaaattttagtatataaaaaaattgctttattaggaactgggttataagaggtctagttgtgcttataattaaatagtggtgggcttttcatctgttacttttgtgcactactttctttaaaaatatattaaacactttgatggcatttatggtttgctaggcactattttaagtggttgaaaagtattaactcccttacttctcaacacagccttatgctactaggtagcattactatcttcatcttatatatgagaaaatcgaggtacacagaagtcaaggaacttgtccagggtcacacagccaggaagtggctggggctttggcctgaggcatctatttctggagtctctgttcttactctccgtgctttgctgtctctctctgctgataggtttcctctgacttaaaaaaaaacacttttgggtactatagaccatacttttataaaaaatgtgcatttgtaattgtaatactgctgaactaccttgcaaagaggttggactatttactctcccctcacaagaagtgcatgacaatatctgtgcttctataccttgccaacactgtaacgttaacttttttgatatttgctaacttaaataggtaaaagatggcaatttaagaaggacttttgaattatgaatgatgtgagcatctaaatgcatgattataagctatttaaaaaattaatagctaacacttacgtagtgcttactgcatgctactactgccagacactagtttaaatcccttacagacagcagtttctttaatgcttaacacaaatctatgagctaggcgttattactacctccattttgcatgtatagaaactgtgacacaaaggggtcaaggtgccagcccaagttcacacagctagaaaacagtcggattggaatctgaacccaggcaggttggctccagggttcttgaccttaacggctttaatctgatgcattagagcactttgcaatgagccctcatattagataagtaaacacagatgtcctgccctagaatgtagacaaaagattcctgggctcaggggacaaacaggagggtaaggaagagaattattttcatcatttagtctctgatgatctggagacctgagacaagaataaaactgcatcccaatacaaagaaaaaactaaaaataaaaccagaggttcccaagtaactagattgcaaaatcccacgtaatagaaaagaaaatggtgacttttcctttttttccccaaagcctcctagagtggccttttgaaaccacagatgcttccaggcgtccttcttgaaattctaatctcctcactcaggtgtctgatggccctgaagacacagttgtataggatgcactgcttgtgtttgcaaactttttgctggtgcaacaacacaagctgtgtgcacaggtagcaccatttttgcctccacaattcccccctgcagctagctatggtagacgcaggtgagatttaaaccctatgggctactccaaaccctttgctttacaggatcatatttttaacagactacattttcagttcataacttcagcagtatatgatgacaaaggccaggacgttttatagttgaaactcagttgcacatgtattttacacaacaatctatttattttgaatagtttgtgttttgttgcatgaaaagttatagttgttgatagttttccactgtataaaatcagtcagatatcgtgacaacatactataatttttcaagataattaatatcagccagcattccataatggcatatcctatcccaagctccaggctagaccattttccttcaatctgtcataagggcctcctaacagcatctctgtgaaataggtagcactctccagcccctacagaagaagaaactgaggctcactggttaagtatgtcactcaaaatccttccattggcaaactgcagagctgggctttgagcctagctctgtctgcctgggaagcgcacactcccaactgtcccccaatcccatgcctggttctccctcaatgcaggggagcaggccttcaaagctggtgcctggaaactcacactcgtttccaaggtgctgcttccttcccaggacatgtagggaacagcccttttgcatttaaaaagtgtaacaaaacaaaaccaaagccaaacaaaatcccacaaatcacagcaaatgtattttttgagaataatatttttttaaataaaaataatcaaagatcatctgcagcaaatatgatgaataatgcacatgaccaagctagactacatagtttcatttcattttgaaatgaaagtgtgatcatcaaagagcatttcatttagattctttgctcactttggctttgacagcaattcccaaagaggaaccccatgttctgagggcaacaaaagcacaattacaatatgcacagagctttcccaaacagagtctcgggagagggccacgctcatttgggcgcccaagctcgtacttgaggttagttgttaataagaaagaaattgaatgtattggccaaaaaataatttagaatacagcttgcctcacgttagaatgggaaagtgaacagggttttacgatgcttttaggattcagtagatgcgtttaaaagtgacaggtcttcctctttaataagtgtttccccagtgttctttattataatgcaaacactgatagcttcagggtaacataaaatatatgatggtcatgactgtaggacaaattatttcaaagggatccacaaaatgaaatgtattacaatcattaagtttccttctacttgatccactccattggctctgccaattaaaataactgcacataaatttttagagtgctatttatttttctttgtagattttagaatataaatatttaaaatgacaatatccaaaaaaaaaaaaatttatatgacaatggtaagagaaacattcggtcaggaattgaatgcatgatgatgtctcttgctctaattctggtttcagttactaaatagtcactcctagaaatatgccaagcatctcctaaagatacaaatatggttttgatcagataagtcaatgatttctacattggtatagtgcaacaaaatgaaatcataaaaaataaattttaaaatgagtaggtaatatcttaaccagtgatatagtggaaaatatattcaattgcaaacatttctttgatttagggtgatagattttggatttttaaaaatggtttccagccagtgaacagaagacaacattcttttaaaaactgaatccatatatctctcaatggtgtacaatttcaatagaatatgtaatgccaagtgaagacacactcaaaaaaaaagcaaactgaagaaagtcacattgaatacaaaacagacgttattctctttatactattcaaactgtattgctgaaaaaattaatacaaacttcattcatttgagctgagtacatgtaaactacaaagtaacactaaaataaagttaaaagcatgtaattctatctttgtatggtatcagtgtaagctagtaagactttagcatgaacaaactgtgtttagccattgcctaagtttctggtgtgtggcacagcataggtgttcagtaaatgtagactgaattaaataaaatggaactctaattaaatagaagttgttgaatcccaactgattctaaagtaaaatttcatgttaaacttagactgtactagattaaatcttttgacttctaatttaatttttaaagtagaaaactggacataacaattgtttttatcattacattctatatccatgtgtattttacgggtgttgaacagagaaatactgacatatcatcatgtacctacctatccatatacaccaaacaatctggagatcttaggggaaaaatttatgaaactctactgccatttaatattactttttttgttttgtaaaatgtagtactatttatttttaaaaatgaatgcataatagatatacatattttcagggtatacgtgatatttggatatatttatgtaatgtgtaatgatcaaattagggtaattggactatccatcatctcaaatatttatcttttctttatgctgggaacattcaaatcctactcttttagctatttagaaatatacaattgattattgttaactatactcactttattgaactattaaacactagatcttattccttctatagaactgtatttttctacccattaatcaatctctcttcatttcccctcacccacctgcccttccagtcctctggtaaccaccaatctattctgtatcttcaggagatccacttttttagctcccacgtacaagtgagaatatgtgatttttgtttttctgtgctggcttatttcatttaacataatgacctcctgttccattcatgtctgcaaatgacaggatttcattactttttatggctgaataatattccattgtgtatatacataccacacttttctttattcacttatctgttaataggcacttagggtgattccatatcttggctattgtgaatagtgctgcaacaggcatgcaagtgcagatatctcttcaatgtattggtctcctttctttttgatatgcactcaatagtgagattgctggatcatacggtattaggttggtgcaaaagtaattgtggtttttgccattactgttaatggttctatcagcctaatagttctatttttagtcttctgaggaacttccatactgttttccatagtggctaatttgcattcccaccaacagtgcacaagcgttcctttttctccacattcttgccggaatccattattttttgtcttgttgataataatgtactttgatttgattttgtatatggtgagatataggggtctagctttaatcttctgcatatggttatccagtttttctagcatcatttattgaagagactgtcctttctccaatgtaggttcttggagtctttgtcgaaaataaattggctgtaaatgcatggatttatttcagggttttcagttctgttccactggtctgtgtgtctgttttcaggccagtatcatgctgttttggttactaccgttttgtagtatattttgaagtcaggtggtgtatgtaatacctccagctttgttctttttgctcaggattgtttgggctattcagtgtctcttgtggttctataggaattttagaattttttttctatttttgtgaagaatatcattttgatagagattgcactaaatctgtaaatttcttgggtagtattcatattttaacagtattaattcttccaatccatgagcatggaatatcattccattttttgtgtcctctccaattttttcatcagtgttttatagttttccttgtagaaatctttcacatctttggtttaaattattcctaggtgtttcatattttttgtagctactgtaaatgggattacttttttgaattttttttagatttttcactgtttgctatagaaatgctactgatttttgcatgctggtttgtgacctgtaactttactgaattcatttataaattctcacagtttttttatggaatctttaggttttcctagctataagatcacatcatctgcaaaaaaggctaatttgacttcttcctttccaattctgatgtctttgatttctctcttttgccaaattactctggctaggacttccagtattatgttgaataaaagttgtgagagtgggcatccttgtcctgcatgtttcatgtttattgatttgtgtatgttgaaccattcttgcatccctgggatgaatcccactaggtcatggtgaatgacctttctttttttttcctgattgtattttttttaaattgtaatttccagggtatatgtgcaggatgtgcaggtttgttacataggtaaatgtgtgccatggtggtttgctgcacctatcaacccatcacctaggtatgaagccccacatgcattagctatttttcttgatgctctccctccaccggccctccacctccaacaggccccggtgtgtgttgtttccctccctgtgtccatgtgttctccttgttgtgaatgatctttttaaagcattgttgaatttggttttttagtgttttgttgaggatttctccatctatgttcactggggatgttggccggtagttttctttttttgttgtgtctatgtctggctttggtaccagaccttatagaatgagtttgaaagtacaaatgacccttgaacaacatgggggttaggagtgctggtgacacacacagtaaaaaaatctacaaatagcatttgactccccaaaacttaactactaataactggttgatcagatgccttactgataacataaacagtccattaacacatattttatatattacatgtattacatactgtattcttacaatgaagtaagcgagaaaaaagaaaatgttattaaaatcataagaaagagaagattatttactgctcactaagtagaagtgcatcatcataaaagttttcatcctcactgtcttcaaattgagtaggctaaggagaaggagaaagaggagaggttggtcttgctgtcttaagggtggcagaggcagaagaaaaatctgcttataagtgggcccatgcagttcaaacctgtgtggttcaagtgtcacctggtcttttcttctccttaattttttttaatagtttgagtagtattggtattagttctttaaatgtttgatggaatttggtagggaatccatcaggtcctgggcttttctttgatgggaggctttttattattgattcaatctcattagtcatcattggtctgttcaggttttctgtttcttcatggttcaattttggtaggttgtacatgtccagaaatttatctgtttcttaaaggctttccaaattgttggtgtacagtttttttgtcatagtttctaacgatcctatatatttctgtggtatcgttgttaagtctcctcttaaatgtctgatttcctttattttggtcttctctcttttttcctcctagttagtctagctaaaagtctgttaattttgttatcttttcaaaaactcaacttttcgttttgttgatttgtgtgtgtgtgtgtgtgtgtgtgtgttttagtctcaatttcatttatttctgctctgatctttatttctttcctttcactaattttgggtttgatttctccttgcttttctagtaccttgagatgcactattaggttgtttgagctctttctgtttttctgatgtaggcctttatttgctataaacatttcccttagtgctgcttttgttatagcccatagattttcatatgttggtttcaattttcatttgtttcaggaacttttaaaattttcctcttaatttcttcattgacccattggtcattcaggagcatgttgtttaatttccatgtttgtataatttccaagttttctcttgttattgatttctagttttattccattgtcatcagaaaaaatacttgatatgatttcaaatttttaaaatttgttttgtggcctaacacgtactatattctggagactattccatgtgctgatgagcaaaatgtgtattctgcagcagttgggtaaaatattctgtaaatgtcagttaggtccatttggtctagtgtgtagcttaattctcatgtttctttgttgattttctgtctggatgatctgtccactactgagaatggggtgttgaagctacctactattattgtattgcagtatatctctccctttaggttgatttaatgtctgctttatatttgggtgctctgatgttggtttcagatatatttataattattatattatcttgctgaattgacccctttatcattatatagtagcctttttgggttcttttttttttacaatccttggtttgtagtcttttttttttttgagatggagtcttgctctgtcacccaggctggagtgcagtggtgtgatctcggctcactacagccaccaccacccaggttcaagcgagtgtcctgcctcagcctctcaagtagctgggactacaggcatctgccaccgcatctggctaatttttgtatttttagtagaggcggggtttcaacatgttggccaagctggtcttgaactcctgacctcaaatgatccacgcaccttggcctcccaaagtgctgggattacaggcgtgagccactgcacctggccagtttgtagtctattttatctaatagaagtatacatattcctgtcctttttttccatttgcatggaatatcttattccattcctttctttaagtccatgtgtgtctttataggtgaaactggcttcctgtaggcagcatatggttggatcttttaatttttaaaatccattcagccactctctatcacttaattggagaattaagtccatttacataaaatgttatttttgataggtaagaatgtactactgccatttacatttttttttctggttgtttgtaatttcttcctttcttatactcttcctttgtgtttaggtgattttctctggcaatatattttaattaattgcttttttatttttagtatatctatcataggttgttgctttatggttatcatgaggcttacaacaagtcatataagttattttaaaaagatgaggacttacctttgatcacaaagaaaggcatagaaacaaaggaaaaactaaaacaactacactttatctcccccacattttgactttttgttgtctcaatttacatctttttatattacttgtctcttaacaatctgctgtagttactgttaattttgatagtcttttagtcttactagagatatgagtggattacacaccacaattacagtattagagtaatttggctttgtctgtatgcttacttttatcagtggcttttagatctttaaatgttttctttctgcatgttagtgtctttttctttcagactgaagaactccctttagcatttcttgttagatgggtctggcagtgatgaattccctcaaattttgtttgtctgggaaacactttatctcttcttcatgtttgaagttcagctttgttgcgtgcagtattcttggttgacaggttttttttttttttttcctttcagaacttaataaatatgtttttctactacctcctggcctgtatggtttcctttgataagtctgttaccaaactggagctccattatatgttatttgcttcttttctcttgttgcttttagaatcccattgctgtccttgacttttgagagtttattatataccttgggatagtcttatttgggttgaatctgtttggtgatctctaaccttcctatacttggatatttttatctttctctaggtttgaaatgttttctgttattatttatttgaataaggcttctaccctttctcaactccctcttgaataccaatgattcttagacttgctcttctgaggtaattttctatatattgtaggtattcttcattccttttcattcttttttttccctctgactgtgtattttcaaatagcttgccttcaagctgattctttcctctgtttgatccattttgctgttaagaacctctaatgtatttttctatccagcaaatgtatttaccagttccaggatttgatttttagaagttatttcaatatctttgttaaaaatttctctgacaaatttcaaagttgctttcctgtgttattttggagtttgctgagtttccttaaaattgctatttggaattattgatctgatggcacacatgttgccatctcattagtgtcagtcactggcttcttgctttgtctcattgaggtcacatttcctgtttgctgttatttcttgttggtgtatgtctatgtattgtcattgaagaattagttatttattccagtcttttctgtttggattgttttggtttccttttgatatgtttgcttaggggttctttacaatttacctgttgaatttcctttattgctaggtaactgcctccttttcagtactttatggaaccttaagcccaggtttgcattagctctagcaaatgtttggagtgatgcctggcccaatggggaaggtcccaaaggggatatccctgctatgcaggaaggctggctagtggtttttgcccaggggacctgtggagcctgccttctacagtgtggtgctgctgaacagccattctgactttgcatctcttttggccaagatacagagaagagttttgtgggctggggatgctagtcctgcctttccctttgtctctggctgccctaaaaggtttttatccttacagatactcatgatgcttcctgtaggttgaggcagggatagttctcctgcaagggaacccaagatggggaagctggttatttacattgatctcactttttccagggtagaaaccatgagtctgggggagattttttccacacatgaggtgcctggcagattgcggggaggagcactgtgaatatagaagtctgattttcttactattggctcagaatttttttacctctctgtggccctggaggtcaagtcatccttaaatctgagttatgggacattgctggtgataatcttggtgctggatattcgtttttgattttctgttggggggagtgaagccaggttgcttctattctgacattttggtgagctgcttttacttttaaatgtgtgttttttttctaattaacaaagtaaaatttgactattttagaaaatgaagatgattacagacaaaaaagaaatctcccaaagctcacacattaaaacatcagctttattcagactttgtgtattttctttctttcttttgtatgtgcatggatgtgtgtatatacttagttgaagtatttacactttagttgaaatctatatactttagaattatacatattatatgtataactatatgtataattctatgtataattctacatattatatgtagaattctatgtataattctacatattatatgtataattctatgtataattctacatattatatgtataattctatgtataattctacatattatatgtataattctaggtataattctacatattatatgtataattctaggtataattctacatattatatgtataattctacatattatatgtataattctatgtataattctacatattatatgtataattctatgtataattctacatattatatgtataattctaaatcctgaatttttaccttgagcattttcatgtagtcaaaattagtcagaaacatactttttaatgctggcatatcactacattatacagggacatcatacattatttaacattgtaattatttaactagatacatactgtaagaatactaaaataagttattcccaattttttcgctattaaaaagaacactgtcaggaacttctatgcacacacatctctatttttggtgagtatcttaaaacagaaatataacttaaggatgaagaatataaatatcttaactatcctgtggcaacttgccaactggctttcagaaaggctgagtccatttaactccttgtgttaagaatgagcatctcatcactaccttgtcaataattataattttaaaaacttttaatattttgctaataagacagacaccacttaccccatttcactaattctaagatgtacatttttcatagtttagcatatctgaaattagggatgggtgtgtattacactcaaggttgtgttttggcttatttggcagcacttttttttcttaatggcacctaaaaataatgatgcatcttacaattgatgatatcttaaagattcaatgaaattacagtagaatctcatgtaatttttattttgtatttttgaccactagctaagagccatgatttatacagaaccatttcaatgtgcgagtgaactttttaaaacaaatttaactgtggtaaaagaacataatataaaacataccagtctaactatttttcagtgtgccattaagtagtgttaactataatcacattattgggcaacagatctctagaactttttcatcttgaaaatggaaactctgtacccattaagcaacaactccccttttctccttcccccagtccctgacaaccaccacctactttctgccctcatgagtttgactactttagatagtgcatataggtgaaatcatacagtatttgtctttttgtgactagcttatttcacttagcataatgtccttcaggtttatgcatgttgcagcacgtgtcagaatttccttctcttttatagctgaataatattccacccagtgaatttctaaatcataaaaatttataacaacttgcagaaattgctgacccattggattctgacagcacacctaaacaactaaaaagcaaaggacaggctgggtcccaaggggttccaatttccaaaaacaaatgttggcttatttttgaaacacaaagatcaaacagaaattaagaatgtaggtgataaaatcaagatatttttgaaatcatatctgctcttctggtgttatttcttatgttttttaaggcagtaagcttggatatcacaacttgagagtttacaaacacagatatggtaagaccatgcccttccaccaggaaactaggcagttccaagtttctggaacatggacttgaattctttcctcaagcaaaataattatggtgaacaacaaaggctgtgtggagaggccatgactgcagatgaagcaatgcaggatgaggggccagggtaaaatgtaaactattctaaaactaaacgaacttgccgtgtcatttagaatgtgccattataaaactgatgaatattacatggcaatatcctgaaaattgaactaaattatattttagttatacttaataccactggcaaaaccttttaatttattttaaatcctaaaatccccaaaaagaaaactgaatatttatacaagaagacttaattaaaatatggcttaaatggttaggtttatggttgatcatagaacaaaaggatttaaagtatcaaccacatagtggtgaccactttatttattttccctgaaagtgaaaagaggaaggcagtattagaaattaacacttaaacctaaaaagaagattaaaaagaaaaccatatcctcacattggttaaaatgtcgtatttgttttacttcttatgttattctctgacatttctactgtgtctgcttttataaatagacagaaaagaatcccgatttttgtcctacctgacatatatatttgttaagtacacagaattggcaaaatgtatttcaaattgactattatttgatgaaggtacaattttaaaagctacaaattatttaagtcatgattcatgtcttttccccctctgacataattttgaacatgcattttatctgtaattttttagacataaaacacatgtttattgcagaaagatgtaagctaagcaaaaattaaaaaacaatcatggtgttcatattttacatttcacaaaatatgtagaaactctaaaacatcacttctaaagatacataataggatattttaactaattatttatgggcaccaatttcttacaactctaaagctatactaatatgaatatctgtatattgtatactttgctcatattcttggctttttttttttttgtagcaaagaaattccaagggttggcactactgggaaaaaaggtgtgtttgtcatgagacaaactgaacttagaaaggcgggcaatgaaaccctcagtagcagtccctgagactgtacttgcccttgggtccctgcccaaactgagtctcatccttactgggtctcttttctttcgttagcatggatttttaaaagcgatttaagtttccttatgggcactgtgctgtaggcggaaactcccccttctcagcccccattccttggtgcctccttcccgacctgcgtcgtgatctgagggttcttcctgccttatttggggccctccctttattctttacagacattctcctactaaatctcttgcatgcctaattccatgcatgctctcacaggacccaaactaacagaaggactttgaaaatcttttcagcatttgctacatggttgttttattaaggtttcttctcctttggtcagtttcactattcatacttccctagacagttttctctcttcaatattttctattttatgaccacagttgttcatgacatcacctaatagtttttaacctgctagtgcctgtggtcactgtatactgtgtatatgactacatatatatatgtcatatatatgtatgtatatatatataatatacatcatgtgtttgtaaatatacatatacacatacatacatatttgtcatacatttgtattttcttcttttcttgattagcctcaccagggctctgtatgttattagcgttttcaaagactgagtcattgtatttatcaatgttcctgtttcaacatttttacctgggcactggatgggggtatcaagccaagtagctcaccagaatacaccttaggtcaatgctggaatgaggccccaaagggctttgtttcttttctttttaaaattacaatgtcctttaatgaaaactgagcaggtcaacaaagccccactaggactgactggtccccttctctggtcataatgagctttgcaaagaattggcttcagggggtttgagagctgcctccaagtgcttaagggattgtcacatgaaagggaaagaggacacattccaagctactgcagggacagagcccagcctggcagtgggatctgcaggaaggccaattgcagttcaatgaaagagaatgggctcctgtgggaggcagaggttctgttttcaggaggggctcgggcagaggagtcagccttcctcagaggccatgcactcgatgaggcaaagcatgcagaaacatctctagcagcagacagactctaagatggtcccagtgaccccgcctcctggtcttcttccctcatgtaataccttccccttgagtgtgggtggcccctataacttgcttctaaccaatatgatagggcaaaggtgatgggatgccacttctgtgatcatttgcataagattctgagcagcccccctctccctgctggcttagacgaagccagctgccatatggagaagcacacatggcatggagctgggggctgcctacagctaacagctggcatgaactgtggcccaggatctgatgccctacagggaacagaatcctgccagcaaccacacaagcttgcaagcaggcccttccgcagttgatcctcagttgagacctcagccctggctgacaccttgactgcagccttgtgagatctggaggggaggacctagttaaggtgtacccagattcctggccctgagaaactgtgagacaacaaattggtgttttaagctactaagtttgtggtaacattgttatgtgacaatagataactaatccacctaatccacctttccatctctatgattcagtaatcaccagcaccagaaaaaaaaaaaagccagctgtatcaatgcaaacccactgttgtgaccgcccatcctaatatagtggtgtgcactgctgacatcagacaggaatagcagattgtgacggctcctagcctgtttccacatctacagcattctgcatcttgcacagaaatgtataaatggatataaccctgatctcttcagatctccctgggcaggcttctgtaccatatgggtgactccattccattaaatcatttatttttctttctttcttccctcaaaaactctcagaagaagacacagtctcacatattctattgtctttaagaaaaccagatgctatctcttaaaaaaaacttaccatacccaggaagatcatctcctcttctctcagtttttcagtttccttacgttgatggaaacgtcgccaaacctaaaaacaaataaatggttacttgtttaatacatacaaatataaagaaaacatggcttgcagtttctcccatataaactgcacatctcaaaatgccaactaatcctaagctctaggctgtccatgtgtgtgctgatggaatattttttcttctgtgatcacaggcaaaaacattgttaaaaagaatgaaccacagaactaacctataattgttattagtgagattcctttaccttggtttcttcaagaggaacattctaggtagcaggaatgtgaggctagatctaaggacggcacttcatggttttaaaggaaaaatttccaaagtaatgtggggaaatatagtaacctccaagaaatgtacaactcaagcttttaactcagatgctacaactttatattcccacagaaacccgaaagaaaacagactcttatccatccttccccatcaccttctcctattcctattcagggaaaattagggacagagtcctcatcttctggcctaattttatgtccttatacttattttctctgaaacctaatgctagtttatatcaccttgccatctgctgtgtttccctgtaagtaaccctagcctctatttgaaaaaaaaaatggggcacaaatccatggtgcttatctgataaggaaagaaaaccttacggattccttctagaagggacactgatgtgctggttattagtgatggctgctgcatgtttctggaatctattaaggcctggtccctcttctgtaattatatatctgtgtgtgaatgtattccaaaaatccattaaggatttatatcctcactgcatttcagcaacattcatttcaacaattaccaatggtctttaacaatatttgaataaaatgccctgagtttagtacctatttagagtaaaaatttgaaaatatgaccaagcttagttaatggtttccccagggtaagttaataaatctttctggaatgtaatctagttctattaagggtaggatttggtgtttgagttttgaagctcagccccaaaattgagatgtatctttagtgtataaggcaccttgtaccccaactccaggagccctaggtttgcaccttctgaatgcggagtgcagcagcccaggtatctgtcactttcttgccaagcatcttggattgctttgctctatattcttgcagatagatttgcttcatgaataaagcccttaggcgaccttgccgtgccctctcagcaatctggattaatttaacagcctcatcgaaagggatactctttacagggtatttctgcaaaaaacagtcaagataaaccaatgtttgaacatgttaaccacatcaattgatcccagacacatcacatgcttacttcaaacacaatcctgctaagggtccccacggctgatcatgagtgtgagaaccgctgaacactgttcatttttccagtgaatgatgtatattttgataacatgacatgctcatgctgtgatcccaaatttaagggccccctgactttcctttatccttctgaacaaaatactaattagctccacgatattttaggttggcagcaaattatactaaaaatgtcaataaaattgattcagtaaaacttgaaattgctatcaatatttcattaacttaataggagaaacagagaaatgaaaaacctacctctaatatgagcttttaaaatttaaaatatatatgaagtaaaatgctgatcttaaaatcaagtacagaatgcccagtgaatacaactaatatcgaaatcattttgggggcatttaattttatatatgaaaagtcttccagtgtctataaacttgcatcttaaaacattcaaacatgatgagtactagtaaaacagaaaaatcagggctggtaagtaaaatgttgttttgggagatctcacatggtgtatgtggagacaaagttaggcgaggggctgtgtcattttttgaggaaagagggacaagaacaaagggctccgggtgcatgctggggcctgtgtgggctctgggtgcaggtgaggcctgtgtgggctccaggtacatgctgggacctgtgtgggctccgggtgcatgctggggcctgtgtgggctctgggtgcaggtgaggcctgtgtgagctccgggtgcatgctgaggcctttatgggctccgggtgcatgctggggcctgtgtgggctctgggtgcaggtgaggcctgtgtgggctctgggtgcatgctggggcctttatgggctccgggtgcatgctggggcctgtgtgggctctgggtgtatgctggggcctgtatgagctccgggtgcaggtgaggcctgtgtgggctccgggtgcaggtgaggcctgtgtgggctctgggtgcatactggggcctgtgtgggctctgggtgcatgctggggcctgtgtgggctctgggtgcatgctggggcctgtgtgggctccgggtacatgctggggcctgtgtgggctctgggtgcaggtgaggcctgtgtgggctctgggtgcatgctggggcctgtgtgggctctgggtgcatgctggggcctatgtgggctccgggtgcagctgaggcctgtgtgaactctgagcaggctcaatgggaggccccagtgctgttccagaggccccagagcaagggaacaggggctcatgtggcctggcttggggggtgtccatgcatggatggaagcagaagggacagatcactggagtcagaaaagcaccaaagaggccaggcacagtggctcacacctgtaatcccagcactttgggatgccgaggtgggaggattacttgagtccaggaattttaagaccaggctgggcaaagcggtgagaccccgtctctaaaaaaattttttttaaattagtggagtgttgtgggacacacctgcagtcccagccacttgggaagctggggcgagaggatcacttgagcccagaaattggaggctacaataagctatgatcatgccactgcattgtggcttgggcaacagagtgagattctgtctctaaaaagaatttaaaaataaatttaaaaagaaaagcaccaaagcataggtgaagcctgtttccaggcctcagagggcagcaatggttgccacagtaggacaatgtgaaggtgctgaggcttcatgtgtggggcgctgccaccagggccactgctgccaggatgatccctcttctgtgcaacaaggccagggtcaggggcacaggaaggagtgagaaggagaggaaaggcacatgtatactgagaacctgcagatgtcagatgctttttttatgcatgctcatcacattcacaagagcaaactccaaggctggtgttactgtgaccacttaagagtgaagacaactgaggatcaaagaagtaaggtaacttatgcaaggccccgtgggtaagaagagaaggagccaatttgaacagactgaccgtctttccactaagcaacccactacccttcaacatggcacaaggaatatgattgcttatgaggaagctctttcacataacaatccctctgagtttgttttcagtaagatttcaccgcttcaaatttgcagtgagcacacattttcaataatgcacttgtcaagttagagtagaacgagtatcattctggcattaaatgagatgatgaacttagcatacagtacccagcaaacatgagttagtatcgtatttctttcctttagattccgggctgtcattctgaaaatagtcgtggccattatcaaataattctaagggattttgagtagggaactcaacatgtcaaacatttttaagcatttaaggaggcccacagtggatattaatgtaggagatggacaataattttcatgcatcaaaattcttcttgggttatatatattgtgtgtgtgtctgcatgcgtgtgtgtgtatatatatacatatacacatatatacatgtctcataagacccctttaagctgcttatatacagtacgtatcccaagaagaatatattgtgtgtgtgtgtgtatatatatgtgtatatatatgagtgtgtatatatatgtgtgtatatatgtgtatatatatacagtatataccccaagaatatattgtgtgtatatatgtgtatatatatgtgtgtatatatatatacagtatatatatatatacacacagtatataccccaagaagaatatatactctgtgtgtgtgtgtatatatatacagtgtgtatatatatatatatacagtatatatatacacacagtatatatatatatatatatatacacacagtatatatatatatatatatatatacacacagtatatatatatatatatatatacacagtatatatatatatatatatatatatacacacagtatataagcagcttaaagaaaggggtcttatgagacaccaaaggccatggggaagtcgcagcagggaagtccttgtggttttctgagcccctggcacatgtgaaatgagactggggtggagatgaagtacttaacccagtggaggtgataggggctggccaaagctggatgctgaaggaacacagaagcctgtctgctctgactgagaacaaatgaagaggaacagtgagcaggacaaatggcaaagaggaatttttaggatttcactgtagtgagtgcaacgtaatctcccttctccattttccaacacaaaatctttagtaattctgcagtgctcatcactgcttggtgcaaagggattcctttcagggaatgaagtgtgagtgcttcgctctgactgatgcatggacagaaagcacagacataggagcccagtggtgaaaggatggctagttgacccccaagtaagttggctttggaatggacttcaaggaattcataatgtaaaagaagggccagtagctgggagcaggggcacaggaaggagaggtcatcttgagttaaatgggtgctatggtttaaacgtgtcccacaaacttcatgtgctagaaacttagtccccaatgcaacagtgttgggatgtgggacttttaagaggtgataaggtcatgaggcctctgtcctcaaaatgaattaatactgttatcgggggaatagcttcctgctaaaaggatgagctcaccgccttacttcttgctctcttactatgtgattccttctgccatgttatgacactgcaagaaggcccttaccagatgcaactcctcaatactggacttccaagcctccagaaccataagcaaaataaacttctgttgtctttaaattacccagtctgtggtattctgttataccagcacaaaatggactaagccagtatgtcaggaaaggtttcttgaaggatggtgtatcaagttaggctccgcagaatgggtaccattttgatgagcaggtatgtaagggagaagaacaagccctctatccagcagggaacatgcctatgggaaatgagagacagcactgggctggcaaatacagggcatgcatttcacctctcttctgaggcaggcacacagggcacttttttctcctgccatcctcagcatacacttggaatcttccttaacaccatcacccaggctggcaatacccaatgagggctatttgtagaaagactgcaggtgctggtttaccctgggaccctggcctgcagttgcagcctcagcatagttactcatagtgcccctttcaccctggagtgtcccagcttgaatggacaagtgctgccttacagcttaggacatgaaggccagccagaagggtgaggcagtaagttactgaaatgtataggcagatctgccatcctgccagaaggtagatagggcagtgccctgtggaaagggtgggaagaagactccccaccagtaggctgcatgggggatgactgcaagaatccaggaggtggtcatgagagtcaggctaagacagctgtggaaacaggaaaaagatgcagctgcacaaatcctgtggacaaaggaggtatcggggcacagaactaaatggattctgttccttgcttcccaggagggatctttatggattattcttcccccaatgacagtccattcaaggtgatccaagtgtcactcaatgtattagtccgttttcacactgctgataaagacttacctgagactgggcaatttacaaaagaaagaggtttaatggactcacagttccatgtggctagggaggcctcacaatcatggcagaaggtgaaaggcacatctcatatggcggcagacaagacagtttgtgcagggaaactcccctttataaaaccatcagatcttgtgagatttattcactatcacaagaacggcacaggaaagacccacctccatgattcaattacctcccaccaggttcctcccacaacacatgggaattgtgggagctacagttcaagatgagatttgggtggggacatagtcaaaccatatctactcaacctgcaattataaaaggccaatcagcatttttagaaagtgtagtaactttcaagttcctagtaagttatgtcagcacttaattattttacatgaacaacatttagcttctgacttcagctagatgaatttgagatgaaacattaaactgcgttgataatcaacagatactgatttaagtagcatatctcagtgtctaagctcttgatctcagtgtctaagctcttgaaaaataatgattatatatcaccaaaagcacatccaaaagttatgcaacttcttatgtactgtataacgagggagggatcattctctgcttaaactgaaaataatctaagtgttgctcacacaattaggagcagcagaaaaaggaagttacacagattatggattaatgtttgttaaaatgatatacaaaccatgtcagatgtatctattccgctgtccgctaatatttgagcaagaattttctctcttccttttattacttccaacttctccttcaaaaaatacttgggtatgggaatatctaattgttgctagagaagagaaagaataaaaaagagtatttccgtcacaatgccaggactagaactttatttaaaatatacagtaaggacgtgcacatcaaagacgcttgctttacttcccattttcatttaagaaaaaaaaaatgaggccagcggagtgaggagaattcatttactaaagagacacaaagtcagaaagaaaatcataaccatgccccttgctttaatcattacagaaaagcatcaagagttcacatcaattaggcctcaattaactaatgattacttaatagatttctttaaagaaatacaatattacctcgttttacctaaaataatggttcaaattgcagtagtaaagtattaagctgtagagatctttgaattaaacctaataatttatcattagcaccgactatttgtatgtaaatagtcacatttttttctagtaatttggttttatttttaccaaaattaccccattgcaaaaattatttacaaaagtagtttgctttattgtgaaacttgtttttatataataaacttctatccttcatttgtgcatgttaccaaatatttcaaaccagtgggggttcagatgaaaatttatcagttcaaattgagtaaaaaggagtacagaagtgctatttaaggatatgggtatgcccttggccaatcccactgagaaacattatcctagaatttctgtcagacctgcctggctgttttgacaggaaagcaaaggtctttgttttcagaattggctaccttatttttttttccaattctaggtgtgactccccataacctccctccagcccagagaattttggataggccttcccctaagtaaacatttaagcctaagagggtatcatttttaggacctggtgggacagtatccccatgacttctgggaggtgacaatgtcttttgaacaccaaacctttctgaggctcatggagtgctgggggtgacgggagagtgaactagcagagtctagtgggtgggtgtggcctgaggagagagggcagtaggagaagaatgatgacactttgatttaatgtgattttatttattaacaagcacattcaagtgtggtacttttataactttgaagacaaaacctcattgtcttatagctccatctggtccatttggtaccacaaaattatagttagcaggcaggcgtggtggctcatgcctgtaatcccagcacttggggaggctgaggcaggtggatcacctgaggtcaggagttcgagaccagcctggtcaacatggtgaaaccccatctctactaaaaatacaaaaattagccgggtgtggtggcatgcacctgtaatcccagctacttgggaggctgaggcaggagaattgcttgaacccaggaggcggaggttgcagtgagctgagcttgcaccattgcactccagcctgggcaagaacagcaaaactccatctaaaaaaaaattatagttaggattttgaggatgagaaaacagagtaactgagaatggaagagaagcaaagagagatattggttgctccatctatgtccatgatgcgtttcatgtccatccctgaaaccttgaggtttctcattccctatggagtggaatctaggaaacttctggtggtagagaaagcctcttccccaccatatatgtctctctatgaggtgggcccattaggaaaggttcctcacatggcaggttacagacatagtcttcggactaaggggcagtttaaggaaggatttggggaactcatggaaccaagggcaggaacccagctgggtgtttgtcagtaccagggttgtggccaagaatgaagatgccttcagcccaccccaaccaaccatgtgggattcagtgacagcacatggttcagtcactatttctaggactgctaggaaacactgttgaccgccctctgcacgaaggcttcctggatgccatctgctcatttgtcactgctcttggtgcttggtggccccatccccacggcaacaatggcatgtcctttaggaagatgatgtccctggagcagaggggcctggctgatgcagcaggaaaggcaaggccgtggagtagccgccacatagagccccaaatgcgctattccttaacaacaggggcatgacttcctattcttgaaattcaactaataaatgtaatattcattaattaaatttaggaatatgatttaataactatttgtttcacagttatcctaaattgttcatattgtcactttagtgagtaaagtgcaccagattaaatctggtgattggcccatgctcttatagatgaatgcaataaacataaaacttttagaataatcatcaacattttcattcatttcagttattctcattactccattctgataaaataataatgtgaggaaagcctatctcagaaagaaaggtacctctataaaagcccaaatattttcaaggagaagaaacgtgaaaccctcatgtagaaaattaaagactttctcctttcgattttacttcaaggaaatgttcctttcaaaatgaaggtgagctcccaggaccatgacactgaggggaggtggccagtggccccggcagcccagccagcctgagtcagaagagaggccctgtgctcggcaggaacgtcggagggcagcagcaggggccgaatgctcgcaggagggggctgtggttgccaggcgccagcagcaagggctccagggagagagggaaggaagggaagagaagcagagggaaagagggagagcaagcacatgagctctcctttgatgtctgaggcccactgccatgtaagccatacattcccctgggtcaccactgacccaaagtaaggaggagatgcatccacttggcaatagggaacctgtgaccaacaggctacagagagattccatggaaacagaggagcgggcgctgctactggatgctgggagggtctgtgtttcaagggtgctgatgaaagggctggcccactgcattccaacagccctgggcagacactacgatgtcaggtaagaccacagccacgacagtgcctaacacagccaagaagtgtgcagatgcatctgcaccagaaagaaagggagcccaatccttgtccgtgacagcatggtgtaattgaaggcaaatgtttagattttccgtacaccaactagtaaacacggacaggaagtctgtagagtatcgtgtacagatatcgggtacatatcttatttataacaaaaaaaagcaactaataagaaaacaacagagtgcttacgggggccagcttgagatcctgcaggatatcatcgaaataatggaactccgtgagttccagctccaccatctcgttcttcagctccaggatgcggcccatcaccccgtccaggactttcctgatcagtattcgtttctgggggtggacgaactggtcgtagacattctctaggtttctaaagatctgcacatactttacgtagaaggtggctaatgtttgaaagatgaaaacctgatttctttgtggttcaatcatcttctgaggctctttatcgagtaaagcaccgagggcttcttgggtctgatgccacatcttattatacattctgggggaagagagagaatttagatgatacagtaaataaaaatcacttggtaaaacataaacatcgggcctctggtatagcaaaatataacacagaatcaagtgtgagctaagaatatagttatatagttgcaaggcttgatagacaatttatatcctgttctgatgtccttctgatttctgaatatgtaccaccactattatcatcaaataaatagtttaaaaagcattttgtctaaatgatataaagttgttcctcacttggcccataaagccactattattatacccatttaaaagatgacaaagttgatatccagaatagttaacttatttgtccatatacacagctggtgaagtatattttggaacaaccagtttggaaagtaatgtagcattttcttattaagttgaacgtgtgcataccctgtgaatgaataattataccctagagaaacttgtaaatatgcatcaagaatgatcacttgcattttttaaataatagtaaaaacctgtagataacataaatgtccaccagtaagagagtggataaataaattgtagtatatacaccaatggactatcacacagcagtgaaaaatgaatgaatgaagtacagcaaaaggcaaccactaagaatcttagaaccatgatgtacagtgtgagaaatgaggtgcaggctgggcgtggtgaggtgcaggccaggcgtggtggctctcgcctgtaatcccagcactttgggaggtcgaggcaggtggatcacgaggtcaggagatcgagaccaccctggccaaccccgtctctactaaaatacaaaaaaaaaaaaaaattagccaggcatagtggcgcccgcctgtagtcccagttactcaggaggctgaggcaggggaatcacttgaacccgggaggtggagtttgcagtgacccgaaatcatgccgctgcattctagcctggcaacagagcgagactgtcttaaaaaaaaaaaaaaagagtgaggtgaggtgcagactgtggcctgggaggctgagctctctggaatgcaccagctgggctctctgccctcattccagtgagttgagttagtggactgaacaaagaggaagccagagagcagaggagtatgaccctcttgtccacaccctggcgaggcaacaaaggctgggtgtgcccttccaccaaagccttaaggtggtggtggctctgctgtggctggccccagaatactgccccatcctttgccggtttcccgagactatgtccacatctttgttactggtccctttattaggccctcatgagtgtccccgcttttcctgccagagccaataccttcatggtagagattcccaccttcccctaccaaatttcaggtgatttttttattctgcttttacattcaagaaccaggactgaaaagtgaactggaaagtcagtgtgtctgggaaggagcttcactgtagaaagtgggtgtggagagccctgatcattgatgaaggagaaatcgaaaaatgtcagtatctctctgtaaggcctttccctatgctaaggggagggggcagccctaatcccctgaaggagaagcaagccggtcaagggggctcacctcttgtttactgtcagccaggccactcattcccgtgcttacctgtgcctggcgtcctgagtccaggttggctgcatgtgccattttctgcctggttggctagtgccttagccacttgctctctggggtgtacaagtgattggcggcctaaatgtggcctatacagatctgcaagcagtcctccaatttcagccctgtcccagaagaaccaggctcccacctggcttcccagggaaacagctggcttttgatcacccagccccactcactggctttcaggtcccacattctctgcccttcctccattccctctcatccatgcctgctctccctttcccacattttctttttttctttttagacagtctcactctgtcacccagcccagagtgcagtggcacgatcttggctcactgcaacctccgcctcctgggttcaagcaattctcctgcctcagcctcctgggtagctgggactacaggcgtgtgccaccacctcaggctaatttttgtatttttagtagagatgggggtttcaccacactggccaggctggtctcgaactcctgacctcaagtgatccacctgtcctggcctcccaaagtgttgggattacagacgtgaaccactgtgcctggcctcctgcattttcttggtatctcttgtcaaatgttttctttgtccttgtgagttcatagctttaaaatcctttattgccattttggaggcaattcaggaggaagaggagataagtatccatggttaaccaccctgtttgactgggactctctcttctacattcccaagtcattattaagcagcccctccaggcatcctctgccccaggctcaccatctgccattcctcaaacatgctccattcttccctacaaactaagcatcatttattgaagcactgattaaatgtgcttttttcacctttctggcgaaaaggtaaaagcgtatcttgatgtttgcaagacttttgggttcagatgatgatgatgatgatgatgatgatgatgatgatggcgaaggtaacagcttacatttatatactgtcagtcactgtcctaagtggtttccatgtaataactcgtgtaatcctcacaacaaccctatgaggtaggcataattattagtccagtttatatatgagaaaactgaggcaaagagaagttactgcccaaagtcacagagtttgaatgcaggacgtacatgtaggcagtccggctccagagttcatgctctaaaccacttgacttcatcgcttcccgtttgtcagggagaaagcagacgaggaaggaggggtcccgtgacacagaggtaattacatcacaagcaaacagactgagcgtaaaaaccaacactcttccccccaacaccccactgagtcaggagactgaattctgcctttagaatcccatccccagcacgtccgaatgccagatttctcaaaacttagcaatatttaaactattgctagtgaaagagcactcttccagaccagcttattataagaaagaaggttattatcagaaaattaggattccacttggcacagtgtattagtccattctcgcattgctatacagaaatacctgagactgggttatttatttgtttattttgagatgcagtttcgttctcgttgcccaggctagagtgcagtggtgcgatctcagctcattccaacctctgcctcccaggctcaagtgattctcctgcctcagcctcccgagtagctgggcaggcatccaccaccatgcccagctaattttgtatttttagtagagacagagtttctccatgttggtcagcctggtctcgaactcccaacctcaagtgatctgcccacctcggcctcccaaagtgctgggattacaggtgtgagccaccacgcccagcaagactgggtaatttataaagaaaagaggtttaattggctcacggttccacaggctgtacaggaagcatggcagcatctgcgtctggggtggcctcggggagcttttactcatggtggaggcaaagtgggagcaggcatctcacatggcgggagcaggagcaagaggaaggtggggaggtgccacactcttttaaacaaccagttctcatgataactcactatcaagagaatggcacaaaaggggaaatccacctccgtgatccaatcacctcccaccagaccccgcctccagcattggggatgacagtttgacaggagagttgggtggggacacaaatctaaaccatatcacacagaacacacattgactcctggcagaattagtgactaataaacaattacactgatcaggaacaacaacaaccatcactcaaaagaacaacaacaaaagcaacacctcatgccagttcaaagttcctgggaccctctgacattctgcttgtcccacctcaaatagacaagcaggaggggctggaagaagcaaagatgattgagatgatcaagggaatggtttggctgtggacaacgatcaagaacagaggatcagcatggtgtgagttttccaaagtccagacttctagggcccgagaagggacagtaaacccaaggcgctcactggcctgagtgaggatacaggctagacatactaacaggtgtgacaactgttgacataaaacagaaccatgctcaagttgctttgtgagcttaataggatttggggcccaaacctgccaggacaacattcaagaggaaaatgacaggctaattttgtttagaactcggatctgaaactccacttagaaaacagactgcagctccagatcaaaagaattgttccctctaacccaggagggttgactgcaggagtgcttttcagttcaacacagaggaaagcataactccagacagcaacagtccagcaaaaccccagcttgtttcatagatgccaagaagatgctcagtaaattgtaacttgcagcacaggcctgattaaaaatgccctccccacacaccaacaaaaaaagaatgacgacttcttcaaagtgccaaaaaccagtgacccaatggaccttcagtggagaaatgctagaaatatgcccccaaaattagcagtaaaaaaggacaaggggatacgtaagtaattaatataaaccattttttaacaccactgcttataaatggcatgactgcaaaatccaaggaaatcagtaacaaaaatacatcaattagtacagcaagggccaggcgtggtggctcacgcctgtaatcccagcactgggtgactgaggtgggtggatcatttgaggtcaggagttccagaccagcctggctaacatggtgaaaacccacctctactaaaaatacaaaaattagctgggcatggtggcaggcgcctgtaatcccagctatttgggaggctgagacaggagaattgcttgaatgtggaggcagaggttgcagtgagccgagatctcaccactgcactccagcaaaaaaaaaaaaaaaaaaaaaaaaaaaaaaaatacagcaaaattgcaatactttaatgcagagaaaaaaaatgaaagcagaaacccattcacagcaccaataaagaacaataaatatttaagaattcacatggtggaagccacatgaaatctagctaaaggaaattctagaatgctaggtacagatcagtgcaagcagaagtcactatctgctcctgtctaaagagacaaaccctgtctctactaaaatcacaaaaattagccgggtgtggtggcatgcgcctgtaatcccagctactcaagaggctgagatgggagactcacttgaacccgggaggcggaggttgcagtgagccgagattgcaccactgcactccagcctgggaaacagagcgagactccatctcaaaaaaaagaaaagaaaagctataaagacagaagactttcaagacatacatacagatttaatatggccaagaattcagtaacaatagactaaagactataaataaatctagtaataacttttaaatatgggagtggaacagacagtaaaagttaaaaggcatcttatacttccaacattggccacaccaacaagcattaagtttgtacaataccctgaagaggctgcctccgtgaagttcaggtggggtgatctgaaccccacaaagacccaaagtcaacaacagcaagagatctcgggttgaagaggctcctgcttccaccagggggaaaccacagccgacctgatggggcagagcacagccagattttctggatgtctagacctgctgtgggcagaaccatccaggggagcccagtcgctccaggtcagagccctcattggcttcagttgggtcagagaagcaggacttttccagggcctcacggagctgacccataactggaatttttggtcaaagacagtcctggtggcttgagccttccgggtcctgccatttctttcttccccaactgcagtctgtctggggaatccctgtctgggggagaccaggcaaagattcccggctgacaggaaaatgagcagctttgaaagcacacggatccctgcatcattacctgttttcctcagcgctgagagacggcgtcatctccttccaccagaccctcttccctcgagactgtctctggcttcctgctccccagctgtcctgatgcctctccacgtgaccacaccccctcccacactggaccgccagggacctgggcaccatgcctcggccacgccagcctggggagcccccactttgcgctcagcccatctggccttgcgccccacctcctcgccctgcagcctcaagcctctttctgcttgagcccagccatgaaggtcaaatgagacaagagaggcggcaagatgatttttcataagagcattgatgagagagaattcacacagcatagaattcactcttttcaagtgtacaattcagtggttttcagcatagttgtgcaactaccaccattatctaactccagaacattttcatcactgggaaagaaacccacacccgtgaagcagtcactccccattccccactcctccctgcccttggcaacccctaacctaatttccatctctttttgcctattctggacacttcacagaagtgaaattacacggcggtgggggggggcgttcagtgctgagctcctttccctcggtgcggtgtcctcaaaattcatccacactgtcgcatactttgtacttcatttctttctattgctaagtttcctttgtacagatacaccacattttgtttatccattcgccagcccattgacacttgggttgtttccgccttctttgctgctgtgagtaatgctgctagaagcattcctgtgcgagtttctgcgtggaaatatgtctttattttccctgggtagggcaaggtggttttcaaaggtaaaagtgctctacatttaaaatagaaaccagtgtcctgagcagctcatccctggaggtcactcaatctcttcatgcttacgcctccttcactggcaaacctggatgatgagaccaactctggacacctccagggactactgtgggatggtgatgtggtttggctgtgtcccgacccaaatctcatcttaaattttagttccataatccccacgtgttgtaagagggacccagtgggaggtaactgaatcatggggacagttacctccatgctgttctcatgatagtgagttctcacgagatcggacgattttatcaggggcttttctccccactttgctctgcaattttccttgctgccgccatgtgaagaagggcatgtttgacttcacctgctgtcatgattgtaagtttcctaaggacttcccagtcctgcagaactgttagtcaattaaacctctttcctttataaatcacccagtctcgggtatgtctttattagcagtgtgagaacagactaatacagatggaacaacaggtgtgaaagtgttcctggaattttaaatgcactttgcaaacagaaggtaatattttatccatgagactacttaacagtttttgaaagtatatgattggtttcagacttgagcatatgacttagagatatgacagattttgaagtcaggaggcttgtggatgaagactgaatatgacagttaaaaagaccagactgttatttctacagcttggcagttttcctataacggagtgggtaggggagggaaacacttgaatattcacttgaatatatgcacttccgtgggaactcaaaatattgcacaatgggaattcttttcaagttattttgcacaagataaaaccttctgaatcttccaatcttaactagtttgctgtcttcttccccaaatactccccctgccttcttgctctacggaaggcctgtctctgctcagaagccctctcagtagaggctcctgttacccccagagccctctgtctctggctgtggggctgggtcaaggggaccccttctcttcactgcacctccagacatttgccttccctcctcccaacactcccaggctttgaatcccatttcatctgatgctgtcaccactgcccctcagtcaccatcatcttccatctaccatgatcgttccaggccacctccagagcacccacccactgaatagcatcttgatgctgccttcctacctgttccattgttaagtgctgagttcctctacctaaggccagcaccccctggatcccatgtcctctcactaccaacgatgtcacccacttctccctcctcctcctatatcattctgggccattcccttccacacacaaacattctattgttttctgtcttggagccatgtcctctgcctctagctgccaacatatttcctttcctctgcagcaaaactcctttaaagagttagctatgctcaccatctatagtttctctccccctacattcacttgagtaagtctttctatctcatcataccactgaatcagctcctgtcaaggtcactggtgaactccacactgccaaatcaacagtcagttctcagttctaccccaacttgtctcaggagcacttgatggaggagaaagaagttacttctcctggaaacactattatttcttccactcgcttcttcctcatggatcatgtctttgattcctttgccaggtctcctcttcccccagccttactgtggatgatcccaggatcagtccttacacctctttattaatattcattctatgtctcacaaagaccatcacaggctgacagtgagcaagtttatatttcagacatgggtctcgctcctgaacccaagatctgaatattttaattgcctatttcatctccacgtgatgtccaatgggcacttccaactcaatacgtcttaaacagaactcttgatcttccccatttccaaaccctggcaagcctttaacctctctgctcttatttccttgcctagaatacagggcacgtaatagcaacagtgcaggctggagctacagtgcccggcttggcactgttcacttgctgtgtgaactacttcacctcttcatccccaagttccctcatctgtaaaatggaaataacaatattaacagcccctacgttacagggttgctgtgaagcggttagaacagtgtctacagggtcagcgctgtaatacctgttggaaattattcttacgaagaccaaatgaggtaactttgtgcaagtgctgtgtaaacgacacagtgctaggcacacacttctttcagtaccaatgccactcgagtctgtgaaaagcaaatgtcaataatgctttcccaagatctttctagacttaaatttcaggacctaggtgtttccacaaagcaccgtatttgttaccgtgaaagattaacaaaaaaagcagacaaaatggcatagtgcttctcagcaatagcccctaagggcttggcaggtatacggaagactgggagctcatccccatggggtggtgggacgcgtaggggagggggagatctaagtgtatgattttccttgctcacaagaagcagatactctatcccgaggcatatttgaatttcctaaaaggaaaaaaagtgggggagaggagggaagttgagaggggaggagaaaagaaaagaaaaaagaaaataagagaagcagaaagcaagccaccttctggcttggggaagcccactccatggctgtggctgggagcccatcacttacgcgttcgacattgctggctactttccctcttttcctcgccctccgggaagctcttccgttgctctctgaaggacggtggcagcaggggtcagggcactaccaggagctacagaggatttgggtggggggtcttctggagggagaaaccaggactgcgagaatcttctgcttcgggcaggaaaaggtgaggccg

SEQ ID NO: 557 - DNA, 26276 bp, Homo sapiens
agacagattttacagatttatttttaaaaaacaaaacaaaggttaaaaaagtccttcatttccaaccctgcctgggggtgtgggtggggaatagaataagctcagaaaggtgcctacctccttcctgcaaaggacacggcaggtcagaggcaggccctcgccctttctgccctgcctcctcctcaggtagctcaaattgctgctaggaagatttataggcaaagaagtgtgggagtgggaggccaagagctgccttcttcacatcaacagaaactccagctgttctttccccttagcagttctctgagcctcaccactgggactcccagggtgggcgggcaggcaggccaggaggctcagccctttgggctatgttgctcagaccaccgcagctttcttaatgctctttgtgaaccaggagggcggtcaggggaacttcacagtgcggggaggggtgtctggaaaggaaactctgaagcgccgtctctttctgaccttgcctctgcgctgaggctgccattcttggctattccccatcctgaggctgagtggagtccaggacaaagcactaagtggctgtttgctacaaaacacctggagatgccagagagtagcccttggcctatctgtcagtccaggctcccacacagtcacacagtcatacacacagcgttaaggcgtctgtgccagcaggcacggcccggctgggcccagcttctctctctccacctgcagagggtgtaggggggagaaccctggctgctgcagaaacaggctgaagggggagaagctgacaacggaagagttaaccaggcctggagaaagaagtgggaggaaggaaggcaagggctttctaggcctccatccaggcctgctggctgcccttgaagtaacccaactcaggttggggagccctgaccatataccccctggaaaatgggggacagaaagaggggaagagagcggggctagagtattgggactttggaggaagccagtgctatcaatatttacaagcataaagccccatcttctgtgccacctacctctctgcccctcccacagaaatgaaaggcccctgagagccatggaggaggtgcccagacctcctcaccagctatgcccctagggagagcccctgccctccaaccggccccatttctgggcccctcaggaatgtctgtctggctctgctcagtcgggaggaggcgccctgggccagaatcctggctgccaccagccctaggagtccttgagcatgctgatgcgggcgtagatcttcagggcgggccccagcttgatgttcatggcgctcatcaggtggtcctccttgagcagcagcagggcttgcccgtcgatttcctgggcacggaattcctctgctatctcctggcagcctgagggggtaccaccaaagacagtgtcaatccaagccgccagtgttcacctctggcagccactgcatctagttatctagatctagttatctgcatccattatttcttttagtcctcataaccacgccttgaggaaggcgctgctgttcttattttgcagcttgagagaggctgtgcaactcacccacagcagccgcgatctgggcctcctcctatgttcccctgttcagacccctgctccatgaactgggcggacccatgtccactaaagtgctgaggaagtgacagcgtgtgatttctgaggctagatcataaagggcacagcagttctcacctcactcttctgcctgggttactgcagagtaagccagctaccagtaagccaccccagcaaccctttggagaggcatgcgtggagagcagccaaggccctggtggtccccggcctccttgccgtgtgagtgaaccgtgctggaagtgggttttctggctccagacctcagacactgcagcctgtatggcgtcttccctgagacctcatatgacctcaaactcatacactgggtctgtggaagggagcagataacctctctgtttctagttcttagactaagaggaactggacaccaggagcctcataccaggactgcccagccgagccactcgattcctgacccacatggcccttgagatgacaagtgattgctgcttaaagtcactgagttctggaataatttacatcatggcaataggtaactaatgcagattctggtacctggaaaaggagtgctgacatcaaacagctctatagatgtgggcgtggcctcagaactggccacaggcaggagccagaaggactctgtggaaagcgtgagtgtctaaggtgctttgagagactgtatatagaagtctcatggcctttagggaagctgctggggaggcctaaaggaaagtgaggaaactcttagtggagattggaagaaacagggtctctgttatgaaataaaagaacattttgtaaaaatgtggttggtagcagaaatgtaagttgaatgtacctcatgaagtgggtggtctagctaaggagattttcaggcagaatgtggaaggtgttgcttggcttcttactgctgctcacagtaaaataggagagagagaaggtaaaaacaaacaaacaaaactgttcaacataaaggaaccgggatctgccggttttaaaaatgcccagcctctccagatggcacatgatgctaacattaagaaatggtttctaggcaaagatcaaattcagggcacagtcaagaaaacacggtctacagattaaacttaggatgtgacttaaatctttttgtgaagacttcagaaagatctaaagtgatgcctcaaagagctattcaatccaaaggctctcgacggattttctaggcatgcctcgcagatcctcttttcaacagcagggtttctaagaatgtgaagggcactgtccatgctgcccctcagcttcagaagaataccaatgcagacaacagcttacccttgaagataattctgggtgtggtttttgtctaatggaatggaccccaacaagattcccagaaaacccacaattattttaagaaatactgaattactgattttaagagtcaaaggtaggccgggcgcagtggctcacgcctataatcccagcactttaggaggctgaggtgggtggatcgcctgaggtaaggagtttgagaccagcctgccaacatggtgaaaccccatctctactaaaatacaaaaattagctgtgtgtggtggcgaatgtctgtaatcccagctactcaagaggctgaggcagaattgcttgaacccaggaggcggaggttgcagtgagccgagatcacgccattgcacaatagcctgggtgatggagcaagcctctatctcaaaaacaaaaaacaaaaaagtcaaaggtaatataaaataaaaaggaggaagcaggctgagaaaacgactacactgaaaatacaggctacttttcacagaaaaggaaggagaactcagagggcagaaccaagacagaaatcactcccaggctttgagtcccaattgaggaaatgccaccataaaccctagcggatttcggaactggaatggatcagcgactcttgtacgctccctgtttctccctttttggatgggcatgtctgtaatggttatcctatggctgtcccactgtgcattgggtttgtggaagggagcagatagcctctctctctagttctcagatcttcagactgagaggacctatacttgaagaactggaccccaggagcctcatctcacctcaatgatgagagcctggacttcaaactgatgctgtcatgggaccaaactgtcggggatttggtggcggtgagggtattctgcatgaggaaggaacacaaatttctgggggtcatggtgaactacatggcttgtctctgaatggctcccaataatccttgcttcccagttcatgccctctcacaatgagtaagactgacctgtgtgacccataagatattgtgaaaaattttaattaaaaaaatatattgtgaaaatgccagtacgtggcttcagaggctagatcataaagggcacagtggcttctaccttgcactcctggatccctacctgtggggacatcccactgccatgcatatcatgagaacactcgagcagccctctggagaggcccatatagacaagaaccaaggcctcttgccaacagccagcccagggcaaatcacgtgagtgaggcaccttggaagagatcccacagctcttcagtattcacgtgacctcagccttggctgataaatcttaattgtaacctcataagacacctgaggcagaacggcccaggaagccactcctgaattccttacccacagcaactgtgtaataaaaattttggggatgaagagataacatactaggttaagtgacagagccagaatttgaacccagttctgtgtgactcagaagtctgtgctcttaaccacactgcagtctcttgagaaagaggcttgtggttaccatgaatacctgacctggtcggtgtatgagtgagactggcagaaaaacagtaatgcatccaggccccactgaaggcatctgtgaatgatgtaaggcttgcctcttacagctggctcctagatcccgggcctcaccaccacttgtgctccaccacgcagggctctgtgccatgtctggccataccacagacttccctatcttcatgcctctgcatgtgcgccctcttgcagtctctccatccagcaaaggcatacttgtctgtctactgtcatttagtttacattttcttaattaaattttttttttttttttttggtagagacaggtctcaccatgttgcccaggctgttctcaaactcctgacctcacgcaatccttccacctcagcctcccaaagtgctgggactataggtgtgagccaccacacctggctattttcttaattttgatgttcctgacacatatcctacactctacctgactcccctcctaatctctcccaggagagagagacagttaattacattatcatctctgtatttcacacagatcacttcccatgccagaaaatatacagaattacagctatggaatatttatagtttgcattctatgctgaatataagcaagctcttataggcagggagctcatctcactcatttctgcaccccagttcctgaacctgagtcattaactaaactacctaatcctcctggtggtgggagggtctctcattttctctttccttgctattccggggagacatggaatttccaagggccttacctggcagagagcggatgaattcgtagacgtcttctacattccacttggtgggctcacttggcaggaagtggtgtcccatgcccaccaggtcccgcatatgcatgtcggggagctccaggtcccgctggccttgtcgccggcgggaagtagatgagctggctgagatgggtgacaagggttcctcatagcttgagttatctgagcaacggctggagtcttcctggctgtgtgttagctgcaaagcagcagtaaccgaaaggggcacagtgcctgttggctgggagcagagagttttcttcaggatgggggaacaaaccatctctagcagcagtgatgaacaaaggaggtatttctcctttttctacttggcctactactacacatctgagttcccagatctaacagcatcttccatgctgtcctgtctcctaccctaggcagagttagtccctcttagtattgtagtgtctaccacacaatactgcaattatctttttctaaacatgagttttaaagcagggctctgagttctaggaggtgatcacagagccacttgaaatagcatgtaacatttcttctgtacgtacacagctttggaccattcttaaggaggtttaagacaaaaaaaaaataaggcaaaattatacataaggttataaaacatcacaccatgctgtggagttcctttaaggcgagactgtgtccttagagcctagtgcctaacagagtttctggcatacagctggtgctaaaaaatatttaatgactgaatacccatgttcctggtagagaccttcaagaactctgtgctcgcgtgttcagggaggcaaaaaggtggcaaaacaaagggtggaggctgccttctcacccagccctccacgtaaggcaggaggttacctgagcagcccaggggagaccccatttccgtggccccagaagccaaggatggaggcaaactggaaggtggggtgatgttgaggcaaggccacggaagggggcagggaaccttgtaagcacccatgggtctaaatgaagggacctactggggtgcagaaggctcgactggacaggtctacaaggaatgagagcacagcagagtgcgctgaagtcggcagctggaggggaccgtggtgtcgagggccatggaagggaagctgtggggactgtggggatggagcttcaggctctgcccgcctcttacctgcttcttggtatccttggtaagtggtggcagactggctttgctggcccgacggcggttgtgggtcgcagctcctgccttctgcagcttgctccggtctgagtggaaaagtcccacccgtttggtgcatcccacgttgtaccttcagggacaggggaacaggggatgtcacagtagtcattgtgcttatgggccgtaggcagaatgagcacagccaagctgtctgacaaattttgagtccatctattggttcagatcctaactccatcactaactactagctgtgtgactttgggtttaagtcacttaagccctgatcctccgtttccttatctggagttgggggtaataccactcactttctaggtctggtcttacaacatgagataatgtctgtaaaatgtttgagacacctggacttggaccagggcgaaagctcacacctgacttattccactataaatgttaccctgtgacgggaaactactgtccactgtcctgctggggagtggcctggctgctccaacagcctgaggggaatgagggctgaagatagctgaactctagcttggcatgcagaacacctctgtctgggacctagagatttcttctcttctgggatttcagggcttcaaggtcagctgttgcttccattgtggtacaaagaccacacatggctttagaattggacaagcctaaatccccaggcccatggcttattagctatgttatctgaggcactactactcctttgtactttggcttcctaacctgtataaaggggacaatagtaatacctgtcttgggagttattttgaagatgagataatcgtatcaattgactggcacagtgactagcacacagcaggttctcaggaaatggcagtggtttttatgatgaccattagtgatctatgctgggcgagagctcaccaagggaacactatagctgtggttctgggtaaggcttaccctaacaaggcaggggctgtcaatgctaggaaaggcgaatgggtgccagtggagcccaggagggccagccgagccaaagcactgcggcttttccttggactcccgctgctctctcccacctgctcttaggggttctggcttctcgtgcttgttgaattagggatgccatcctgcttccaggtgggtcgaggaactaggaaactggagaagccacccctatggacctcctggggtagactattaatggcaggaggtgggacataaagtgcagtcctggggaaatggagggggctggggccactcacctctttgcacaagccatggaacagaagcgcttggaacgcttgaacttataggcaaagtccacccggccacagagctcacacttgagtttgaggggagcaccctcctctttggattctgaaaagtatagaaatgggtagggtggagaatgagaaattcctgcaggactgtggccagccccaccacggggcctccctactccatcctgcctggtcctcctgctcccacagctgtgacatacagcagcattctagcatggaaaatgccagtggttctcacccctggaatgcactcaagggtgtctggggatgccccttgtagacttgacatttttttcttccacgtggtctgagtctgaggcaaaacacaggtggggaagaatcagcatcaaatgactgtggaagaaagcaggagcccccaggaaatactctggatgctgtcacagctgctccgctggcatcatcacaccttgatctatgcagctggctgctgacccagtaaaagacctcaggagcccacgctcctgcagctgtgcagctctgtcagtgcttcatgtggaaagagcagccttgcctggtctctgctgtgacctagagctggccccagtctcaaggcagggacgaagggcaggacttgcctggggccactcctacagtcatgcctaaaacttgccaatgattcccacaggaaaagccattcttgggatcctgtggttggctggagggggattgggggagcagaggacacatggttcccgtgatttcccctatccctctttttgagggaaggaggctgaggaggtgctgggggaaatgtttacagactcgctggctcagggttcctctggggaaacagagagaggaagtgtgtgaggcctgcctttccagccacgctgggaggccgagagattcagggtctgagatgcccaccttgcagatagggctcctccatctccgagtcagtggtggtggtgtgatcctgctgtggaagtttctcaggcaggaacccctgtgcatacttcttcttgagattccccaccagcagggacgagcgtcccacctagaggacaggtaacacggaggccgtgagggtcaggtgggagcggcttccttgctatccatcctcatcacaattacacgtataaagtatccaggcacagaggccagccctcctcaaaccttcccccatgtcatcatccaagtgtgctgggctcaaggccctattttgctggttggctcacgaggtaagatgctaatgggcaaagtacagggatggcttctgtccaggaccaacggatggctcaggagattaggaaaatgtctattccagtaagagtctaagggctgagatcaggtttcccacagtgccagatcaagcaccaagacccagtacccacgcatctccaggcaaggacagagcggagtctgtgtgaggctgtacatacgagagagagactcagcacccattttctgatttttttactgttctccaccttaccccaatgcctgacccaagccagaggtacaggccgccacagagtatagcaggaaaaaacagaccctgggccacagagccaatgaactctcagttgtcagaaccccagagcagcttatttacgcgtttagatctccttttgtggcctgtgtttaggcagcctggtagccagtcacgtggcaccgactctagggcaatgctgggggtgctatgcaatctgcctccaccccatgagatcaggtggtttctagtgttactctaggaggcccagtctaacagggaagggatgtaacagagcgagagccacttctagctaaggtgttccaggcagatttctttgccactggccttggacaacctccagtgggaaagaagacaagaagctatgtgtcttttggcattttacaggagcagttcacccatctcagttaatcaagctccgcgtcttctgcagactaatcaaaccactcatggaaccaaagaatgaggaaaaggcagatggtatcccagaaaggtgtcttctccaacagccagatacttttcatcagaacagaggctggtgtgccgctggctctgggctcctccacacccacagggcagcaccactgtctccagtgcacactgcacagaagcagctctgggtgctttggtcaataacccatcttcgtggctcgtggatatttcttgttagtcttaggcttccatcgtgacctttctgagtgcccctcaatctcattaactcccctttcaaggctctgtccccagaaaacaagcttcaggttgtgaccctgtttcctcacattcatttctgatacacgtatctggagaattctgttctgtgcaattccttttgttcctaactggccgaagttttgccattcagaggttttggcattcaaaactcaatgaaatctaatttcccaaaacccatcatctctcaccaaatatcccacagtgaactcccttttaaccaagggttcacacatcaacaggcagggacacacctgagtttgtgtgggaaacttctaaccaagggtcttgtcaattattcctgatcactgacccccctcttctggaccttggaaagataatcctagaaagaaatggctctatattctttgggggaggaagttagcaaggaaagagcaaattgttcacattttcagaaattttacatggaaatgtaaaaatattctaagacacatccaaaatatacttaaaaaaaaaaggggaaaagaagtagtccgtaccgggaaaggctccgccccctcctggatcacaaacccttcgataacatgcgtcaggatttggggtttcacaatggcctgtggtggtttattctcaccattctggggggcagtgccggcgatgctggaggcagagtttccgttccctgaggtcatgccggggctgctgaggtcggtcagtgcatgaacaatgccctgccctgtctctgcacgagagagagtaggaaaacaaagcaggggagatcagaaccagagtccacgcccagggagggacagcaaggactcaaactgcgcccggcttttaccgtggggccaagcgacaatgcaaaccaagcagtcccctcccctcagtgacccatttaaaagtggcacagtttcaatggacacatcaccaagtatgagtatagtcagttccacaacaacgcatgcagctaatcagctagcagtgtttcttcatttcccaaccgtgctatgaacagttaacccggataaacagacgggaattctatctttgaggagttaagaccttggtcgatactgatttgaacaaataaggttaatactcagtttgagggagaaaagtattcaaggtgacatctaaaaccaggacaagaagctgagctaggtatagggctttgagtgtgataaagagaagcttctacgaggttccttagaggagggattttaagagccctgtgaaatgtcaaaacactgaaccccagaaattgatgccaagggaatgtgggtgctgaaccccaagtaaaggctatcatgtatatttgactattcagagactggtcatctggggtcagtgcattgaaatatgcagaaattccatttctctgctaagaaggctgctaggcagaggctgagattttctctgctgtttctgctgagctgagtgctctcaaaatcagtcctcatgcccagatgtcagcttcttatctaatctgatcctcaccaaatcatagatcctctgtctctctgtggacaacctttcctaattctccttccccatgggcctgctagccttcctctaaaagacctaacagagtgctccagaaagtgagattacatgcctatacacaaccacacgacagtgaacttcctctcttccacttcaaacagcatctctcatgagctgtctcattgtcttagacgtgcaagacttcatctcctcacttctgtaactctctcccgcccccttcccagggctgttctctaccaccatcaactgccccgtgagctgaggctgcctttaacctggaacttcctaaaaaagaaaagaaaaagccatttctttattgcaacaagtccattaatataaagcataccccagtgaggtatgagtgatatatactttaaaagtgatttcagcacacttgttaagtaatctttgcataaaactttatatgaagatgctcatatttcatgttaaagatccataataccaccacagaataggaattctttgtgcttaattatatagtatggaaaagtcaaaacagacacgtttgagaaaaggtggtttagggccaggcatggcggctcacacctgtaatctcagcactttggaagaccgaggcgggtggatcaccaggtcaagagttgaagaccagcctggccaacatggtgaaaccctgtctctactaagaatacaaaaattatccaggcatggtggtgcgtgcctgtaatcccagctactcaggaggctgaggcaggagaactgcttgaacccagggggtggaggctgcagtgagctgagatctcgccacccccctccagcctgggcgacagagcaagactctatcttggggggggagggggggaaagaaaagatggtttatgactagttcataatgggtcttggtccactcaagctcatgtttttgttgttgttgttgttgttgtttttttttttagatggagtctcactctgtcacccaggctggaacgcagtggtgcgacctatgctcactgcaacctctgcctctcaggttcaagcgattctcctgccttggcctcctgagtagctgggattacaggcacgtaccaccatacccggctaatttttgtatttttagtagggactgggtttcaccatgttggccaggctggtctcgaactcctgatctcaggtggtccacctgcctcagcctcgcaaagtgctgggattacaggcatgagccaccgcgcccagcctcaagctcatgttcttactggtggttctaatgctaactaaaccaggataaacctttaatgaacaagagttgactatgactcatgtctttagtactcagtcctccataattcagctacataataaacttctgagctgagcaggggccatctaagagaaaggaccaatgaagttttttttgtttgtttgagacacagttataccagtaagttagaaagtttccattaagtgcctatattcacttgaaaaaaaatttttaaacagctttggcttttctgtagagatggaaacatttcctttcttttagaattagtctttccaattgcaaaggtgtctgagaacttgagagcttgtctggaggttctagcaggggagggcagctactcgtatgcccttgactgagggacggccctcctctacgggatggtcgtcctctttgacccagctgctggttcaggagggacgcacatggagcagtgaaggaggaaggggacacctgcgtagccagccagatcagcggaatcaactctgccgatcaatggggtgacaggtgttgcagccagatggccctcacatccatgtttgagaacgtagaaaaaacccctttccctcacaatctatgaataactaggaggactgagttgatgattcaatcaaattaagtttctgtgcttttaaattttaaatatttaactctgcctttacacaattacattttctctgcttttatgttttgcatatgctaagaaacatctattttatttaaaatgaattactaacatagattactatgaaagctaaaattttgttttttagatgatggctatttcctcccaattagagcctggtaaaaaatattccctgatgagtctaatgaactgcagattatacaattataggattggaaagtctggttcgatctcttgccaatgcttgaaaattttctataatatgcccacccaatgattttctggcatttgtttgaatacctccagcgacaaagaaactcactactctggaagcagtttgttcccaccttggacggctcattagtgattccttatataacgagcccaaaatctgtctttctattaatttctgcccagttatcctcgttctgttccttaaactcacagagaacaaggccaatcagatttgtctaacaggcagagacacgggcttagacctggcttagagactggtctctatcattgagtcaactgcgggcaagtcattgtccctctctaagcctcagcttcactggctgtgaaataaggatcctacgcctaccttagagtgctgctgtgaggactaatgagccagtgaaaggcagtgcgtgctagcttacgagaaaatgcttgagaatgctcctggtgtcatgaaggatgtcactcatgaccacagtcttctctcctccaggacaaagcccttctgttctttcaggtatttcttacataaaaaggctacaaattcgtaatcatcctaggccctctctgcccacatcttttaacatcaggtacctagttaatactaagcatcatctgtcaggtgtagtcatgtaagagatctggttggtaagatttttggttttctgtgtttgctttaaagacagtcacatctctgactgagagcataggtagaaagtattaattcccttgtttcagtttaatgaattcttccatggaattaatccattctcctcttaattctgggatcactcccacctcctgcctctttcgctgatagtcatcagaaaacagcccccctctgaccttgtcttttgtgggatccctctatccttgcttgacttccctgcctccatcccccactcctgtctcagatctatgcctattaatgttcactgcaagacagaagatcactcttgaggtcagagtctgtcttcatgccagatacattcgtgagcagatatggtcaccagctcaaaggctacagagccaatgcttaactctgggaagcaaaactttttggaatttgaggttgttttttaaaaaagatcttgttaagagagagaacacactaaaaaactcttgcaccacattagaaactaccactccccattgtaacccagggcagatcaaaggagagacagaatccaagggacagatgggagagtgttttatgaatatacaaaggttcacagctacttcgctttgcagtcatcttgtagaccaatagctcctcatctgctttagtaacaaaggagtttgggctattcctggaatgaccgaacacaatctcgccccctgccaagctcagcacactgagattaatttaatctgcttcccgctctcccagactgctttgcggcctttggggaaaagcagcttaacagtgaaacttgcagaaacctgccctgctggccctgaggccagataaaagagacaaagaaatactctgaatttggttccttactcaattcccttgaccagttcagaggctataagtgctgccgggcattcccacaggtctcaaatgcctgtatacagtcaggcacctgaaaccgaaaggtggaggcaggataaggccgatgggagaggctgggggaggggagtaaagctaggcttcggtgggggaagggggaggtaaaatcttggcctttagttgacgctgaccacaaagggccaagtattccggtcagaatgaacagagcagcatgttccacggagtcttgcctaacatatgtctcaacttctaggctgtttctcatttctggtctcattcacaggctctggtacaaacagcccttacaggggtgggagaaaacaggaaggactactcagctcctgtttgtgaaattatctgctttgggactggtcacgtctcctaagcagagcagacttctctaggcagggggctaccactcactcagtcacctcgagatcttcaggggctaaccccatgtccaaaatatgacaggtgcttaatgaccactaaactggaatgtgtggcatccatgatctcagtcttcactgtctacatatagaatacagggctgcctagtgccaagataagcaatttggcactagctgagatttacaagttgctttctgaagctatgatgttttgagagcagctaggctggtggtacctgcctaccggagcggcatttctagatacctgattatgaagaataagagctattttttggcccatgtcttcctgttacagtggggatttcctcaacagaaaagaggtacaggtggacctctgaattccctgtcccctttgaaacatttttgccagacccaggcacttggcaaggcaggatgacctctagaggcagaggcagggaggctcctaggaccagtgggttgatgtccagagctgacgggctctccagcctgctgaggacagacgtcaggctggtgccagttatgcacaattgggccacttcagagccagtgctgatgttttgttttgttatactggaatacagcttagtacaggttaagtatcccttatccaaaatgcctgggaccagaagtgtttttaattttggattttttcaggttttagaatatttgcattatacttactggttgagcatcccaaatccaaaaatctgaaacgctccaatgagcatttcctttgagtatcacgtaggtgctcaaaaagtttgggattttggagcattttggatctgggatgctcaatctgtactaacatctgcaacaggtatttcagatggcctagcactcattctatctgaccctaagatagcctgaagacatggcttcaaaggcaatggagaccaaacggagcttttccttctaccccctcaccttggtcaatggctgatttccaccttatcatgagaagggagtatgtattttaacttaaaagacttctatttactgtttggttgcagtaggagtatgacagagctaatgaaatgaataaagaatttaaagaagcagagtagatgataacatggctcattttcttacaacaaattctgctcaacaaatggcaaacaaggtcacctataaaacccaaagcacactctccaagcccccagcactgaagtcacgctcactgtgctgcagttcagcaggcccagccatgtggccagggtggtctctgcagggttcccaaggaaccatttgctctagaaaccgcctcagtggagcactgcagagtgatgcccagttaaaccatatccaggagacagcagcaaacacagcacatacctggtccaagcaacaggccgtactgcagtgcggtaagctgaggacagagtgcccagtcctcatggaaagatctggggccacgctttacaatttctttggttatatttgggcccccaaagaaattaatgccactgaaagtgaggaaggcaagagatttcacaaacacctgtttgttgacaccttcccccagggcggggtaagtgaagggtaggaaagtgactgagagggagttgcggggaggagggaggggaacaggcaggctgagctctatctgggaccctgacagagtccatcaattagagattcatttggttaacaatttctttaaaatgcaagtatacatcttacagtcattcacactttactgtgaattactcgactcagataaacagattgctttcctcccaatttagggatggggtgggggagggggtgggtagtgattgttttggatcacggggcactagatcccagaggattaaagttagaaaggccctgagtttaacatcttaaatgtcctagatgaagcaacttggcctcagaggtgaggtgatttgcccaaggtcacaaaaggtcacaaaaaaagactctaggcttaaatcccatcctgtaatgctgggcaagttactctaggcctgtttcctcatctatgaaatggggtacttatatctgtcttacatatagctgtggtgaggattaaataatgtaatgcaggcacaacacactggactaggctgagcttggacacaggcagtggcagaacccacactagaacccagtgctttagacttttccgggtgggccacacaggtggagggagggctgcgctgattagccgtggatagcacgagggcacttgggaaaagaggacaagacatgtaaactgtattctgggaccttctgaggcagaggccagatatcacatgtgggctggagcatttgggttgggaagcacaggatgatctagatgagtgattcccaaattgggattcctggatgactaagcaggatccctgaatctagttaatcaggacgcacaagctggattcaatatctgaagaagccgaaaaggaaacagcacataatatataccttcaggagggcaaaacatgctattatttaatatcatgttaccatgtttcccaaattctaaaatgcagtcagttgttaagatgacccatttcccccacaacgaatttacacattgattacgtgtgcgtctcaagtacagattgtaaaagtgtgcattttagaataaaacaaacgaatgccatttatttggaagacagtatcttgtaaaacatgcacaaaatgaactcttagtggtgggaaaattatagacccttcccacctggggtcctctgaataccagaaggcagggggaacatccaatgtctgcagccttttcaaatctgctaagggcagagctgtcaaagggacaaggactccttgccttgacacagcaggctgtggctccctgaggaacctctctgaagcacctcctctgaaggacctctcccagagaagggaaggcacagcagtgacagaaggaccctgtggggctctttgctgagaaaactggtgagcttttcaggcacaggagggtcactggctgcggatgactgagatccacacctgagttccttgcagggggctggccagcaggatgaaggagaggccaagccaggggaccctccagccttgccctcagcgtcactgcaaaatgctcttgctgggtctgggttgaaaggtttggagagcttactggattttaagcatctgtgttgaccagctcccgttaaggcatctggcagggagggggctcctcccatgctggcagccattaccatacagctgactttcatgctgtctctcaggacacaggcaaagagaacggcccttctgactcacccacaatccccagctaaagtgtacataagctgaattgtaaacagctgaatgtgctccaagctgccacccccagctatgcaggaaggaatcaatggagcgaacagccaccctccccccaccccatgcagttcaggacaacgggagcagtgggggatttccaaacagctgcttgaacgcttcccagcccacaggctgaggactgcaagaggggcctgagctcaaactcagcagcagcacctgcaggaccagagtgacttccaccaggtcaacacaccagggaataatagctggccctggctgcagggagtcagggaggagttttcaaagagttctacttaaccctggtgatggaggccagtccactggtatccaatgccagggtcaagggctcccagatagtctcacatcatagtgctccggcccatgctatgatttcaaaacgcaaaatgtctagaaccaatgggagaggttctacagtagacactaagatcaggggagataaaaggaagaatggcagagtagaaagagcatgggctctgggggccagacctggactcatattctgttccacctttaatcaaaggtgtgtggcttcaagcactcactgcctgttctgagtcttggtttctccatctgtaacaacgaggctcatactacctacctgtctgggaggtttcagtaaatattatatatgtaaaatgcctggcactgaatacacgcagaagctgtgctacatggcagttaagactgtgggattagaaagactctaggcggccaggtacagtggctcatgcctgtaatcctagcactttgggaggctgaggtgggtggatcacgacgtcaagagattgagaccatcctggtcaacatggtgaaaccctgtctctagtaaaaatacaaaaaaaaaaataaataactgggtgtggtggcgagcgcctgtagtccccgctactcgggaggctgaggcaggagaattgcttgaaccctggaggcagaggttgcagtgagccgagattgcaccactgcactccatcctggcaacagagcaagactctgtctcaaaaaaaaaaaaaaaaaaaaaaagactctaggcttaaatcctatcctgtaatgctggacaagttactctaggcctctttcctcatctatgaaatgggatacttatatctgtcttacatatagctgtggtgaggattaaataatgtaatgcaggcacaacacactggactaggctgagcttggacacaggagtgccaacgtcactgagacctgtgagaagattaggaaatcattctaatctcactctttcactgagtctggcctcttacagccccagagcagggctaatctttccgtggcccaaactgaggtatctgaggtttgtgttcctcagacgtcttggtctacgtcggtagtcctgtccttgcactgttgaggtcaggcttcaggaagaaatgttacctccactgtgactgcaacataacagaaatgcttctgtcctaaagggcaaagcaaagtctcaagtcaccttcaatggctattaatctaaaggacaagaagacaagcaccagattctctttctatgcagttttttcataaaggggggttttaagcagacagtgcagaagaaccctagaaaccaaaagaaaggttaactttaagacaaataaaaggaagcactgctttacttagaaaatactaaatttatgtaacttgtaatgccagatgatttagcttatgaaaagaaattagtttaaaaggctaaaaataaacccagtttaagataaactcatggaagatggatttctaccggtttacaaaagaaatctagaaatgtttagtaaactctccaattattttcaggttgataacagggaaaggcagccatgttccccaatatgatgactatttttttggttatcaactgcagcatcactaatattgttagataaatgtcaggggagactgggaggagggaacactaagcctcagttgtcctgtctatattatggactacatactacataccttgcaaatcagttctattgatcatttctgctcatggaaacattactcctttcctccttataaccattgtctaagcttccagtcaaccctattttgccaccagtcaactgatagaacagattaatactgattactggaggcctcaaaatatggatttaatcaaatttttttattttttattttttgagatgaggcctcgctctgtcacccaggctggagtgcagtggcacgatcatggctcactgaagcctcgactgtccacacttaagcgatcctcccacctcggtctcctgagcaactgagaccacaggcgtgtgccactatgcccaggtaatttttttttttaattatctgtagaggcgaggtcttgttatattgctcaggctggtctcgaactcctgcgctcaagtgatcctcctgcctcggccccccaggcatgagccaccgtgcctggtcccaatttttttttttaaagtagttgcttcatattagttttgttttaatttaaagtgtcatttgctttgattgttcaaaaatgtcttaatatagctgtgtggctttaggtcacatatggatggtttcaaatatgctaaagataccagtaactagggataattatatagtatttgagacataacagccatgcaactagagttttaaaaataactcaagcagtcacgaactttcattttcttgccaacagttccaatattcagtatcaggcctggtcctcctaatctactggagaagagttggttatggcatggcatctaatagtcatctcttcttaatacaaatgataataaatttcactgctaagacgacaatcatctgaaaaaaacagacatttgcttatgttttaaagtcataatagcaaactggggctctcttcaacatctggattcatctcagagcactggcaatctgtgtttaacagcagtcatgtctttaccagatgtagaaagaatgttctcttcttttggacttacctaaatatcatttggaaattggaagaacaggaaagcatatcctttttcactaactataaaaataatttggaaggagaaggaaacaaaaaaaaccttgaagttttctatgctggtctacatggtcttacaatgaatctcagagcaacggtttatgacttaaattatatgctgtgttccttagcatactttttcttcaaaaactagtaattctaaattgtataattcttgactatgataaaagagcccatttcttgaccatgtcatttatactggacttttgttactgatggggaaaaatccagaatttgtaataattatgtcttggatatgcaaatggttgattattttcctaacaattcccaaaatatccacatcataaagcagaattaaagatggtttgcctctcaatacctttagaaatatcaaatcagtgttctgatgtggctagtaattcaaatgaaaaatgttaaataagtcattgcttcaagtgaagcctacctctgtttgagttgtgaataagtagttatcttaaataggcaactttttttaaaaacagaaaacatattcaaaaagggttttaactggtgactcatagtttaaaccatgccctaaaaacatttaaagcataaatctatgtgttcagactcccatcttgaggggtagttcagttttgggttccatgaaacaaggtgttaagtccccaaagagagagccatttctgtcattggcacaaagtccccatcagagtagactgcataacgcagtcagttctcaccctgctttcccatagggctggggactggggggaggtggggagggtgggcaggctcagaggggcacctcactccaggacagtctcctgaggggtacacaaaagcctctctctacaaccacttttgtgagattcctcctgaccacagaaagtcatcatcatgatcatctttcagtagcaaaatggcacaaaacaaagggaataaaagagaaactatcaattatgaagactcctcattctcatttccctactctcgtctccagtaggtgtcctttcagaagagaatctttctatggctggaactaaatctgtctggagattaaatattgaacagctgggagaagtttaatataaatttagactgactcaagaagagggaaaaactcttggtaaacaccgtactaatgatgagcagcattacaggaactggagtcaccaacctattccctaggttttttaaactttaactttattttggcttgctgatccatgctggatgaaagtgaggaggtgggggaactttacttggcaaatggttactgaacgcctggcctgaggtccacagcctaaaggaggacagagacttaagggaagagtttaaggcagtgaggtcatcccctttacacattcacaatagagaaaagtagacaaaaagacacctacgagcacaccagtaggggttcctaattctgagacaataatcatgttctgtgtttttccttaaataagaaaatgtagagaggggacagcctatgtaagagcatacaaggccagaggtaagaagagttcaattgtgtaagatcatccatctacttactcctcttaacatgccctctccccctgaaagatcagaaccaagggatccaaagtatctgagacaggaaatgagtaacacaggaaaaaggatgtggtctgaaaaagagtggattctggggctgagccagagcaaggaacaggcacagggtcatagctgagggaagggcttggtggcaggaagagaaatctcagggtcagtccgcttagactagaaagtcaatgacagagcaggtatgtcaggggaagcagcacagtgccttcctaagaggctctccttccctgaaggaggcagagaatgcagaaacaatggctgatgagatgatgagacccacagccaggagaatgatgactgtgacagaaggaaaaggggctggaggtccttctttacttagagggaagagtaaataatatatatggagtgagcttgacaaaggtaaattaaaaattaacccaggacctgggagagagtggaaagggccaggaggtggggacatgatgaaacaccaacattcattaagcacctttgtgccacatgtcagtaaagaacagtttgggggaaaaaagaagggggtgaaaacaggagagaaaacatagttggacaactgagaaaccgactcaagtacaacagaaaggactaagaaactaccccctttctcaagattcaggctggaggaaaaagatgtctattcttccctgtgtgcatggacgagcctggaaacagatcttgggtgggctgagaagcagagctcatgtgatgaagagtgcctggaaagggcaggtgccaaaagagcaccactccccatctgcccgaccttctgcgaaacaagcccgcccttgtgagtgagccaagccagaggccccagttcccgccttgcaggggctggaacttaggtacagagaaatcaccagtggaaaacacagtttatcagctggttagaaagggtgaatactcccaaatgtagatccagatgttgggagctatttgttaaaatcacttttatattccccagtgcctagggcagtactttacctaaaatgggagccaaataaaagtatgttaaatctaactgaatgaaaccagaactgctttgctgtgctggttatcttaaggttcaagacagcctcttgcccgataaccaacacagtcaggtactttatttctgttctaaagtcaaaacgatgggaagccctacatcccttgtgacctaaacctaaatcctaatcaatagggtctgccacaggtctgttgccctgtaccagaataaaagatgggcgggtgggggaggtgggaagaaatacaagagcaagaaggaatttccttgcctcattagcctgtaatgttcatgctgacctagaaatcctggcagttccaacatttgggttgactcaggcggggaagaaaaatcccaggtgaatgataattggattacccagttatgctccagagccaaatggctggaaaaggccaggtcagtaggctgtggtacaaagtgacattattttttaaaccaaaaatggagatactcaggctgatggacaatgggatggaatagtttaaattggggctgtcctagaaaaatcagggacatatgatggatttaggtaggtagcttattttgcaagggatcctctgggcccaatatgctaatggagaggggattaaagatcaaacacgggagatatccgaggggaaggctgtcattgatttgtaagggaagaaaaagatgaaaagagtgtgttccgtacacagcacatgaaggtacatatcgtaggtatggagtaggaaggaaaggaaagttgttcagaaccgaaagtatgtgggtgagatcagttcaggttatggaagacgggtgggtgggcagtagcagggcactgactggtatccgacacggggcccagggcttagttcagatggtagcgtcgccactggtttgcaacctgaccttgggccaattatttccctgtctgtggacttcagtttaaatacagaatctcacaaatcccgattttaatgtaaagaagcaacaaatatagtctaccttcatttggcataggaaggagagaaaacgctcttctaaaaatggaagaaaagacacagaacagcttgtccctttccatccaattaaaaacctcgtgagactgaactagattaaaaacaaaactctccagcgaagccgcaggcgcctccaagatagggagtccaccaccaataaagtacggcagatgccagcagtctcgtccccgaacgcaccgtccgtcccagggaagtcgcagcggcggggaggccggtcctaggttggggctggggtggggtgtgcggggcctggggacgcggaagctgcggcgcgccgaggtgacacggcttccaggggcgacgggcgcgcagggtccccaggcgagcgaggctggggagcagggcacctcccaggcgccgcgcggacgagagccgcgactggcacggcctggcagccgcgtaggcccgggccgttaggggcaccgagggcggtgcccgacttccagtgcggcgagcgcggcccccggcctccctactggcgagaacccctcccccgccccggcactgacctgtccagggcccggctgggcctggccgggcggggcctacgcagcccctcggccgggcgccgactcgcgcggggtcccgggcccgggcgggccgcctcctctccgccgggagcctccgagccggggcccggggctgccgcggcgcatccgaccgcaccggcctggccggcgtcaacaaagggcggccggggcgcgaggccgggacgggggcgcgaggccggggcgggagcgcgggcggcggccggggttgcgcgcgcgcgcgcggcgggcgctcgagggctgcagccgccgcggagacaatg

SEQ ID NO: 558 - DNA, 51971 bp, Homo sapiens
agacagattttacagatttatttttaaaaaacaaaacaaaggttaaaaaagtccttcatttccaaccctgcctgggggtgtgggtggggaatagaataagctcagaaaggtgcctacctccttcctgcaaaggacacggcaggtcagaggcaggccctcgccctttctgccctgcctcctcctcaggtagctcaaattgctgctaggaagatttataggcaaagaagtgtgggagtgggaggccaagagctgccttcttcacatcaacagaaactccagctgttctttccccttagcagttctctgagcctcaccactgggactcccagggtgggcgggcaggcaggccaggaggctcagccctttgggctatgttgctcagaccaccgcagctttcttaatgctctttgtgaaccaggagggcggtcaggggaacttcacagtgcggggaggggtgtctggaaaggaaactctgaagcgccgtctctttctgaccttgcctctgcgctgaggctgccattcttggctattccccatcctgaggctgagtggagtccaggacaaagcactaagtggctgtttgctacaaaacacctggagatgccagagagtagcccttggcctatctgtcagtccaggctcccacacagtcacacagtcatacacacagcgttaaggcgtctgtgccagcaggcacggcccggctgggcccagcttctctctctccacctgcagagggtgtaggggggagaaccctggctgctgcagaaacaggctgaagggggagaagctgacaacggaagagttaaccaggcctggagaaagaagtgggaggaaggaaggcaagggctttctaggcctccatccaggcctgctggctgcccttgaagtaacccaactcaggttggggagccctgaccatataccccctggaaaatgggggacagaaagaggggaagagagcggggctagagtattgggactttggaggaagccagtgctatcaatatttacaagcataaagccccatcttctgtgccacctacctctctgcccctcccacagaaatgaaaggcccctgagagccatggaggaggtgcccagacctcctcaccagctatgcccctagggagagcccctgccctccaaccggccccatttctgggcccctcaggaatgtctgtctggctctgctcagtcgggaggaggcgccctgggccagaatcctggctgccaccagccctaggagtccttgagcatgctgatgcgggcgtagatcttcagggcgggccccagcttgatgttcatggcgctcatcaggtggtcctccttgagcagcagcagggcttgcccgtcgatttcctgggcacggaattcctctgctatctcctggcagcctgagggggtaccaccaaagacagtgtcaatccaagccgccagtgttcacctctggcagccactgcatctagttatctagatctagttatctgcatccattatttcttttagtcctcataaccacgccttgaggaaggcgctgctgttcttattttgcagcttgagagaggctgtgcaactcacccacagcagccgcgatctgggcctcctcctatgttcccctgttcagacccctgctccatgaactgggcggacccatgtccactaaagtgctgaggaagtgacagcgtgtgatttctgaggctagatcataaagggcacagcagttctcacctcactcttctgcctgggttactgcagagtaagccagctaccagtaagccaccccagcaaccctttggagaggcatgcgtggagagcagccaaggccctggtggtccccggcctccttgccgtgtgagtgaaccgtgctggaagtgggttttctggctccagacctcagacactgcagcctgtatggcgtcttccctgagacctcatatgacctcaaactcatacactgggtctgtggaagggagcagataacctctctgtttctagttcttagactaagaggaactggacaccaggagcctcataccaggactgcccagccgagccactcgattcctgacccacatggcccttgagatgacaagtgattgctgcttaaagtcactgagttctggaataatttacatcatggcaataggtaactaatgcagattctggtacctggaaaaggagtgctgacatcaaacagctctatagatgtgggcgtggcctcagaactggccacaggcaggagccagaaggactctgtggaaagcgtgagtgtctaaggtgctttgagagactgtatatagaagtctcatggcctttagggaagctgctggggaggcctaaaggaaagtgaggaaactcttagtggagattggaagaaacagggtctctgttatgaaataaaagaacattttgtaaaaatgtggttggtagcagaaatgtaagttgaatgtacctcatgaagtgggtggtctagctaaggagattttcaggcagaatgtggaaggtgttgcttggcttcttactgctgctcacagtaaaataggagagagagaaggtaaaaacaaacaaacaaaactgttcaacataaaggaaccgggatctgccggttttaaaaatgcccagcctctccagatggcacatgatgctaacattaagaaatggtttctaggcaaagatcaaattcagggcacagtcaagaaaacacggtctacagattaaacttaggatgtgacttaaatctttttgtgaagacttcagaaagatctaaagtgatgcctcaaagagctattcaatccaaaggctctcgacggattttctaggcatgcctcgcagatcctcttttcaacagcagggtttctaagaatgtgaagggcactgtccatgctgcccctcagcttcagaagaataccaatgcagacaacagcttacccttgaagataattctgggtgtggtttttgtctaatggaatggaccccaacaagattcccagaaaacccacaattattttaagaaatactgaattactgattttaagagtcaaaggtaggccgggcgcagtggctcacgcctataatcccagcactttaggaggctgaggtgggtggatcgcctgaggtaaggagtttgagaccagcctgccaacatggtgaaaccccatctctactaaaatacaaaaattagctgtgtgtggtggcgaatgtctgtaatcccagctactcaagaggctgaggcagaattgcttgaacccaggaggcggaggttgcagtgagccgagatcacgccattgcacaatagcctgggtgatggagcaagcctctatctcaaaaacaaaaaacaaaaaagtcaaaggtaatataaaataaaaaggaggaagcaggctgagaaaacgactacactgaaaatacaggctacttttcacagaaaaggaaggagaactcagagggcagaaccaagacagaaatcactcccaggctttgagtcccaattgaggaaatgccaccataaaccctagcggatttcggaactggaatggatcagcgactcttgtacgctccctgtttctccctttttggatgggcatgtctgtaatggttatcctatggctgtcccactgtgcattgggtttgtggaagggagcagatagcctctctctctagttctcagatcttcagactgagaggacctatacttgaagaactggaccccaggagcctcatctcacctcaatgatgagagcctggacttcaaactgatgctgtcatgggaccaaactgtcggggatttggtggcggtgagggtattctgcatgaggaaggaacacaaatttctgggggtcatggtgaactacatggcttgtctctgaatggctcccaataatccttgcttcccagttcatgccctctcacaatgagtaagactgacctgtgtgacccataagatattgtgaaaaattttaattaaaaaaatatattgtgaaaatgccagtacgtggcttcagaggctagatcataaagggcacagtggcttctaccttgcactcctggatccctacctgtggggacatcccactgccatgcatatcatgagaacactcgagcagccctctggagaggcccatatagacaagaaccaaggcctcttgccaacagccagcccagggcaaatcacgtgagtgaggcaccttggaagagatcccacagctcttcagtattcacgtgacctcagccttggctgataaatcttaattgtaacctcataagacacctgaggcagaacggcccaggaagccactcctgaattccttacccacagcaactgtgtaataaaaattttggggatgaagagataacatactaggttaagtgacagagccagaatttgaacccagttctgtgtgactcagaagtctgtgctcttaaccacactgcagtctcttgagaaagaggcttgtggttaccatgaatacctgacctggtcggtgtatgagtgagactggcagaaaaacagtaatgcatccaggccccactgaaggcatctgtgaatgatgtaaggcttgcctcttacagctggctcctagatcccgggcctcaccaccacttgtgctccaccacgcagggctctgtgccatgtctggccataccacagacttccctatcttcatgcctctgcatgtgcgccctcttgcagtctctccatccagcaaaggcatacttgtctgtctactgtcatttagtttacattttcttaattaaattttttttttttttttttggtagagacaggtctcaccatgttgcccaggctgttctcaaactcctgacctcacgcaatccttccacctcagcctcccaaagtgctgggactataggtgtgagccaccacacctggctattttcttaattttgatgttcctgacacatatcctacactctacctgactcccctcctaatctctcccaggagagagagacagttaattacattatcatctctgtatttcacacagatcacttcccatgccagaaaatatacagaattacagctatggaatatttatagtttgcattctatgctgaatataagcaagctcttataggcagggagctcatctcactcatttctgcaccccagttcctgaacctgagtcattaactaaactacctaatcctcctggtggtgggagggtctctcattttctctttccttgctattccggggagacatggaatttccaagggccttacctggcagagagcggatgaattcgtagacgtcttctacattccacttggtgggctcacttggcaggaagtggtgtcccatgcccaccaggtcccgcatatgcatgtcggggagctccaggtcccgctggccttgtcgccggcgggaagtagatgagctggctgagatgggtgacaagggttcctcatagcttgagttatctgagcaacggctggagtcttcctggctgtgtgttagctgcaaagcagcagtaaccgaaaggggcacagtgcctgttggctgggagcagagagttttcttcaggatgggggaacaaaccatctctagcagcagtgatgaacaaaggaggtatttctcctttttctacttggcctactactacacatctgagttcccagatctaacagcatcttccatgctgtcctgtctcctaccctaggcagagttagtccctcttagtattgtagtgtctaccacacaatactgcaattatctttttctaaacatgagttttaaagcagggctctgagttctaggaggtgatcacagagccacttgaaatagcatgtaacatttcttctgtacgtacacagctttggaccattcttaaggaggtttaagacaaaaaaaaaataaggcaaaattatacataaggttataaaacatcacaccatgctgtggagttcctttaaggcgagactgtgtccttagagcctagtgcctaacagagtttctggcatacagctggtgctaaaaaatatttaatgactgaatacccatgttcctggtagagaccttcaagaactctgtgctcgcgtgttcagggaggcaaaaaggtggcaaaacaaagggtggaggctgccttctcacccagccctccacgtaaggcaggaggttacctgagcagcccaggggagaccccatttccgtggccccagaagccaaggatggaggcaaactggaaggtggggtgatgttgaggcaaggccacggaagggggcagggaaccttgtaagcacccatgggtctaaatgaagggacctactggggtgcagaaggctcgactggacaggtctacaaggaatgagagcacagcagagtgcgctgaagtcggcagctggaggggaccgtggtgtcgagggccatggaagggaagctgtggggactgtggggatggagcttcaggctctgcccgcctcttacctgcttcttggtatccttggtaagtggtggcagactggctttgctggcccgacggcggttgtgggtcgcagctcctgccttctgcagcttgctccggtctgagtggaaaagtcccacccgtttggtgcatcccacgttgtaccttcagggacaggggaacaggggatgtcacagtagtcattgtgcttatgggccgtaggcagaatgagcacagccaagctgtctgacaaattttgagtccatctattggttcagatcctaactccatcactaactactagctgtgtgactttgggtttaagtcacttaagccctgatcctccgtttccttatctggagttgggggtaataccactcactttctaggtctggtcttacaacatgagataatgtctgtaaaatgtttgagacacctggacttggaccagggcgaaagctcacacctgacttattccactataaatgttaccctgtgacgggaaactactgtccactgtcctgctggggagtggcctggctgctccaacagcctgaggggaatgagggctgaagatagctgaactctagcttggcatgcagaacacctctgtctgggacctagagatttcttctcttctgggatttcagggcttcaaggtcagctgttgcttccattgtggtacaaagaccacacatggctttagaattggacaagcctaaatccccaggcccatggcttattagctatgttatctgaggcactactactcctttgtactttggcttcctaacctgtataaaggggacaatagtaatacctgtcttgggagttattttgaagatgagataatcgtatcaattgactggcacagtgactagcacacagcaggttctcaggaaatggcagtggtttttatgatgaccattagtgatctatgctgggcgagagctcaccaagggaacactatagctgtggttctgggtaaggcttaccctaacaaggcaggggctgtcaatgctaggaaaggcgaatgggtgccagtggagcccaggagggccagccgagccaaagcactgcggcttttccttggactcccgctgctctctcccacctgctcttaggggttctggcttctcgtgcttgttgaattagggatgccatcctgcttccaggtgggtcgaggaactaggaaactggagaagccacccctatggacctcctggggtagactattaatggcaggaggtgggacataaagtgcagtcctggggaaatggagggggctggggccactcacctctttgcacaagccatggaacagaagcgcttggaacgcttgaacttataggcaaagtccacccggccacagagctcacacttgagtttgaggggagcaccctcctctttggattctgaaaagtatagaaatgggtagggtggagaatgagaaattcctgcaggactgtggccagccccaccacggggcctccctactccatcctgcctggtcctcctgctcccacagctgtgacatacagcagcattctagcatggaaaatgccagtggttctcacccctggaatgcactcaagggtgtctggggatgccccttgtagacttgacatttttttcttccacgtggtctgagtctgaggcaaaacacaggtggggaagaatcagcatcaaatgactgtggaagaaagcaggagcccccaggaaatactctggatgctgtcacagctgctccgctggcatcatcacaccttgatctatgcagctggctgctgacccagtaaaagacctcaggagcccacgctcctgcagctgtgcagctctgtcagtgcttcatgtggaaagagcagccttgcctggtctctgctgtgacctagagctggccccagtctcaaggcagggacgaagggcaggacttgcctggggccactcctacagtcatgcctaaaacttgccaatgattcccacaggaaaagccattcttgggatcctgtggttggctggagggggattgggggagcagaggacacatggttcccgtgatttcccctatccctctttttgagggaaggaggctgaggaggtgctgggggaaatgtttacagactcgctggctcagggttcctctggggaaacagagagaggaagtgtgtgaggcctgcctttccagccacgctgggaggccgagagattcagggtctgagatgcccaccttgcagatagggctcctccatctccgagtcagtggtggtggtgtgatcctgctgtggaagtttctcaggcaggaacccctgtgcatacttcttcttgagattccccaccagcagggacgagcgtcccacctagaggacaggtaacacggaggccgtgagggtcaggtgggagcggcttccttgctatccatcctcatcacaattacacgtataaagtatccaggcacagaggccagccctcctcaaaccttcccccatgtcatcatccaagtgtgctgggctcaaggccctattttgctggttggctcacgaggtaagatgctaatgggcaaagtacagggatggcttctgtccaggaccaacggatggctcaggagattaggaaaatgtctattccagtaagagtctaagggctgagatcaggtttcccacagtgccagatcaagcaccaagacccagtacccacgcatctccaggcaaggacagagcggagtctgtgtgaggctgtacatacgagagagagactcagcacccattttctgatttttttactgttctccaccttaccccaatgcctgacccaagccagaggtacaggccgccacagagtatagcaggaaaaaacagaccctgggccacagagccaatgaactctcagttgtcagaaccccagagcagcttatttacgcgtttagatctccttttgtggcctgtgtttaggcagcctggtagccagtcacgtggcaccgactctagggcaatgctgggggtgctatgcaatctgcctccaccccatgagatcaggtggtttctagtgttactctaggaggcccagtctaacagggaagggatgtaacagagcgagagccacttctagctaaggtgttccaggcagatttctttgccactggccttggacaacctccagtgggaaagaagacaagaagctatgtgtcttttggcattttacaggagcagttcacccatctcagttaatcaagctccgcgtcttctgcagactaatcaaaccactcatggaaccaaagaatgaggaaaaggcagatggtatcccagaaaggtgtcttctccaacagccagatacttttcatcagaacagaggctggtgtgccgctggctctgggctcctccacacccacagggcagcaccactgtctccagtgcacactgcacagaagcagctctgggtgctttggtcaataacccatcttcgtggctcgtggatatttcttgttagtcttaggcttccatcgtgacctttctgagtgcccctcaatctcattaactcccctttcaaggctctgtccccagaaaacaagcttcaggttgtgaccctgtttcctcacattcatttctgatacacgtatctggagaattctgttctgtgcaattccttttgttcctaactggccgaagttttgccattcagaggttttggcattcaaaactcaatgaaatctaatttcccaaaacccatcatctctcaccaaatatcccacagtgaactcccttttaaccaagggttcacacatcaacaggcagggacacacctgagtttgtgtgggaaacttctaaccaagggtcttgtcaattattcctgatcactgacccccctcttctggaccttggaaagataatcctagaaagaaatggctctatattctttgggggaggaagttagcaaggaaagagcaaattgttcacattttcagaaattttacatggaaatgtaaaaatattctaagacacatccaaaatatacttaaaaaaaaaaggggaaaagaagtagtccgtaccgggaaaggctccgccccctcctggatcacaaacccttcgataacatgcgtcaggatttggggtttcacaatggcctgtggtggtttattctcaccattctggggggcagtgccggcgatgctggaggcagagtttccgttccctgaggtcatgccggggctgctgaggtcggtcagtgcatgaacaatgccctgccctgtctctgcacgagagagagtaggaaaacaaagcaggggagatcagaaccagagtccacgcccagggagggacagcaaggactcaaactgcgcccggcttttaccgtggggccaagcgacaatgcaaaccaagcagtcccctcccctcagtgacccatttaaaagtggcacagtttcaatggacacatcaccaagtatgagtatagtcagttccacaacaacgcatgcagctaatcagctagcagtgtttcttcatttcccaaccgtgctatgaacagttaacccggataaacagacgggaattctatctttgaggagttaagaccttggtcgatactgatttgaacaaataaggttaatactcagtttgagggagaaaagtattcaaggtgacatctaaaaccaggacaagaagctgagctaggtatagggctttgagtgtgataaagagaagcttctacgaggttccttagaggagggattttaagagccctgtgaaatgtcaaaacactgaaccccagaaattgatgccaagggaatgtgggtgctgaaccccaagtaaaggctatcatgtatatttgactattcagagactggtcatctggggtcagtgcattgaaatatgcagaaattccatttctctgctaagaaggctgctaggcagaggctgagattttctctgctgtttctgctgagctgagtgctctcaaaatcagtcctcatgcccagatgtcagcttcttatctaatctgatcctcaccaaatcatagatcctctgtctctctgtggacaacctttcctaattctccttccccatgggcctgctagccttcctctaaaagacctaacagagtgctccagaaagtgagattacatgcctatacacaaccacacgacagtgaacttcctctcttccacttcaaacagcatctctcatgagctgtctcattgtcttagacgtgcaagacttcatctcctcacttctgtaactctctcccgcccccttcccagggctgttctctaccaccatcaactgccccgtgagctgaggctgcctttaacctggaacttcctaaaaaagaaaagaaaaagccatttctttattgcaacaagtccattaatataaagcataccccagtgaggtatgagtgatatatactttaaaagtgatttcagcacacttgttaagtaatctttgcataaaactttatatgaagatgctcatatttcatgttaaagatccataataccaccacagaataggaattctttgtgcttaattatatagtatggaaaagtcaaaacagacacgtttgagaaaaggtggtttagggccaggcatggcggctcacacctgtaatctcagcactttggaagaccgaggcgggtggatcaccaggtcaagagttgaagaccagcctggccaacatggtgaaaccctgtctctactaagaatacaaaaattatccaggcatggtggtgcgtgcctgtaatcccagctactcaggaggctgaggcaggagaactgcttgaacccagggggtggaggctgcagtgagctgagatctcgccacccccctccagcctgggcgacagagcaagactctatcttggggggggagggggggaaagaaaagatggtttatgactagttcataatgggtcttggtccactcaagctcatgtttttgttgttgttgttgttgttgtttttttttttagatggagtctcactctgtcacccaggctggaacgcagtggtgcgacctatgctcactgcaacctctgcctctcaggttcaagcgattctcctgccttggcctcctgagtagctgggattacaggcacgtaccaccatacccggctaatttttgtatttttagtagggactgggtttcaccatgttggccaggctggtctcgaactcctgatctcaggtggtccacctgcctcagcctcgcaaagtgctgggattacaggcatgagccaccgcgcccagcctcaagctcatgttcttactggtggttctaatgctaactaaaccaggataaacctttaatgaacaagagttgactatgactcatgtctttagtactcagtcctccataattcagctacataataaacttctgagctgagcaggggccatctaagagaaaggaccaatgaagttttttttgtttgtttgagacacagttataccagtaagttagaaagtttccattaagtgcctatattcacttgaaaaaaaatttttaaacagctttggcttttctgtagagatggaaacatttcctttcttttagaattagtctttccaattgcaaaggtgtctgagaacttgagagcttgtctggaggttctagcaggggagggcagctactcgtatgcccttgactgagggacggccctcctctacgggatggtcgtcctctttgacccagctgctggttcaggagggacgcacatggagcagtgaaggaggaaggggacacctgcgtagccagccagatcagcggaatcaactctgccgatcaatggggtgacaggtgttgcagccagatggccctcacatccatgtttgagaacgtagaaaaaacccctttccctcacaatctatgaataactaggaggactgagttgatgattcaatcaaattaagtttctgtgcttttaaattttaaatatttaactctgcctttacacaattacattttctctgcttttatgttttgcatatgctaagaaacatctattttatttaaaatgaattactaacatagattactatgaaagctaaaattttgttttttagatgatggctatttcctcccaattagagcctggtaaaaaatattccctgatgagtctaatgaactgcagattatacaattataggattggaaagtctggttcgatctcttgccaatgcttgaaaattttctataatatgcccacccaatgattttctggcatttgtttgaatacctccagcgacaaagaaactcactactctggaagcagtttgttcccaccttggacggctcattagtgattccttatataacgagcccaaaatctgtctttctattaatttctgcccagttatcctcgttctgttccttaaactcacagagaacaaggccaatcagatttgtctaacaggcagagacacgggcttagacctggcttagagactggtctctatcattgagtcaactgcgggcaagtcattgtccctctctaagcctcagcttcactggctgtgaaataaggatcctacgcctaccttagagtgctgctgtgaggactaatgagccagtgaaaggcagtgcgtgctagcttacgagaaaatgcttgagaatgctcctggtgtcatgaaggatgtcactcatgaccacagtcttctctcctccaggacaaagcccttctgttctttcaggtatttcttacataaaaaggctacaaattcgtaatcatcctaggccctctctgcccacatcttttaacatcaggtacctagttaatactaagcatcatctgtcaggtgtagtcatgtaagagatctggttggtaagatttttggttttctgtgtttgctttaaagacagtcacatctctgactgagagcataggtagaaagtattaattcccttgtttcagtttaatgaattcttccatggaattaatccattctcctcttaattctgggatcactcccacctcctgcctctttcgctgatagtcatcagaaaacagcccccctctgaccttgtcttttgtgggatccctctatccttgcttgacttccctgcctccatcccccactcctgtctcagatctatgcctattaatgttcactgcaagacagaagatcactcttgaggtcagagtctgtcttcatgccagatacattcgtgagcagatatggtcaccagctcaaaggctacagagccaatgcttaactctgggaagcaaaactttttggaatttgaggttgttttttaaaaaagatcttgttaagagagagaacacactaaaaaactcttgcaccacattagaaactaccactccccattgtaacccagggcagatcaaaggagagacagaatccaagggacagatgggagagtgttttatgaatatacaaaggttcacagctacttcgctttgcagtcatcttgtagaccaatagctcctcatctgctttagtaacaaaggagtttgggctattcctggaatgaccgaacacaatctcgccccctgccaagctcagcacactgagattaatttaatctgcttcccgctctcccagactgctttgcggcctttggggaaaagcagcttaacagtgaaacttgcagaaacctgccctgctggccctgaggccagataaaagagacaaagaaatactctgaatttggttccttactcaattcccttgaccagttcagaggctataagtgctgccgggcattcccacaggtctcaaatgcctgtatacagtcaggcacctgaaaccgaaaggtggaggcaggataaggccgatgggagaggctgggggaggggagtaaagctaggcttcggtgggggaagggggaggtaaaatcttggcctttagttgacgctgaccacaaagggccaagtattccggtcagaatgaacagagcagcatgttccacggagtcttgcctaacatatgtctcaacttctaggctgtttctcatttctggtctcattcacaggctctggtacaaacagcccttacaggggtgggagaaaacaggaaggactactcagctcctgtttgtgaaattatctgctttgggactggtcacgtctcctaagcagagcagacttctctaggcagggggctaccactcactcagtcacctcgagatcttcaggggctaaccccatgtccaaaatatgacaggtgcttaatgaccactaaactggaatgtgtggcatccatgatctcagtcttcactgtctacatatagaatacagggctgcctagtgccaagataagcaatttggcactagctgagatttacaagttgctttctgaagctatgatgttttgagagcagctaggctggtggtacctgcctaccggagcggcatttctagatacctgattatgaagaataagagctattttttggcccatgtcttcctgttacagtggggatttcctcaacagaaaagaggtacaggtggacctctgaattccctgtcccctttgaaacatttttgccagacccaggcacttggcaaggcaggatgacctctagaggcagaggcagggaggctcctaggaccagtgggttgatgtccagagctgacgggctctccagcctgctgaggacagacgtcaggctggtgccagttatgcacaattgggccacttcagagccagtgctgatgttttgttttgttatactggaatacagcttagtacaggttaagtatcccttatccaaaatgcctgggaccagaagtgtttttaattttggattttttcaggttttagaatatttgcattatacttactggttgagcatcccaaatccaaaaatctgaaacgctccaatgagcatttcctttgagtatcacgtaggtgctcaaaaagtttgggattttggagcattttggatctgggatgctcaatctgtactaacatctgcaacaggtatttcagatggcctagcactcattctatctgaccctaagatagcctgaagacatggcttcaaaggcaatggagaccaaacggagcttttccttctaccccctcaccttggtcaatggctgatttccaccttatcatgagaagggagtatgtattttaacttaaaagacttctatttactgtttggttgcagtaggagtatgacagagctaatgaaatgaataaagaatttaaagaagcagagtagatgataacatggctcattttcttacaacaaattctgctcaacaaatggcaaacaaggtcacctataaaacccaaagcacactctccaagcccccagcactgaagtcacgctcactgtgctgcagttcagcaggcccagccatgtggccagggtggtctctgcagggttcccaaggaaccatttgctctagaaaccgcctcagtggagcactgcagagtgatgcccagttaaaccatatccaggagacagcagcaaacacagcacatacctggtccaagcaacaggccgtactgcagtgcggtaagctgaggacagagtgcccagtcctcatggaaagatctggggccacgctttacaatttctttggttatatttgggcccccaaagaaattaatgccactgaaagtgaggaaggcaagagatttcacaaacacctgtttgttgacaccttcccccagggcggggtaagtgaagggtaggaaagtgactgagagggagttgcggggaggagggaggggaacaggcaggctgagctctatctgggaccctgacagagtccatcaattagagattcatttggttaacaatttctttaaaatgcaagtatacatcttacagtcattcacactttactgtgaattactcgactcagataaacagattgctttcctcccaatttagggatggggtgggggagggggtgggtagtgattgttttggatcacggggcactagatcccagaggattaaagttagaaaggccctgagtttaacatcttaaatgtcctagatgaagcaacttggcctcagaggtgaggtgatttgcccaaggtcacaaaaggtcacaaaaaaagactctaggcttaaatcccatcctgtaatgctgggcaagttactctaggcctgtttcctcatctatgaaatggggtacttatatctgtcttacatatagctgtggtgaggattaaataatgtaatgcaggcacaacacactggactaggctgagcttggacacaggcagtggcagaacccacactagaacccagtgctttagacttttccgggtgggccacacaggtggagggagggctgcgctgattagccgtggatagcacgagggcacttgggaaaagaggacaagacatgtaaactgtattctgggaccttctgaggcagaggccagatatcacatgtgggctggagcatttgggttgggaagcacaggatgatctagatgagtgattcccaaattgggattcctggatgactaagcaggatccctgaatctagttaatcaggacgcacaagctggattcaatatctgaagaagccgaaaaggaaacagcacataatatataccttcaggagggcaaaacatgctattatttaatatcatgttaccatgtttcccaaattctaaaatgcagtcagttgttaagatgacccatttcccccacaacgaatttacacattgattacgtgtgcgtctcaagtacagattgtaaaagtgtgcattttagaataaaacaaacgaatgccatttatttggaagacagtatcttgtaaaacatgcacaaaatgaactcttagtggtgggaaaattatagacccttcccacctggggtcctctgaataccagaaggcagggggaacatccaatgtctgcagccttttcaaatctgctaagggcagagctgtcaaagggacaaggactccttgccttgacacagcaggctgtggctccctgaggaacctctctgaagcacctcctctgaaggacctctcccagagaagggaaggcacagcagtgacagaaggaccctgtggggctctttgctgagaaaactggtgagcttttcaggcacaggagggtcactggctgcggatgactgagatccacacctgagttccttgcagggggctggccagcaggatgaaggagaggccaagccaggggaccctccagccttgccctcagcgtcactgcaaaatgctcttgctgggtctgggttgaaaggtttggagagcttactggattttaagcatctgtgttgaccagctcccgttaaggcatctggcagggagggggctcctcccatgctggcagccattaccatacagctgactttcatgctgtctctcaggacacaggcaaagagaacggcccttctgactcacccacaatccccagctaaagtgtacataagctgaattgtaaacagctgaatgtgctccaagctgccacccccagctatgcaggaaggaatcaatggagcgaacagccaccctccccccaccccatgcagttcaggacaacgggagcagtgggggatttccaaacagctgcttgaacgcttcccagcccacaggctgaggactgcaagaggggcctgagctcaaactcagcagcagcacctgcaggaccagagtgacttccaccaggtcaacacaccagggaataatagctggccctggctgcagggagtcagggaggagttttcaaagagttctacttaaccctggtgatggaggccagtccactggtatccaatgccagggtcaagggctcccagatagtctcacatcatagtgctccggcccatgctatgatttcaaaacgcaaaatgtctagaaccaatgggagaggttctacagtagacactaagatcaggggagataaaaggaagaatggcagagtagaaagagcatgggctctgggggccagacctggactcatattctgttccacctttaatcaaaggtgtgtggcttcaagcactcactgcctgttctgagtcttggtttctccatctgtaacaacgaggctcatactacctacctgtctgggaggtttcagtaaatattatatatgtaaaatgcctggcactgaatacacgcagaagctgtgctacatggcagttaagactgtgggattagaaagactctaggcggccaggtacagtggctcatgcctgtaatcctagcactttgggaggctgaggtgggtggatcacgacgtcaagagattgagaccatcctggtcaacatggtgaaaccctgtctctagtaaaaatacaaaaaaaaaaataaataactgggtgtggtggcgagcgcctgtagtccccgctactcgggaggctgaggcaggagaattgcttgaaccctggaggcagaggttgcagtgagccgagattgcaccactgcactccatcctggcaacagagcaagactctgtctcaaaaaaaaaaaaaaaaaaaaaaagactctaggcttaaatcctatcctgtaatgctggacaagttactctaggcctctttcctcatctatgaaatgggatacttatatctgtcttacatatagctgtggtgaggattaaataatgtaatgcaggcacaacacactggactaggctgagcttggacacaggagtgccaacgtcactgagacctgtgagaagattaggaaatcattctaatctcactctttcactgagtctggcctcttacagccccagagcagggctaatctttccgtggcccaaactgaggtatctgaggtttgtgttcctcagacgtcttggtctacgtcggtagtcctgtccttgcactgttgaggtcaggcttcaggaagaaatgttacctccactgtgactgcaacataacagaaatgcttctgtcctaaagggcaaagcaaagtctcaagtcaccttcaatggctattaatctaaaggacaagaagacaagcaccagattctctttctatgcagttttttcataaaggggggttttaagcagacagtgcagaagaaccctagaaaccaaaagaaaggttaactttaagacaaataaaaggaagcactgctttacttagaaaatactaaatttatgtaacttgtaatgccagatgatttagcttatgaaaagaaattagtttaaaaggctaaaaataaacccagtttaagataaactcatggaagatggatttctaccggtttacaaaagaaatctagaaatgtttagtaaactctccaattattttcaggttgataacagggaaaggcagccatgttccccaatatgatgactatttttttggttatcaactgcagcatcactaatattgttagataaatgtcaggggagactgggaggagggaacactaagcctcagttgtcctgtctatattatggactacatactacataccttgcaaatcagttctattgatcatttctgctcatggaaacattactcctttcctccttataaccattgtctaagcttccagtcaaccctattttgccaccagtcaactgatagaacagattaatactgattactggaggcctcaaaatatggatttaatcaaatttttttattttttattttttgagatgaggcctcgctctgtcacccaggctggagtgcagtggcacgatcatggctcactgaagcctcgactgtccacacttaagcgatcctcccacctcggtctcctgagcaactgagaccacaggcgtgtgccactatgcccaggtaatttttttttttaattatctgtagaggcgaggtcttgttatattgctcaggctggtctcgaactcctgcgctcaagtgatcctcctgcctcggccccccaggcatgagccaccgtgcctggtcccaatttttttttttaaagtagttgcttcatattagttttgttttaatttaaagtgtcatttgctttgattgttcaaaaatgtcttaatatagctgtgtggctttaggtcacatatggatggtttcaaatatgctaaagataccagtaactagggataattatatagtatttgagacataacagccatgcaactagagttttaaaaataactcaagcagtcacgaactttcattttcttgccaacagttccaatattcagtatcaggcctggtcctcctaatctactggagaagagttggttatggcatggcatctaatagtcatctcttcttaatacaaatgataataaatttcactgctaagacgacaatcatctgaaaaaaacagacatttgcttatgttttaaagtcataatagcaaactggggctctcttcaacatctggattcatctcagagcactggcaatctgtgtttaacagcagtcatgtctttaccagatgtagaaagaatgttctcttcttttggacttacctaaatatcatttggaaattggaagaacaggaaagcatatcctttttcactaactataaaaataatttggaaggagaaggaaacaaaaaaaaccttgaagttttctatgctggtctacatggtcttacaatgaatctcagagcaacggtttatgacttaaattatatgctgtgttccttagcatactttttcttcaaaaactagtaattctaaattgtataattcttgactatgataaaagagcccatttcttgaccatgtcatttatactggacttttgttactgatggggaaaaatccagaatttgtaataattatgtcttggatatgcaaatggttgattattttcctaacaattcccaaaatatccacatcataaagcagaattaaagatggtttgcctctcaatacctttagaaatatcaaatcagtgttctgatgtggctagtaattcaaatgaaaaatgttaaataagtcattgcttcaagtgaagcctacctctgtttgagttgtgaataagtagttatcttaaataggcaactttttttaaaaacagaaaacatattcaaaaagggttttaactggtgactcatagtttaaaccatgccctaaaaacatttaaagcataaatctatgtgttcagactcccatcttgaggggtagttcagttttgggttccatgaaacaaggtgttaagtccccaaagagagagccatttctgtcattggcacaaagtccccatcagagtagactgcataacgcagtcagttctcaccctgctttcccatagggctggggactggggggaggtggggagggtgggcaggctcagaggggcacctcactccaggacagtctcctgaggggtacacaaaagcctctctctacaaccacttttgtgagattcctcctgaccacagaaagtcatcatcatgatcatctttcagtagcaaaatggcacaaaacaaagggaataaaagagaaactatcaattatgaagactcctcattctcatttccctactctcgtctccagtaggtgtcctttcagaagagaatctttctatggctggaactaaatctgtctggagattaaatattgaacagctgggagaagtttaatataaatttagactgactcaagaagagggaaaaactcttggtaaacaccgtactaatgatgagcagcattacaggaactggagtcaccaacctattccctaggttttttaaactttaactttattttggcttgctgatccatgctggatgaaagtgaggaggtgggggaactttacttggcaaatggttactgaacgcctggcctgaggtccacagcctaaaggaggacagagacttaagggaagagtttaaggcagtgaggtcatcccctttacacattcacaatagagaaaagtagacaaaaagacacctacgagcacaccagtaggggttcctaattctgagacaataatcatgttctgtgtttttccttaaataagaaaatgtagagaggggacagcctatgtaagagcatacaaggccagaggtaagaagagttcaattgtgtaagatcatccatctacttactcctcttaacatgccctctccccctgaaagatcagaaccaagggatccaaagtatctgagacaggaaatgagtaacacaggaaaaaggatgtggtctgaaaaagagtggattctggggctgagccagagcaaggaacaggcacagggtcatagctgagggaagggcttggtggcaggaagagaaatctcagggtcagtccgcttagactagaaagtcaatgacagagcaggtatgtcaggggaagcagcacagtgccttcctaagaggctctccttccctgaaggaggcagagaatgcagaaacaatggctgatgagatgatgagacccacagccaggagaatgatgactgtgacagaaggaaaaggggctggaggtccttctttacttagagggaagagtaaataatatatatggagtgagcttgacaaaggtaaattaaaaattaacccaggacctgggagagagtggaaagggccaggaggtggggacatgatgaaacaccaacattcattaagcacctttgtgccacatgtcagtaaagaacagtttgggggaaaaaagaagggggtgaaaacaggagagaaaacatagttggacaactgagaaaccgactcaagtacaacagaaaggactaagaaactaccccctttctcaagattcaggctggaggaaaaagatgtctattcttccctgtgtgcatggacgagcctggaaacagatcttgggtgggctgagaagcagagctcatgtgatgaagagtgcctggaaagggcaggtgccaaaagagcaccactccccatctgcccgaccttctgcgaaacaagcccgcccttgtgagtgagccaagccagaggccccagttcccgccttgcaggggctggaacttaggtacagagaaatcaccagtggaaaacacagtttatcagctggttagaaagggtgaatactcccaaatgtagatccagatgttgggagctatttgttaaaatcacttttatattccccagtgcctagggcagtactttacctaaaatgggagccaaataaaagtatgttaaatctaactgaatgaaaccagaactgctttgctgtgctggttatcttaaggttcaagacagcctcttgcccgataaccaacacagtcaggtactttatttctgttctaaagtcaaaacgatgggaagccctacatcccttgtgacctaaacctaaatcctaatcaatagggtctgccacaggtctgttgccctgtaccagaataaaagatgggcgggtgggggaggtgggaagaaatacaagagcaagaaggaatttccttgcctcattagcctgtaatgttcatgctgacctagaaatcctggcagttccaacatttgggttgactcaggcggggaagaaaaatcccaggtgaatgataattggattacccagttatgctccagagccaaatggctggaaaaggccaggtcagtaggctgtggtacaaagtgacattattttttaaaccaaaaatggagatactcaggctgatggacaatgggatggaatagtttaaattggggctgtcctagaaaaatcagggacatatgatggatttaggtaggtagcttattttgcaagggatcctctgggcccaatatgctaatggagaggggattaaagatcaaacacgggagatatccgaggggaaggctgtcattgatttgtaagggaagaaaaagatgaaaagagtgtgttccgtacacagcacatgaaggtacatatcgtaggtatggagtaggaaggaaaggaaagttgttcagaaccgaaagtatgtgggtgagatcagttcaggttatggaagacgggtgggtgggcagtagcagggcactgactggtatccgacacggggcccagggcttagttcagatggtagcgtcgccactggtttgcaacctgaccttgggccaattatttccctgtctgtggacttcagtttaaatacagaatctcacaaatcccgattttaatgtaaagaagcaacaaatatagtctaccttcatttggcataggaaggagagaaaacgctcttctaaaaatggaagaaaagacacagaacagcttgtccctttccatccaattaaaaacctcgtgagactgaactagattaaaaacaaaactctccagcgaagccgcaggcgcctccaagatagggagtccaccaccaataaagtacggcagatgccagcagtctcgtccccgaacgcaccgtccgtcccagggaagtcgcagcggcggggaggccggtcctaggttggggctggggtggggtgtgcggggcctggggacgcggaagctgcggcgcgccgaggtgacacggcttccaggggcgacgggcgcgcagggtccccaggcgagcgaggctggggagcagggcacctcccaggcgccgcgcggacgagagccgcgactggcacggcctggcagccgcgtaggcccgggccgttaggggcaccgagggcggtgcccgacttccagtgcggcgagcgcggcccccggcctccctactggcgagaacccctcccccgccccggcactgacctgtccagggcccggctgggcctggccgggcggggcctacgcagcccctcggccgggcgccgactcgcgcggggtcccgggcccgggcgggccgcctcctctccgccgggagcctccgagccggggcccggggctgccgcggcgcatccgaccgcaccggcctggccggcgtcaacaaagggcggccggggcgcgaggccgggacgggggcgcgaggccggggcgggagcgcgggcggcggccggggttgcgcgcgcgcgcgcggcgggcgctcgagggctgcagccgccgcggagacaatgcggcgagtctgggacggctcccgcggccgcctccgccgggggcggggcgagggagcggggcggggaggggcggggccgcgggaggggcggggcggacacgggccgcgcgcttcctttgtgcggcgagccccgcctcgcgccctccggaaggcgggttagggacgcccggggctcagcttagggaggcgggcgccacgccacgaggaggctgccctgatagccggtgcaagtgctccttggcggggcggcccgcgactcccgccttggaccgttcactccctgaggggcctgggggtcagtcagaagactaacgaccaccagtcaccgagagctcagttcgtgccaaaccctgctcgcgctgtccccgacttattgttcacaacgaccctacaagtcattctccttcccactgggaaccgaggatcagagggaagtcatggcccgagtgccccggtcacacctccgtgagcggcctcgggctcgcggttgaggctgattgaggaagtgggttcaggcggcccgccgtgcctggcacacggtcagagtcccgtaagtgttggttatcttccccaagcgcaccgggtgaacctgcgctgtcgtggcgaagcatactcattcagcacgcgcgcgaggggctgcgggggtacagagacgtgcagcgtgacacagtccccaccctcaggagcgcgaggcgcaggaaggtgctggacacacgccaggcacttctctccattcttgacttccctctgttcccaacatggtcccattttcttgccttccttagtattcatattcgttgcctgcctttcttctccccccacccctttccactctcaggcctcatcccatcttctttgtttacatttattttacattccccgaatatttacttagctccctttctcctctatttttcaaattttcaaccccccttttcattaatattcatatttccttctcctctgcctctgcatttcttacacttatattttgttttataaactagggtaacacaggattgtatcctcaactcctgttccctaacatgcccacactttcctgcctccctctcttaagttccaccagttcttcctggaatgctctttcctcaactttgcatgtccaggtcctacctatccttcaaggtccagactcaagaacagcagttggcaaactttttctgccagggaccagagagtaaatattttagactttgtaggtcacacggtctgtggcaacaactcatctctgctgttgccgcaggaaagcaaccacagacaatatgtacgtgaaggagtgtggttgtgttccaatagaactttatttatgggcactagaattggaatttcagataattttcatgtatcatgaaatagaattcttttgattttttcaaaaaaaaatttaaaatgtagaaatcattattagcttgcgagctgtacgaacactggcaatgtgatggttttggccattgggctgtagtttgtcaacctctgctctagaacaatgcctcgtcctccctgaaatctatcctgaacatctctagttggcagtaacttttcctgttttgtagcttttaaatgacttacctcaaatccatctatggcatttatcgcattttactttctattgtaatttttttcctgtgcatttttcatcgtttcaagtagaccttcagctcttgaggtggggtacagaccgtgtttctcagtgtgctacctcccttcccacagtgctttgcacagagcaggcattcacacatacacagaatgggccgggcgcagtggctcacacctgtaatcccagcacttgggaggccgaggcgggcagatcacctgaggtcaggagtttgagaccagcctggctaacatggcgaaaccctgtctctactaaaagtacaaaaattagctgggcatggtggtgtgcacctgtaatcccagctactcgggaggctgaggcaggagagtcacttgaacccgggaggtgtagattgcagtgagctgagatcacaccactgcactccagcctgggcgacagagtaagaatgcatctcaaaaaaaaaaaaaaaaaaaaagacatacacagaatggatatttaagtcttgggtggttgacagttgtttccactgtgtaaagcttacttctctcatgagataggacctcaagaggaggatgcttgtttgtatatcaccatgattagatttcagaaagaaaattttgagagctttatggaggagaaaggcaaatgtcagttcatttaggggtttctggattacaaacacttgagcaaaaaatgttgattaccactgttgcggagacagggcatgagtactcagtggggtcccatatggtacttctattagcaaattggtaaaaggcaaataaaacatgctatataatttacaggtggcaaagttaagcagaggtgttagtataatgaatagcagaattcagatagaaaagattcctgccccaccacttgtttttttctatgcctcagtggtcttacctttaaaatgaggatgataaaagttgctacctcagagggttattgtcaggattaaatgaggaaatatgtgtagtctagcagagagggctcagtaaatattaactattaatcattactgttttcttgctaggctggaactatgggctgaatttacaaggtaacacttaacagatgtaagcaattatattttggttcaaactataaattatacaagtttgagactagggagagctggcatgacagcagttccaggtaagacgaaacctcagaaacaaaaatgaaacccagctctctggaattcaggtgacagtgctctgtgaacaacagtgtcattcctatagggtgggagagttcacgggggccattcgtgcaccatcctgatgaaggaaggtgagcgagtgactaccgtaggagtcagagtcatggcgctgccctttcagagccgcgggacctggagcccctcagcctttgtttctgcctctgaataatggggcgattctacttatgtcctagggctgtcgtgagtgagtaaaggacttggaacagtactcagcatatactaagtgttcaacaaattttggttcctccctaccgtaaaacatggatctagggaacagccctgcccctgaaacaggcctctaaagactagtagctgtttatatttggaattaatgtgctcaattttggggaccaaacgttaggaaaattaatgaaaaggtagaatgtagatagacaagcctgaccagaatggtgagaatggaggtcttgatctgtcataggtaaaaaatgaaaaaaagtctcagatgtttagcctggagattttctcttttttaatggggggagaggcaagagacagtccgacaactgtctacaaacactgtataagatggactcttataattcacaagacagaatcatgaccaatgctggcaaattccaagagagcaggttttgacttcatttgaaaagcaactttctgataattagagcaaatctacagtggaatggactgctgttcaaaaccccttctcatctgcaagtgtgcaaagagagaagagatgacctccttcccatcctttaattttcctgctgtcctttctccatattctcttccttgatcctgcttctgttccctatagaaccttcgtactctttttgccctgccttgtgctaaggtatttttttcttatttctccatcaatttctaaactctttttctctttcctgttccccgcccctaccccctcagcaaacacagcacaatgactggaactgcctccctgagttgcaggtggtccatggctcagaatgtcactgagatctgggccaacagtgctgtgcaaactggcagagaggggaagggaagcaaatagatctttgcagaaggcggaggtactgctgtgcctctcccatccgggtgaagggacccagcagagtctcctgaaccccaggcagggagaagtccacttgtaactgagcccgcacagatggacagatggggatcccagagctgagcagttttcctcagagatgcttcctgtgagctgaactcatctgagtccccttctgcctccccctggcatttcccttatttttgagatgtggtagccgttttgccatatttccaatatcaagaaccccctttcataccaaaggaagcagagaactgtgacaactggccacctgcctccactctccacttggcatatgtctatgtggatgcatctgacaccagtgacatgcaggtaggccccagtgtctggctctagaactttcacctcttctgtctccaccctcttgctctaatatcttccgtgtctcaattactttatccctggttcatcttctcacatccctcctctgtttccaaccccccagcttccttgcttgtaatagtttaccctcccattccagatgcccaagtgaaatgtgccagggcatggcaagaaaggccaacttcctcccctcccccagggccccactgtgcttcataccgtgagctggggacggctggatgttagggctcgtgggtacaggcaggccaccaggcatggcagtgacaatagcctgctgatgtggtgatgggccagaccgcgtctcaggcacacttttctcccctggtgccacttctttccagtcatcagggacacactgctggggctgtcaaaggacaggacagagaggggggcctctcagaaatagcctttgcattcttggatacttccctggtttccatggagcttgggaagcaggtaaggaccttaagattcagtcatcctcaaattggggaaggccctctcttccttcttggaatccccaaagatgacttcacccgtcagcctacccagaagcacctcttgacggggctgtggggtcgtccgagctgtggccaccccgtgtgctccctggaccttggggctggcttactcaccactggtgaagcaggctgcagttgtaagatgacagctgaagtgtgctggaacctgcgttgaggggtgtggggcacgccctcgggatgtccattctgaggcccagtatcaggtgtgggagggtgacactgctgactgccgccaggcttgtgcaggttggcagtgggacactggagtggcagggcgggtgtaaccgggcctagtggcatggcatgggcctctgagctgggctggagggccacgcttggagagactgaggcgagctgggggtggggctcagcttggagcacaggccgtgactgctggggcggcggctgctgctgttgtggctgtggctgctgctggatcacaaattggggctgcaggtgctttgaggatggctgtgggaggagctggtgtggctgcagctgagcataggctgaaaggggaaaggccaggttagagagcatggcttgaccttctcttctgctgtgtcttccaactctgcccctcccgcatccaaataaaaatggcttcccaaattcaatgtctcttgttttcatctctttcatttttcaccctgagcctggcctgctcattgccatggcctaacacattcactctattcctgctttcctcctttgctggaggaacactgggctctttgagctgtcccccatccccaaagctcaactcctcaaaactaaaaactcacctcctctgtgatgccctttggccattctggcagttcagagaaatactggattctaagtgtgacatgctctcgctctcctccatgcccttcacctgctgttctctgtgcctgcaacagctacaacctttccaccacccaacccagctctgtgtggctagtcctcatccagcctctggctctgctcaggcgaggccttctccaggaagagccagtagacaacggtggttcttggatcctggcatcagacagaccagggctggattactggttccctctgttatataccaagggacctggaaataactactctctgggcctcagcttcccaatctaaaaattgaaaatatagtttctgtacagaagttgctaaaaggatgaaatgagaagaaaatgacagaaaaatgacttaatgtgcacagcacagtgcctggcacatggtcatattcagtcatttctagttataactactatatcagtctggtttaggttcttaaagtatccagggtctacctctatcataataatgcttattaaggtgagttgtaattgtttcttatctgtcttccagatcatgaactccttgcggtcagaaactttgtgtatctctttttccagaacctaccacagtgcctgacaggaatttgttttttggcatgtgttgctatgctagcttttctctcttctattttaagcaggctgactctttgaggtgaaaattcttatatatatatatatatatatatatatgtatatatatatatatatttatttatttagtatttattgatcattcttgggtgtttctcggagagggggatttggcagggtcataggacaatagtggagggaaggtcagcagataaacatgtgaacaagggtctctggttttcctaggcagaggaccctgcggccttccgcagtgtttgtgtccctgggtacttgagattagggagcggtgatgactcttaacgagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaagaacctttcttagtacagaacaaaatggagtctcccatgtctacttctttctacacagacacagtaacaatctgatttttctttcttttccccacatttccccctttcctattcgacaaaatcgccatcgtcatcatggcccgttctcaatgagctgttgggtacacctcccagacggggtggcggccgggcagagaggctcctcacttcccagacagggcggccaggcagaggcgcccccccacctcccagacggggcggcggccgggcgggggctgccccccacctccctcccggacggggcgaaaattcttatattttttagtatcccttcagtgtctagctcatgccttgtttggagtagggattcaggaaattcagctcagagattgtctttgcacagatcactctctggctagtgccaggccagcctaggatgaagcagctcagctgaatctgtcctgtttaaaaactgccctccacagagacttccacggctggagagctagccaagtgcatggcaggccacagctggaggcccgcaaatggatttttacaactaaagcctcatgccagtaaggataaaggtgaattctgggtcctgagctcacgttttaaatggatcctgtgatgcaacaggtgcaaagtaagcaggtttcaaactgagttaggggaggtgccttccttcttgaattttgtctgttcacatgcaagttttgaatggtctcatcccagcccaacgtgaaattccaagcagaattccaataggaatggaaaggacagaaataagatgtgttacaaaggaaaagcaaaatggtccttggtgactgactgtcgtagtcagagagagagggactatggatggcccagaggggtttagtatggatgatactgaatgacaggtttgggaaacttggacaccagtgtgatgttgagggaagtgtgttgggtttgggttgatggcggaacctttgtggaaatgccagcagacatttggtgattataaactgaccccaatctaagctgtgtctccttatctcacattgaataggtcggaatttaacaatcaggcacttttgagaagactgttgataaggcacctgggagacactgaagaggccacacaggactttgttaggcccccacagccaaaatgatctgcaaatgttgggcatgtcactgcaaatgcaaccaaaactttttctcctgtaatgcaaaatcatggattcctgctcctgggatgtggaatcattcttaggggctgcctatgtgaggtgggagctggagatggttccaggtcagggaggctaagaggatcaatggcatgccccactacttgctggctgtgcggcctgagacaaggtactcttctttctcagggcttcagagtttaatctgtgaaagaggaggtctgggctaggtgatcacataaatctcttccacatctagaatttgatggagtggctatagcagaaaagtagtttacaattcagggttaataaggaggaaaaaggattacagagggaaaaggttctaaatctctacagcataaagagtataggtagggacaacacacatttgttttcccaaaagactgggaaaggggactgcttgcctggcttctattcctgtgcttcctctcctatcccattccctccccaccctgtgctgctcatggaaaactgaaagcaattgttttaggacaaacgaggctactatacaccaaggctggaaatcaagctcataaggcttgaatcaatttatagatcagagacccaaaggtatttggggtatatattaatacatccttaactttttgaggttaataaaaacaaagatcatgatttaactccagcattatcctggatcaaaaaaaaatccttttgtttcgagtactgcagtagaggaagggtcttcctgattccagtttcttctctctgtaatccagcttagagagagcaaactaatcttcctagtgcacagatctgatctctcactaaaaaccgccagggactctcctttgtctacggttgtctaaagcccctggcagacattcaggatctctttacaacataaaccaaccttttaatttttattatttctttgacccaagcaatctttactgttcactgtaccctgtacagagtatatgccttttctcatactgtctagagtgctacaaatcaaattctagtcaccattctctggtctttacagctgacaggactttcccctttctctgagatgacaatcaggccgctttgctttgcactgccctcagagaagcagtgtgcccagaagtcaagtgtgagctcttgagtcaaaatgcttggatttgaattccaactctgctgcttaccagctgtgtgacatggggtgagtgagttacctgacctctctgtacctctatgtcatcatctttaaaatggaggtaaggatgacacctatctcagagttatttcagtaagtgacttatctcttttagtaggcagaatttatgtgagacatttgtttcctccaaaatatcttgaatttagtagatgctcaatcaatattgctgaatgaatgaatgaatgacagacaacatggtgggacttgtttatcctacaagacttgttctcaaggcttcaaatatgcaggaaacgactcactgtcccagaaatgctgggactcttgccgcaaagtatatgggagctgcaagcataccagttatagttacaggactacttatgcactcattttcctagaagtccactatagttgactagagtttgatgttacctggcctaccagcaaggagaatgtgcctgtgggagaggaatggcagatctttttactagccactacccttaagggaagatacactttcaaccattcactcactcaacaaacaatttattaagcacccaccacacaccaagtactatggttggtactggctaagacatggtccctagaagagattacagtttagtaaaagagatggaagacagatactctcaccataatttggtaaatattatgataggtgataagcacagaatattgagaacacggaaaaggggattcagctttggaaggagagcagagaaggtttcccagagcaagtaagtgtttaacatgattcagagttaggaagatgacaaaaggaacagcattcgggaagactcagaggcataaaatactatggtgaattcagggatctccagggcatcatgtatagttgaaagccaaggtgtctaagagagaggagtcagaaaggaggcagtttttggctgggtctaagttacgctagcaccttctaggggctgcttatccctaaagatgtctcatgtgattaggcttcatgaggtaactaaggttagagttagctctagaggtcagtgctctgcatacacaagaatagacaaggaagctccttttagaaaaccctaaagcaatagccacacaaattttccatgatgcattcccttggcatggggtcaggaggagtttgagaggggaagtagagctaagggaagtttacctgtaagaaacttgcaaaacggtgttgggttgccagctgcaggggcactctatgatagtctgattatgcttgaaggttcttaggcctgttctgcagccctctggaaaaactaccaaatacttgctgtgtacaggatactttgctaagcagcttggagcattataaaagaaaatgttatctgcatctctgcccctaccctgcccttggcagaggatggcaggatagcataagtggataaacgcatgggttttagagtcagtcagatctgggtttaaatcttggctctgacactgataggctgtgcaatcttagataaattgctcaacctctctgtatcttgacttgctgttctgtaaatggtgacacataccacatagttgttagtatcaaatggactattttgtttaaaccacaaagagattcactgcctttgctcaacacttggtacctagtagatgctcagtaaatggtagctattcttaaaatactacctgttatctgtgtgttgctttgaacttctcaaagaatttttatcatttaaatctaatttatttctaacaagaagcccatgaggcaattgagaagtgtttttattttacaagcaagagctgagagtagtttccaagtgacttgtacaatgcagtaagtgaaggggaacttgacttcatttgacaggtgaggcatggtgccttgcatattacaagacgctgatggccaagtgaataacacaagtcagtaaggacaaaaaaggtcaaaaatgctgatggccaagtgaataacagaagtcagtaaggacgagcgagtaccgcaagcctaggagtattagttgcaggcagttgagaatactggaggcaatcttggaggtatggacaacaaaaagggattgttaacgccaggaggcagggaggaaaagggcatatgacaggccaagaaagtcacaaaggggtaggagtgggagagaagagacaacagcatatttgcttggccataacagagcgtctgcatgaggacaccacgagcagtcaggtgcagtgggcagtggggggagggtctttaaggtcccccatgaagtcagatagtcagaagtcattaacatgatattgagtgagcccttactatagactaggcattccagctgatcaaggaggacataaagacacagtgaaggtttttgttttttgtttttttgagatggagtttcgctcttgacgcccaggctgtagtgcaatggcatgatctctgctcactgcaacctccgcctcctcggttcaagcaattctcctgcctcagcctcccaagtagctaggattacaggcatgagccaccacacctggctaatttttgtagttttagtagagatggggtttcaccatgttggccaggctggtgtcaaactcctgacctcaagtgatccgcctgtctcggggcctcccaaagggctgagattacaggcgtgagccatcgtgcctggccacagtgaaggtttttaaacaagaaggaaataacagtctctgagggagataattctagcagttgtgagtaggatatcctggcgatcagttcagcctcatcccgtcagcaggccttaagcaaagcaggaagccaaaacaagaggaagtctcatcagaacctggtgacaaactggtgataagctgggtggtgatggagcgtgggaatgagggagggctttctctgtgccggtcacttgcacaggccatctcagtcatttacagcccataggaaatataatcacctctgttttacggatgaggaaatggaggtttacagagcttaagtaacttgatcatagtcattaaactaataggtgatgaaactggggtctgaaaccaggttaactccgaagcccactgcttttcccactgtaacgctctgcctccctggtagctctgacaccaacaggtggtgcaatcttagataaattgcttaacctctctggatttagacttgctgttctgtaaatggtgatacatagcacatacttgttagtatcaaatggagtattttgtttaaaccacaaagaggttcactgcctttgctcaatgcctattagatgctcagtaaatggtaactattttaaaaatactacctgttatctgaatgtgaagtcaaaataactctgtgagtctggggtgcaggaggacctcgcaattgtggacagtgctcaggaaactggtagagggggcctttccagagaggaagatgcatggtttttgttttacaaattctccagattaaaaaaaacttgtatgcagtggggtgatgtctatttatagacagctgaaatgtatggggagaagagaggaggacagggatggatgtgtattaggaagtcactggcagacaggtggtggatgtctgaaaggtatgaactgacaaactcctctgtaagtgaaacacaggggcacaggactgagttttaggagacccacagctaatggcagaggcaagggaaaaggaaggagggtcccgcttacacacacagatggtcacacgcgcacacagcccctctgggcttaggtgcttcccagtgccagctgagatactcctcctcctgttccattcttgaaacttaatcatgtttcaaagcacaactcaaatgtctgcagctcccattagaatttaaactcttgttcatctctttaacacccatagtgttcagcataatgtttggcacataagaggtgctaaatgagtatctgttgagctacataattaaagggacaaatggtttggggatgacagtgactctgagccatacctctttcatttgtgaagtggaataatcactgttaagattaagtgagatatgtaggtaaagcatttagtgcagtatgtggaacatggctgttcattaactggtaattattactattagcccacagcaaccagggaaatagtctaacagaagcctaggatgaagaatttcgggaaagaagaaacgtccagcaaggccaagtccctttgtgtgtcagtctgctttctctctcacacatacgtgcacacaggctcgtacacacaaagatgttaagcaaaatataaagcccctccactgatagctgatgattgtggatttttctcctaacataaaaagagattcttagtcatctagatttggtgctacagtggatagctgaaatgaccttcatcaaaatcgttggggattttagcagatgacagtcccacctgtatgctttggtttttattggattccctaagtaaaagtgtgcttgcagtttggaggctgctttgggagggaaatagggtacccaagaatcctggaatcagcaacactgcattgtccagcctatcacagacagaaatcactgccccctgcacaaaacgctctctgtgttcaaacaaagcagctgtgtggccttccagcagagttctcgctcctcagctgagacctgaggcgggctgaggatgcagaacaaagacctggcatctggaggcccaactgggtgaaagggccctggcttttcaacaacccgacagttcccttttatcacagcatatccctcccagtcagcaactttctcctcacctttgggcctgagtgtgcacccaaagcctggagtttatccactagaatgaggactccaagaaccaagtctcctatctggggctgtggcccactcccttaggactcggcttccctgaaggccaggcccaagggacccctgctgcctgcctctcttctgccctccattgctcagtcctcatgtcagtgagaagggcaagccaggcccttctccttcccctccaaagcccaacctcttaggctctgttctccgccccttactcccctcccccacctgctcccccacccctattctcggcataagggaccttttctatttgcagagcctgaagaagccggttgccaaggtgacaggagcaggaacagcagggagcttgccatgggggaggggctttgcccccaaacagctgtcagtgggagcagtcccagctgggactggagggtctgcctgctctgggaggaaacagcccccaggagaacacattcctcactgccataccccctcctactggcccactgcaagtctccactggttactttccctgggggcagccagccagccagctcaaaaaatgctccaataacaaacaaaaaatgtgtgcgcgctcgcttgctttctctctcccagacacacacacacacacacacacacttgctttcacacacacacacacacacacacacacacacacacgctcaagcacgctcttctctcctgctctcagatcccttggttcattgacagtgggttggctgggcaggaggccagaagtcacctctgcccagggaactgtatagcccaagacaggtgctgctcctggctgccgtgcactaggtcctaagaatgatttcagtctttttgtccagaggccctgagaggaccttcccctactaaaactccccagctgccttccatatgggaggtgggagtggggcagcgccatctctgggcttacagagaggaaggggtgggagagaggaagaatgaacaggatggtgggaggcaggaacaatgcaggcccactgctttgtgtctctggggagaggttctttgtggagctgcagctcacagctgctccatagaaagttctgtggagccactggtctctgtactgcattctagccaggcactgttagccttaggccctcgggcctcaagcctgtcacctgctggtgtttacctttacatggggtctccaccagactctgcaaaccctcaataggcttagaccccccagatactttcagctttgggtcagaaacaggaaaggctgaggaggccccagattactgtaagaactgagagggacgatctggcttgagatgaagaacagtgtttgactcagccagctatggcccccagtcctgccacttactacttaggtgactttgagtgcgtgacggatgtggtaagctcctggagaacctctctgagcttcagtttgctcatctgtaaaatggataaagacagctaccggacagggatctttccagggtttaaagaagcgtgatgcatacaatgcagggcacgttatctagcacacgacggacgtcctgtgagtgctggtcccgtttctgtccagttttcttgagaactgagttgcctagcagccttaggaggaacccaagaactagtctttcttttgaacagtgttagaacttggggggctggcttagatttagagagaggttacatttcggcctgggctggaagggggttctcaggaaggcctgagacgcagatggtccgccagggcatgcggattgaatgagaaactagaagaagtgctcatctggggtctcagctgtagtccaagctgctttcaacgcattgaaagagcccccagtctacccttctgagcctcactttctttttccataaaaggaagaggctgggccactttctggagaaagccatgccagacagtgagaaacatctgaagccacagggccgtgaggcctccgtggggaggtgcctttcttggctcagcggtgaccactggaatgcagcgactgaccctttgcccctgggtgacttctgaagcctcaagaaggtgaatgagggattttgaccccgtttcctcctaactcagtgccatgtgcgctgctttgcttttctctgcctgggaaccttccccactctgtctgtcaggtcacatgctcgtgccgcaaggctcatgtgccatgtcctctgaaggacggcatctctgacccattctgcctgacaggcagctgaccatctgtgcccacactgtacctggtacttagtcctaaaatagaatttatgaagtggaatggatttgcttctatatctggttcccttcttttgactgcacactctagggaaaaataaaaatcctatcttattttgacaaagatgtattgagatatattcttgatgtattttctcaagaaaaaaccccacagattagattggatggtaaaatggtttgagagaggactgaggttagtggttgtctcagggatgcgatcagcgtgaccctctctttaatgcaaagccatgtgcttcgccactctatttatttctatggtaaaacagggtggtcttgttacctagatcgataggcctggcttcttgggctcttggcagattttcccattaaagattgcctacaatgggcagcacagggagagttttagtaggcagggaaaggggtctagcagggcatgtggattcatcggacctgcctcacaagcaagctcctagatttattctcaagtgttaccctcactagcaagcctttcctagctcctctcctcaagccacatagctcttctgttctgacagtgttcagagcttagatctattatggcatatgcactgcactctctgtctccccagctacactgtggagggcaggacctgagtctcatttatctctgcacacctagaattggcaacatgattggcaaatactaatcaacaaatgcttgctgaatgatgagaaaaataaacttcctacattcccatctctctgtctggttcttacatgcttctggctagcccctggcctttttgctgagtcttggagaatttcaaaatagttcaactgcctgcctccagccactccaggttgtgcccacagctccaccgctgtggctgcgtaccctgattcatcgctgtgcctacagtgcagaaggactcctttattccaactaacatggctgccctgcgtaaagttagaccagaagcatggcacagagccaggagctgatggacattttgagatagggagggaggagagagagatccatggctggtatctttgcaaatccatgggaaaaaggaaagtgtgaaagtctcctcctgactcacggccctgagttttctgggaaaggattcctgcttcctgaagaccttacctggtgcaatgagggggtgggcagccacagcaggaaccgtccggctgagcccagcccggccttccatgctccctggcacactgctgttgccatctcctttcttgtgtggctccatcacactgtcagctatgccaggcttggcacctgcaggggaagcctgagcagtatttctgctctgtgctggggtaggcagaggctggctaccgcccggcgtgggtttcagggccaagctgggcaggacaggctgagtgggggtggggcccgaggctgctgccgctggtgtctgctgtgttcggagggtcaagttctgtacctggaaaagaggggtctgtgggagtccagagaatgtggcaggagcaatgccagtatacaactaagagggagagagggatggatccaggaatggctgaatagaacaggaggttgtcaaatcagagagagagaatgtgttaggggctagaagaggaaccagaagcacgtggagttgctaaagagggccagagggttcgctgtgactgcatccagcagcagaagaggctgagttctgagaaggacctgctgcccagctgggcgggcaggggtggggaggccaggctctgtcccttctgttgccctccctcctccccaacactttcaggattggatgcacaccacccagaaataattcccagtgagggggagcatggggcttcccacactggaaaaggccagggcaaaagtggaagttaactgaccaggaaggccaccgggcaaatatcttgtctcagaataaggttgccaccggctcttccaagacggccggcatgcttactcagcccggtccctggcgccctctgctggacacagggaggctgtgccagactctgaaaatccggctaccagccctgtcccatcaccctccccattccgtagatgaggatggggagatgcgagtgctaggggttccttccccggctgcccacagaatcttcccagccacggtagtatctgtgcgctcctagcagagcaggacacgtctctgctccctcttacatgtcatttttctcgagtcctagcagcactaccgtgtgtaaccggagcgggactttccacttatgaagcagcagcagccagaccagctatgctggggcaggtgtaaagtatggagggtagcacagcccacccctccctggcaaatcatgctggcctcagcaggctgccctctggctcctgacctgtgtttgagggaacgaaacagagccaggagggactgaggccttctggaacagggtagacgcgcaggcctgggggcattggggtgtcctgtctcccgcctgctttcctagctgatcccggcctctccttgtgcccctccccagtatcagtgcccctctacaggggtgcccacccccctgccctcccacaagcatggagtcctcacctgggcgggggtggggggccgggcgggggagccagtgccgagctcaggctgcacagtagcgacggtggccgtgggcgtgaagatgagctgaggggacaaaggaacagtgccgcctaggctcctagctacctgcaccaggttacctggctgggcctggaatcacaggaaacgaggcgccttttacctgctcgatgtggactcagccacaggacacaactgtttagcccaggagcggctatgaggaagggcaggacagtagaagcagaaaggaagggggagtccaaggggagcgcctgcctttctctagaggctcgttgcatcctgacccaggctgggtgcaggggtgggtggggagagccgctctggggctacaccaaagccgagttcccttcagaaccctctgtgaggggctcatcctagaggagaccgatatccccaggatacgctgaagccaccacctccttagcgtcctgggaagcgagatggatgccctaggaccaccttccaggtctaacccactgctgaacccagggctgagccaagatgagactgccctccaggggatcaagttcgatgtatccttttggtcattttctagtcaaagttagattcagaggggcctagagacaacaacagcagaggaagcggaccgcctggagccgtcctcatgtctgaatcccatcctgcagggtgcaggatccatggtgttctctgcatgacacctcgacctccgtgggagtctagctctgcatcagtgtggatgtgctggtgccttgacagggtgctttccctagaactctgcgatagcgcagctgtgctttttcctctgtgggtgtatgccctgctctggggagggaggcagacaggcaggcatcacgaccccagtggagtaggacatagggacaagcaacctgcagacacagtcagctttgggcagcagcatcacagtgtggctgtccagttcccgaggagatggaagtctatttcatgccttgtgtctaagaggctgttccctggggatagagatgcgcctcaaatgatgaactcagagccaagaacaaatgtgcgggagcaagaccagacaagctccgagggtcacgtcctggccataagagcaaagggaggggtgggactgtgttactttcgggatagtgtgtcaagagcccgaaggagcagacttcagaatgggaggtatgagacacgacccacagtgactgagccctagctggggctgcatgctactgccacccagggagtatgctgccattttcccagggcattctcctaaatcttagggacctggtaggctcctaaggacctttgcacccctcagggataggtgcaaaggaaagagttggtgctatcctgagtatatcctgcccaaacaagctcacctgaccctgattagaatgggggccgctgggagggcaatggaggcacgctgaagctggaaagcatctttggcccttgagttagaggtggccagtccttgtaaggatggtgggaaggggaagactccatttctgtcaagtatatggatgtctgggtgtccaggaccacctgggcatgaaccactctgcccatcctgattaattttgaggagtttctgataaggggacacttctgtttcactctaggaggagaaggaaaggtggcatcgcaggaactttctctgtttcagtctggagccccacccttcatgactcttcgaggctgtaccaaagctcccactcagccttccaggcccccttctttatcccaccccttatctcctgcccctgcccctagtgcttcctccccacccttctccagctcccagctcccagcttctctgcctctgtcctcctggtgcctctgagccatggccctggccatgggtactcaccatctgtgccctcagatacatctgtgcttggcttgcagtcagggctggggaagacgtgttgcccaagagcacagcctgctgagcgatgcctgaggctgctgcagagttcacactctgggcccggttgaggagctgggctgctgctggggaggctgccaggttgatctaatgagagagacatgtgcggtaggagataggaggttctgttggtgagctgtgtccccctcatccatttctttctcccccctcttttgctccttggtttattcagcctccttcaggaacgtctgtggtccttggctttggagcaatcccccagccctgtcccatctctgaccttggtgcagagctgcagggggatcccatgttgagagaactgagctatccacagagagccctgacactgggaggatgacagggagttactaacctaaaggtcagtaagagacatgcccttttctttttcttcccggtaagggcaatagattccagccatgatgctacatggccacggattcaccacaactgggtctgggaacttgggcattttggtcctggggctgtggactctgctgctgctcccccattctactcaccgaagatgactgggccggggcctgcgcagacacattgctgcctgaagtgcttccttgtctattggataccaggcttgcctaggaaagaacaaactcctcttgctagagtcccagacctcccccagtcactcctgggctctcatcatccacaggaggtgctgcaggctggtgttaaggacaacagcctctggaggtcagcccccaacctgcctctatgtggcccacagcaagtatcccgcctcctctgtgaataggtgaggatgctaacagtacctgcctgataggattgctgagaggactgaataaggcaaggcattgccactgagcactccaactattaggccaccgccttcggtgtgtggagccctccactccaccactatcacacccggccaccaccatcacacccagccaccaccatcacacctggccaccaccatcacacccagccaccaccatcacacctggccaccgccatcacacccggccaccgccatcacacttggccactgccatcacacccagccaccgccccccacagagaatttgcagacatgagctggagtgtccaaactgcccttctccccatggccggcttctcatccttcaagtgtcagctccagtgttactccaacagacaggcttttcctgaccatgcaatgcaaggccgtctaccttgcccttcagtcagaacaatctgttcttctctttcatggcgcttattgtaacttagagatttaaatattttgtttccttggctattctggttcctgtttacttgctgtctcctattgtaagtgccaagaagacagggtgctcagtatacccagtgcttgatacaaactttgcatgcagaaggtacataaaatgtttttctgaatggataaatgaatgtgttcttctcagctaaggaggagagagagcaacaatgggcagacaagctaaacaggcagtgcccttcgttcacgaacgcttccctggaacccacagtcctttccctagacctgcggtaaggtggttaggagaggggctccccggcacttcttccatgggctagcattccgccgctatagtcactagctgcatgaccctgggctctgtccttcatctgccaaaaggagataatgacagtagtgctcgtgtcacaaggacttctttaggttgcaggtaagagaaggatgtgaagcgcaggtgcggtgcctgcttcctctcccttttgcttccacaaccaggatgcctggcaccagcctcaaggtccttcccaagtctcacctgctgtacggctgccaggctctggagctgggcgctgctgaggtgctgctgctggagcgccgcggtctgcagcatgaggtgctgctgctgggcggcgtacatctgctgcaggtactgagcggccgtgctgggctgtctgtgcagggcctgctggatcacctgagaagggagggagggggaagagccaggctggtagctgccacacagaacacccctttggcagtaatgccttgcccaccccaggtctctataactgctcgggagacaccaagatctgtgaccaccaccacagccaattgtggccactctctagggcagtgggaggacagctgttcgcagagcttcttcatcatgtctaactttgtctatcttgcctctctctgcagctcctccccagcacggcctgctcctgcatcaactgcctcggtgaggagaatcagagccgcacgccagtgctttaaccaactcttgggcagtagggaggctcagggagacagaagggtctccaccaggcttgtcaggcactcctctccctctgtcactctgcagcctcagatgagagtgaagctcaataaggcagggaaaagaatgggggtggagggaagagccaagtcagcagggggcctactccagcttcagcaacagccagccacaggcaaacttaggtggaggcaatgcctccttcttgaggctggggctgcaaggcagacttggggctgctccccagctctgcccacagcctctcagagtcccatcaatcccttagaataaggttgtctgggccttacagagcaggccagtgccacagggacagcacactccccttttattcttttttttggaggggggatggagtttcgctcttgttgcccaggctggagtgcaatggcgtgatctcggctcactgcaacctctgcctccctagttcaagtgattctcctgcctcagcctcccaaggagctggaattacaggtgcccgccaccacacctggctaattttttttgtatttttagtagagacggggttttaccatgttggccaggctggtctcgaactcctgacctcaggtaatctacccacctcggtctcccaaagtgctgggattacaggcgtgagccactgtgcccggccccctttaattctttcccttcctctctctctccatcattccctctttttagctgctgtctcccattccctggccttactgcttattccttctttcctgatgggattggccaatctcctggaaaggacaaaaggctgtcctttgatcctccccatccccaggaacaaagaacagcgagtgcctttccccagccctaagatcctctgtcttcttcctgtgagtcccagagacatttctcctcccttctcccactggtcaccctcctgccatctcttcccagttgatgccctgcactggccttcaccaggcttccccctattttctacccttacctctgctgaatccctggccacaggcagctcctgaccctgggccctgtcccggcgagcaagccttgccagaacggggcccagggtcaggtcaggctttccccaggttggtgtgacttctagggctgacagctctaggacaaaacagcctctggctcagatttggggttctgtaaaaacagcctgttgttatagcagatcctccgtgggctctggtgtctccccagacatccccatcccaactcttccacatgttgcccccagattccactcctctgacgtgaacacccctctccgataccctgttttattttaactctattctttttctctcctgctctctcagaattatctgtctgtattccctttgcctaggcctttctattagactcctgaaagtgacctccccagcagtccagcccatgtagttgagatcctgtgacccttcctcatgagaagatgtcaatgaagggagacaggaggagcccaggatggttctgcatgcaaccttgggtgattccactcgccagaacaggaccccagacccccttttgcctagaattgtgatgagtggcaggagtgggtatatctgaatgccgtggctataaatcagagctaaggttctcatgcatgatgggccagggccaggtgctggggctagggacaagggtaggggcaggaaacatggattcactaagcacgaggtagaaataagtgggagagggaagagtccagggtatctgatggcatcttctttaacttgggttttcaggccctcttactgtctgttgtgggttctcccttgttcccttatctgggcctaagttcaaagcaggatgaggtcacttttctagtatatccaaactgtaatagcaaagtcactgggagtaaacacttctcagctgtggtctctcttttctgcctgtattatccaggaacctcaaaaaaacattgtagtgattaagaacacaggtctggggtgagaggttcaatttttttgtctttacctgaatgaccttgaacaagttattaccttctctgagccccagttttctcaactacagaattgtgcctaataataaccaaaaggataagcgtgcaaaatgcttagtaccatgtcaggcacacagcagatggtagtgcatggccctgactgcatttaggagcagtgagccgccacctggaaggccttctggatgacatttgccaactgctgctttaagggagaaggtaaaaagctgcaatgacaaaggattatttgggggttctctttggcttttggtctctgaaaaactgagatgtgttcttcaccgggcaatggtcatttagagagtgggtctgggttgtggctgagcagctcttggtcatgtattatttgttattgttacttgtctgccctttatactttcacacacgtgtcctccaaactccttgattgggccattttgcatccttcaccccctgtaactatacacaaatgtgtatctacgaactcactcccatatgcccgttctagagtccacatctagattatcccaccagaccatgccaacacctcctccttgctagccctggagatgattaaggagtataattcccagatcaattagactcttacctgcacggtctgccggtctggaataccactgtacacagaaatctggggcccggtggggcggccacttccaccactgctgctgttgttgcagccactgctgctactggccccgctggtactgctggtggcacaggcactgctagatgtatgtgggactggcagctcattctccatggcctgcagtgtggcgcagtcagggcgctcggatggcagaagggcaggcagatg
